US008354514B2

(12) United States Patent
Siezak et al.

(10) Patent No.: US 8,354,514 B2
(45) Date of Patent: Jan. 15, 2013

(54) MULTIPLEX DETECTION OF AGRICULTURAL PATHOGENS

(75) Inventors: Thomas R. Siezak, Livermore, CA (US); Shea Gardner, Oakland, CA (US); Clinton Torres, Pleasanton, CA (US); Elizabeth Vitalis, Livermore, CA (US); Raymond J. Lenhoff, Livermore, CA (US)

(73) Assignee: Lawrence Livermore National Security, LLC, Livermore, CA (US)

( * ) Notice: Subject to any disclaimer, the term of this patent is extended or adjusted under 35 U.S.C. 154(b) by 180 days.

(21) Appl. No.: 12/842,952

(22) Filed: Jul. 23, 2010

(65) Prior Publication Data

US 2011/0070586 A1 Mar. 24, 2011

Related U.S. Application Data

(63) Continuation-in-part of application No. 11/652,841, filed on Jan. 12, 2007, now Pat. No. 7,794,938.

(51) Int. Cl.
*C07H 21/02* (2006.01)
*C12Q 1/68* (2006.01)

(52) U.S. Cl. ......................... 536/23.1; 435/6.1; 435/975

(58) Field of Classification Search ........................ None
See application file for complete search history.

(56) References Cited

OTHER PUBLICATIONS

Hindson, B.J. et al., "Diagnostic Evaluation of Multiplexed Reverse Transcription-PCR Microsphere Array Assay for Detection of Foot-and-Mouth and Look-Alike Disease Viruses," *Journal of Clinical Microbiology*, Mar. 2008, pp. 1081-1089, vol. 46, No. 3.
Jiang, C. et al., "A Functional Gene Array for Detection of Bacterial Virulence Elements," *PLoS ONE*, May 2008, e2I63, vol. 3, Issue 5, eleven pages.
Lenhoff, R.J. et al., "Multiplexed Molecular Assay for Rapid Exclusion of Foot-And-Mouth Disease," *Journal of Virol. Methods*, 2008, pp. 61-69, vol. 153, No. 1.
Perkins, J. et al. "Multiplexed Detection of Antibodies to Nonstructural Proteins of Foot-And-Mouth Disease Virus," *Analytical Chemistry*, Aug. 2006, pp. 5462-5468, vol. 78, No. 15.
Wilson, W.C. et al., "A Multiplex Real-Time Reverse Transcription Polymerase Chain Reaction Assay for Detection and Differentiation of *Bluetongue* Virus and *Epizootic* Hemorrhagic Disease Virus Serogroups," *Journal of Veterinary Diagnostic Investigation*, Nov. 2009, pp. 760-770, vol. 21, No. 6.
Alegre, M. et al., "Development of a Multiplex Polyymerase Chain Reaction for the Differentiation of Bovine Herpesvirus-1 and -5," *Journal of Veterinary Medicine Series B*, Oct. 2001, pp. 613-621, vol. 48, No. 8.
Callahan, J.D. et al., "Use of a Portable Real-time Reverse Transcriptase-polymerase Chain Reaction Assay for Rapid Detection for Foot-and-Mouth Disease Virus," *Journal of the American Veterinary Medical Association*, Jun. 1, 2002, vol. 220, No. 11, pp. 1636-1642.

Database EMBL [Online] Apr. 8, 1996, "Sequence 2 from Patent US 5462734," XP002515959, Retrieved from EBI Accession No. EMBL:I15275, Database Accession No. I15275 abstract and US 5,462,734 A (Letchworth III, Geoffrey J. [US] et al.) Oct. 31, 1995, 1 page.
Database EMBL [Online] Sep. 6, 2005, "Bovine Herpesvirus Type 1.1 Isolate T3 Glycoprotein C (gC) Gene, Partial Cds.," XP002515958, Retrieved from EBI Accession No. EMBL:DQ173736, Database Accession No. DQ173736 abstract, 2 pages.
Deka, D. et al., "Detection of Bovine Herpesvirus -1 Infection in Breeding Bull Semen by Virus Isolation and Polymerase Chain Reaction," *Revue Scientifique Et Technique, Office International Despizooties/Scientific and Technical Review, International Office of Epizootics*, Dec. 1, 2005, vol. 24, No. 3, Paris, France.
Deregt D. et al., "A Multiplex DNA Suspension Microarray for Simultaneous Detection and Differentiation of Classical Swine Fever Virus and Other Pestiviruses, " *Journal of Virological Methods*, Sep. 1, 2006, pp. 17-23, vol. 136, No. 1-2.
El-Kholy, A., "Molecular and Immunological Detection of Bovine Herpesvirus -1 in Clinical Specimens," *Egyptian Journal of Immunology*, Jan. 1, 2005, pp. 125-136, vol. 12, No. 2.
Harris, C., "Liquid Array Single-Handedly Detects Bounty of BW Agents," *Analytical Chemistry*, May 1, 2003, p. 202.
Heller, A., "Protecting the Nation's Livestock," *S&TR*, May 2006, pp. 11-17.
Hullinger, P. ,"Agricultural Security Domestic Deomonstration and Application Program (AgDDAP)," NIAA Annual Meeting Proceedings, [Online] 2006, Retrieved from the internet on Jul. 31, 2009: <http://animalagriculture.org/Proceedings/2006/Wednesday/AHEM/6%20Pam%20Hullinger%20speaker%20for%20AHEM.pdf>, 22 pages.
Mahlum, C. et al., "Detection of Bovine Viral Diarrhea Virus by TaqMan Reverse Transcription Polymerase Chain Reaction," *Journal of Veterinary Diagnostic Investigation: Official Publications of the American Association of Veterinary Laboratory Diagnosticians, Inc.*, Mar. 2002, pp. 120-125, vol. 14, No. 2.

McBride, M., et al., "Autonomous Detection of Aerosolized *Bacillus anthracis* and *Yersinia petsis," Analytical Chemistry*, Oct. 15, 2003, pp. 5293-5299, vol. 75, No. 20.

McBride, M., et al., "Multiplexed Liquid Arrays for Simultaneous Detection of Simulants of Biological Warfare Agents," *Analytical Chemistry*, Apr. 15, 2003, pp. 1924-1930, vol. 75, No. 8.

McBride, M., et al., "Tailored assays for the Detection of Foreign Disease Pathogens in Animals," *IVD Technology*, May 2005, pp. 49-52, vol. 11, No. 4.

PCT International Search Report and Written Opinion, PCT Application No. US2008/050304, May 14, 2009, 23 pages.

Reid, S.M. et al., "Detection of All Seven Serotypes of Foot-and-Mouth Disease Virus by Real-time, Fluorogenic Reverse Transcription Polymerase Chain Reaction Assay," *Journal of Virological Methods*, Aug. 1, 2002, pp. 67-80, vol. 105, No. 1.

Wilson, W., et al., "A multiplexed PCR-coupled liquid bead array for the simultaneous detection of four biothreat agents," *Molecular and Cellular Probes*, 2005, pp. 137-144, vol. 19.

*Primary Examiner* — Albert Navarro
(74) *Attorney, Agent, or Firm* — Fenwick & West LLP

(57) ABSTRACT

Described are kits and methods useful for detection of agricultural pathogens in a sample. Genomic sequence information from agricultural pathogens was analyzed to identify signature sequences, e.g., polynucleotide sequences useful for confirming the presence or absence of a pathogen in a sample. Primer and probe sets were designed and optimized for use in a PCR based, multiplexed Luminex assay and/or an array assay to successfully identify the presence or absence of pathogens in a sample.

18 Claims, 75 Drawing Sheets

Titration Curves for Endemic Diseases and FMD

- EHV-1
- EHV-3
- EPSV-1
- EPSV-2
- EPSV-4
- ETV-2
- ETV-3
- EVD-1a
- FMDV-1
- FMDV-2

FIG. 69A

MULTIPLEX DETECTION OF AGRICULTURAL PATHOGENS

CROSS REFERENCE TO RELATED APPLICATIONS

This application is a continuation-in-part of U.S. patent application Ser. No. 11/652,841, filed Jan. 12, 2007, the entire disclosure of which is hereby incorporated by reference in its entirety for all purposes.

LENGTHY TABLES

The patent contains a lengthy table section. A copy of the table is available in electronic form from the USPTO web site (http://seqdata.uspto.gov/?pageRequest=docDetail&DocID=US08354514B2). An electronic copy of the table will also be available from the USPTO upon request and payment of the fee set forth in 37 CFR 1.19(b)(3).

STATEMENT REGARDING FEDERALLY SPONSORED RESEARCH OR DEVELOPMENT

The United States Government has rights in this invention pursuant to Contract No. W-7405-ENG-48 between the U.S. Department of Energy and the University of California, for the operation of Lawrence Livermore National Laboratory.

REFERENCE TO TABLES 13-25

This application includes Tables 13-25 submitted electronically as text files named Table__13.txt (Table 13); Tables__14__15__16__17__18__19__20__21.txt (Tables 14-21); Tables__22__23.txt (Tables 22 and 23); and Tables__24__25.txt (Tables 24 and 25), all created on Jul. 19, 2010, with a size of 897 kilobytes; 574 kilobytes; 828 kilobytes; and 47.2 kilobytes, respectively. Table 13 describes probes for detecting FMDV. Table 14 describes probes for detecting PRRS. Table 15 describes probes for detecting SVD. Table 16 describes probes for detecting VESV. Table 17 describes probes for detecting VSV. Table 18 describes probes for detecting OvHV-2. Table 19 describes probes for detecting AHV 1. Table 20 describes probes for detecting BHV 1. Table 21 describes probes for detecting PPDX. Table 22 describes probes for detecting BVD. Table 23 describes probes for detecting BTV. Table 24 describes probes for detecting RPV. Table 25 describes probes for detecting BPSV. Tables 13-25 are herein incorporated by reference in their entirety, for all purposes.

SEQUENCE LISTING

The instant application contains a Sequence Listing which has been submitted via EFS-Web and is hereby incorporated by reference in its entirety. Said ASCII copy, created on Aug. 13, 2010, is named 13252US_CRF_sequencelisting.txt and is 5,347,740 bytes in size.

BACKGROUND OF THE INVENTION

1. Field of the Invention

The invention relates to nucleic acid based kits and methods for determining the presence or absence in a sample of agricultural pathogens.

2. Description of the Related Art

Agriculture is a major sector of the U.S. economy, accounting for more than 13% of the gross domestic product, and employing more than 15% of the U.S. population. Cattle and dairy farmers alone earn between $50 billion and $54 billion a year through meat and milk sales, and roughly $50 billion is raised every year through farm-related exports. Overall livestock sales in 2001 were in excess of $108 billion.

An agro-terrorism attack in the U.S. could cause devastating economic consequences, not only for the affected agribusinesses but also for allied industries and services, disrupting food supplies, trade, and tourism. Moreover, because of the structure of American agribusiness (e.g., highly concentrated herds with frequent movement, suboptimal animal tracking systems, minimal farm security/surveillance), agricultural and food industries are quite vulnerable to such an attack.

The agricultural community currently views an introduction of foot-and-mouth disease (FMD) into the United States as one of their greatest concerns. FMD is a severe, highly communicable viral disease of cattle, other ruminants, and swine, FMD is endemic to many countries in the world, and the virus is easy to obtain. Because FMD does not pose a direct threat to human health, there is no need for elaborate containment procedures or personal protective equipment while handling or preparing the virus. Recent estimates associated with the 2001 FMD outbreak in the United Kingdom place economic losses at greater than $30 billion (U.S.).

The Animal and Plant Health Inspection Service (APHIS), a branch of the U.S. Department of Agriculture (USDA), is charged with protecting the nation's livestock and poultry from the introduction of foreign animal diseases and for coordinating the response to an agricultural disease outbreak. The current system for detecting a foreign animal disease (FAD) such as FMD generally involves the following components: (1) observations by veterinary practitioners and livestock owners, who likely will be the first to suspect and report a FAD case; (2) investigation of suspect cases and submission of samples to USDA/APHIS at the Plum Island Animal Disease Center (PIADC); and (3) diagnostic work-up of tissues at the Plum Island Foreign Animal Diagnostic Disease Laboratory (FADDL). Currently, all testing for FMD is done (by law) at FADDL on Plum Island, which averages about 300 investigations per year. During a major outbreak, demand could rise to 100 investigations per week. The number of required diagnostic tests would far exceed current analysis capacity, and authorities would have to resort to subjective clinical observations to determine if herds must be destroyed.

A critical problem facing the USDA/APHIS and state agriculture departments in combating an outbreak of FMD is the lack of rapid, validated diagnostic assays for detection and identification of FMD. The need for improved diagnostics and surveillance programs to better enable the United Sates to detect and respond to foreign animal diseases (FADs) has been highlighted in several reports (e.g. National Association of State Departments of Agriculture and Research Foundation, the General Accounting Office, and the National Research Council) as well as Homeland Security Presidential Directive-9 (HSPD-9). Additionally, recent outbreaks of FMD in South America and the United Kingdom have heightened concerns about the ability of existing US surveillance systems to rapidly detect a FMD incursion early in the course of an outbreak and then provide the required diagnostic surge capacity needed for an outbreak response and the recovery of disease free status.

At PIADC, laboratory methods currently used to detect FADs include agar gel immunodiffusion assays, enzyme-linked immunosorbent assays (ELISA), serum neutralization assays, virus isolation in tissue culture, direct fluorescent antibody tests, electron microscopy, and animal inoculation. These methods are generally time-consuming and labor-intensive. Rapid polymerase chain reaction (PCR) assays have been used on a limited basis and a few rapid diagnostic tests are currently undergoing validation, but these tests are not yet available. (Callahan, J. D.; Brown, F.; Csorio, F. A.; Sur, J. H.; Kramer, E.; Long, G. W.; Lubroth, J.; Ellis. S. J.; Shoulars, K. S.; Gaffney, K. L.; Rock, D. L.; Nelson, W. M. "Use of a portable real-time reverse transcriptase-polymerase chain reaction assay for rapid detection of foot-and-mouth disease virus." J. Am. Vet. Med. Assn., 220 (11) 1636-1642, Jun. 1, 2002.)

APHIS also lacks rapid, validated diagnostic assays that can differentiate FMD from the many "look-alike" diseases indigenous to the animal agricultural industries (e.g., bovine viral diarrhea virus, contagious ecthyma, bluetongue virus). These domestic diseases induce signs that are similar to FMD: drooling, blisters, or lameness. In the absence of an FMD outbreak, these look-alike diseases can instill a sense of complacency on the part of practitioners and producers, who may have seen similar signs before and thus, believe these signs are the result of common enzootic diseases. When a practitioner notifies a regulatory agency of a suspicious disease, animal samples are sent to PIADC for FAD diagnosis only, not for diagnosis of look-alike domestic diseases. Consequently, without the ability to offer a timely diagnosis for the look-alike diseases that are indigenous, practitioners and producers might disregard important disease signs or develop a disinterest in becoming involved in an FAD investigation of their animals. In an actual FMD outbreak, however, the tendency is to err on the side of over-diagnosis. In the 2001 United Kingdom FMD outbreak, field diagnoses based on clinical observations resulted in a large number of false positive diagnoses (estimates are as high as 70-80%) and unnecessary slaughter of herds (4.3 million animals slaughtered), with only 2023 laboratory-confirmed cases of FMD.

Traditional approaches to DNA signature development started with the hypothesis that a particular gene was vital to the organism's virulence, host range, or other factors that might be considered "unique". Suitable primers and probe were designed for the detection system of choice, with or without computational screening (via BLAST or equivalent) for uniqueness. The resulting assay would then be tested with the available strain(s) and success declared if the targets were detected, but the assay didn't detect whatever near-neighbors were tested. This approach would sometimes yield good results, but failures occurred due to inadequate strain panel coverage and cross reactions with genetic near neighbors and complex environmental samples.

SUMMARY OF THE INVENTION

Disclosed herein are kits and methods for detection of bovine and/or porcine pathogens. The kits and methods can use, e.g., real-time PCR to detect pathogen nucleic acid signature sequences in a sample. The kits and methods can also use, e.g., oligonucleotide probes affixed to a solid support, e.g., an array for detection of pathogen nucleic acids in a sample.

One embodiment of the invention is a kit for determining the presence or absence of at least two porcine pathogens in a sample, the pathogens selected from the group consisting of FMDV, PRRS, SVD, VESV, and VSV, the kit including nucleic acid reagents for detection of at least one nucleic acid signature sequence from each of the at least two pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

In some embodiments, the kit is for determining the presence or absence of FMDV, PRRS, SVD, VESV, and VSV in a sample, the kit including nucleic acid reagents for detection of SEQ ID NO:129, SEQ ID NO:133, SEQ ID NO:137, SEQ ID NO:141, SEQ ID NO:145, SEQ ID NO:149, SEQ ID NO:153, SEQ ID NO:157, SEQ ID NO:161, SEQ ID NO:165, SEQ ID NO:169, SEQ ID NO:173, SEQ ID NO:177, SEQ ID NO:181, SEQ ID NO:185, SEQ ID NO:189, SEQ ID NO: 193, SEQ ID NO: 197, and SEQ ID NO: 201.

In some embodiments, the reagents include a set of oligonucleotides for each signature sequence to be detected, the set including PCR primers and hybridization probes for each signature sequence. In some embodiments, the reagents include at least two sets selected from the group consisting of PCR primers and hybridization probes disclosed in Table 11. In some embodiments, the reagents include all of the PCR primers and hybridization probes disclosed in Table 11. In some embodiments, the reagents include those for detection of control sequences disclosed in Table 11.

In some embodiments, the hybridization probes are affixed to a bead.

Also disclosed herein are methods for determining the presence or absence of at least two of the porcine pathogens FMDV, PRRS, SVD, VESV, and VSV in a sample, the method including the steps of using the kits disclosed herein. In some embodiments, the method includes PCR amplification of each signature sequence. Is some embodiments, the method includes reagents that include all of the PCR primers and hybridization probes disclosed in Table 11.

Also disclosed herein is a kit for determining the presence or absence of at least two bovine pathogens in a sample, the pathogens selected from the group consisting of OvHV-2/AHV1, BHV, PPDX, FMDV, BVD, BTV, VSV, and RPV, the kit including nucleic acid reagents for detection of at least one nucleic acid signature sequence from each of the at least two pathogens, wherein the following nucleic acid signature sequences are detected: for pathogen OvHV-2/AHV1, signature sequences consisting of SEQ ID NO:211 or SEQ ID NO:215 or SEQ ID NO:219; for pathogen BHV, signature sequences consisting of SEQ ID NO:223 or SEQ ID NO:227; for pathogen PPDX, signature sequences consisting of SEQ ID NO:231 or SEQ ID NO:235 or SEQ ID NO:239; for pathogen FMDV, signature sequences consisting of SEQ ID NO:243 or SEQ ID NO:247; for pathogen BVD, signature sequences consisting of SEQ ID NO:251 or SEQ ID NO:255 or SEQ ID NO:259 or SEQ ID NO:263 or SEQ ID NO:267 or SEQ ID NO:271; for pathogen VSV, signature sequences consisting of SEQ ID NO:275 or SEQ ID NO:279 or SEQ ID NO:283 or SEQ ID NO: 287, and for pathogen RPV, signature sequences consisting of SEQ ID NO:291 or SEQ ID NO:295 or SEQ ID NO:299.

In some embodiments, the kit is for determining the presence or absence of OvHV-2/AHV1, BHV, PPDX, FMDV, BVD, BTV, VSV, and RPV in a sample, the kit including nucleic acid reagents for detection of signature sequences SEQ ID NO:211, SEQ ID NO:215, SEQ ID NO:219, SEQ ID NO:223, SEQ ID NO:227, SEQ ID NO:231, SEQ ID NO:235, SEQ ID NO:239, SEQ ID NO:243, SEQ ID NO:247, SEQ ID NO:251, SEQ ID NO:255, SEQ ID NO:259, SEQ ID NO:263, SEQ ID NO:267, SEQ ID NO:271, SEQ ID NO: 275, SEQ ID NO: 279, SEQ ID NO: 283, SEQ ID NO: 287, SEQ ID NO: 291, SEQ ID NO: 295, and SEQ ID NO: 299.

In some embodiments, the reagents include a set of oligonucleotides for each signature sequence to be detected, the set including PCR primers and hybridization probes for each signature sequence. In some embodiments, the reagents include at least two sets selected from the group consisting of the PCR primers and hybridization probes disclosed in Table 12. In some embodiments, the reagents include all of the PCR primers and hybridization probes disclosed in Table 12. In some embodiments, the kit can further include the reagents for detection of control sequences disclosed in Table 12.

In some embodiments, the hybridization probes are affixed to a bead.

Also disclosed herein methods for determining the presence or absence of at least two bovine pathogens selected from the group consisting of OvHV-2/AHV1, BHV, PPDX, FMDV, BVD, BTV, VSV, and RPV in a sample, the method including the steps of using a kit disclosed herein. In some embodiments, the method includes a PCR amplification of each signature sequence.

In some embodiments, the method includes the steps of using a kit wherein the reagents comprise all of the PCR primers and hybridization probes disclosed in Table 12.

Also described herein is a kit for determining the presence or absence of at least two pathogens in a sample, the pathogens selected from the group consisting of FMDV, PRRS, SVD, VESV, VSV, OvHV-2, AHV1, BHV, PPDX, BVD, BTV, and RPV, the kit including oligonucleotide probes for detection of at least one nucleic acid sequence from each of the at least two pathogens, wherein the following oligonucleotide probes are used: for pathogen FMDV, oligonucleotide probes consisting of SEQ ID NO:306-8574; for pathogen PRRS, oligonucleotide probes consisting of SEQ ID NO:8575-9300; for pathogen SVD, oligonucleotide probes consisting of SEQ ID NO:9301-10720; for pathogen VESV, oligonucleotide probes consisting of SEQ ID NO:10721-11518; for pathogen VSV, oligonucleotide probes consisting of SEQ ID NO:11519-12572; for pathogen OvHV-2, oligonucleotide probes consisting of SEQ ID NO:12573-12701; for pathogen AHV1, oligonucleotide probes consisting of SEQ ID NO:12702-12775; for pathogen BHV, oligonucleotide probes consisting of SEQ ID NO:12776-13173; for pathogen PPDX, oligonucleotide probes consisting of SEQ ID NO:13174-14235; for pathogen BVD, oligonucleotide probes consisting of SEQ ID NO:14236-16339; for pathogen BTV, oligonucleotide probes consisting of SEQ ID NO:16340-22724; and for pathogen RPV, oligonucleotide probes consisting of SEQ ID NO:22725-23046.

In an embodiment, the kit is for determining the presence or absence of FMDV, PRRS, SVD, VESV, VSV, OvHV-2, AHV1, BHV, PPDX, BVD, BTV, and RPV in a sample, the kit including oligonucleotide probes consisting of SEQ ID NO:306-23046. In an embodiment, the kit includes reagents for detection of control sequences. In an embodiment, the oligonucleotides are affixed to a solid support, e.g., a glass slide.

Also described herein is a method for determining the presence or absence of at least two pathogens selected from the group consisting of FMDV, PRRS, SVD, VESV, VSV, OvHV-2, AHV1, BHV, PPDX, BVD, BTV, and RPV in a sample, the method including the steps of using a kit for determining the presence or absence of at least two pathogens in a sample, the pathogens selected from the group consisting of FMDV, PRRS, SVD, VESV, VSV, OvHV-2, AHV1, BHV, PPDX, BVD, BTV, and RPV, the kit including oligonucleotides for detection of at least one nucleic acid sequence from each of the at least two pathogens, wherein the following oligonucleotide probes are used: for pathogen FMDV, oligonucleotide probes consisting of SEQ ID NO:306-8574; for pathogen PRRS, oligonucleotide probes consisting of SEQ ID NO:8575-9300; for pathogen SVD, oligonucleotide probes consisting of SEQ ID NO:9301-10720; for pathogen VESV, oligonucleotide probes consisting of SEQ ID NO:10721-11518; for pathogen VSV, oligonucleotides consisting of SEQ ID NO:11519-12572; for pathogen OvHV-2, oligonucleotide probes consisting of SEQ ID NO:12573-12701; for pathogen AHV1, oligonucleotide probes consisting of SEQ ID NO:12702-12775; for pathogen BHV, oligonucleotide probes consisting of SEQ ID NO:12776-13173; for pathogen PPDX, oligonucleotide probes consisting of SEQ ID NO:13174-14235; for pathogen BVD, oligonucleotide probes consisting of SEQ ID NO:14236-16339; for pathogen BTV, oligonucleotide probes consisting of SEQ ID NO:16340-22724; and for pathogen RPV, oligonucleotide probes consisting of SEQ ID NO:22725-23046.

Also described herein is a method for determining the presence or absence of FMDV, PRRS, SVDV, VESV, VSV, OvHV-2, AHV1, BHV, PPDX, BVD, BTV, and RPV in a sample, the method including the steps of using a kit for determining the presence or absence of FMDV, PRRS, SVD, VESV, VSV, OvHV-2, AHV1, BHV, PPDX, BVD, BTV, and RPV in a sample, the kit including oligonucleotide probes consisting of SEQ ID NO:306-23046.

In an embodiment, the method includes hybridization of each oligonucleotide to a sample. In another embodiment of the method, the oligonucleotide probes are affixed to a solid support and the method includes processing the sample contacting the sample with the solid support under conditions to allow hybridization of nucleic acid to the oligonucleotide probes; and determining the presence or absence of the at least two pathogens in the sample.

Also described herein is a kit for determining the presence or absence of at least two pathogens in a sample, the pathogens selected from the group consisting of FMDV, PRRS, SVD, VESV, VSV, OvHV-2, AHV1, BHV, PPDX, BVD, BTV, and RPV, the kit including any combination of the kits described above.

Also described herein is a method for determining the presence or absence of at least two pathogens selected from the group consisting of FMDV, PRRS, SVD, VESV, VSV, OvHV-2, AHV1, BHV, PPDX, BVD, BTV, and RPV in a sample, the method including the steps of using any combination of the kits described above.

Also described herein is a kit for determining the presence or absence of agricultural pathogens FMDV and VSV in a sample, the kit including (a) nucleic acid reagents for detection of at least one nucleic acid signature sequence from each pathogen or (b) oligonucleotide probes for detection of each pathogen or both (a) and (b); and the nucleic acid reagents and oligonucleotide probes are selected from the following: nucleic acid reagents for detection of the following FMDV nucleic acid signature sequences: SEQ ID NO:129 or SEQ ID NO:133 or SEQ ID NO:243 or SEQ ID NO:247; nucleic acid reagents for detection of the following VSV nucleic acid signature sequences: SEQ ID NO:181 or SEQ ID NO:185 or SEQ ID NO:189 or SEQ ID NO: 193 or SEQ ID NO:197 or SEQ ID NO:201 or SEQ ID NO:275 or SEQ ID NO:279 or SEQ ID NO:283 or SEQ ID NO: 287; oligonucleotide probes for FMDV: SEQ ID NO:306-8574; and oligonucleotide probes for VSV: SEQ ID NO:11519-12572.

BRIEF DESCRIPTION OF THE SEVERAL VIEWS OF THE DRAWINGS

These and other features, aspects, and advantages of the present invention will become better understood with regard to the following description, and accompanying drawings, where:

FIG. 3: Near-neighbor testing of BVD_1a and BVD-2 signatures against CSFV isolates in the bovine multiplex assay panel. Other parameters as described in FIG. 2.

FIG. 4: Near-neighbor testing of BVD_1a and BVD-2 signatures against CSFV isolates in the bovine multiplex assay panel. Other parameters as described in FIG. 2.

FIG. 6: The BVD_1a signature in the Version 1.0 detected lower concentrations of BVDV Type 1 strains compared to Type 2, with the exception of BVDV 1b TGAN. The LOD ($TCID_{50}$/mL) represents the lowest sample concentration tested that generated response above threshold. A threshold value of 40 MFI units was used.

FIG. 9: Near-neighbor testing of BTV signatures against BRV and three serotypes of EHDV in the bovine multiplex assay panel. Other parameters as described in FIG. 2.

FIG. 10: Near-neighbor testing of BTV signatures against AHSV in the bovine multiplex assay panel. Other parameters as described in FIG. 2.

FIG. 11: Multiplex screening of four BTV signatures against five US BTV strains (Types 2, 11, 10, 13 and 17) showing response over a wide range of virus concentrations. Samples were serial dilutions of total RNA Trizol extracted from titered virus-infected cell culture. Each point represents the mean response (n=2). Error bars indicate ±1σ of the mean.

FIG. 14: Near-neighbor testing of FMDV signatures against CVB5 and one SVDV isolate in the porcine multiplex assay panel. The response of the porcine multiplex assay to blanks (NTC) is included for reference. Testing was conducted at PIADC. Each sample was analyzed in triplicate. For each signature, the responses (MFI) from triplicate analyses were averaged. Error bars indicate ±1σ of the mean response.

FIG. 15: Near-neighbor testing of FMDV signatures against PTV in the porcine multiplex assay panel. Other parameters as described in FIG. 25.

FIG. 16: Near-neighbor testing of FMDV signatures against PTV and PEV-8 in the porcine multiplex assay panel. Other parameters as described in FIG. 25.

FIG. 17: Near-neighbor testing of FMDV signatures against BEV in the bovine multiplex assay panel. Other parameters as described in FIG. 3.

FIG. 18: Near-neighbor testing of FMDV signatures against CVB5 and SVDV in the bovine multiplex assay panel. FMDV A Arg 2001 is shown as a positive control. Other parameters as described in FIG. 3.

FIG. 19: Near-neighbor testing of FMDV signatures against SVDV in the bovine multiplex assay panel. Other parameters as described in FIG. 3.

FIG. 20: The FMD_TC signature in the Version 1.0 panel detected lower concentrations of virus than FMD_Pir for all seven serotypes. The LOD (pfu/ml) represents the lowest sample concentration tested that generated response above threshold. The threshold values for FMD_PIR and FMD_TC were 42 and 60 MFI units, respectively. Samples were A Argentina 2001, O1 South Korea, C4 Tierra Del Fuego, Asia1, SAT 1/6 SWA, SAT 2 Zim and SAT 3/3 Bech 1Nov05 (PIADC).

FIG. 24: Near-neighbor testing of the MCF signatures in the bovine multiplex assay panel against OHV-2. The response of the MCF signatures to targets (ALHV a US isolate from Minnesota and ALHV WC11, the laboratory reference strain) is shown for reference. BVDV cell culture contamination is evident in both ALHV strains tested. Other parameters as described in FIG. 3.

FIG. 29: Taqman screening of RPV signatures against nine RPV strains (PIADC). Samples were total RNA extracted (Qiagen RNeasy Mini kit) from virus-infected cell culture (Qiagen RNeasy Mini kit). Each reaction was spiked with 200 pg of template. Each point represents the mean (n=3) cycle threshold. If no cycle threshold was reached (i.e. infinite cycle threshold), a cycle threshold of 40 was assigned in this plot.

Figure 31:
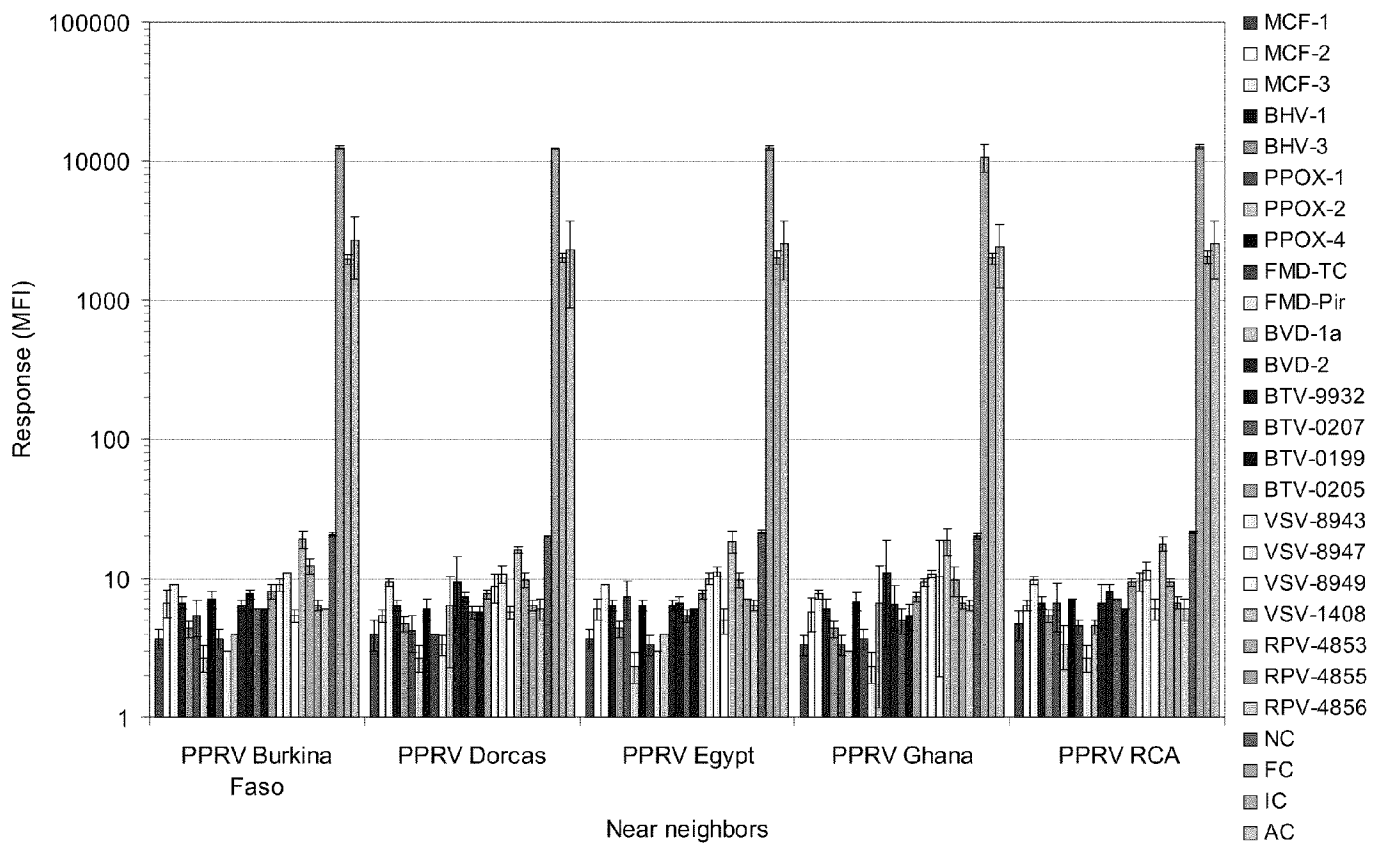

FIG. 31: Near-neighbor testing of the RPV signatures in the bovine multiplex assay panel against PPRV. Other parameters as described in FIG. 3.

FIG. 35: LOD comparison for SVD_1, SVD_2 and SVD_3 signatures in Version 1.0 showing the multi-loci detection of seven SVD isolates. Multiplex titrations were performed using serial dilution of total nucleic acid extracted from titered virus-infected cell culture (PIADC). Threshold values (MFI) were SVD-1=38, SVD-2=28, SVD-3=40.

Figure 39:
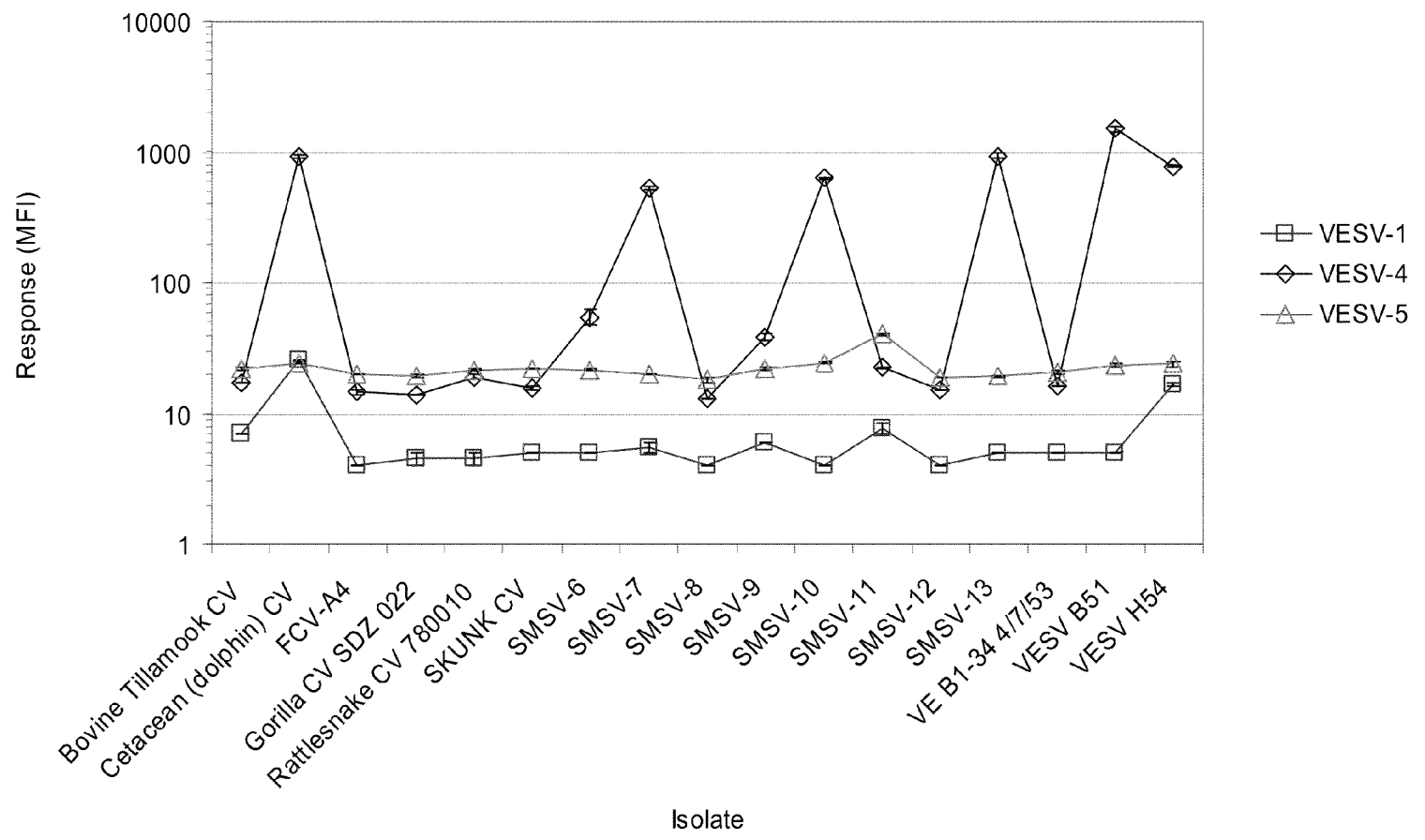

FIG. 39: Multiplex screening data for the three VESV signatures against extracted nucleic acids from caliciviruses.

FIG. 40: LOD comparison showing that VESV_4 signature in Version 1.0 panel afforded superior detection of the 9/11 VESV strains tested. Multiplex titrations were performed using serial dilution of total nucleic acid extracted from titered virus-infected cell culture (PIADC). Threshold values (MFI) were; VESV-1=24, VESV-4=105, VESV-5=56.

Figure 41:
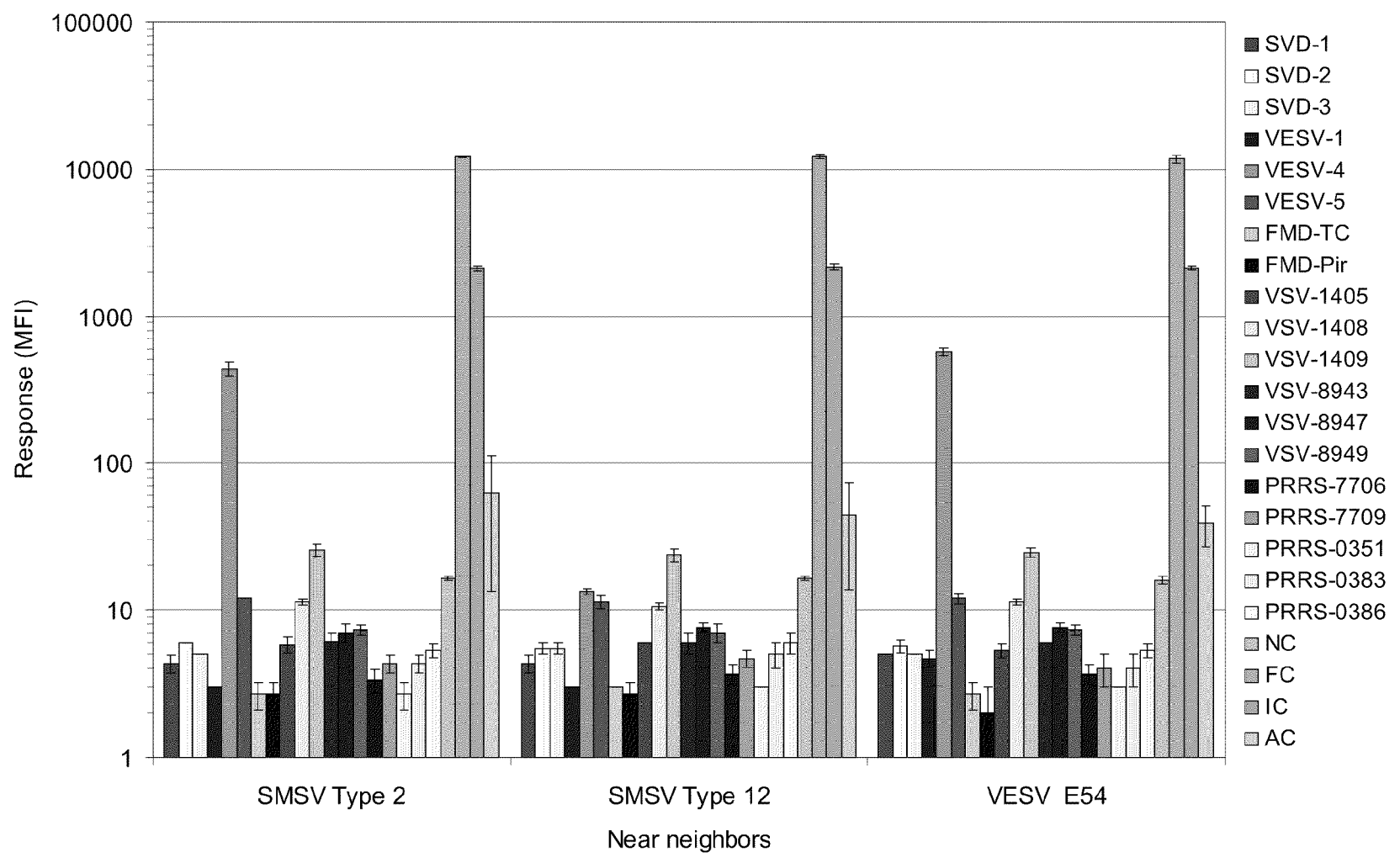

FIG. 41: Screening of VESV signatures against SMSV in the porcine multiplex assay panel. VESV E54 is shown as a positive control. Other parameters as described in FIG. 25.

FIG. 69 illustrates dose response curves for detection of the agricultural pathogens. FIG. 69A: The curves combined herewith represent common viral extraction units (pfu/mL) of representative strains for BHV, BPSV, BTV, BVDV and FMDV.

DETAILED DESCRIPTION OF THE INVENTION

Advantages and Utility

Figure 1:
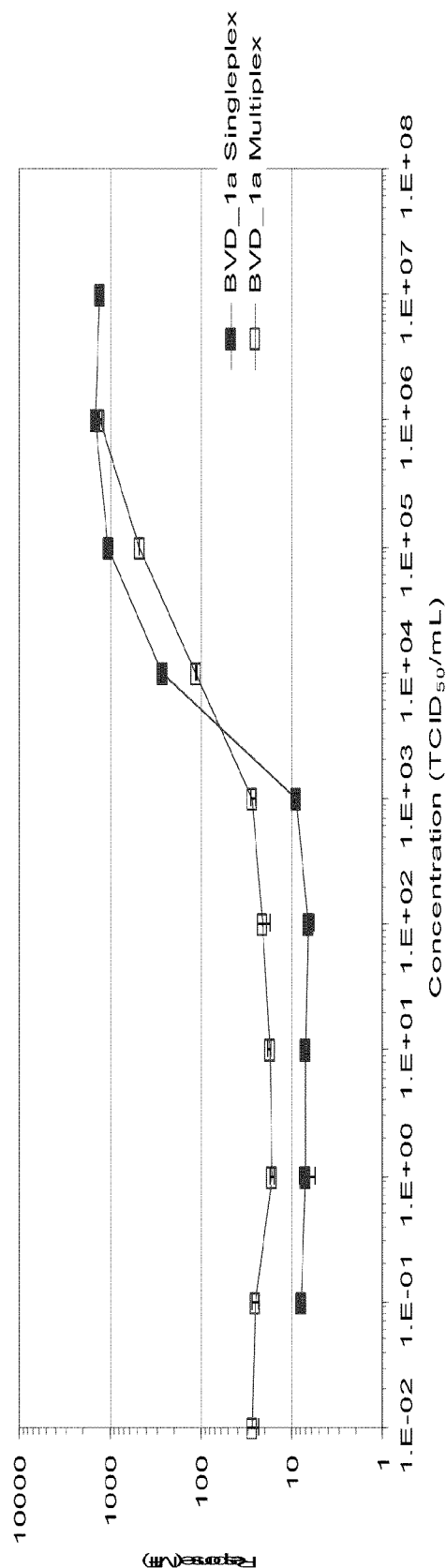
FIG. 1: BVDV signature screening in singleplex and multiplex Version 1.0 formats against a single BVD Type 1 strain (Singer). The sample was serially diluted from a stock sample of total RNA extracted from titered virus-infected cell culture. Each point represents the mean response (n=2). Error bars indicate ±1σ of the mean.

Briefly, and as described in more detail below, disclosed and claimed herein are kits and methods for determining the presence or absence of the agricultural pathogens in a sample. The kits and methods are based on detection of nucleic acid signature sequences using, e.g., multiplexed real time PCR and/or are based on hybridization to oligonucleotide probes, e.g., oligonucleotide probes affixed to a solid support in an array.

In one embodiment, the kits and methods utilize nucleic acid based methods for detection of at least one signature nucleic acid sequence for each of at least two agricultural pathogens of interest. In one embodiment, the presence or absence of all the agricultural pathogens is determined by detection of all disclosed signature sequences. In one embodiment, the signature sequences are amplified using exemplary primers disclosed herein, and the resulting amplicons are detected using hybridization probes (sequences disclosed herein) affixed to beads in a liquid array format; amplicons hybridized to probes affixed to beads are detected using a Luminex instrument.

Multiplexed detection capabilities provide many advantages over conventional detection methodologies. In the event of an outbreak of an agricultural pathogen, the use of multiplexed assay panels can provide rapid, sensitive, specific and cost-effective means of handling high volumes of samples. The assay panels can greatly improve response time and provide rapid results that can help reduce the impact of infectious disease outbreaks. The use of bead-based liquid arrays has proven to be a well adapted and versatile technology that can be custom tailored to rapidly screen for both DNA and RNA in a single tube, while also allowing for multi-loci detection.

The multiplexed assays are liquid arrays on a commercially available flow cytometer, e.g., a Luminex Bio-Plex. The liquid arrays utilize surface-functionalized polystyrene microbeads, embedded with precise ratios of red and infrared fluorescent dyes. There are 100 unique dye ratios, giving rise to 100 unique bead classes. When excited by a 635-nm laser, the two dyes emit light at different wavelengths, 658 and 712 nm and thus each bead class has a unique spectral address. Bead classes can be easily distinguished and therefore they can be combined and up to 100 different analytes can be measured simultaneously within the same sample. Although the liquid arrays have been demonstrated in a variety of applications, including detection of antigen, antibodies, small molecules, and peptides, in this application, beads are functionalized with a nucleic acid probe of approximately 30 oligonucleotides, where the probe sequence is complimentary to the desired target amplicon. Nucleic acid from the pathogen of interest is extracted, and amplified in an off-line PCR reaction. The PCR reaction is conducted using a mixture of all forward and reverse primers for each of the pathogen targets in the multiplexed panel. All forward and reverse primers are contained in the PCR reaction mixture and the amplified product is then introduced to the bead mixture, allowed to hybridize, and subsequently labeled with the fluorescent reporter, strepavidin-phycroerythrin. Each optically encoded and fluorescently-labeled microbead is then interrogated by the Luminex flow cytometer. A red laser excites the dye molecules inside the bead and classifies the bead to its unique bead set, and a green laser quantifies the assay at the bead surface. The flow cytometer is capable of reading several thousand beads each second; analysis can be completed in as little as 15 seconds.

In another embodiment, arrays of oligonucleotide probes that are complementary to target nucleic acid sequences from a pathogen can be used to identify a nucleic acid and detect the presence of the pathogen in a sample. Oligonucleotide arrays typically comprise a plurality of different oligonucleotide probes that are coupled to a surface of a substrate in different known locations.

The approach disclosed herein is more rapid than prior assays. Results on a clinical sample can be provided in about 4 hours, including sample preparation and processing, and data analysis.

Finally, the approach provides improved strain panel coverage and reduces cross-reactions with genetic near neighbors and complex environmental samples.

Definitions

Terms used in the claims and specification are defined as set forth below unless otherwise specified.

"Signature sequence" refers to a nucleic acid sequence specific and unique to an agricultural pathogen such that it can be used for detection of the pathogen in a sample.

"Amplicon" refers to the amplified product of a nucleic acid amplification reaction, e.g., the product of amplification of a signature sequence.

"Pathogen" means any disease-producing agent (especially a virus or bacterium or other microorganism). Pathogens include: Bovine Viral Diarrhea Virus (BVDV or BVD); Bluetongue Virus (BTV); Foot-and-Mouth Disease Virus (FMDV); Malignant Catarrhal Fever (MCF); ovine herpesvirus-2 (OvHV-2); alcelaphine herpesvirus-1 (AHV1); Porcine Respiratory Reproductive Syndrome Virus (PRRSV or PRRS); Rinderpest Virus (RPV); Swine Vesicular Disease Virus (SVDV or SVD); Vesicular Exanthema of Swine Virus (VESV); Vesicular Stomatitis Virus (VSV); Bovine Herpesvirus-1 (BHV-1 or BHV); Parapox (PPDX or PPox); and Bovine Papular Stomatitis Virus (BPSV).

"Agricultural pathogen" means a pathogen capable of infecting animals, e.g., bovine or porcine animals, or plants that are domesticated or propagated through human labor.

"Polynucleotide," when used in singular or plural, generally refers to any polyribonucleotide or polydeoxyribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes DNAs and RNAs that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

"Oligonucleotide" refers to a relatively short polynucleotide, including, without limitation, single-stranded deoxyribonucleotides, single- or double-stranded ribonucleotides, RNA:DNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

"Percent identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent "identity" can exist over a region of the sequence being compared, e.g., over a functional domain, or, alternatively, exist over the full length of the two sequences to be compared. For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., infra). One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information (www.ncbi.nlm.nih.gov/).

It must be noted that, as used in the specification and the appended claims, the singular forms "a," "an" and "the" include plural referents unless the context clearly dictates otherwise.

Kits and Methods of the Invention

Disclosed herein is a rapid, multiplexed nucleic acid panel, e.g., a kit for the detection of agricultural pathogens including Foot and Mouth Disease Virus (FMDV) and its differentiation from a number of other viruses that cause clinical signs in animals that are indistinguishable from FMDV. The diagnostic assay panel detects signature sequences, e.g., unique nucleic acid sequences, for agricultural pathogens, including: Foot and Mouth Disease Virus (FMDV, 2 signatures), Bovine Herpes Virus-1 (BHV-1, 2 signatures), Bovine Papular Stomatitis Virus (BPSV, 3 signatures), Bovine Viral Diarrhea Virus (BVD, 1 signature), Bluetongue Virus (BTV (domestic) 2 signatures), Swine Vesicular Disease Virus (SVD or SVDV, 3 signatures) and Vesicular Exanthema of Swine Virus (VESV, 4 signatures). Signature sequences are presented in Tables 1, 11, and 12.

Accordingly one aspect of the invention is a kit for determining the presence or absence in a sample of at least one pathogen or at least two pathogens selected from the group consisting of FMDV, PRRS, SVDV, VESV, VSV, OvHV-2, AHV1, BHV, PPDX, BVD, BTV, and RPV, said kit having nucleic acid reagents for detection of at least one nucleic acid signature sequence from each pathogen.

In one embodiment, the kit further includes reagents for determining the presence or absence FMDV in a sample. The reagents detect at least one nucleic acid signature sequence for FMDV. Example signature sequences include those disclosed in Example 10, below. In other embodiment, FMDV signature sequences are those previously disclosed, e.g., SEQ ID NO:21 (JAVMA, Vol 220, No. 11, Jun. 1, 2002) and/or SEQ ID NO:25 (Journal of Virological Methods 105, (2002), 67-80).

In one aspect, the kit includes reagents for determining the presence or absence of all agricultural pathogens, e.g., FMDV, PRRS, SVDV, VESV, VSV, OvHV-2, AHV1, BHV, PPDX, BVD, BTV, and RPV in a sample. The kit includes nucleic acid reagents for detection of all signature sequences listed in Tables 1, 11, and 12.

In another aspect, the kits includes reagents for detection of less than all pathogens, e.g., for detection of at least 1, 2, 3, 4, 5, 6, 7, 8, 9, 10, or at least 11 of the pathogens.

In some embodiments, the kits include nucleic acid reagents that are sets of oligonucleotides for each signature sequence to be detected. Each set has PCR primers and hybridization probes for each signature sequence. Exemplary embodiments include the PCR primers and hybridization probes disclosed in Tables 1, 11, and 12. In one embodiment the kit includes each of the PCR primers and hybridization probes listed for the respective pathogen. In other embodiments, the kit includes a subset of the disclosed primer and probes, e.g., at least 1, 2, 3, 4, 5, 6, 7, 8, 9, 10, 11, 12 13, 14, 15, 16, 17, 18, 19, 20, 21, 22, 23, 24, 25, 26, 27, 28, 29, 30, 40, or at least 50 of the primer probe sets disclosed in Tables 1, 11, and 12.

Accordingly, in a preferred embodiment the invention provides the use of all PCR primers and hybridization probes in Tables 1, 11, and 12. Alternatively, the invention provides the use of all PCR primers and hybridization probes for a particular pathogen. In yet another embodiment the invention provides the use of all of the probes in Tables 1, and 11-25. Alternatively, the invention provides the use of all probes in Tables 13-25.

In one aspect the kits include control nucleic acid reagents. Exemplary control nucleic acid reagents are disclosed in Tables 1, 11, and 12.

Also disclosed herein is an oligonucleotide array for the detection of agricultural pathogens. The array includes oligonucleotide probes for agricultural pathogens, including: FMDV, PRRS, SVD, VESV, VSV, OvHV-2, AHV1, BHV, PPDX, BVD, BTV, and RPV. Exemplary probes are disclosed in Tables 13-25.

In one variation of the invention, the kit includes hybridization probes that are affixed to a solid substrate, e.g., a microsphere or a slide, e.g., a glass slide. Exemplary probes are disclosed in Tables 13-25. In one embodiment the kit includes each of the probes listed for the all of the respective pathogens in Tables 13-25. In other embodiments, the kit includes a subset of the disclosed probes, e.g., at least 1, 2, 3, 4, 5, 6, 7, 8, 9, 10, 11, 12 13, 14, 15, 16, 17, 18, 19, 20, 21, 22, 23, 24, 25, 26, 27, 28, 29, 30, 40, 50, 60, 70, 80, 90, 100, 200, 300, 400, 500, 600, 700, 800, 900 or at least 1000 of the probes disclosed in Tables 13-25.

Also disclosed are methods using the kits disclosed herein. In some embodiments, the method includes a PCR based amplification step. In some embodiments, the method includes an array hybridization step.

Samples

The invention provides kits and methods for detection of agricultural pathogens in a sample. As will be appreciated by those in the art, the sample may comprise any number of things, including, but not limited to, bodily fluids (including, but not limited to, blood, nasopharyngeal secretions, urine, serum, lymph, saliva, milk, anal and vaginal secretions, and semen) of virtually any organism, with mammalian samples, including livestock, (e.g. sheep, cow, horse, pig, goat, lama, emu, ostrich or donkey), poultry (e.g. chicken, turkey, goose, duck, or game bird), fish (e.g. salmon or sturgeon), laboratory animal (e.g. rabbit, guinea pig, rat or mouse) companion animal (e.g. dog or cat) or a wild animal in captive or free state, being preferred, environmental samples (including, but not limited to, air, agricultural, water and soil samples); biological warfare agent samples; research samples; purified samples, such as purified genomic DNA, RNA, proteins, etc.; and raw samples (bacteria, virus, genomic DNA, etc.). As will be appreciated by those in the art, any experimental manipulation can have been performed on the sample before analysis.

In one embodiment, the sample type for diagnosis of vesicular diseases is vesicular epithelium/fluid. The vesicular diseases include FMD, VESV, SVD, and BVD (if oral lesions are present), parapox (BPSV), and BHV-1 (IBR). In other embodiments, the methods of the invention are performed using sample types including oral/nasal swabs and probang samples, for detection of, e.g., FMD, BVD, and BVH. For detection of BTV (vector-borne), the sample can be is EDTA whole blood. For BVD where no lesions are present, sample types include, e.g., tonsils (scrapings), lymph nodes and spleen.

Additional tissue samples include brain (brain stem, cerebellum, brain stem), spinal cord tissues or fluids, bone marrow, and ear notches.

The sample is generally processed before use. In some embodiments, processing entails simple isolation from the subject. If required, nucleic acid from the sample is isolated using known techniques. For example, the sample may be treated to lyse the cells, using known lysis buffers, sonication, electroporation, etc., with purification occurring as needed, as will be appreciated by those in the art. In addition, the reactions outlined herein may be accomplished in a variety of ways, as will be appreciated by those in the art. Components of the reaction may be added simultaneously, or sequentially, in any order, with preferred embodiments outlined below. In addition, the reaction may include a variety of other reagents that may be included in the assays. These include reagents like salts, buffers, neutral proteins, e.g. albumin, detergents, etc., which may be used to facilitate optimal hybridization and detection, and/or reduce non-specific or background interactions. Also reagents that otherwise improve the efficiency of the assay, such as protease inhibitors, nuclease inhibitors, anti-microbial agents, etc., may be used, depending on the sample preparation methods and purity of the target.

In an embodiment, nucleic acid from the sample is isolated using Trizol reagent. After Trizol reagent treatment, RNA from cells can be precipitated with isopropanol and washed with 70% ethanol. The RNA pellet can be dried and reconstituted with RNase free water. 1 µg of RNA can be transcribed into double-strand cDNA with random hexamers using Superscript™ double-stranded cDNA synthesis kit from Invitrogen (Carlsbad, Calif.). The DNA or cDNA can be labeled using Cy-3 labeled nonamers from Trilink Biotechnologies for later detection.

Signature Sequences

Using the kits and methods of the invention, the presence or absence of an agricultural pathogen in a sample is determined using reagents for detection of a signature nucleic acid sequence. The term "signature sequence" or "signature nucleic acid" or grammatical equivalents herein means a nucleic acid sequence on a single strand of nucleic acid or its complement. The signature sequence may be a portion of a gene, a regulatory sequence, genomic DNA, cDNA, RNA including mRNA and rRNA, and the like.

The signature sequences detected are presented in Tables 1, 11, and 12.

As will be appreciated by those in the art, the signature sequence can take many forms. For example, it may be contained within a larger nucleic acid sequence, i.e. all or part of a gene or mRNA, a restriction fragment of a plasmid or genomic DNA, among others.

Amplification Methods

In one embodiment and as describe more fully herein, a signature sequence from a sample is amplified to produce a secondary target, e.g. an amplicon that is detected, as outlined herein.

Amplification involves the amplification (replication) of the signature sequence to be detected, such that the number of copies of the signature sequence is increased. Suitable amplification techniques include, but are not limited to, the polymerase chain reaction (PCR), strand displacement amplification (SDA), transcription mediated amplification (TMA) and nucleic acid sequence based amplification (NASBA).

In one embodiment, the amplification technique is PCR. The polymerase chain reaction (PCR) is widely used and described, and involves the use of primer extension combined with thermal cycling to amplify a target sequence; see U.S. Pat. Nos. 4,683,195 and 4,683,202, and PCR Essential Data, J. W. Wiley & sons, Ed. C. R. Newton, 1995, all of which are incorporated by reference. In addition, there are a number of variations of PCR which also find use in the invention, including "quantitative competitive PCR" or "QC-PCR", "arbitrarily primed PCR" or "AP-PCR", "immuno-PCR", "Alu-PCR", "PCR single strand conformational polymorphism" or "PCR-SSCP", "reverse transcriptase PCR" or "RT-PCR", "biotin capture PCR", "vectorette PCR", "panhandle PCR", and "PCR select cDNA subtraction", "allele-specific PCR", among others.

In another embodiment, the amplification technique is SDA. Strand displacement amplification (SDA) is generally described in Walker et al., in Molecular Methods for Virus Detection, Academic Press, Inc., 1995, and U.S. Pat. Nos. 5,455,166 and 5,130,238, all of which are hereby expressly incorporated by reference in their entirety.

In another embodiment, the amplification technique is nucleic acid sequence based amplification (NASBA). NASBA is generally described in U.S. Pat. No. 5,409,818; Sooknanan et al., Nucleic Acid Sequence-Based Amplification, Ch. 12 (pp. 261-285) of Molecular Methods for Virus Detection, Academic Press, 1995; and "Profiting from Gene-based Diagnostics", CTB International Publishing Inc., N.J., 1996, all of which are incorporated by reference. NASBA is very similar to both TMA and QBR. Transcription mediated amplification (TMA) is generally described in U.S. Pat. Nos. 5,399,491, 5,888,779, 5,705,365, 5,710,029, all of which are incorporated by reference. The main difference between NASBA and TMA is that NASBA utilizes the addition of RNAse H to effect RNA degradation, and TMA relies on inherent RNAse H activity of the reverse transcriptase.

In another embodiment, the amplification technique is signal amplification. Signal amplification involves the use of limited number of target molecules as templates to either generate multiple signaling probes or allow the use of multiple signaling probes. Signal amplification strategies include LCR, CPT, QβR, invasive cleavage technology, and the use of amplification probes in sandwich assays.

In another embodiment, single base extension (SBE; sometimes referred to as "minisequencing") is used for amplification. Briefly, SBE is a technique that utilizes an extension primer that hybridizes to the target nucleic acid. A polymerase (generally a DNA polymerase) is used to extend the 3' end of the primer with a nucleotide analog labeled a detection label as described herein. Based on the fidelity of the enzyme, a nucleotide is only incorporated into the extension primer if it is complementary to the adjacent base in the target strand. Generally, the nucleotide is derivatized such that no further extensions can occur, so only a single nucleotide is added. However, for amplification reactions, this may not be necessary. Once the labeled nucleotide is added, detection of the label proceeds as outlined herein. See generally Sylvanen et al., Genomics 8:684-692 (1990); U.S. Pat. Nos. 5,846,710 and 5,888,819; Pastinen et al., Genomics Res. 7(6):606-614 (1997); all of which are expressly incorporated herein by reference.

In another embodiment, the signal amplification technique is OLA (oligonucleotide ligation amplification). OLA, which is referred to as the ligation chain reaction (LCR) when two-stranded substrates are used, involves the ligation of two smaller probes into a single long probe, using the target sequence as the template. In LCR, the ligated probe product becomes the predominant template as the reaction progresses. The method can be run in two different ways; in a first embodiment, only one strand of a target sequence is used as a template for ligation; alternatively, both strands may be used. See generally U.S. Pat. Nos. 5,185,243, 5,679,524 and 5,573,907; EP 0 320 308 B1; EP 0 336 731 B1; EP 0 439 182 B1; WO 90/01069; WO 89/12696; WO 97/31256; and WO 89/09835, and U.S. Ser. Nos. 60/078,102 and 60/073,011, all of which are incorporated by reference.

In another embodiment the signal amplification technique is RCA. Rolling-circle amplification is generally described in Baner et al. (1998) Nuc. Acids Res. 26:5073-5078; Barany, F. (1991) Proc. Natl. Acad. Sci. USA 88:189-193; and Lizardi et al. (1998) Nat. Genet. 19:225-232, all of which are incorporated by reference in their entirety.

A second alternative approach involves OLA followed by RCA. In this embodiment, an immobilized primer is contacted with a target nucleic acid. Complementary sequences will hybridize with each other resulting in an immobilized duplex. A second primer is contacted with the target nucleic acid. The second primer hybridizes to the target nucleic acid adjacent to the first primer. An OLA assay is performed as described above. Ligation only occurs if the primers are complementary to the target nucleic acid. When a mismatch occurs, particularly at one of the nucleotides to be ligated, ligation will not occur. Following ligation of the oligonucleotides, the ligated, immobilized, oligonucleotide is then hybridized with an RCA probe. This is a circular probe that is designed to specifically hybridize with the ligated oligonucleotide and will only hybridize with an oligonucleotide that has undergone ligation. RCA is then performed as is outlined in more detail below.

Nucleic Acid Reagents: Primers and Probes

The kits and method disclosed herein use nucleic acid reagents, e.g., oligonucleotides, e.g., amplification primers and hybridization probes, for detection of the signature sequences. Exemplary primers and probes are disclosed herein, e.g., in Tables 1 and 11-25, and in one embodiment, the claimed kits and methods include the primers and probes disclosed in Tables 1 and/or 11-25. The invention also include kits and methods using variant versions of the primers and probes disclosed herein, e.g., oligonucleotides that are shorter or longer or have at least 95%, 96%, 97%, 98%, or at least 99% sequence identity, as long as the oligonucleotide accomplishes that same function, e.g., functions in the assay for the detection of the signature sequences.

In addition, one of skill can readily design additional primers and hybridization probes that can function as nucleic acid reagents for the detection of signature sequences. Generally the nucleic acid reagents include signature sequence, or complementary sequence, sufficient to confer specific amplification or hybridization to the target nucleic acid, e.g., agricultural pathogen nucleic acid.

The length of a nucleic acid reagent, e.g., a primer or hybridization probe, will vary depending on the application. In general, the total length can be from about 8 to 80 nucleobases in length. The primers and hybridization probes used in accordance with this invention preferably comprise from about 8 to about 80 nucleobases (i.e. from about 8 to about 80 linked nucleosides). One of ordinary skill in the art will appreciate that the invention embodies oligonucleotides of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleobases in length.

Nucleic Acid Reagents: Adapters

In a preferred embodiment, a hybridization probe further comprises an adapter sequence. Adapters facilitate immobilization of probes to solid supports. That is, arrays (either solid phase or liquid phase arrays) are generated that contain capture probes that are not target specific, but rather specific to individual (preferably) artificial adapter sequences. The adapter sequences of the probes are preferably from 15-25 nucleotides in length, with 20 being especially preferred. The target specific portion of the probe is preferably from 15-50 nucleotides in length.

Thus, an adapter sequence is a nucleic acid that is generally not identical to or complementary to the signature sequence, i.e. is exogenous, but is added or attached to a hybridization probe. It should be noted that in this context, the signature sequence can include the primary signature sequence, or can be a derivative target such as a reactant or product of the reactions outlined herein; thus for example, the target sequence can be a PCR product, a first ligation probe or a ligated probe in an OLA reaction, etc.

The terms "barcodes", "adapters", "addresses", "tags" and "zip codes" have all been used to describe artificial sequences that are added to amplicons to allow separation of nucleic acid fragment pools. One preferred form of adapters is hybridization adapters. In this embodiment adapters are chosen so as to allow hybridization to the complementary capture probes on a surface of an array. In general, sets of adapters and the corresponding capture probes on arrays are developed to minimize cross-hybridization with both each other and other components of the reaction mixtures, including the signature sequences and sequences on the larger nucleic acid sequences outside of the target sequences (e.g. to sequences within genomic nucleic acid of the agricultural pathogen).

As will be appreciated by those in the art, the attachment, or joining, of the adapter sequence to the target sequence can be done in a variety of ways. In a preferred embodiment, the adapter sequences are added to the primers of the reaction (extension primers, amplification primers, readout probes, genotyping primers, Rolling Circle primers, etc.) during the chemical synthesis of the primers. The adapter then gets added to the reaction product during the reaction; for example, the primer gets extended using a polymerase to form the new target sequence that now contains an adapter sequence. Alternatively, the adapter sequences can be added enzymatically. Furthermore, the adapter can be attached to the target after synthesis; this post-synthesis attachment can be either covalent or non-covalent. In a preferred embodiment the adapter is added to the target sequence or associated with a particular allele during an enzymatic step.

In addition, as will be appreciated by those in the art, the adapter can be attached either on the 3' or 5' ends, or in an internal position, depending on the configuration of the system.

In one embodiment the use of adapter sequences allow the creation of more "universal" surfaces; that is, one standard array, comprising a finite set of capture probes can be made and used in any application. The end-user can customize the array by designing different soluble target probes, which, as will be appreciated by those in the art, is generally simpler and less costly. In a preferred embodiment, an array of different and usually artificial capture probes are made; that is, the capture probes do not have complementarity to known target sequences. The adapter sequences can then be incorporated in the target probes.

As will be appreciated by those in the art, the length of the adapter sequences will vary, depending on the desired "strength" of binding and the number of different adapters desired. In a preferred embodiment, adapter sequences range from about 5 to about 25 basepairs in length, with 20 being especially preferred.

In a preferred embodiment, the adapter sequence uniquely positions the target analyte, e.g. agricultural organism nucleic acid, to which the target probe binds. That is, while the adapter sequence need not bind itself to the target analyte, the system allows for identification of the target analyte by detecting the presence of the adapter. Accordingly, following a binding or hybridization assay and washing, the probes including the adapters are amplified. Detection of the adapter then serves as an indication of the presence of the target analyte.

Detection of Nucleic Acids

As described herein, the kits and method described herein utilize detection of the signature sequences by detection of amplicons. In general, either direct or indirect detection of amplicon can be performed. Direct detection generally involves the incorporation of a label into the amplicon via, e.g., a labeled primer. Indirect detection involves incorporation of a label into, e.g., a hybridization probe.

For direct detection, the label(s) may be incorporated in four ways: (1) the primers comprise the label(s), for example attached to the base, a ribose, a phosphate, or to analogous structures in a nucleic acid analog; (2) modified nucleosides that are modified at either the base or the ribose (or to analogous structures in a nucleic acid analog) with the label(s); these label-modified nucleosides are then converted to the triphosphate form and are incorporated into the newly synthesized strand by a polymerase; (3) modified nucleotides are used that comprise a functional group that can be used to add a detectable label; or (4) modified primers are used that comprise a functional group that can be used to add a detectable label. Any of these methods result in a newly synthesized strand that comprises labels that can be directly detected as outlined below.

For indirect detection, the label is incorporated into the hybridization probe using methods well known to one of skill in the art. For example, the label can be incorporated by attaching the label to a base, ribose, phosphate, or to analogous structures in a nucleic acid analog, or by synthesizing the hybridization probe using a modified nucleoside.

Thus, a modified strands of the amplicon or the hybridization probe can include a detection label. By "detection label" or "detectable label" herein is meant a moiety that allows detection. This may be a primary label or a secondary label.

In one embodiment, the detection label is a primary label. A primary label is one that can be directly detected, such as a fluorophore. In general, labels fall into three classes: a) isotopic labels, which may be radioactive or heavy isotopes; b) magnetic, electrical, thermal labels; and c) colored or luminescent dyes. Labels can also include enzymes (horseradish peroxidase, etc.) and magnetic particles. Preferred labels include chromophores or phosphors but are preferably fluorescent dyes. Suitable dyes for use in the invention include, but are not limited to, fluorescent lanthanide complexes, including those of Europium and Terbium, fluorescein, rhodamine, tetramethylrhodamine, eosin, erythrosin, coumarin, methyl-coumarins, pyrene, Malacite green, stilbene, Lucifer Yellow, Cascade Blue™, Texas Red, alexa dyes, phycoerythrin, bodipy, and others described in the 6th Edition of the Molecular Probes Handbook by Richard P. Haugland, hereby expressly incorporated by reference.

In another embodiment, a secondary detectable label is used. Accordingly, detection labels may be primary labels (i.e. directly detectable) or secondary labels (indirectly detectable). A secondary label is one that is indirectly detected; for example, a secondary label can bind or react with a primary label for detection, or may allow the separation of the compound comprising the secondary label from unlabeled materials, etc. Secondary labels find particular use in systems requiring separation of labeled and unlabeled probes, such as SBE reactions. Secondary labels include, but are not limited to, one of a binding partner pair; chemically modifiable moieties; nuclease inhibitors, etc.

In another embodiment, the secondary label is a binding partner pair. For example, the label may be a hapten or antigen, which will bind its binding partner. In a preferred embodiment, the binding partner can be attached to a solid support to allow separation of extended and non-extended primers. For example, suitable binding partner pairs include, but are not limited to: antigens (such as proteins (including peptides)) and antibodies (including fragments thereof (FAbs, etc.)); proteins and small molecules, including biotin/streptavidin; enzymes and substrates or inhibitors; other protein-protein interacting pairs; receptor-ligands; and carbohydrates and their binding partners. Nucleic acid-nucleic acid binding proteins pairs are also useful. In general, the smallest of the pair is attached to the NTP for incorporation into the extension primer.

In another embodiment, the binding partner pair comprises biotin or imino-biotin and streptavidin Imino-biotin is particularly preferred as imino-biotin disassociates from streptavidin in pH 4.0 buffer while biotin requires harsh denaturants (e.g. 6 M guanidinium HCl, pH 1.5 or 90% formamide at 95° C.).

In another embodiment, the binding partner pair comprises a primary detection label (for example, attached to the NTP and therefore to the extended primer) and an antibody that will specifically bind to the primary detection label. By "specifically bind" herein is meant that the partners bind with specificity sufficient to differentiate between the pair and other components or contaminants of the system. The binding should be sufficient to remain bound under the conditions of the assay, including wash steps to remove non-specific binding. In some embodiments, the dissociation constants of the pair will be less than about 10-4-10-6 M-1, with less than about 10-5 to 10-9 M-1 being preferred and less than about 10-7-10-9 M-1 being particularly preferred.

Formats

Detection of the amplified products described above preferably employs arrays, as described herein. In one embodiment, the arrays comprise hybridization probes affixed to a solid support.

By "substrate" or "solid support" or other grammatical equivalents herein is meant any material to which a hybridization probe can be immobilized. Possible substrates include, but are not limited to, glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses, plastics, and a variety of other polymers. In general, the substrates allow optical detection and do not themselves appreciably fluoresce.

Generally the substrate is flat (planar), although as will be appreciated by those in the art, other configurations of substrates may be used as well.

In a preferred embodiment the array is a liquid array. In this embodiment, a species of hybridization probes is immobilized to a first set of microspheres. Likewise, a second species of hybridization probes is immobilized to a second set of microspheres. Similarly additional species of hybridization probes are attached to discrete populations of microspheres. There is no upward limit to the number of populations of microspheres or capture probes when populations are analyzed individually.

When multiple sets of microspheres are mixed and analyzed the number of sets is limited only by the number of encoding moieties applied to the microspheres. That is, microspheres are encoded so that the identity of each set of microspheres can be determined. Encoding moieties can be any distinguishable characteristic, e.g. size, shape, texture etc., of the microsphere. In preferred embodiments, encoding moieties are attributes that are not inherent in the bead or microsphere itself. Rather, the encoding moiety is a feature that is added to a bead. Preferred encoding moieties include, but are not limited to nucleic acids, proteins, and detectable labels or fluors. In addition, materials such as nanocrystals can be used as encoding moieties.

Also, in some embodiments, a plurality of different types of encoding moieties can be used to develop numerous different codes.

In a preferred embodiment, the beads and encoding system are those used in the Luminex flow cytometer. This system is described in more detail in U.S. Pat. No. 5,981,180, which is expressly incorporated herein by reference.

Briefly, the flow cytometer comprises a Luminex LX100 Flow Cytometer instrument with a sheath source and a waste reservoir. The hybridized bead array is introduced into the Luminex Flow Cytometer instrument where the beads are interrogated by two lasers, a red laser for the internal discriminator and a green laser for the external discriminator dyes respectively.

With the liquid arrays it is possible to simultaneously multiplex 100 or more different organisms or targets. The discrimination of the polystyrene Luminex bead array is dependent on the precise ratio of two internal discriminator dyes, a red and an infrared dye. The signal intensity on the surface of the bead is dependent on the concentration of the analyte in solution, in our case the amplified DNA of a suspect agent or an antigen or a toxin, whichever the case may be.

A 100-plex Luminex liquid array is generated by intercalating varying ratios of red and orange infrared dyes into polystyrene latex microspheres or beads. The process of producing varying ratios of red and orange infrared dyes in the beads is accomplished by increasing the amount of red dye and increasing the amount of orange dye. This gives each optically encoded bead a unique spectral address.

The beads are coated with capture probes complementary to adapter sequences, e.g., hybridization probes, as described herein. Each bead has an attachment site specific for a unique bioagent, e.g., hybridization probe.

The beads are analyzed in the flow cytometer, one at a time. A red laser classifies the bead, identifying the bead type. Subsequently a green laser quantifies the assay on the bead surface—only those beads with a complete sandwich will produce a fluoresce in the green, and the signal is a function of label concentration, which is indicative of the amount of target, e.g., amplicon.

Solid Support Arrays

In another aspect, arrays of oligonucleotide probes that are complementary to target nucleic acid sequences from a pathogen can be used to identify a nucleic acid and detect the presence of the pathogen in a sample. Oligonucleotide arrays typically comprise a plurality of different oligonucleotide probes that are coupled to a surface of a substrate in different known locations. Oligonucleotide arrays have been generally described in the art, for example, U.S. Pat. No. 5,143,854 and PCT patent publication Nos. WO 90/15070 and 92/10092. These arrays can generally be produced using mechanical synthesis methods or light directed synthesis methods that incorporate a combination of photolithographic methods and solid phase oligonucleotide synthesis methods. See Fodor et al., Science 251:767-777 (1991), Pirrung et al., U.S. Pat. No. 5,143,854 (see also PCT Application No. WO 90/15070) and Fodor et al., PCT Publication No. WO 92/10092 and U.S. Pat. No. 5,424,186, the entire teachings are incorporated by reference herein. Techniques for the synthesis of these arrays using mechanical synthesis methods are described in, e.g., U.S. Pat. No. 5,384,261; the entire teachings are incorporated by reference herein. In another example, linear arrays can be utilized.

Once an oligonucleotide array is prepared, a sample potentially having the nucleic acid of interest is hybridized with the array and scanned. Hybridization and scanning are generally carried out by methods described herein and also in, e.g., published PCT Application Nos. WO 92/10092 and WO 95/11995, and U.S. Pat. No. 5,424,186, the entire teachings are incorporated by reference herein. In some aspects, a target nucleic acid sequence is not amplified prior to application to an array. In some aspects, a target nucleic acid sequence is amplified prior to application to an array. In brief, a target nucleic acid sequence is amplified by well-known amplification techniques, e.g., PCR. Typically, this involves the use of primer sequences that are complementary to the two strands of the target sequence both upstream and downstream from the polymorphism. Asymmetric PCR techniques may also be used. Amplified target, generally incorporating a label, is then hybridized with the array under appropriate conditions. Upon completion of hybridization and washing of the array, the array is scanned to determine the position on the array to which the target sequence hybridizes. The hybridization data obtained from the scan is typically in the form of fluorescence intensities as a function of location on the array.

Although primarily described in terms of a single detection block, e.g., for detecting a single nucleic acid of interest, arrays can include multiple detection blocks, and thus be capable of analyzing multiple, specific nucleic acids, e.g., a single array can be used for detection of multiple nucleic acids from multiple pathogens. In alternative aspects, it will generally be understood that detection blocks may be grouped within a single array or in multiple, separate arrays so that varying, optimal conditions may be used during the hybridization of the target to the array. For example, it may often be desirable to provide for the detection of those polymorphisms that fall within G-C rich stretches of a genomic sequence, separately from those falling in A-T rich segments. This allows for the separate optimization of hybridization conditions for each situation.

Additional uses of oligonucleotide arrays for nucleic acid detection can be found, for example, in U.S. Pat. Nos. 5,858,659 and 5,837,832, the entire teachings of which are incorporated by reference herein.

In some aspects, array detection is used in tandem with RT-PCR for orthogonal detection of a nucleic acid or set of nucleic acids. For example, RT-PCR is used to obtain a rapid detection of target nucleic acids and then an array is used to obtain more detailed information about the sample from which the target nucleic acids were obtained.

Multi-platform Testing

Described herein are kits and methods for detection of agricultural pathogens using 2 assay platforms (multiplexed PCR and oligonucleotide arrays) that can be used independently from or in conjunction with each other. The two detection platforms are distinct and complementary. Jointly, they offer alternatives for users as well as orthogonal detection.

Real-time PCR has been the gold standard for detection, and the machines necessary are readily available in most labs including field labs. It is known to be rapid and sensitive.

Microarray technology enables deep detection and in general, a very large number of loci may be detected. This gives much greater assurance that the target organism will be detected. Since microarrays can accommodate thousands of probe sequences, the probes we provided may be added to existing microarrays to increase the range of pathogens detected.

In some embodiments, the two detection platforms are used in tandem for orthogonal detection. For example, a rapid answer can be first obtained using Real-time PCR, followed by more detailed information about the sample from microarray analysis.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences,* 18th Edition (Easton, Pa.: Mack Publishing Company, 1990); Carey and Sundberg *Advanced Organic Chemistry* $3^{rd}$ *Ed.* (Plenum Press) Vols A and B (1992); "Oligonucleotide Synthesis" (M. J. Gait, ed., 1984); "Animal Cell Culture" (R. I. Freshney, ed., 1987); "Handbook of Experimental Immunology", 4th edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

Summary of Assay Development

Figure 65:
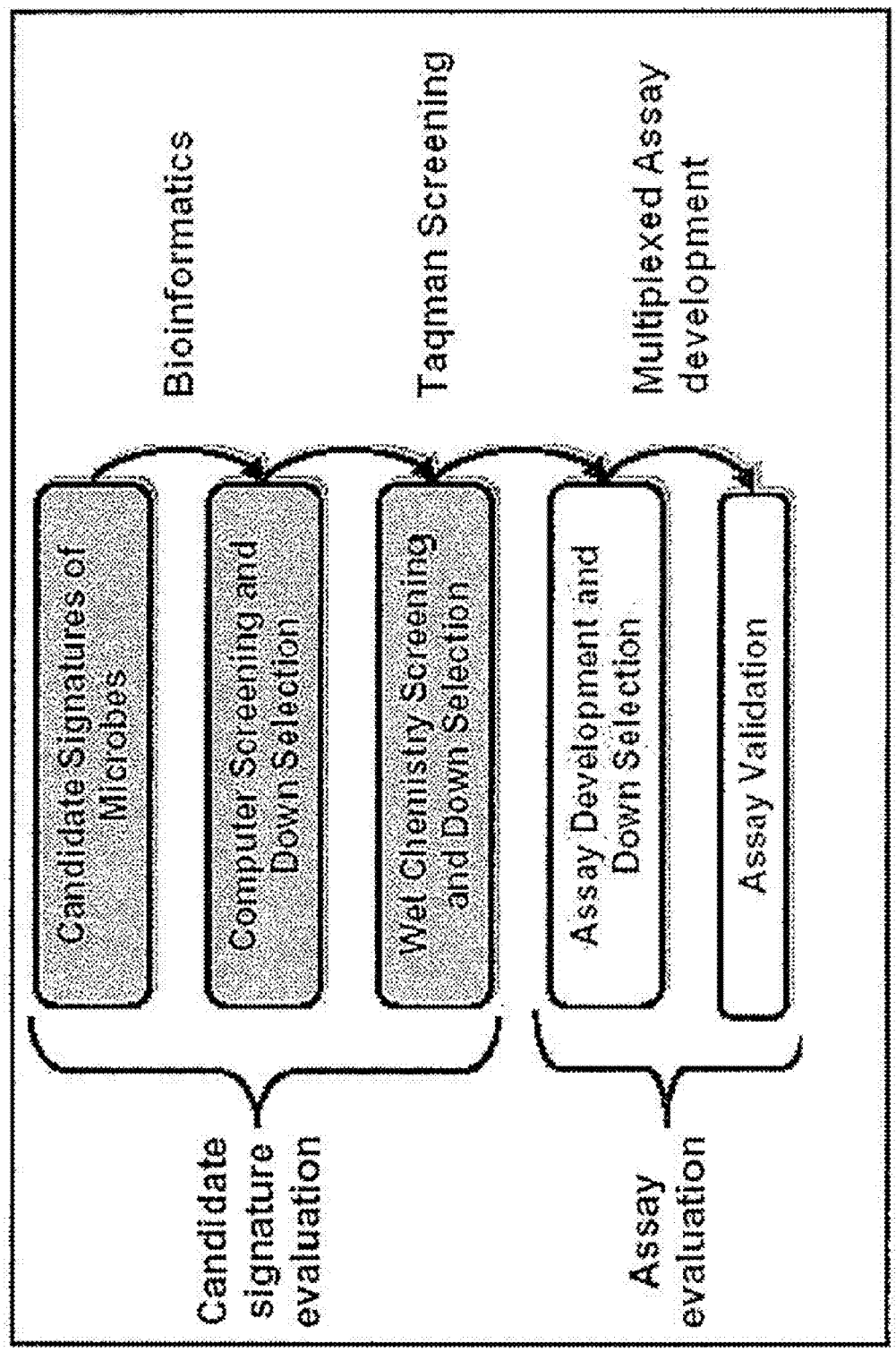

The Bioassays and Signatures Program (BSP) at Lawrence Livermore National Laboratory (LLNL) have constructed a robust technical architecture for the rapid development of highest-quality nucleic acid assays, tailored to end-user specifications. A summary of this process is shown in FIG. 65.

The pipeline process begins with an analysis of all available genomic sequence information, which forms the basis for the development of signatures. A signature is a region or set of regions on a chromosome that is unique to that organism. Candidate signatures can be selected based on performance criteria for specific detection technologies. Our nucleic acid assays employ PCR with primer pairs to generate the signature fragment(s) of interest. Once candidate signatures have been identified, they are subjected to a computational screening and down-selection process. This "in silico" screening method tests the candidate regions for uniqueness when compared to all the sequence data available. The computational screening also ensures that the signature primer pairs are amenable to assay chemistry requirements and provides rapid, low-cost initial screening of signatures.

The primers that emerge from the computational screening and down-selection are then tested against an extensive panel of DNAs and cDNAs. The bench screening consists of a panel of 2,000 to 3,000 samples, representing a wide range of organisms and backgrounds. This bench screening ensures that the primers will detect the strain diversity of the pathogen but will not react with the nucleic acids of other organisms that could be present in a sample.

Primer pairs that successfully pass the wet chemistry screening criteria are advanced to the assay development stage. Assay development includes the optimization of detection protocols, so that the assays perform consistently to required specifications on the prototype equipment selected. At the assay development stage, assays are fully characterized by assessing performance against a specified, standardized panel of targets (nucleic acid from various strains of the organism of interest, for which the assay was designed) and near-neighbors (genetically-related organisms), which yields rich data about the sensitivity and specificity of an assay. The results of all this work (from informatics through characterization) is captured in an extensive "certificate of analysis" that provides an assay pedigree. The pedigree comprises the entire history of the assay, including results of screening, metrics of performance such as sensitivity, specificity, and known cross-reactions (if any); all available at a glance, captured in a single data file.

Table 2 provides a summary of the number of signatures that were initially identified, screened in-silico, bench screened, and then screened in a mutiplex format.

TABLE 2

Summary of narrowing the search for signature sequences

| Agent | Initial # of candidate signatures | # of signatures forwarded to Taqman | # of signatures released to multiplex | # of signatures in Mux frozen panel |
|---|---|---|---|---|
| BPSV | 8 | 7 | 4 | 3 |
| BHV | 177 | 101 | 4 | 2 |
| BVD | 1 | 1 | 1 | 1 |
| FMDV | 4 | 4 | 4 | 1 |
| BTV | 8 | 8 | 4 | 2 |
| SVD | 4 | 4 | 4 | 3 |
| VESV | 44 | 20 | 6 | 4 |

Example 1

In-silico Identification of Candidate Signature Sequences

The LLNL Bioinformatics team developed "KPATH", a whole-genome comparative analysis software system. The general approach is the following: All available complete genomes of different strains of the target species are compared using multiple genome alignment programs. A consensus gestalt is formed from the alignments that contain the sequence conserved among all target inputs. This step is bypassed if only one target sequence is available. To establish that the organism-conserved sequence does not occur in any other sequenced microbial organism, the consensus gestalt is compared against the LLNL updated database of microbial organisms. A customized algorithm accomplishes this electronic subtraction, and the result is a uniqueness gestalt that is mined for potential signature candidates. A final computational screening is done to verify that cross-reactions are not detected.

KPATH allows the genome to define potential signature candidates. However, rather than selecting candidate signatures randomly (often there are more candidates than is economically feasible to screen in the wet lab), they can be prioritized based on annotation. Annotation allows signatures to be scrutinized in a biological context. Identifying genes responsible for rendering a pathogen virulent is one component of a good diagnostic signature set. We manually select candidates associated with genes of interest, and include a random selection of candidates within intergenic regions, for wet lab screening. The random unique intergenic regions are selected as a guard against gene deletion or substitution engineering to evade DNA-based detection. We note that there are few tools focused on viral gene finding, and none known to us that can adequately predict genes in certain RNA virus families Because signature candidates are generated using exact matches in the Vmatch step described above, additional electronic screening on the signature candidates is performed to catch potential non-exact matches that might result in false positives in the wet lab. We have seen cases where this would predict cross-reactions with near-neighbor species that had not been caught by the exact-matching step (due to as few as 1 or 2 fortuitously-placed mis-matched bases.)

Table 3 summarizes the genomes used to generate candidate signatures for the seven agricultural pathogens.

TABLE 3

Genomes screened via K-path to generate candidate signature sequences for 7 agricultural pathogens

| Pathogen | Genome Description | GI Number | Sequence Length (bp) |
|---|---|---|---|
| BHV | Bovine Herpesvirus 1 | 9629818 | 135301 |
| BPSV | Sequence 1 from Patent WO03006654 | 32167392 | 137560 |
| BPSV | raw sequence of Orf virus OV-IA82 from Dan Rock on Oct. 21, 2003 | 40019122 | 137241 |
| BPSV | raw sequence of Orf virus OV-SA00 from Dan Rock on Oct. 21, 2003 | 40019123 | 139962 |
| BPSV | raw sequence of Orf virus OV-SA00 from Dan Rock on Oct. 21, 2003 | 40019124 | 134431 |

TABLE 3-continued

Genomes screened via K-path to generate candidate signature sequences for 7 agricultural pathogens

| Pathogen | Genome Description | GI Number | Sequence Length (bp) |
|---|---|---|---|
| BVD | mature peptide N-Pro, proteinase, cleaves itself from the nascent polyprotein | 9626649|NC_001461.1 | 12573 |
| FMDV | Foot-and-mouth disease virus polyprotein, isolate C3Arg85 | 4007041/AJ007347.1 | 8161 |
| FMDV | Foot-and-mouth disease virus, derived from C3Arg85, clone 15 | 4007043/AJ007572.1 | 8161 |
| FMDV | Foot-and-mouth disease virus (FMDV) strain C, isolate c-s8c1 | 6318187/AJ133357.1 | 8115 |
| FMDV | Foot-and-mouth disease virus (FMDV) strain C, isolate rp99 | 6318189/AJ133358.1 | 8115 |
| FMDV | Foot-and-mouth disease virus (FMDV) strain C, isolate rp146 | 6318191/AJ133359.1 | 8115 |
| FMDV | Foot-and-mouth disease virus C strain C-S8 clone MARLS, | 10334811/AF274010.1 | 8115 |
| FMDV | FMDV RNA of primary translation product | 61063/X00429.1 | 7107 |
| FMDV | Foot & mouth disease virus A12; L, P2, and P3 polypeptide coding region | 210306/M10975.1 | 7712 |
| FMDV | Foot and Mouth Disease Virus A L-fragment of RNA genome | 397965/X74812.1 | 7820 |
| FMDV | Foot and mouth disease virus (FMDV-O1K) RNA for polyprotein precursor | 61076/X00871.1 | 7804 |
| FMDV | Foot-and-mouth disease virus (strain O1) polyprotein gene | 6456593/AF189157.1 | 6996 |
| FMDV | Foot-and-mouth disease virus polyprotein precursor | 5031481/AF154271.1 | 7739 |
| FMDV | Foot-and-mouth disease virus O strain Chu-Pei complete genome | 5921457/AF026168.2 | 7733 |
| FMDV | Foot-and-mouth disease virus, complete genome | 12018088/AF308157.1 | 8134 |
| FMDV | Foot-and-mouth disease virus C, complete genome | 10445391/NC_002554.1 | 8115 |
| BTV | Bluetongue virus (serotype 17/isolate USA) segment 1 from LLNL on Feb. 14, 2005 1:58PM | Segment 1 reference genome: 50253391/NC006023.1 | 3862 |
| BTV | Bluetongue virus (serotype 10 American isolate) segment 1 from LLNL on Feb. 14, 2005 1:51PM | Segment 1 reference genome: 50253391/NC006023.1 | 3703 |
| BTV | Bluetongue virus (serotype 2/isolate USA) segment 1 from LLNL on Feb. 14, 2005 2:01PM | Segment 1 reference genome: 50253391/NC006023.1 Segment 1 | 3857 |
| BTV | Bluetongue virus (serotype 11/isolate USA) segment 1 from LLNL on Feb. 14, 2005 1:53PM | Segment 1 reference genome: 50253391/NC006023.1 | 3755 |
| BTV | Bluetongue virus (serotype 13/isolate USA) segment 1 from LLNL on Feb. 14, 2005 1:56PM | Segment 1 reference genome: 50253391/NC006023.1 | 3830 |
| BTV | Bluetongue virus (serotype 17/isolate USA) segment 8 from LLNL on Feb. 14, 2005 2:00PM | Segment 8 reference genome: 50253377/NC_006007. | 1074 |
| BTV | Bluetongue virus (serotype 10/American isolate) segment 8 from LLNL on Feb. 14, 2005 1:51PM | Segment 8 reference genome: 50253377/NC_006007. | 1085 |
| BTV | Bluetongue virus (serotype 11/isolate USA) segment 8 from LLNL on Feb. 14, 2005 1:54PM | Segment 8 reference genome: 50253377/NC_006007. | 977 |
| BTV | Bluetongue virus (serotype 13/isolate USA) segment 8 from LLNL on Feb. 14, 2005 1:57PM | Segment 8 reference genome: 50253377/NC_006007. | 1090 |
| BTV | Bluetongue virus (serotype 17/isolate USA) segment 9 from LLNL on Feb. 14, 2005 2:00PM | Segment 9 reference genome: 50253379/NC_006008.1 | 997 |
| BTV | Bluetongue virus (serotype 10/American isolate) segment 9 from LLNL on Feb. 14, 2005 1:52PM | Segment 9 reference genome: 50253379/NC_006008.1 | 897 |
| BTV | Bluetongue virus (serotype 2/isolate USA) segment 9 from LLNL on Feb. 14, 2005 2:03PM | Segment 9 reference genome: 50253379/NC_006008.1 | 1029 |
| BTV | Bluetongue virus (serotype 11/isolate USA) segment 9 from LLNL on Feb. 14, 2005 1:54PM | Segment 9 reference genome: 50253379/NC_006008.1 | 808 |
| SVD | Swine vesicular disease virus strain NET/1/92, complete genome | 8896132 | 7406 |
| SVD | PISVDV Swine vesicular disease virus complete genomic RNA | 61167 | 7400 |
| SVD | SVDMPS Swine vesicular disease virus gene for polyprotein, complete cds | 37993797 | 7401 |
| SVD | Swine vesicular disease virus strain HK'70, complete genome | 402536 | 7401 |
| SVD | Swine vesicular disease virus (STRAIN H/3 '76) genomic RNA, complete genome | 1228947 | 7401 |
| VESV | Vesicular exanthema of swine virus, complete genome | 10314005/NC_002551.1 | 8284 |

Example 2

Use of Taqsim to Further Screen Candidate Signature Sequences

A computational TaqMan simulator program, "Taqsim", was used to identify all potential targets for each candidate signature from all sequences available in Genbank. Taqsim is a BLAST-based comparison of each signature as a triplet against all sequences in Genbank to identify the targets that are predicted to produce a TaqMan reaction at 57 degrees primer annealing and 67 degrees for probe annealing (these temperatures are according to Primer 3 oligo Tm calculations). Input parameters allow for standardized signature informatics that allows for universal protocol development and assay compatibility.

TABLE 4

Taqsim settings used for generation of candidate signatures
Primer3 Parameters

| Parameters | Standard Settings |
| --- | --- |
| PRIMER_OPT_SIZE | 20 |
| PRIMER_MIN_SIZE | 18 |
| PRIMER_MAX_SIZE | 27 |
| PRIMER_PRODUCT_OPT_SIZE | 100 |
| PRIMER_PRODUCT_SIZE_RANGE | 71-600 |
| PRIMER_OPT_TM | 62 |
| PRIMER_MIN_TM | 61 |
| PRIMER_MAX_TM | 63 |
| PRIMER_MIN_GC | 20 |
| PRIMER_MAX_GC | 80 |
| PRIMER_PICK_INTERNAL_OLIGO | 1 |
| PRIMER_INTERNAL_OLIGO_OPT_SIZE | 31 |
| PRIMER_INTERNAL_OLIGO_MIN_SIZE | 18 |
| PRIMER_INTERNAL_OLIGO_MAX_SIZE | 36 |
| PRIMER_INTERNAL_OLIGO_OPT_TM | 72 |
| PRIMER_INTERNAL_OLIGO_MIN_TM | 71 |
| PRIMER_INTERNAL_OLIGO_MAX_TM | 73 |
| Number of Primers/Probe Set generated: | 101 |

Example 3

Wet Chemistry Screening Process

To ensure extremely high selectivity and sensitivity, a rigorous wet-chemistry screening was performed to further down-select candidate nucleic acid signatures before taking those signatures that pass this screening on to assay development. This step ensures that the primers will detect the strain diversity of the pathogen, but will not react with the nucleic acids of other organisms that could be present in a sample. At this stage, only the primers are tested and many unsuitable primers (e.g., those that form primer-dimers, those that do not produce amplicons of the correct size, etc.) can be eliminated in this first step.

An initial screening of the PCR signatures was performed in duplicate using end-point PCR and gel electrophoresis as described herein. The signatures are initially screened against nucleic acid extractions from 5 soils, 5 eukaryotic nucleic acids, and 5 microbes, each picked at random, and selected near neighbors. The soils represent a diverse geographical and temporal distribution and contain complex mixtures of organisms. The eukaryotic nucleic acids are those that may potentially carry over from sample collection processes. The microbial nucleic acids were selected to span the range of microbial diversity. Near neighbors are organisms that are closely related at the genetic level and have the greatest likelihood of causing confounding results in the assays.

Signatures that produce amplicons with various soils, microbe, eukaryotic or near neighbor nucleic acids were eliminated. Furthermore, signatures were eliminated due to their inability to produce correct size PCR product when crossed with targets. The down-selected signatures are then put through intensive background screening in real-time (TaqMan) PCR format.

Reagents: Invitrogen Platinum Taq polymerase, Catalog #10966-083 (Carlsbad, Calif.); Invitrogen 10 PCR Buffer, Catalog #10966-083 (Carlsbad, Calif.); Invitrogen 50 mM MgC12, Catalogue #10966-083 (Carlsbad, Calif.); Sigma Chemical BSA, Catalogue #B8687 (St Louis, Mo.); Amersham dNTPs, Catalogue #27-2035-02 (Piscataway, N.J.); Biosearch Technologies oligonucleotides (Novato, Calif.); Nuclease-Free water; Cambrex 4% agarose gel, Catalogue #57225; Cambrex Simplyload 20 by ladder, catalogue #50331; Teknova 10× TBE, Catalogue #T0210; Teknova 10× Loading Dye, Catalogue #F3062; Clonetech Powerscript one step qRT-PCR kit, Catalogue #630051.

Sample preparation. Pathogen nucleic acids were isolated from virus grown in cell culture as described herein.

PCR assays for DNA templates: Background templates are added to each 25 ul reaction in the following amounts: 5 ng of total soil extract, 1 ng of total Eukaryotic extracted DNA and 200 pg of total extracted Prokaryotic DNA. Control on each plate consists of 2 *Bacillus thuringiensis* reactions (1 ng DNA per 25 ul reaction), and an NTC (No Template Control=5 ul PCR water in place of the template), for each primer used on the plate. Each reaction includes the following: 10× PCR Buffer (2.5 ul); 10 mM dNTPs (2.0 ul); 50 mM MgSO4 (2.25 ul); BSA (2 ug/ul) (1.0 ul); F/R Primers (2.5 uM) (1.0 ul); PlatinumTaq (0.125.0 ul); PCR water (11.125 ul); Template (in 5.0 ul). Thermalcycler Parameters are as follows: Cycle 1: (1×): Step 1: 94.0° C. for 01:00; Cycle 2: (39×) Step 1: 94.0° C. for 00:20; Step 2: 55.0° C. for 00:10; Step 3: 72.0° C. for 00:30; Cycle 3: (1×) Step 1: 15.0° C., HOLD.

PCR assays for RNA templates: Primer set assays are performed in triplicate against available RNA extractions of targets and near neighbors using 200 pg of extracted RNA to each 25 ul reaction. Each reaction includes the following: 2× One-step RT-PCR Buffer (12.5 ul); 50× Q Taq Polymerase Mix, 1.5 U/ul (0.5 ul); 60×Q PowerScript (0.42 ul); PCR water (5.53 ul); F/R Primers (10 uM) (1.05 ul); Template in 5 ul. Thermalcycler Parameters are as follows: Cycle 1: (1×) Step 1: 48.0° C. for 20:00; Step 2: 95.0° C. for 03:00; Cycle 2: (39×): Step 1: 95.0° C. for 00:15; Step 2: 60.0° C. for 01:00; Step 3: 72.0° C. for 00:15; Cycle 3: (1×): Step 1: 15.0° C. HOLD.

Gel electrophoresis. Product size was determined by running 15 ul of PCR product with 5 ul 10× loading dye (Teknova; Hollister, Calif.) on 4% agarose gels (Cambrex Rockland, IN) in Tris-borate-EDTA buffer (Teknova). Band size was determined using Cambrex's Simpleload 20 base pair ladder. The Epi Chemi II Darkroom Bioimaging system (UVP Bioimaging Systems Upland, Calif.) was used for visualization of the DNA.

Example 4

Taqman Format Screening

Following the wet screening process, signature sequences were screened in a real-time PCR format in triplicate against nucleic acid samples that include nucleic acid extracts from all targets and near neighbors, 16 eukaryotes, 55 soils, 45 prokaryotes, and a total of 2256 samples collected from aerosol collectors and pooled for background testing purposes. Primer pairs that successfully pass the wet chemistry screening criteria are advanced to the assay development stage.

Taqman assay development includes the bioinformatics selection and evaluation processes, and optimization and characterization. Optimization is conducted for every relevant parameter that impacts assay performance. For example, in a standard RT-PCR assay, parameters to be optimized include: primer/probe length, GC content, Tm, concentration(s), thermocycling parameters (2-step or 3-step, times, temperatures for each step) reaction conditions (MgC12 concentration), Taq polymerase (type and concentration), reaction buffers, extraction protocols, etc.

Taqman probes: Probes for Real-time PCR Taqman reactions were obtained from Biosearch Technologies using the Tamara fluorophore and Black Hole quencher. In some instances the Taqman probes had the same sequence as the probes used in the multiplex Luminex assay and described in Table 1, e.g., the Taqman probes were forward complement probes (FCP). In other instances, the Taqman probes were the reverse complement of probes disclosed in Table 1 and used in the Luminex assay. For example, for the BHV-1 assay, the sequence of the real-time probes was the reverse complement of the Luminex probe, e.g., the sequence was CTCCATGT-TAGCGCTCTGGAACCTGGA (SEQ ID NO: 69). The Taqman probes were as follows:

V/V (to 15 ml add 75 ul Triton). Add 0.5M EDTA to a final concentration of 20 mM (15 ml add 600 ul 0.5M EDTA. Mix vigorously and vortex, let sit 5 mM at room temp. Spin tube at <1000 rpm for 10 minutes. Discard pellet and to the supernatant add 10% (W/V) Sodium Dodecyl Sulfate (SDS) solution to a final concentration of 1% (to 15 ml add 1.5 ml of 10% SDS). Add proteinase K to a final concentration of 0.4 Upper ml (to 15 ml add 2.4 mg of 2.5 U/mg Roche or 60 ul of a 0.1 mg/ul solution of proteinase K in water). Incubate the tubes at 55° C. for one hour mixing every 10 minutes. Cool tubes to room temperature. Add 5 M NaCl to a final concentration of 150 mM (to 16.5 ml add 510 ul 5 M NaCl). Add an equal volume of room temperature phenol/chloroform/isoamyl alcohol (approx. 15 ml). Mix by inversion and swirling till phases are completely mixed. Let sit 5 mM then spin at 3,000 rpm for 10 mM Remove the upper aqueous layer and distribute 500 ul into 1.5 ml microcentrifuge tubes (for 15 mls need 30 tubes). Discard the lower layer in phenol/chloroform waste. Add two volumes (1 ml) of 100% ethanol to each microcentrifuge tube and leave at −20° C. one hour. Spin in microfuge at top speed refrigerated for 10 minutes. Discard supernatant and wash pellet once with 70% ethanol 150 mM NaCl. Remove all ethanol and dissolve the pellet in TE. For 15 ml extraction dissolve each pellet in each tube in 50 ul of liquid. Each tube should contain 50 fg/ul of puc 18.

Sample preparation, RNA: RNA was extracted from virus infected tissue culture samples as follows. Add 3× the volume

TABLE 5

Probes for Taqman assays

| SEQ ID NO: | Pathogen-assay | Real-time probe orientation | Sequence (5' => 3') |
|---|---|---|---|
| 69 | BHV-1 | Plus, RCP | CTCCATGTTAGCGCTCTGGAACCTGGA |
| 70 | BHV-3 | Plus, RCP | CGCGAATCTTATTTAAGTGCACACCGTGTTATTT |
| 71 | BPSV-1 | Plus, RCP | CACGTTCTCCACGTCGGAGTCGG |
| 72 | BPSV-2 | Plus, RCP | CGGAAGCCCATGAGCCCGTACA |
| 73 | BPSV-4 | Plus, RCP | CGCTTGTTGTCCGCCTCGAAGTC |
| 74 | BTV-2 | Plus, RCP | ACAGAAGATGATGATTGGCCCACGAGTTAG |
| 75 | BTV-3 | Minus, FCP | CTAACTCGTGGGCCAATCATCATCTTCTGT |
| 76 | BVD-1a(mod) | Plus, RCP | CTCGAGATGCCACGTGGACGAGG |
| 77 | FMDV.Pir | Minus, FCP | CCTCGGGGTACCTGAAGGGCATCC |
| 78 | FMDV.TC | Minus, FCP | GTCCCACGGCGTGCAAAGGA |
| 79 | SVD_1 | Plus, RCP | CGTCACAAGTTGTACCATCAGACACAATGCA |
| 80 | SVD_2 | Minus, FCP | TGACCGTAATGAGGTCATCGTGATTTCTCAC |
| 81 | SVD_3 | Minus, FCP | CTGGCGTCATAGCCTGAATAGTCAAACGCTA |
| 82 | VESV_1 | Plus, RCP | CCAAATTGCACATCTAAGGTTATCAACGATGATG |
| 83 | VESV_3 | Plus, RCP | CGACTCATCTGACAAGGTTGATTATGCCAATTT |
| 84 | VESV_4 | Plus, RCP | CTTCCTCCAACTCAGGCACCGAGC |
| 85 | VESV_5 | Plus, RCP | TGGTGACAAATGCCCGTCCCG |

Sample preparation, DNA: Total DNA was extracted from virus infected cell culture as follows. Add $5 \times 10^{-2}$ nanograms of Puc18 per ml of virus cell culture (to 15 ml add 0.75 ng Puc19). Add Triton X-100 to a final concentration of 0.5% Trizol (TRIZOL LS Invitrogen Cat. No. 10296-010) to the volume of sample. (Upon completion of this step, sample can be stored at −80, or continue with extraction.) Lyse cells in the sample suspension by passing the suspension several times through a pipette, or by shaking vigorously. Incubate for 15 minutes at room temperature. (Typically, LLNL uses 2× the volume Trizol to water (e.g., 15 ml sample and 30 mls TRIZOL.) Add 200 ul chloroform per 1 ml solution in the fume hood, cap and shake vigorously for 15 seconds. Incubate at room temperature for 5-15 minutes. Centrifuge at 3000 g for 15 minutes, at 4° C. Remove aqueous layer. Add 1 ml isopropyl alcohol per 500 ml aqueous layer. Gently mix by inverting several times. Incubate samples on the bench top for 10 minutes. Centrifuge at 12,000 g for 10 minutes at 4 C. Carefully, pour off liquid. Wash pellet with 70% EtOH. Vortex sample and re-centrifuge at 7,500 g for 5 minutes at 4° C. Pour off the EtOH, cap, re-spin at 7,500 g for 5 minutes and pipette off remaining liquid. Air dry briefly at 55° C., caution not to over-dry. Resuspend RNA in RNAse-free water and store at −80° C.

Reverse transcriptase. RNA samples were subjected to reverse transcription using the BD Clonetech kit, 48 degrees C. for 30 minutes.

Real-time PCR for DNA samples. Primer/probe set assays were performed in triplicate against 54 extracted soil samples, 16 Eukaryotic backgrounds and 45 Prokaryotic backgrounds and against 3 distinct aerosol extraction plates, adding 5 ul template to each 25 ul reaction. Background templates, with the exception of aerosols, were added to each 25 ul reaction in the following amounts: 5 ng of total soil extract, 1 ng of total Eukaryotic extracted DNA and 200 pg of total extracted Prokaryotic DNA. (The backgrounds are premade up in plates that are diluted to the proper concentrations so that 5 ul of each background is added to each 25 ul reaction.) Controls on each plate consist of 2 *Bacillus thuringiensis* reactions (1 ng DNA per 25 ul reaction), and an NTC (No Template Control=5 ul PCR water in place of a template), reaction for each primer/probe on the plate.

| Component | 1x (ul) |
|---|---|
| 10x PCR Buffer | 2.5 |
| 10 mM dNTPs | 0.5 |
| 50 mM MgSO4 | 3.0 |
| BSA (2 ug/ul) | 1.0 |
| F/R Primers (10 uM) | 0.5 |
| Probe (10 uM) | 1.0 |
| PlatinumTaq | 0.25 |
| PCR Water | 11.25 |
| Template (**/ul) | 5.0 |

| iCYCLER Parameters | | |
|---|---|---|
| Cycle 1: (1X) | 95.0° C. for 01:00 | |
| Cycle 2: (39X) | 95.0° C. for 00:20 | Data collection and real-time analysis enabled |
| | 55.0° C. for 00:10 | |
| | 72.0° C. for 00:30 | |
| Cycle 3: (1X) | 4.0° C. HOLD | |

PCR for RNA samples. Reverse transcriptase Real-Time Procedure. Follow steps 1 and 2 of the Real-Time DNA procedure for background screening on each signature. Perform primer set assays in triplicate against RNA extractions of targets and near neighbors using the Clonetech RT-PCR kit. Controls on each plate consist of 2 *Bacillus thuringiensis* (Bt) reactions (1 ng DNA per 25 ul reaction), and an NTC (No Template Control=5 ul PCR water in place of a template), reaction for each primer/probe on the plate. Be sure to use the Clonetech RT-KIT for Bt controls on RNA plates.

Clontech RT-PCR Reagent Mix Preparation:

| Component | 1x (ul) |
|---|---|
| 2x One-step RT-PCR Buffer | 12.5 |
| 50x Q Taq Polymerase Mix, 1.5 U/ul | 0.5 |
| 60x Q PowerScript | 0.42 |
| PCR water | 5.33 |
| F/R Primers (10 uM) | 1.05 |
| Probe (10 uM) | 0.20 |
| Template, concentration varies | 5.0 |

| iCYCLER Parameters | | |
|---|---|---|
| Cycle 1: (1X) | 48.0° C. for 20:00 | |
| Cycle 2: (39X) | 95.0° C. for 00:10 | Data collection and real-time analysis enabled |
| | 60.0° C. for 01:00 | |
| | 72.0° C. for 00:15 | |
| Cycle 3: (1X) | 15.0° C. HOLD | |

PCR efficiency. The efficiency, of the PCR assay was determined by testing dilutions from 3000 pg to 10 pg in triplicate. The average ct value was graphed against the template concentration, the equation of the resulting line yielded the R2 value that represents the PCR efficiency.

Signature sequences that performed well in the Taqman format are presented in Table 1.

TABLE 1

Signature sequences, PCR primers, and probes for detection of 7 agricultural pathogens in a sample.

| SEQ ID NO: | Pathogen_Assay | description | Sequence 5' => 3' |
|---|---|---|---|
| 1 | BVH_1 | SIGNATURE SEQUENCE 140 bp | GTGCCAGCCGCGTAAAAGCGGCGCTCCATGTTAGCGCTCTGGAACCAGGA GACGTCGCAGCGCAGGTTGGGCGGGTGGGCGGTTGGCGTCGCGTCCTCGA GCGTAAGGACGGACGTGCGCGAAAAGAGCCCGGAGTCGTC |
| 2 | BVH_1 | FORWARD PRIMER | GTGCCAGCCGCGTAAAAG |
| 3 | BVH_1 | REVERSE PRIMER | GACGACTCCGGGCTCTTTT |
| 4 | BVH_1 | PROBE | TCCTGGTTCCAGAGCGCTAACATGGAG |

TABLE 1-continued

Signature sequences, PCR primers, and probes for detection of 7 agricultural pathogens in a sample.

| SEQ ID NO: | Pathogen_Assay | description | Sequence 5' => 3' |
|---|---|---|---|
| 5 | BVH_3 | SIGNATURE SEQUENCE 114 bp | GTCCCCACGGGCGTAGTAGCACCGGGCGTGCTGTCCTCTGGCGTAGCGTC GGGGCTGTTGGGCGTGGGGGGCGTTGCGCCGGTGGTCCCAGCGGAGCTTT CCGTCTCGGTTGGG |
| 6 | BVH_3 | FORWARD PRIMER | TGAGGCCTATGTATGGGCAGTT |
| 7 | BVH_3 | REVERSE PRIMER | GCGCGCCAAACATAAGTAAA |
| 8 | BVH_3 | PROBE | AAATAACACGGTGTGCACTTAAATAAGATTCGCG |
| 9 | BPSV-1 | SIGNATURE SEQUENCE 178 bp | GCAGATGCGCTCCTGGTTCTGGCAGAACACCGAGTCTTCGATGATCAACA CCCTCCTGGTCCCGGCCGACCGCATGATGGCCATGGCCCGGATGAGCCTC TTCTTCGATCCGCGTATGGACATGGACCGGAGCACGTTCTCCACGTCGGA GTCGGAGACGTTGCAGCAGCAGAGGTGC |
| 10 | BPSV-1 | FORWARD PRIMER | GCAGATGCGCTCCTGGTT |
| 11 | BPSV-1 | REVERSE PRIMER | GCACCTCTGCTGCTGCAA |
| 12 | BPSV-1 | PROBE | CCGACTCCGACGTGGAGAACGTG |
| 13 | BPSV_2 | SIGNATURE SEQUENCE 95 bp | GATGGCCGTGCAGCTCTTGGCCGAGGCGTACGAGAAGAGCGCGCTGTTGC GGAAGCCCATGAGCCCGTACACGGAGTTGGCCGTGATCTTGTACG |
| 14 | BPSV_2 | FORWARD PRIMER | GATGGCCGTGCAGCTCTT |
| 15 | BPSV_2 | REVERSE PRIMER | CGTACAAGATCACGGCCAACT |
| 16 | BPSV_2 | PROBE | TGTACGGGCTCATGGGCTTCCG |
| 17 | BPSV_4 | SIGNATURE SEQUENCE 167 bp | GCAGCAGTGCACCACGTAGTACCCGGCGGTGGCGCGCAGGCGCTTGTTGT CCGCCTCGAAGTCCGCCTCCAACCCCTCGTTGAAGTACTTGTCGAATATG ATGGGCAGGAAGGATAGTTTTGACTCGGTGACCACCTTCCCGAAGTTGAG GATGTACGGGTTCAGCG |
| 18 | BPSV_4 | FORWARD PRIMER | GCAGCAGTGCACCACGTAGT |
| 19 | BPSV_4 | REVERSE PRIMER | CGCTGAACCCGTACATCCT |
| 20 | BPSV_4 | PROBE | GACTTCGAGGCGGACAACAAGCG |
| 21 | FMDV-TC | SIGNATURE SEQUENCE 280 bp | ACTGGGTTTTACAAACCTGTGATGGCCTCGAAGACCCTCGAGGCCATCCT CTCCTTTGCACGCCGTGGGACCATACAGGAGAAGTTGATCTCCGTGGCAG GACTCGC |
| 22 | FMDV-TC | FORWARD PRIMER | ACTGGGTTTTACAAACCTGTGA |
| 23 | FMDV-TC | REVERSE PRIMER | GCGAGTCCTGCCACGGA |
| 24 | FMDV-TC | PROBE | GTCCCACGGCGTGCAAAGGA |
| 25 | FMDV-pir | SIGNATURE SEQUENCE 280 bp | CACTTTAAAGTGACACTGAAACTGGTACCCAATCACTGGTGACAGGCTAA GGATGCCCTCCAGGTACCCCGAGGTAACACGAGACAC-TCGGGATCTG |
| 26 | FMDV-pir | FORWARD PRIMER | CACYTYAAGRTGACAYTGRTACTGGTAC |
| 27 | FMDV-pir | REVERSE PRIMER | CAGATYCCRAGTGWCICITGTTA |
| 28 | FMDV-pir | PROBE | CCTCGGGGTACCTGAAGGGCATCC |
| 29 | BVD_1a | SIGNATURE SEQUENCE 202 bp | GGTAGTCGTCAGTGGTTCGACACCTCGGAAAGAAGGTCTCGAGATGCCAC GTGGACGAGGGCATGCCCAAAGCACATCTTAACCTGGACGGGGGTCGCCC AGGTAAAAGCAGTTTTGACCAACTGTTATGGACACAGCCTGATAGGGTGC TGCAGAGGCCCACTGAATTGCTACTAAAAATCTCTGCTGTACATGGCACA TG |
| 30 | BVD_1a | FORWARD PRIMER | GGTAGTCGTCAGTGGTTCGAC |
| 31 | BVD_1a | REVERSE PRIMER | CATGTGCCATGTACAGCAGAGAT |
| 32 | BVD_1a | PROBE | CCTCGTCCACGTGGCATCTCGAG |
| 33 | BTV_2 | SIGNATURE SEQUENCE 271bp | TCAAGACGAATGAATGAGGAGAAGATCTTAGAGGCGGTGAAGTATTCGCA AAATTTAGGCTCGCACGATCGTAGGCTACCTCTTTTTGAAAAAATGTTAA AGATGGTTTATACTACACCATTCTACCCGCATAAGAGCTCGAACATGATA TTAGCATCTTTCCTATTAAGCATTCAAACCATTACTGGATATGGCAGGGC |

TABLE 1-continued

Signature sequences, PCR primers, and probes for detection of 7 agricultural pathogens in a sample.

| SEQ ID NO: | Pathogen_Assay | description | Sequence 5' => 3' |
|---|---|---|---|
| | | | GTGGGTGAAGAACGTGAGCACCGAGTTCGATAAACAGCTGAAACCGAACC CAAGC |
| 34 | BTV_2 | FORWARD PRIMER | GCACCCTATATGTTTCCAGACCA |
| 35 | BTV_2 | REVERSE PRIMER | CAGCTAACTCTTCAGCCACACG |
| 36 | BTV_2 | PROBE | CTAACTCGTGGGCCAATCATCATCTTCTGT |
| 37 | BTV_3 | SIGNATURE SEQUENCE 187 bp | GGATTTGCGATATGAAGGTTATACGTTAGAACAGATCATAGATTTTGGAT ATGGAGAGGGGAGGGTAGCGAATACGTTGTGGAACGGAAAGCGAAGACTG TTTAAGACTACATTTGACGCGTATATACGATTAGATGAGAGCGAGCGAGA CAAAGGTGGTTTCAAGGTCCCCAAGGGAGTGCTTCCAGTATCGAGTGTTG ACGTTGCGAATCGAATCGCGGTGGACAAGGGATTCGACACGCTTATCGCG GCA |
| 38 | BTV_3 | FORWARD PRIMER | GCACCCTATATGTTTCCAGACCA |
| 39 | BTV_3 | REVERSE PRIMER | CAGCTAACTCTTCAGCCACACG |
| 40 | BTV_3 | PROBE | CTAACTCGTGGGCCAATCATCATCTTCTGT |
| 41 | SVD_1 | SIGNATURE SEQUENCE 349 bp | CAGGATAATTTCTTCCAAGGGCCCCCAGGAGAGGTGATGGGAAGAGCCAT TTCCAGCCCTAACCGCCGCAGAGACAGGGCACACGTCACAAGTTGTACCA TCAGACACAATGCAAACTAGACACGTGAAGAATTACCATTCAAGATCAGA GTCGACAGTGGAGAACTTCCTGTGCAGATCTGCATGCGTCTTCTACACCA CATACAAGAACCATGACTCCGATGGCGACAACTTCGCCTACTGGGTGATC AACACACGGCAAGTTGCTCAACTGCGTCGGAAGCTCGAAATGTTCACGT |
| 42 | SVD_1 | FORWARD PRIMER | CAGGATAATTTCTTCCAAGGGC |
| 43 | SVD_1 | REVERSE PRIMER | ACGTGAACATTTCGAGCTTCC |
| 44 | SVD_1 | PROBE | TGCATTGTGTCTGATGGTACAACTTGTGACG |
| 45 | SVD_2 | SIGNATURE SEQUENCE 281 bp | GACTTGTTGTGGCTGGAGGACGACGCCATGGAGCAAGGAGTTAGGGATTA TGTGGAACAACTCGGCAACTGCTTCGGCTCAGGATTCACCAATCAAATTT GCGAACAGGTTACCCTTCTAAAAGAGTCGTTAATTGGACAGGATTCTATC CTTGAGAAGTCTCTCAAGGCCCTCGTCAAGATAGTATCAGCACTCGTGAT CGTGGTGAGAAATCACGATGACCTCATTACGGTCACCGCCACACTGGCGT TAATAGGATGCACTACCTCACCATGGCGCTG |
| 46 | SVD_2 | FORWARD PRIMER | GACTTGTTGTGGCTGGAGGA |
| 47 | SVD_2 | REVERSE PRIMER | CAGCGCCATGGTGAGGTAG |
| 48 | SVD_2 | PROBE | TGACCGTAATGAGGTCATCGTGATTTCTCAC |
| 49 | SVD_3 | SIGNATURE SEQUENCE 248 bp | GACAAAGTGGCCAAGGGAAAGTCCAGGCTCATCGAGGCTTCTAGCCTCAA CGACTCAGTAGCAATGAGGCAGACATTTGGAAACCTATATAAGACTTTCC ACCTCAACCCGGGCATCGTTACGGGTAGCGCCGTTGGGTGTGACCCAGAT GTCTTTTGGAGCAAGATTCCCGTCATGCTCGATGGACATCTCATAGCGTT TGACTATTCAGGCTATGACGCCAGCCTCAGCCCAGTGTGGTTTACGTG |
| 50 | SVD_3 | FORWARD PRIMER | GACAAAGTGGCCAAGGGAAA |
| 51 | SVD_3 | REVERSE PRIMER | CACGTAAACCACACTGGGCT |
| 52 | SVD_3 | PROBE | CTGGCGTCATAGCCTGAATAGTCAAACGCTA |
| 53 | VESV_1 | SIGNATURE SEQUENCE 153 bp | GCCTTCTCCCTTCCCAAAACGGACGGACCCACCGGAAACGAACCCGAATT CATCGCTGAGGCTTGCCCTAGCTGCGCTCTTTACGACACGTGTCCAAATT GCACATCTAAGGTTATCAACGATGATGGCTCAACTGACGGAACCATTCCT TCA |
| 54 | VESV_1 | FORWARD PRIMER | GCCTTCTCCCTTCCCAAAA |
| 55 | VESV_1 | REVERSE PRIMER | TGAAGGAATGGTTCCGTCAGT |
| 56 | VESV_1 | PROBE | CATCATCGTTGATAACCTTAGATGTGCAATTTGG |
| 57 | VESV_3 | SIGNATURE SEQUENCE 199 bp | GGGAATGAGGTGTGCATCATTGATGAATTCGACTCATCTGACAAGGTTGA TTATGCCAATTTTGTAGTCAACATGGTTAACACCAACCCCATGGTCTTAA ATTGTGATCTAATTGAAAACAAAGGCAAGACATTCACCTCAAAATACGTC ATCATGACGTCCAACACGGAAACACCAGTCAAGCCAACATCAAGACGTG |
| 58 | VESV_3 | FORWARD PRIMER | GGGAATGAGGTGTGCATCATT |

TABLE 1-continued

Signature sequences, PCR primers, and probes for detection of 7 agricultural pathogens in a sample.

| SEQ ID NO: | Pathogen_Assay | description | Sequence 5' => 3' |
|---|---|---|---|
| 59 | VESV_3 | REVERSE PRIMER | CACGTCTTGATGTTGGCTTGAC |
| 60 | VESV_3 | PROBE | AAATTGGCATAATCAACCTTGTCAGATGAGTCG |
| 61 | VESV_4 | SIGNATURE SEQUENCE 124 bp | GGTCGCTCTCACTGATGATGAGTACAATGATTGGAAACAGTCCAAAGCTG AAAAAAACCTCGACCTCACGGTCAAGGACTTCCTCCAACTCAGGCACCGA GCTGCAATGGGTGCTGATAACACC |
| 62 | VESV_4 | FORWARD PRIMER | GGTCGCTCTCACTGATGATGAGTA |
| 63 | VESV_4 | REVERSE PRIMER | GGTGTTATCAGCACCCATTGC |
| 64 | VESV_4 | PROBE | GCTCGGTGCCTGAGTTGGAGGAAG |
| 65 | VESV_5 | SIGNATURE SEQUENCE 200 bp | ACCACCTCTGGAAACATCTATGGAGCCTGCGGCTCATCGTGTTCACTGAC GAGACAGGGTGACTGCGGTCTCCCCTACGTCGACGATCACGGTGTTGTCG TTGGACTCCATGCTGGGTCTGGTGGTGACAAATGCCCGTCCCGAAAACTC ATTGTTCCCTACGTCAAGGTGGATATGAGAATTCGTGACACGTGCACAAA |
| 66 | VESV_5 | FORWARD PRIMER | ACCACCTCTGGAAACATCTATGG |
| 67 | VESV_5 | REVERSE PRIMER | TTTGTGCACGTGTCACGAAT |
| 68 | VESV_5 | PROBE | CGGGACGGGCATTTGTCACCA |

Example 5

Development of Multiplexed Liquid Array Format

Figure 66:
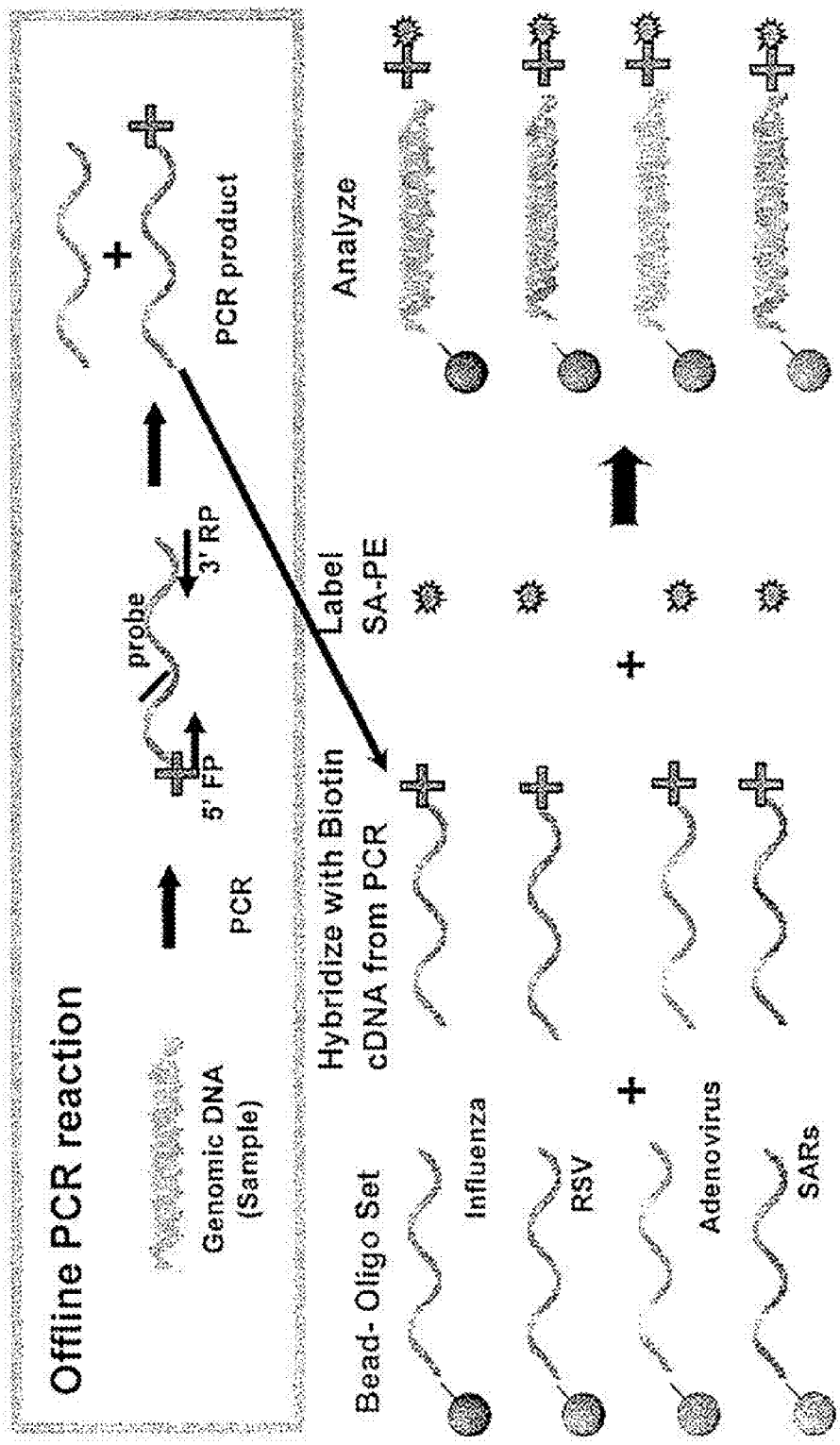
Figure 67:
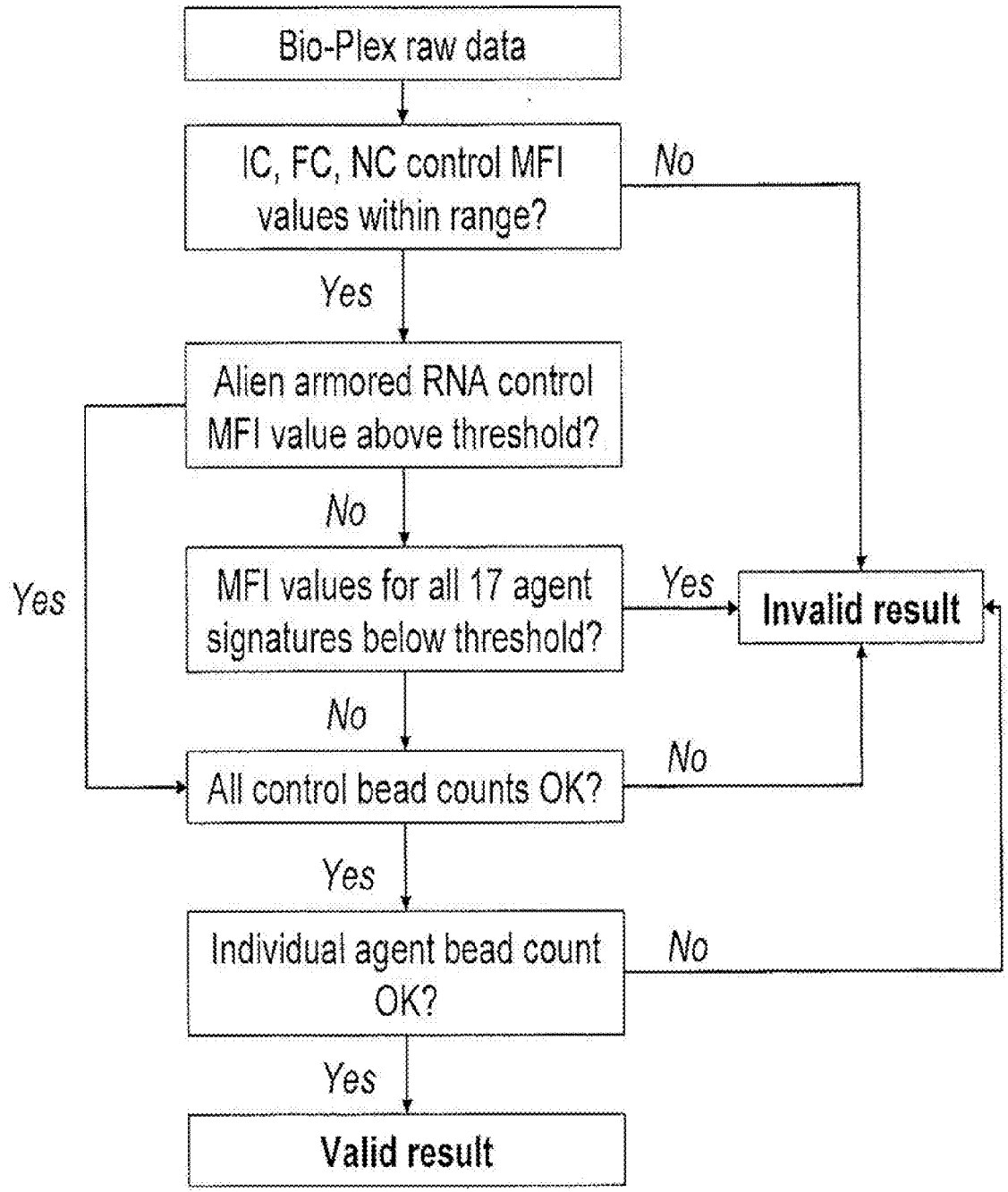
FIG. 67 is a flow diagram illustrating the process used to determine whether or not any individual assay result is valid based on results of the control data.

After ascertaining that signatures perform well in the Taqman format, they are then transitioned to the multiplexed liquid array format. The multiplexes liquid array format is summarized in FIG. 66.

This phase is divided into two steps. The first step, called 'Singlepex' testing, is a step in which each individual signature is tested against target virus. In this format, only two sets of primers are present in the PCR mix: the primers for the Alien RNA positive control (to ensure the PCR reaction proceeds well), and the primers for the signature being tested. The target virus is then spiked at various concentrations in order to generate a titration curve. All titrations are run in triplicate. In the cases in which various strains of the same virus are available, a titration is run for each one.

The second step, called 'Multiplexed' testing, is a step in which the individual signatures are added to the multiplexed panel. In this format, the primers of the signature being tested are added to the multiplexed PCR mix, with the other primers present in the panel. Titrations are then run in triplicate for each signature present in the panel in order to determine the limit of detection of the assay against each target in the multiplexed format, and also to control for signature cross-reactivity.

A summary of the multiplex PCR assay procedure is as follows. The sample, e.g., an oral swab placed in virus transport media, undergoes a magnetic bead extraction to purify target nucleic acids from impurities in the sample matrix. Target DNA or RNA is amplified by real-time-PCR. The forward primer is biotinylated. The reverse primer is unmodified. The double stranded PCR product is mixed with a suspension of probe-bead conjugates then melted at 95° C. to form single strand product. Extended forward primer is hybridized to the complementary probe-bead conjugate at 95° C. The hybridized product is then labeled with the fluorescent probe SA-PE. The bead suspension is analyzed using the flow cytometer.

For this application, oligonucleotide probes with sequences that are complementary to the target nucleic acid sequences were covalently coupled to beads. Nucleic acids from pathogens (targets) were amplified using standard PCR techniques. After target amplification, the amplicons, half of which contain the biotinylated forward (5'-3') primer were introduced to the beads and allowed to hybridize to their complementary probes on the appropriate bead. A fluorescent reporter molecule (strepavidin-phycoerythrin) was added, and binds the biotin functional groups within the forward primer. Therefore, the completed assay product comprises a bead+probe+biotinylated (and fluorescently tagged) amplicon. Each optically encoded and fluorescently-labeled microbead was then interrogated by the flow cytometer. The 635-nm red diode laser excites the dyes inside the bead and classifies each bead to its unique bead class, and a green "reporter" laser (532 nm) quantifies the assay at the bead surface. The flow cytometer is capable of reading several hundred beads each second; analysis can be completed in as little as 15 seconds. Conducting the assay requires multiple steps and significant thermocycling times; the process currently takes about 2 hours.

Extraction of Target Nucleic Acid from a Sample

Extractions of nucleic acid from the samples were conducted with an MagMax (catalog #1839, Ambion, Austin, Tex.) extraction kit using the standard protocol. The kit is specifically designed for the simultaneous extraction of both DNA and RNA using a single procedure. Nucleic acid was extracted from deactivated antigens to use as positives when testing the various signatures.

Primer and Probe Synthesis

Oligonucleotides for Luminex bead-based assays were purchased from Integrated DNA technologies (IDT DNA, Coralville, Iowa). Each forward primer has a 5 prime biotin and 2 internal biotins. Since the biotin molecules are proportionately larger than the bases, it is preferred that the biotins be separated by about 5-10 bases and it is important that there is not a biotin too near the 3 prime terminus of the forward primer, as this could interfere with amplification efficiencies. The reverse primer was unmodified.

The probe was modified with a 5' amine and a space amine modification for coupling the microbeads, e.g., if the real-time PCR probe sequence is 5' FAM-ATCCGCGCATAG-TAM3' (SEQ ID NO: 23,189), the Luminex probe sequence becomes 5'/5AmMC12//iSp18//ATCCGCGCATAG-3'. (SEQ ID NO: 23,189)

A number of oligonucleotide synthesis parameter were optimized for the multiplex, Luminex based assays. First, all oligonucleotides were HPLC purified. A small percentage of probes produced were contaminated by free biotin molecules that are residuals from the primer production. This contamination can cause undesirable interference with the assay. To minimize this occurrence and improve quality control, we have requested that IDT includes a SA (streptavidin agarose) purification followed by sephadex filtration to remove any contamination. We have also found that impurities in the oligonucleotides (synthesis "artifacts"; buffer crystals, truncated products, etc) can also weaken assay performance. As a result we require purity to be a minimum of 85% to pass quality standards with less than 15% impurities. Quality control documentation; signed ESI Mass Spectrometry Trace and Capillary Electrophoresis Trace was required. Oligonucleotides were shipped as lyophilosized pellets and are then resuspended to their desired concentrations; primers in TE [Tris EDTA, pH 8] buffer and probes in 0.1M MES [ (2-{N-morpholino } ethanesulfonic acid)] buffer, pH 4.5. All oligonucleotides are stored in small aliquots at −20° C.

Covalent Coupling of Oligonucleotide Probes to COOH-microbeads:

Different sets of carboxylated fluorescent microbeads were obtained from Luminex Corp (Austin, Tex.), and probes for each assay were assigned to a unique bead set. Oligonucleotide probes, with sequences representing the reverse complement to target region of the forward strand (5'-3') were obtained from Integrated DNA Technologies (Coralville, Iowa). Each probe contained a C-18 spacer between the amine reactive group and the 5' end of the oligo to enable optimum hybridization. Probes for each of the pathogen targets were coupled according to the manufacturer recommended coupling protocol. Briefly, a homogenized 1 ml aliquot (1.25×10$^7$) of beads was centrifuged for 5 min at 13,000 rpm, and re-suspended in 50 ul of 100 mM 2[N-morpholino] ethanesulfonic acid (MES) buffer, pH 4.5. To this suspension, 10 ul of probe at a concentration of 50 μM was added followed by addition of 50 μg of 1-ethyl-3-[3-dimethylaminopropyl]-carbodiimide hydrochloride (EDC) (Pierce Biotechnology [CU1], Rockford, Ill.). This solution was incubated in the dark at room temperature for 30 minutes. A second aliquot of EDC (25 μg) was added and incubated as before. The beads were rinsed in 1 ml phosphate buffered saline (PBS) containing 0.02% Tween-20 (Sigma), centrifuged at 13,000 rpm for 5 min, rinsed using 1 ml of 0.1% (w/v) sodium dodecyl sulfate (SDS) in water, and centrifuged as before. The supernatant was aspirated and the conjugated beads were washed in 100 ul of TE (10 mM Tris, 1 mM EDTA, Ph 8.0 [Sigma]) and then re-suspended in 250 ul TE and stored in the dark at 4° C. Each probe/bead conjugate was stored separately, and a fresh bead set containing all conjugates was prepared for each liquid bead array assay.

TABLE 6

Modified forward primers for Luminex assay

| Pathogen-assay | SEQ ID NO: | Sequence |
| --- | --- | --- |
| BHV-1 | 23,190 | 5'-/5Bio/G/iBiodT/GCCAGCCGCG/iBiodT/AAAAG-3' |
| BHV-3 | 86 | 5'-/5Bio/TGAGGCC/iBiodT/ATGTATGGGCAG/iBiodT/T-3' |
| BPSV-1 | 87 | 5'-/5Bio/GCAGA/iBiodT/GCGCTCC/iBiodT/GGTT-3' |
| BPSV-2 | 88 | 5'-/5Bio/GATGGCCG/iBiodT/GCAGC/iBiodT/CTT-3' |
| BPSV-4 | 89 | 5'-/5Bio/GCAGCAG/iBiodT/GCACCACG/iBiodT/AGT-3' |
| BTV-2 | 90 | 5'-/5Bio/GCACCC/iBiodT/ATATGTT/iBiodT/CCAGACCA-3' |
| BTV-3 | 91 | 5'-/5Bio/AGAAT/iBiodT/CAGGA/iBiodT/GGGCAGGA-3' |
| BVD-1a(mod) | 92 | 5'-/5Bio/GGTAGTCG/iBiodT/CAGTGGT/iBiodT/CGAC-3' |
| FMDV.Pir | 93 | 5'-/5Bio/CAC YTY AAG R/iBiodT/G ACA YTG RTA C/iBiodT/G GTA C |
| FMDV.TC | 94 | 5'-/5Bio/ACTGGG/iBiodT/TTTACAAACC/iBiodT/GTGA-3' |
| SVD_1 | 95 | 5'-/5Bio/CAGGA/iBiodT/AATTTCT/iBiodT/CCAAGGGC-3' |
| SVD_2 | 96 | 5'-/5Bio/GACTTG/iBiodT/TGTGGC/iBiodT/GGAGGA-3' |
| SVD_3 | 97 | 5'-/5Bio/GACAAAG/iBiodT/GGCCAAGGGAAA-3' |
| VESV_1 | 98 | 5'-/5Bio/GCCT/iBiodT/CTCCCT/iBiodT/CCCAAAA-3' |
| VESV_3 | 99 | 5'-/5Bio/GGGAA/iBiodT/GAGGTGTGCA/iBiodT/CATT-3' |
| VESV_4 | 100 | 5'-/5Bio/GGTCGC/iBiodT/CTCACTGATGA/iBiodT/GAGTA-3' |
| VESV_5 | 101 | 5'-/5Bio/ACCACC/iBiodT/CTGGAAACATC/iBiodT/ATGG-3' |

Multiplexed PCR Amplification:

Each amplification reaction was performed in a total volume of 25 µl. The reaction mix consisted of 12.5 µl of 2× Superscript III RT-PCR reaction Mix (Invitrogen, Carlsbad, Calif.), 0.1 µl each of forward and reverse primers (each at a concentration of 100 µl), 1 µl per reaction of Superscript III/Platinum Taq Enzyme Mix, 0.95 µl of 50 mM MgSO$_4$ (Invitrogen, Carlsbad, Calif.), 1 µl of 100 copies/µl "Alien RNA" internal control template (Ambion, Austin, Tex.), 5 µl of template, and enough RNase-free water to bring final volume to 25 µl. The "Superscript III RT-PCR System" kit 2× reaction mix contains 0.4 mM of each dNTP and 3.2 mM MgSO$_4$ plus "proprietary stabilizers". With the addition of 0.95 ul of 50 mM MgSO$_4$, the final component concentrations in the 1× reaction mix were as follows: 0.2 mM each dNTP, 3.5 mM MgSO4, 1× Superscript III RT-PCR buffer, 0.4 µM of each primer, and 300 copies of Tobacco Mosaic Virus internal control template. The Platinum Taq polymerase used is a "Hot Start" Taq that is robust and is held by binding a thermolabile inhibitor containing monoclonal antibodies to Taq polymerase.

Thermocycling conditions were as follows: 30 min at 55° C., 2 min at 95° C., followed by 35 cycles of 15 sec at 94° C., 30 sec at 60° C., 15 sec at 72° C., and concluding with one cycle at 72° C. for 2 min followed by 4° C. soak.

Hybridization of Amplified Sample to the Bead:

A bead set was prepared, consisting of a mixture of 3 µl of beads each covalently coupled to a probe listed in Table 1 into a volume equal to 1 ml of Tris-NaCl buffer (100 mM Tris, 0.05% Triton X100, 200 mM NaCl pH 8.0). Amplified PCR reaction product, e.g., amplicon (1 µl) was added to 22 µl of the bead mix. PCR products and bead mix were denatured at 95° C. for 2 min and allowed to hybridize at 55° C. for 5 min. The mix was transferred to a 96 well filter plate (Millipore, Bedford, Mass.). The beads were washed twice in 100 µl Tris-NaCl and incubated with 60 µl of 3 ng/µl Streptavidin-phycoerythrin (SAPE) (Caltag Laboratories, Burlingame, Calif.) for 5 min The hybridized beads were washed again with 100 µl Tris-NaCl buffer and re-suspended in a final volume of 100 µl Tris-NaCl buffer. The completed sample was then introduced to the Luminex flow analyzer for analysis.

Example 6

Controls for the Multiplexed Liquid Format Assay

Controls that convey important diagnostic information regarding reagent addition, quality and concentration, assay operator performance, and instrument stability can be easily added without compromising or limiting the screening capabilities of an assay. The disclosed assays employ a unique set of four rationally-designed internal controls built into every sample that monitors and reports every step of the assay.

IC: Instrument Control: The purpose of this control is to inform the user of the reporter laser's integrity and utility. It is a bead coupled to BSA conjugated to tetramethylrhodamine (TAMRA), a heat stable fluorophore; it automatically fluoresces and generates a signal in the presence of the reporter laser. If one notices a decline in the signal, it is due to decline in the laser's integrity. Under those circumstances, one must contact BioRad (or Luminex Customer Support) for a service request. The laser's output is important to monitor because it has a finite lifespan. This control is generally the most robust.

FC: Fluorescence Control/SAPE Addition Control: As a fluorescent control, or SAPE addition control, biotinylated BSA (b-BSA) is coupled to one of the beads. The biotin molecule has a very high binding affinity for streptavidin (biotin-avidin binding) and the Phycoerythrin (PE) component of SAPE is what is detected by the reporter laser (same as the fluorophore bound directly to the bead for the IC). If one does not detect a signal on the FC, then it is likely that SAPE was not added.

NC: Negative Binding Control: The NC is a bead bound to a DNA sequence specific to a random sequence from the genome of an organism found at the bottom of the ocean (*Maritima maritensis*, Mt7). MT-7 is a conserved DNA sequence from a maritima organism (a thermal vent microbe) that does not match those of published genomes of terrestrial organisms, and serves as a non-specific binding control in the multiplex PCR assay. In the absence of non-specific binding, the MFI values for the NC MT-7 bead should remain consistently low.

PCR/RT-PCR PC: RNA Amplification Control/Inhibition Control: Alien armored RNA (arRNA Alien) is a synthetic RNA sequence, ~1000 nucleotides in length, packaged in an MS2 phage (protein capsid). The sequence is termed "alien" as it has no homology to currently annotated GenBank sequences. Packaging increases the stability of the RNA in clinical sample matrices and more closely mimics the behavior of target virus particles during processing. An internal control assay for alien armored RNA was incorporated into the multiplex PCR assay using specific primers and probe. Alien armored RNA is used as an end-to-end internal control for reverse transcription, PCR amplification, Luminex microsphere array hybridization and Bio-Plex detection.

The alien RNA concentration used is typically 200 copies per well, which consistently yields a median fluorescent intensity (MFI) value above the assay detection limit for both clean and clinical sample matrixes. A low number copy number for the internal control was selected to minimize competition within the PCR reaction with the agent signatures. A low copy number can also better reflect detrimental changes in assay performance that could potentially result in a false negative. MFI values below threshold may indicate failed reverse transcription and PCR amplification, or a failed hybridization reaction.

The controls used in the multiplexed liquid format assay are shown in the following table.

TABLE 7

Controls for multiplexed liquid format assay

| Control | Description | Sequence (5' => 3') | SEQ ID NO | Organism |
|---|---|---|---|---|
| Instrument Control | Luminex probe | 5'-/5AmMC6//iSp18/CAAAGTGGGAGACGTCGTTG-3'Cy3 | 102 | Maritima 7-Cy3 |

TABLE 7-continued

Controls for multiplexed liquid format assay

| Control | Description | Sequence (5' => 3') | SEQ ID NO | Organism |
|---|---|---|---|---|
| Fluorescence Control | Luminex probe | 5'-/5AmMC6//iSp18/CAAAG/iBiodT/GGGAGACGTCG/iBiodT/TG-3' | 103 | Maritima 7-biotin |
| Negative Control | Luminex probe | 5'-/5AmMC6//iSp18/CAAAGGGGAGACGTCGTTG-3' | 104 | Maritima 7 |
| PCR Amplification/ Inhibition Control | Forward primer | 5' GACATCAAGGCTCAAACTAATTTTACC 3' | 105 | n/a |
| PCR Amplification/ Inhibition Control | Reverse primer | 5' CAAAGGCTGCCAACATAAAATG 3' | 106 | n/a |
| PCR Amplification/ Inhibition Control | Luminex probe | 5'-/5AmMC6//iSp18/CAAGCGTAAATGCAGCGTCCA-3' | 107 | n/a |

The controls are used to verify the integrity of the assay. Control results are used to determine whether the results for a given sample are valid or not. Assay integrity is determined using the following processes:

First, for each sample, MFI values for the 4 control bead classes are checked against a corresponding threshold. The thresholds used for the panel are still being determined and cannot be established until the multiplexed assay panel development is complete (i.e., no additional signatures are added). In general, if MFI values for the IC, NC or FC controls are out of range then the results from that sample are deemed invalid and excluded from further analysis.

Second, if the MFI value of the alien armored RNA control is out of range AND none of the MFI values for the 17 agent channels exceed threshold, then the results from that sample are deemed invalid and excluded from further analysis. If the MFI for the alien armored RNA control is out of range AND one or more of the MFI values for the 17 agent channels exceeds threshold, then the results from that sample are deemed valid and included in further analysis. We have observed that agent spikes above certain concentrations can cause a decrease in the alien armored RNA MFI, probably due to competition in the PCR reaction. When the alien armored RNA MFI drops below threshold on a sample considered negative for all signatures, the analysis would be discarded and would need to be repeated. This control reduces the probability of false negatives.

Third, if the MFI values for all four controls are within range, bead counts are checked. First, the bead counts for each of the 4 controls are checked. If the bead count minimum (40 beads) for any of the 4 controls was not reached, then the control MFI values are deemed invalid, and all assay results for that sample are excluded from further analysis.

The final step is to check the individual bead count for each of the 17 signatures for a given sample (non-control beads). If an individual agent bead class (signature) does not reach the bead count minimum (40 beads), that individual assay result is deemed invalid and only that individual result for that signature is removed from the analysis. If the bead counts for any of the agent channels exceeded the minimum, they are considered valid and included in the analysis.

Figure 68:
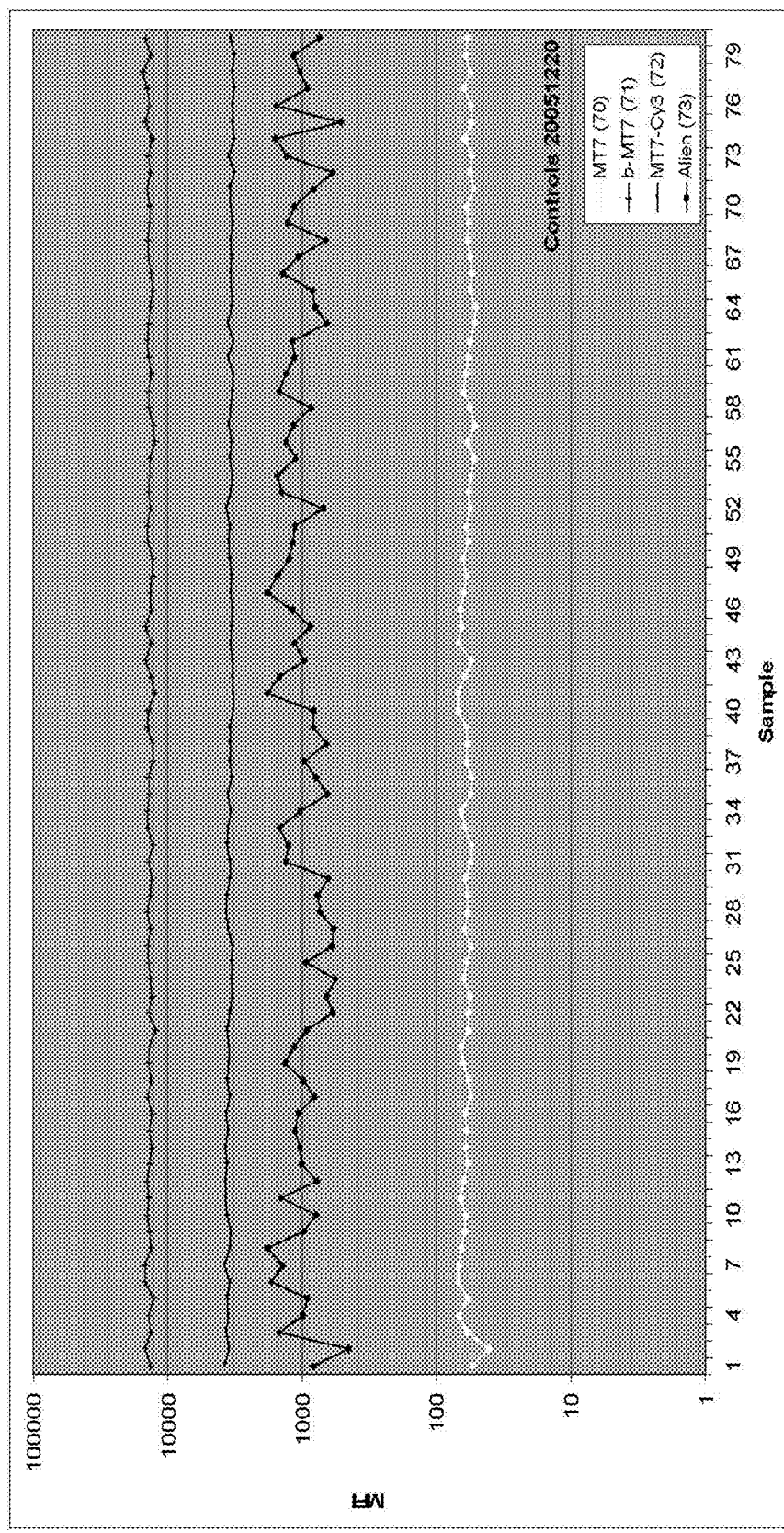
FIG. 68 a typical plot showing the MFI of four controls recorded in a multiplexed assay PCR assay across a microtiter plate (96-wells, 80 samples tested) and analyzed using a Luminex detector. The log of the median fluorescence intensity (MFI) is plotted on the Y-axis versus sample number shown on the X-axis. Each sample contains 4 internal controls. Controls should produce data that is constant form one sample to the next; therefore data in plots like this one should exhibit 4 straight lines. Fluctuations in MFI values for any of the 4 controls can indicate a problem with the assay. Additionally, each control is characterized by its inherent variation. Some controls produce data that is much less variable than others. The high deviation from point to point shown on this plot from the positive control Alien RNA is expected and normal.

A flow diagram of the process used to determine whether or not any individual assay result is valid or not is shown in FIG. 68.

Example 7

Limits of Detection

The panel of selected signature sequences was tested for the limit of detection (LOD) in both the single plex and multiplex format. The results are presented below.

TABLE 8

Limits of Detection (LOD)

| Assay ID | Target DNA | Reference Test Strain | Singleplex LOD | Multiplex LOD | LOD shift (logs) | Bkgrd SP | Bkgd Mux | Threshold (MFI) | Cross-reactivities with panel constituents |
|---|---|---|---|---|---|---|---|---|---|
| BVH_1 | Bovine Herpes Virus | BHV_N/A | 100 viral particles/uL | 100 viral particles/uL | 0 | 9 | 60 | 120 | None Noted |
| BVH_3 | Bovine Herpes Virus | BHV_N/A | 100 viral particles/uL | 100 viral particles/uL | 0 | 10 | 40 | 980 | None Noted |
| BPSV_1 | Bovine Papular Stomatitis Virus | BPSV_N/A | 1000 viral particles/uL | 100 viral particles/uL | −1 | 10 | 30 | 125 | None Noted |

TABLE 8-continued

Limits of Detection (LOD)

| Assay ID | Target DNA | Reference Test Strain | Singleplex LOD | Multiplex LOD | LOD shift (logs) | Bkgrd SP | Bkgd Mux | Threshold (MFI) | Cross-reactivities with panel constituents |
|---|---|---|---|---|---|---|---|---|---|
| BPSV_2 | Bovine Papular Stomatitis Virus | BPSV_N/A | 10 viral particles/uL | 10 viral particles/uL | 0 | 10 | 65 | 140 | Background cross-reactivity, not well defined |
| BPSV_4 | Bovine Papular Stomatitis Virus | BPSV_N/A | 100 viral particles/uL | 100 viral particles/uL | 0 | 10 | 35 | 600 | None Noted |
| FMDV.TC | Foot and Mouth Virus | 01 Manisa | $1 \times 10^{-8}$ pfu/ul | $1 \times 10^{-6}$ pfu/ul | 2 | 10 | 10 | 150 | None Noted |
| FMDV.Pir | Foot and Mouth Virus | 01 Manisa | $1 \times 10^{-4}$ pfu/ul | $1 \times 10^{-4}$ pfu/ul | 0 | 10 | 10 | 200 | None Noted |
| BVD_1a | Bovine Viral Diarrhea | BVD_N/A | 10 viral particles/uL | 10 viral particles/uL | 0 | 7 | 30 | 110 | None Noted |
| BTV_2 | Bluetongue Virus | BTV-13 | 1 viral particles/uL | 1 viral particles/uL | 0 | 11 | 30 | 90 | None Noted |
| BTV_3 | Bluetongue Virus | BTV-13 | 1 viral particles/uL | 10 viral particles/uL | 1 | 9 | 20 | 1000 | None Noted |
| SVD_1 | Swine Vesicular Disease | ITL/1/66 | $1 \times 10^{-6}$ pfu/ul | $1 \times 10^{-5}$ pfu/ul | 1 | 5 | 8 | 135 | None Noted |
| SVD_2 | Swine Vesicular Disease | ITL/1/66 | $1 \times 10^{-6}$ pfu/ul | $1 \times 10^{-4}$ pfu/ul | 2 | 10 | 10 | 150 | None Noted |
| SVD_3 | Swine Vesicular Disease | ITL/1/66 | $1 \times 10^{-5}$ pfu/ul | $1 \times 10^{-5}$ pfu/ul | 0 | 16 | 16 | 200 | None Noted |
| VESV_1 | Vesicular Exanthema of Swine Virus | E54[1]/A48[2] | $1 \times 10^{-6}$ pfu/ul | $1 \times 10^{-3}$ pfu/ul | N/A | 5 | 5 | 80 | None Noted |
| VESV_3 | Vesicular Exanthema of Swine Virus | A48[1]/A48[2] | $1 \times 10^{-6}$ pfu/ul | $1 \times 10^{-6}$ pfu/ul | N/A | 22 | 18 | 500 | None Noted |
| VESV_4 | Vesicular Exanthema of Swine Virus | E54[1]/A48[2] | $1 \times 10^{-6}$ pfu/ul | $1 \times 10^{-5}$ pfu/ul | N/A | 25 | 17 | 700 | None Noted |
| VESV_5 | Vesicular Exanthema of Swine Virus | A48[1]/A48[2] | $1 \times 10^{-6}$ pfu/ul | $1 \times 10^{-6}$ pfu/ul | N/A | 23 | 20 | 100 | None Noted |

Example 8

Disease Signature Thresholds

Thresholds were initially determined using all available data from known negative samples (blanks) by plotting a histogram that showed the probability of a given sample generating a particular MFI. In the absence of cross reactivity, each signature in the multiplex assay could be treated as an individual assay result. For example, for a sample spiked with BPSV virus, data for other disease signatures could contribute towards negative data, providing that cross reaction between disease signature sets was not observed. This is a way to increase the number of samples that can be used to establish thresholds.

To determine the degree of cross reactivity for each assay, the probability of obtaining a given MFI was plotted versus MFI for both true blank samples and spiked samples. Signatures intended to detect a virus-spiked sample were excluded from this analysis. Histograms generated from virus positive samples and true blank samples were not significantly different; the distributions indicated negligible cross reactivity. Using all negative sample data, a receiver operator characteristic (ROC) function describing the relationship between threshold values and the rate at which false positives occur was plotted. The threshold was determined from the ROC function by finding the MFI values that would yield a false positive at a given rate. A false positive rate of 0.002 was selected, which corresponds to 1 false positive every 500 samples. The resolution in false positive rate is determined by the number of samples that are present. For example to establish a false positive rate of 0.0001, or 1 false positive per 10,000 samples, a minimum of 10,000 samples are required.

The threshold values that were established for the assay controls and each signature in the multiplex assay panel are shown below. The BPSV-2 threshold was set at 400. The MFI value for a false positive rate of 0.002 was 730. This resulted in a sensitivity which was too low for the samples virus concentrations used.

TABLE 9

Threshold values for signature sequences

| Signature | Threshold (MFI) |
|---|---|
| BHV-1 | >49 |
| BHV-3 | >43 |
| BPSV-1 | >35 |
| BPSV-2* | >400 |
| BPSV-4 | >41 |
| FMDV-1 | >42 |
| FMDV-2 | >60 |
| BVD-1a | >40 |
| BTV-2 | >55 |
| BTV-3 | >31 |
| SVD-1 | >38 |
| SVD-2 | >28 |
| SVD-3 | >40 |
| VESV-1 | >24 |
| VESV-3 | >39 |
| VESV-4 | >105 |
| VESV-5 | >56 |

Example 9

Data from Multiplexed Luminex Assay

Figure 69B:
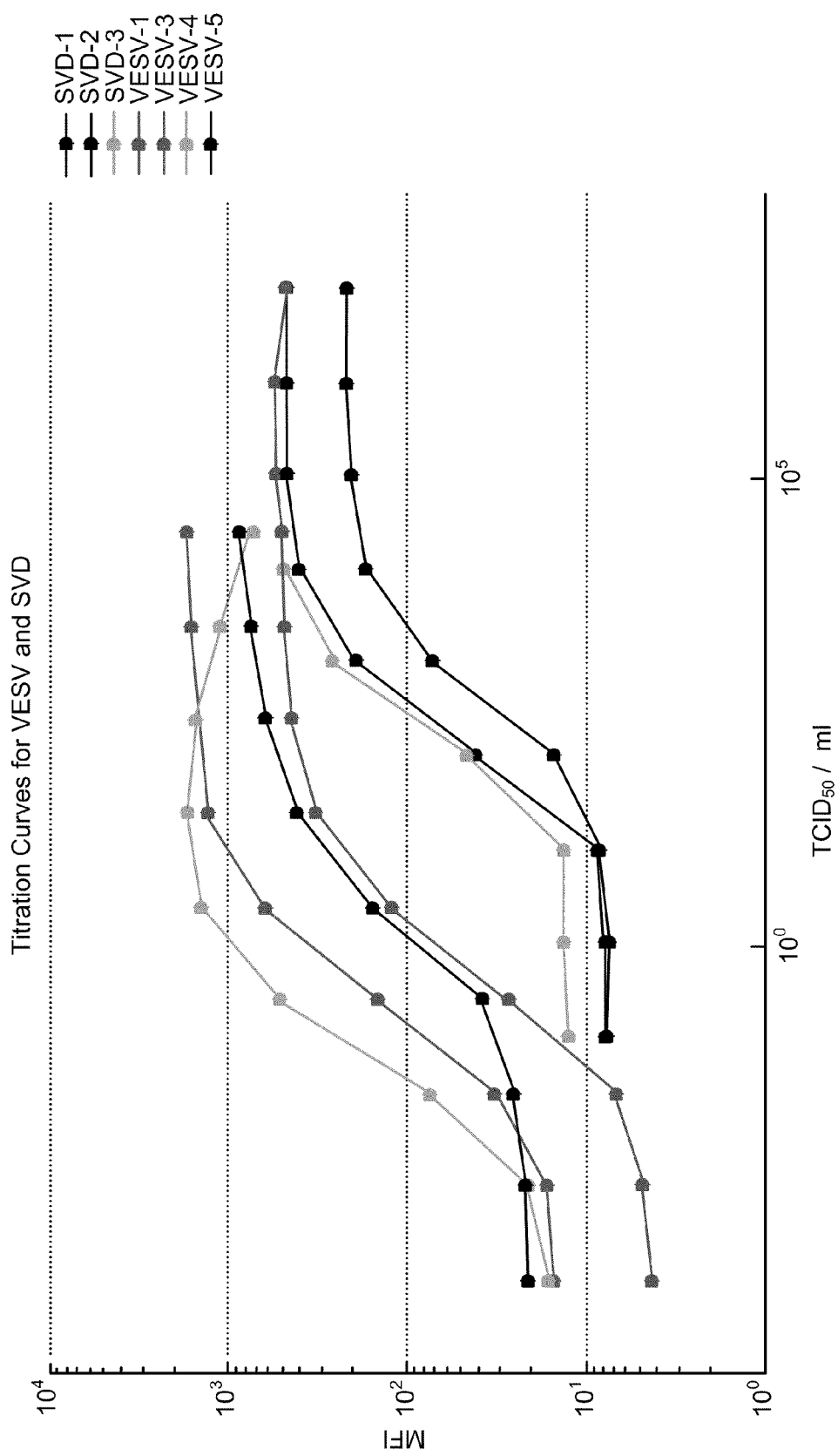
FIG. 69B: The curves combined herewith represent common viral extraction units (TCID50/mL) of representative strains for SVD and VESV.

FIG. 69 is plot of dose-response curves for select domestic and foreign animal diseases that constitute the FMDV rule-out panel as described in Table 1. The curves combined herewith represent common viral extraction units (pfu/mL) of representative strains for BHV, BPSV, BTV, BVDV and FMDV. The results demonstrate that the signature sequences described in Table 1 effectively detect and differentiate between multiple pathogens in a sample.

Example 10

Multiplexed Detection of Agricultural Pathogens Using a Microarray Approach

In another embodiment, the signature sequences used herein are used for detection of pathogens in a sample using a microarray, e.g., a microarray manufactured by Nimblegen Systems. Nimblegen builds its arrays based on photodeprotection chemistry using its proprietary Maskless Array Synthesizer (MAS) system. The Digital Micromirror Device, at the heart of the system, creates digital masks whose design can be easily changed. Up to 390,000 custom oligos can be synthesized onto glass slides within a few hours. To detect the agricultural pathogens, oligonucleotide probes of up to 70 bases long that are complementary to the signature sequences disclosed herein are designed using a set of probe design parameters. Due to the ultra high density, multiple probes from the same sequence can be included on the same chip with on-chip replicates, which increases the confidence in probe calls. A variety of techniques for probe design can be employed, ranging from non-overlapping (sampling) to overlapping (tiling) to the detection of Single Nucleotide Polymorphisms (resequencing, using short oligos.) The pathogen nucleic acid sample is amplified with fluorescently labeled random primers and the labeled DNA is hybridized to the chip. The chip is washed to get rid of non-specifically bound samples and scanned using a laser scanner at high resolution. The raw data and images are analyzed using statistical tools and presence/absence calls are made. Though not as sensitive as Taqman assays and bead assays, microarray allows the detection of presence or absence of multiple viruses simultaneously, and shortens the optimization time for multiplexing assays.

Example 11

Additional FMDV Signature Sequences

Using the in-silico identification techniques described herein, additional signature sequences for determining the presence or absence of FMDV in sample were determined as follows.

TABLE 10

Additional FMDV signature sequences

| SEQ ID NO: | Assay reference | SEQUENCE DESCRIPTION | SEQUENCE (5'->3') |
|---|---|---|---|
| 108 | FMDV-1261 | Signature sequence | CAAACCTGTGATGGCTTCGAAGACCCTCGAAGCTATCCTCTCCTTTGCACGCCGTGGGACCATTCAGGAGAAGTTGATCTNNNNNNNNNNNNNNNNNNNTCCACTCCGGACAAGACGAGTACCGGCGTCTCT |
| 109 | FMDV-1261 | Forward primer | CAAACCTGTGATGGCTTCGA |
| 110 | FMDV-1261 | Reverse primer | AGAGACGCCGGTACTCGTCTT |
| 111 | FMDV-1261 | Probe | TGCACGCCGTGGGACCATTC |
| 112 | FMDV-1261R | Signature sequence | AGAGACGCCGGTACTCGTCTTGTCCGGAGTGGANNNNNNNNNNNNNNNNNNNAGATCAACTTCTCCTGAATGGTCCCACGGCGTGCAAAGGAGAGGATAGCTTCGAGGGTCTTCGAAGCCATCACAGGTTTG |
| 113 | FMDV-1261R | Forward primer | AGAGACGCCGGTACTCGTCTT |
| 114 | FMDV-1261R | Reverse primer | CAAACCTGTGATGGCTTCGA |
| 115 | FMDV-1261R | Probe | TCCTGAATGGTCCCACGGCGT |
| 116 | FMDV-1674 | Signature sequence | CCAACGCAGGTAAAGTGATCTGTAGCTTGGAATCTCGAACGTCCNNNNNNNNNNNNNNNNNNNGACGCCGGTACTCGTCTTGTCCGG |

TABLE 10-continued

Additional FMDV signature sequences

| SEQ ID NO: | Assay reference | SEQUENCE DESCRIPTION | SEQUENCE (5'->3') |
|---|---|---|---|
| 117 | FMDV-1674 | Forward primer | AGTGGANNNNNNNNNNNNNNNNNNNNAGATCAACTTCTCCTGAAT GGTCCCACGGCGTGCAAAGGAGAGGATAGCTTCGAGG CCAACGCAGGTAAAGTGATCTG |
| 118 | FMDV-1674 | Reverse primer | AACCTGTGATGGCTTCGAAGAC |
| 119 | FMDV-1674 | Probe | TCCTGAATGGTCCCACGGCGT |
| 120 | FMDV-3238 | Signature sequence | AGCATCATCAACACAATTCTGAACAACATCTACGTGCTCTACG CGCTGCGTAGGCACTACGAGGGAGTTGAGCTGGACACTTACAC CATGATCTCCTACGGGGACGACATCGTGGTTGCAAGTGATTAC GATCTNNNNNNNNNNNNNNNNNNNNNNNNNNNNNNNNNNNNNNNN NNNNNNNNNNNNNNNNNNNNNNNNNNNNNNNNNNNNNNNNNNNN NNNNNGTCACTCCATTACCGATGTCACTTTCCTCAAAAGACAC TTCCACATGGATTATGGAACTGGGTTTTACAAACCTGTGATGG CTTCGAAGACCCTCGAAGCCATCCTCTCCTTTGCACGCCGTG |
| 121 | FMDV-3238 | Forward primer | AGCATCATCAACACAATTCTGAACA |
| 122 | FMDV-3238 | Reverse primer | CATCACAGGTTTGTAAAACCCAGTT |
| 123 | FMDV-3238 | Probe | CACTTTCCTCAAAAGACACTTCCACATGGATTATG |

The signature sequences disclosed in Table 9 are used, either individually or in combination with each other, in kits and methods disclosed herein for determining the presence or absence of FMDV in a sample by detection of the signature sequences. The kits and methods use the signature sequences disclosed in Table 9 alone or in combination with one or more additional signature sequences from FMDV and other agricultural pathogens, e.g., those disclosed in Table 1.

For detection of the signature sequences via amplification, primers suitable for PCR were designed and are disclosed in Table 9. The forward and reverse primers in Table 9 are used for PCR based detection of FMDV in a sample via detection of the signature sequences disclosed in Table 9 in the sample. Detection of the amplicon, e.g., the amplified signature sequence, is performed using an agarose gel.

For detection of signature sequences using real-time PCR, probes suitable for Taqman PCR were designed and are disclosed in Table 9. The primers and probes in Table 9 are used for Taqman PCR based detection of FMDV in a sample via detection of the signature sequences disclosed in Table 9 in a sample. Detection of the amplicon, e.g., the amplified signature sequence, is performed using an iCycler.

The primers and probes are also used for Luminex based detection of the signature sequences in Table 9. Probes are covalently attached to fluorescent microbeads and hybridized to samples subjected to PCR using the disclosed primers.

Example 12

Additional Bovine and Porcine Signature Sequences

Using the in-silico identification techniques described herein, additional signature sequences for determining the presence or absence of FMDV, PRRS, SVD, VESV, VSV, OvHV-2/AHV1, BHV, PPDX, FMDV, BVD, BTV, and/or RPV in a sample were determined using the methods and techniques described above and as follows.

The signature sequences disclosed in Tables 11 and 12 are used, either individually or in combination with each other, in kits and methods disclosed herein for determining the presence or absence of FMDV, PRRS, SVD, VESV, VSV, OvHV-2/AHV1, BHV, PPDX, FMDV, BVD, BTV, and/or RPV in a sample by detection of the signature sequences. The kits and methods use the signature sequences disclosed in Tables 11 and 12 alone or in combination with one or more additional signature sequences from other agricultural pathogens, e.g., those disclosed in Tables 1, 10, and others as described herein.

For detection of the signature sequences via amplification, primers suitable for PCR were designed and are disclosed in Tables 11 and 12. The forward and reverse primers in Tables 11 and 12 are used for PCR based detection of FMDV, PRRS, SVD, VESV, VSV, OvHV-2/AHV1, BHV, PPDX, FMDV, BVD, BTV, and/or RPV in a sample via detection of the signature sequences disclosed in Tables 11 and 12 in the sample. Detection of the amplicon, e.g., the amplified signature sequence, is performed using an agarose gel.

For detection of signature sequences using real-time PCR, probes suitable for Taqman PCR were designed and are disclosed in Tables 11 and 12. The primers and probes in Tables 11 and 12 are used for Taqman PCR based detection of FMDV, PRRS, SVD, VESV, VSV, OvHV-2/AHV1, BHV, PPDX, FMDV, BVD, BTV, and/or RPV in a sample via detection of the signature sequences disclosed in Tables 11 and 12 in a sample. Detection of the amplicon, e.g., the amplified signature sequence, is performed using an iCycler.

The primers and probes are also used for Luminex based detection of the signature sequences in Tables 11 and 12. Probes are covalently attached to fluorescent microbeads and hybridized to samples subjected to PCR using the disclosed primers.

TABLE 11

Porcine Panel

| organism Assay ID | Forward Primer Reverse Primer Luminex Probe | Amplicon sequence Reference genome Amplicon size |
|---|---|---|
| FMDV FMDV.TC | ACTGGGTTTTACAAACCTGTGA (SEQ ID NO: 126) | ACTGGGTTTTACAAACCTGTG ATGGCCTCAAAGACCCTTGAG GCTATCCTCTCCTTTGCACGCC GTGGGACCATACAGGAGAAGT TGATCTCCGTGGCAGGACTCGC (SEQ ID NO: 129) |
| | GCGAGTCCTGCCACGGA (SEQ ID NO: 127) | ref\|NC_004915.1\|gnl\|NCBI_GENOMES\| 17191\|gi\|32188257\|Foot-and-mouth disease virus Asia 1, complete genome\|kpath_id\|1129999 |
| | GTCCCACGGCGTGCAAAGGA (SEQ ID NO: 128) | 107 |
| FMDV FMDV.Pir | CACYTYAAGRTGACAYTGRTACT GGTAC (SEQ ID NO: 130) | CACTTTAAGGTGACACTGATA CTGGTACTCAAACACTGGTGA CAGGCTAAGGATGCCCTTCAG GTACCCCGAGGTAACACGCGA CACTCGGGATCTG (SEQ ID NO: 133) |
| | CAGATYCCRAGTGWCICITGTTA (SEQ ID NO: 131) | ref\|NC_011450.1\|gnl\|NCBI_GENOMES\| 17687\|gi\|48429536\|Foot-and-mouth disease virus A, complete genome\|kpath_id\|1130015 |
| | CCTCGGGGTACCTGAAGGGCATCC (SEQ ID NO: 132) | 97 |
| PRRS PRRS_1807709 | GAGCGGCAATTGTGTCTGTC (SEQ ID NO: 134) | GAGCGGCAATTGTGTCTGTCG TCAATCCAGACCGCCTTTAAT CAAGGCGCTGGGACTTGCACC CTGTCAGATTCAGGGAGGATA AGTTACACTGTGGAGTTTAGT TTGCCTACGCATCATACTGTG CGCCTGATCCGCGTCACAGCA TCACCCTCAGC (SEQ ID NO: 137) |
| | GCTGAGGGTGATGCTGTGAC (SEQ ID NO: 135) | ref\|NC_001961.1\|gi\|9630807\|gnl\|NCBI_GENOMES\| 14001\|Porcine respiratory and reproductive syndrome virus, complete genome\|kpath_id\|1150959 |
| | CGCACAGTATGATGCGTAGGCAAA CTAAACTC (SEQ ID NO: 136) | 158 |
| PRRS PRRS_1810351 | TTCTTGTGACCACGATTCGC (SEQ ID NO: 138) | TTCTTGTGACCACGATTCGCC GGAATGTCATGCTGAGCTTTT GGCTCTTGAGCAGCGCCAACT TTGGGAACCTGTGCGCGGCCT TGTGGTTGGCCCCTCAGGTCT CTTATGTGTCATCCTTGGCAA GTTACTCGGTGGGTC (SEQ ID NO: 141) |
| | GACCCACCGAGTAACTTGCC (SEQ ID NO: 139) | gb\|DQ489311.1\|gi\|99082872\|Porcine reproductive and respiratory syndrome virus strain SD01-08, complete genome\|kpath_id\|889562 |
| | GCTCAAGAGCCAAAAGCTCAGCA TGACA (SEQ ID NO: 140) | 141 |
| PRRS PRRS_1807706 | ATTGGTTTGCTCCGCGATAC (SEQ ID NO: 142) | ATTGGTTTGCTCCGCGATACTC CGTACGCGCCCTGCCATTCAC TCTGAGCAATTACAGAAGATC TTATGAGGCCTTTCTTTCCCAG TGCCAAGTGGACATTCCCACC TGGGGAACTAAACATCCTTTG GGGATGCTTTGGCACCATAAG GTGTCAACCTTGATAGATGAA ATGGTGTCGCGTCGAATGTAC CGCATCATGGAAAAATCAGGG CAGGCTGCCTGGAAACAGGTG GTGAGCGAGGCTACACTGTCT |

TABLE 11-continued

Porcine Panel

| organism Assay ID | Forward Primer Reverse Primer Luminex Probe | Amplicon sequence Reference genome Amplicon size |
|---|---|---|
| | AAATGAGCCACCACATCCAA (SEQ ID NO: 143) CGGTACATTCGACGCGACACCATT TC (SEQ ID NO: 144) | CGCATTAGTAGTTTGGATGTG GTGGCTCATTT (SEQ ID NO: 145) ref\|NC_001961.1\|gi\|9630807\|gnl\|NCBI_GENOMES\| 14001\|Porcine respiratory and reproductive syndrome virus, complete genome\|kpath_id\|1150959 286 |
| PRRS PRRS_1810383 | CAGTGTGCACGCTTCCATTT (SEQ ID NO: 146) CTCGAATGATGTGTTGCCGT (SEQ ID NO: 147) AAACATAGCGTAGAGCTGGAATT CGAAGCCA (SEQ ID NO: 148) | CAGTGTGCATGCTTCCATTTTT TCCTCTGTGGCTTCATCTGTTA CCTTGTTCATAGTGCTTTGGCT GCGAATTCCAGCTCTACGCTA TGTTTTTGGTTTCCATTGGCCC ACGGCAACACATCATTCGAG (SEQ ID NO: 149) gb\|DQ489311.1\|gi\|99082872\|Porcine reproductive and respiratory syndrome virus strain SD01-08, complete genome\|kpath_id\|889562 129 |
| PRRS PRRS_1810386 | GCTTTCTGCGTGCCTTTTCT (SEQ ID NO: 150) ACAACGCCAGAGACATTCCC (SEQ ID NO: 151) TGACTTTGAAGCCTTTCTCGCTCA TTTCTGA (SEQ ID NO: 152) | GCTTTCTGCGTGCCTTTTCCAC GCCTCAGAAATGAGCGAGAA AGGCTTCAAAGTTATCTTTGG GAATGTCTCTGGCGTTGT (SEQ ID NO: 153) gi\|112821997\|gb\|DQ864705.1\| Porcine respiratory and reproductive syndrome virus strain 01CB1, complete genome\|kpath_id\|788611 81 |
| SVD SVD_1727049 | CAGGATAATTTCTTCCAAGGGC (SEQ ID NO: 154) ACGTGAACATTTCGAGCTTCC (SEQ ID NO: 155) TGCATTGTGTCTGATGGTACAACT TGTGACG (SEQ ID NO: 156) | CAGGATAATTTCTTCCAAGGG CCCCCAGGAGAGGTGATGGAA AGAGCCATTGCCCGCGTCGCT GATACTACTGGGAGCGGACCA GTTAACTCGGAATCCATTCCA GCTCTAACCGCCGCAGAGACA GGGCACACGTCACAAGTTGTA CCATCAGACACAATGCAAACT AGGCACGTGAAGAATTACCAT TCAAGGTCAGAGTCGACAGTG GAGAACTTCCTGTGCAGATCT GCATGCGTTTTCTACACCACA TACAAGAACCATGACTCTGAT GGCGACAACTTCGCCTACTGG GTGATCAACACACGGCAAGTT GCTCAACTGCGTCGGAAGCTC GAAATGTTCACGT (SEQ ID NO: 157) gi\|402536\|dbj\|D16364.1\|SVDMPS Swine vesicular disease virus gene for polyprotein, complete cds\|kpath_id\|62762 349 |
| SVD SVD_1727050 | GACTTGTTGTGGCTGGAGGA (SEQ ID NO: 158) | GACTTGTTGTGGCTGGAGGAC GATGCCATGGAGCAAGGAGTT AGGGATTATGTGGAACAACTC GGCAATGCCTTCGGCTCAGGA TTCACCAATCAAATTTGCGAA CAGGTTACCCTTCTAAAAGAG TCGTTAATTGGACAGGATTCT GTCCTTGAGAAGTCTCTCAAG |

TABLE 11-continued

| Porcine Panel | | |
|---|---|---|
| organism<br>Assay ID | Forward Primer<br>Reverse Primer<br>Luminex Probe | Amplicon sequence<br>Reference genome<br>Amplicon size |
| | | GCCCTCGTCAAGATAGTATCA<br>GCACTCGTGATCGTGGTGAGA<br>AATCACGATGACCTCATTACG<br>GTCACCGCCACACTGGCGTTA<br>ATAGGATGTACTACCTCACCA<br>TGGCGCTG<br>(SEQ ID NO: 161) |
| | CAGCGCCATGGTGAGGTAG<br>(SEQ ID NO: 159) | gi\|402536\|dbj\|D16364.1\|SVDMPS<br>Swine vesicular disease virus gene for polyprotein, complete cds\|kpath_id\|62762 |
| | TGACCGTAATGAGGTCATCGTGATTTCTCAC<br>(SEQ ID NO: 160) | 281 |
| SVD<br>SVD_1727051 | GACAAAGTGGCCAAGGGAAA<br>(SEQ ID NO: 162) | GACAAAGTGGCCAAGGGAAA<br>GTCCAGGCTCATCGAGGCTTC<br>TAGCCTCAACGACTCAGTGGC<br>AATGAGGCAGACATTTGGAAA<br>CCTATATAAGACTTTCCACCTC<br>AACCCGGGCATCGTTACGGGT<br>AGCGCCGTTGGGTGTGACCCA<br>GATGTCTTTTGGAGCAAGATC<br>CCCGTCATGCTCGATGGACAT<br>CTCATAGCGTTTGACTATTCA<br>GGCTATGACGCCAGCCTCAGC<br>CCAGTGTGGTTTACGTG<br>(SEQ ID NO: 165) |
| | CACGTAAACCACACTGGGCT<br>(SEQ ID NO: 163) | gi\|402536\|dbj\|D16364.1\|SVDMPS<br>Swine vesicular disease virus gene for polyprotein, complete cds\|kpath_id\|62762 |
| | CTGGCGTCATAGCCTGAATAGTCAAACGCTA<br>(SEQ ID NO: 164) | 248 |
| VESV<br>VESV_95653.F,<br>VESV_95654.R,<br>VESV_95655.P | GCCTTCTCCCTTCCCAAAA<br>(SEQ ID NO: 166) | GCCTTCTCCCTTCCCAAAACG<br>GACGGACCCACCGGAAACGA<br>ACCCGAATTCATCGCTGAGGC<br>TTGCCCTAGCTGCGCTCTTTAC<br>GACACGTGTCCAAATTGCACA<br>TCTAAGGTTATCAACGATGAT<br>GGCTCAACTGACGGAACCATT<br>CCTTCA<br>(SEQ ID NO: 169) |
| | TGAAGGAATGGTTCCGTCAGT<br>(SEQ ID NO: 167) | ref\|NC_002551.1\|gnl\|NCBI_GENOMES\|15509\|gi\|10314005\|Vesicular exanthema of swine virus, complete genome\|kpath_id\|888158 |
| | CATCATCGTTGATAACCTTAGATGTGCAATTTGG<br>(SEQ ID NO: 168) | 153 |
| VESV<br>VESV_95686.F,<br>VESV_95687.R,<br>VESV_95688.P | GGTCGCTCTCACTGATGATGAGTA<br>(SEQ ID NO: 170) | GGTCGCTCTCACTGATGATGA<br>GTACAATGATTGGAAACAGTC<br>CAAAGCTGAAAAAAACCTCGA<br>CCTCACGGTCAAGGACTTCCT<br>CCAACTCAGGCACCGAGCTGC<br>AATGGGTGCTGATAACACC<br>(SEQ ID NO: 173) |
| | GGTGTTATCAGCACCCATTGC<br>(SEQ ID NO: 171) | ref\|NC_002551.1\|gnl\|NCBI_GENOMES\|15509\|gi\|10314005\|Vesicular exanthema of swine virus, complete genome\|kpath_id\|888158 |
| | GCTCGGTGCCTGAGTTGGAGGAAG<br>(SEQ ID NO: 172) | 124 |
| VESV<br>VESV_95692.F,<br>VESV_95693.R,<br>VESV_95694.P | ACCACCTCTGGAAACATCTATGG<br>(SEQ ID NO: 174) | ACCACCTCTGGAAACATCTAT<br>GGAGCCTGCGGCTCATCGTGT<br>TCACTGACGAGACAGGGTGAC<br>TGCGGTCTCCCCTACGTCGAC<br>GATCACGGTGTTGTCGTTGGA<br>CTCCATGCTGGGTCTGGTGGT<br>GACAAATGCCCGTCCCGAAAA |

TABLE 11-continued

| | | Porcine Panel | |
|---|---|---|---|
| organism Assay ID | Forward Primer Reverse Primer Luminex Probe | Amplicon sequence Reference genome Amplicon size | |

| organism Assay ID | Forward Primer / Reverse Primer / Luminex Probe | Amplicon sequence / Reference genome / Amplicon size |
|---|---|---|
| | | CTCATTGTTCCCTACGTCAAG GTGGATATGAGAATTCGTGAC ACGTGCACAAA (SEQ ID NO: 177) |
| | TTTGTGCACGTGTCACGAAT (SEQ ID NO: 175) | ref\|NC_002551.1\|gnl\|NCBI_GENOMES\| 15509\|gi\|10314005\|Vesicular exanthema of swine virus, complete |
| | CGGGACGGGCAT

TABLE 11-continued

Porcine Panel

| organism Assay ID | Forward Primer Reverse Primer Luminex Probe | Amplicon sequence Reference genome Amplicon size |
|---|---|---|
| VSV VSV_1811405 | AAGAGATGGTCACGAGTGAC (SEQ ID NO: 194) | AAGAGATGGTCACGAGTGACT TGTGTCACCAATGACCAAATA CCCACTTGTGCTAATATAATG AGCTCAGTTTCCACAAATGCTC (SEQ ID NO: 197) |
| | GAGCATTTGTGGAAACCGAGC (SEQ ID NO: 195) | ref\|NC_001560.1\|gnl\|NCBI_GENOMES\| 10405\|gi\|9627229\|Vesicular stomatitis Indiana virus, complete genome\|kpath_id\|1100794 |
| | TGGGTATTTGGTCATTGGTGACACA (SEQ ID NO: 196) | 85 |
| VSV VSV_1811408 | CTCACAACATGGGTCCTGAA (SEQ ID NO: 198) | CTCACAACATGGGTCCTGAAT AGGGAAGTTGCAGACGAGCTA TGCCAGATGATGTATCCGGGT CAAGAA (SEQ ID NO: 201) |
| | TTCTTGACCTGGATACATCAT (SEQ ID NO: 199) | ref\|NC_001560.1\|gnl\|NCBI_GENOMES\| 10405\|gi\|9627229\|Vesicular stomatitis Indiana virus, complete genome\|kpath_id\|1100794 |
| | GGCATAGYTCGTCTGCRACTTCCCT (SEQ ID NO: 200) | 69 |
| Maritima N/A | NT NT CAAAGTGGGAGACGTCGTTG (SEQ ID NO: 202) | Probe only |
| Maritima N/A | NT NT CAAAGTGGGAGACGTCGTTG (SEQ ID NO: 203) | Probe only |
| N/A N/A | NT NT CAAAGTGGGAGACGTCGTTG (SEQ ID NO: 204) | Probe only |
| None Alien RNA | GACATCAAGGCTCAAACTAATTTT ACC (SEQ ID NO: 205) CAAAGGCTGCCAACATAAAATG (SEQ ID NO: 206) CAAGCGTAAATGCAGCGTCCA (SEQ ID NO: 207) | Proprietary |

TABLE 12

Bovine Panel

| organism Assay ID | Forward Primer Reverse Primer Luminex Proble | Amplicon sequence Reference genome Amplicon size |
|---|---|---|
| MCF emcf_94975.F, emcf_94976.R, emcf_94977.P | ATGCCAGTCACTGGCTCTCA (SEQ ID NO: 208) | ATGCCAGTCACTGGCTCTCAAG AGGGGTACCAGGGTGCCACCG TGATCAACCCCATTTCAGGATT CTACAACACCC (SEQ ID NO: 211) |
| | GGGTGTTGTAGAATCCTGAAATGG (SEQ ID NO: 209) | ref\|NC_002531.1\|gnl\|NCBI_GENOMES\| 15497\|gi\|10140926\|Alcelaphine herpesvirus 1, complete genome\|kpath_id\|881213 |
| | GTTGATCACGGTGGCACCCTGG (SEQ ID NO: 210) | 76 |

TABLE 12-continued

Bovine Panel

| organism Assay ID | Forward Primer Reverse Primer Luminex Proble | Amplicon sequence Reference genome Amplicon size |
|---|---|---|
| MCF emcf_95059.F, emcf_95060.R, | GTTCTGGAAACTGACCAAACAGT GT (SEQ ID NO: 212) | GTTCTGGAAACTGACCAAACAG TGTTCTTATGTGCACTTATTTTGT ATTTCCCTTATGCCTGCCAGAGT GCTCAATAAAAGTTACACTCAA GTGCCACT (SEQ ID NO: 215) |
| emcf_95061.P | AGTGGCACTTGAGTGTAACTTTT ATTG (SEQ ID NO: 213) GCACTCTGGCAGGCATAAGGGAA ATACA (SEQ ID NO: 214) | ref\|NC_002531.1\|gnl\|NCBI_GENOMES\| 15497\|gi\|10140926\|Alcelaphine herpesvirus 1, complete genome\|kpath_id\|881213 99 |
| MCF emcf_95155.F, emcf_95156R, emcf_95157.P | CCCTGGAAGCTGTCATACAAAA (SEQ ID NO: 216) | CCCTGGAAGCTGTCATACAAA AAGCTTTCCTGCCAGGAGACCC AGCTGAGGCTCTAAACAGTAG CCAGTTTTGTGAGACAACTGCA GCCCTGGACTCTACTGCACCTT GCAAGATATGCCAATGTTT (SEQ ID NO: 219) |
| | AAACATTGGCATATCTTGCAAGGT (SEQ ID NO: 217) CAGTAGAGTCCAGGGCTGCAGTT GTCTCA (SEQ ID NO: 218) | ref\|NC_002531.1\|gnl\|NCBI_GENOMES\| 15497\|gi\|10140926\|Alcelaphine herpesvirus 1, complete genome\|kpath_id\|881213 127 |
| BHV BVH_94666.F, BVH_94667.R, BVH_94668.P | GTGCCAGCCGCGTAAAAG (SEQ ID NO: 220) | GTGCCAGCCGCGTAAAAGCGG CGCTCCATGTTAGCGCTCTGGA ACCAGGAGACGTCGCAGCGCA GGTTGGGCGGGTGGGCGGTTG GCGTCGCGTCCTCGAGCGTAAG GACGGACGTGCGCGAAAAGAG CCCGGAGTCGTC) (SEQ ID NO: 223) |
| | GACGACTCCGGGCTCTTTT (SEQ ID NO: 221) TCCTGGTTCCAGAGCGCTAACAT GGAG (SEQ ID NO: 222) | ref\|NC_001847.1\|gnl\|NCBI_GENOMES\| 12918\|gi\|9629818\|Bovine herpesvirus 1, complete genome\|kpath_id\|1109875 140 |
| BHV BVH_94738.F, BVH_94739.R, BVH94740.P | TGAGGCCTATGTATGGGCAGTT (SEQ ID NO: 224) | TGAGGCCTATGTATGGGCAGTT CGGGTGCCAATAATAAATTTTG CGCGAATCTTATTTAAGTGCAC ACCGTGTTATTTGCGGCTGTTT GTTTTTCTTGGAGGCGGGACGT GCGCGCGAGCTCGGCCGGATT AGGGTTCGGCGCCACCCGGGC ACGGCAGGGCGCCCTTTACTTA TGTTTGGCGCGC (SEQ ID NO: 227) |
| | GCGCGCCAAACATAAGTAAA (SEQ ID NO: 225) AAATAACACGGTGTGCACTTAAA TAAGATTCGCG (SEQ ID NO: 226) | ref\|NC_001847.1\|gnl\|NCBI_GENOMES\| 12918\|gi\|9629818\|Bovine herpesvirus 1, complete genome\|kpath_id\|1109875 186 |
| BPSV BPSV_95719.F, BPSV_95720.R, BPSV_95721.P | GCAGATGCGCTCCTGGTT (SEQ ID NO: 228) | GCAGATGCGCTCCTGGTTCTGG CAGAACACCGAGTCTTCGATG ATCAACACTCTCCTGCTCCCGG CCGACCGCATGATGGCCATGG CCCGGATGAGCCTCTTCTTCGA GCCCCGGATGGACATGGACCG GAGCACGTTCTCCACGTCGGAG |

TABLE 12-continued

Bovine Panel

| organism Assay ID | Forward Primer Reverse Primer Luminex Proble | Amplicon sequence Reference genome Amplicon size |
|---|---|---|
| | GCACCTCTGCTGCTGCAA (SEQ ID NO: 229) CCGACTCCGACGTGGAGAACGTG (SEQ ID NO: 230) | TCGGACACGTTGCAGCAGCAG AGGTGC (SEQ ID NO: 231) ref\|NC_005337.1\|gnl\|NCBI_GENOMES\| 17541\|gi\|41057437\|Bovine papular stomatitis virus, complete genome\|kpath_id\|879465 178 |
| BPSV BPSV_95722.F, BPSV_95723.R, BPSV_95724.P | GATGGCCGTGCAGCTCTT (SEQ ID NO: 232) CGTACAAGATCACGGCCAACT (SEQ ID NO: 233) TGTACGGGCTCATGGGCTTCCG (SEQ ID NO: 234) | GATGGCCGTGCAGCTCTTGGCG GAGGCGTACGAGAAGAGCGCG CTGTTCCGGAAGCCCATGAGCC CGTACACGGAGTTGGCCGTGAT CTTGTACG (SEQ ID NO: 235) ref\|NC_005337.1\|gnl\|NCBI_GENOMES\| 17541\|gi\|41057437\|Bovine papular stomatitis virus, complete genome\|kpath_id\|879465 95 |
| BPSV BPSV_95731.F, BPSV_95732.R, BPSV_95733.P | GCAGCAGTGCACCACGTAGT (SEQ ID NO: 236) CGCTGAACCCGTACATCCT (SEQ ID NO: 237) GACTTCGAGGCGGACAACAAGCG (SEQ ID NO: 238) | GCAGCAGTGCACCACGTAGTA CCCGGCGGTGGCGCGCAGACG CTTGTTGTCCGCCTCGAAGTCG GCCTCCAGGCCCTCGTTGAAGT ACTTGTCGAAGATGATGGGCA GGAAGGAGAGCTTGGACTCGG TGACCACCTTCCCGAAGTTGAG GATGTACGGGTTCAGCG (SEQ ID NO: 239) ref\|NC_005337.1\|gnl\|NCBI_GENOMES\| 17541\|gi\|41057437\|Bovine papular stomatitis virus, complete genome\|kpath_id\|879465 167 |
| FMDV FMDV.TC | ACTGGGTTTTACAAACCTGTGA (SEQ ID NO: 240) GCGAGTCCTGCCACGGA (SEQ ID NO: 241) GTCCCACGGCGTGCAAAGGA (SEQ ID NO: 242) | ACTGGGTTTTACAAACCTGTGA TGGCCTCAAAGACCCTTGAGGC TATCCTCTCCTTTGCACGCCGT GGGACCATACAGGAGAAGTTG ATCTCCGTGGCAGGACTCGC (SEQ ID NO: 243) ref\|NC_011450.1\|gnl\|NCBI_GENOMES\| 17687\|gi\|48429536\|Foot-and- mouth disease virus A, complete genome\|kpath_id\|1130015 107 |
| FMDV FMDV.Pir | CACYTYAAGRTGACAYTGRTACT GGTAC (SEQ ID NO: 244) CAGATYCCRAGTGWCICITGTTA (SEQ ID NO: 245) CCTCGGGGTACCTGAAGGGCATCC (SEQ ID NO: 246) | CACTTTAAGGTGACACTGATAC TGGTACTCAAACACTGGTGACA GGCTAAGGATGCCCTTCAGGTA CCCCGAGGTAACACGCGACACT CGGGATCTG (SEQ ID NO: 247) ref\|NC_004915.1\|gnl\|NCBI_GENOMES\| 17191\|gi\|32188257\|Foot-and- mouth disease virus Asia 1, complete genome\|kpath_id\|1129999 97 |
| BVD BVD_1a | GGTAGTCGTCAGTG)GTTCGAC (SEQ ID NO: 248) | GGTAGTCGTCAGTGGTTCGACG CCTTGGAATAAAGGTCTCGAG ATGCCACGTGGACGAGGGCAT GCCCAAAGCACATCTTAACCTG AGCGGGGGTCGCCCAGGTAAA AGCAGTTTTAACCGACTGTTAC GAATACAGCCTGATAGGGTGC TGCAGAGGCCCACTGTATTGCT |

TABLE 12-continued

Bovine Panel

| organism Assay ID | Forward Primer Reverse Primer Luminex Proble | Amplicon sequence Reference genome Amplicon size |
|---|---|---|
| | CATGTGCCATGTACAGCAGAGAT (SEQ ID NO: 249) CCTCGTCCACGTGGCATCTCGAG (SEQ ID NO: 250) | ACTAAAAATCTCTGCTGTACAT GGCACATG (SEQ ID NO: 251) ref\|NC_001461.1\|gnl\|NCBI_GENOMES\| 10192\|gi\|9626649\|Bovine viral diarrhea virus 1, complete genome\|kpath_id\|963464 202 |
| BVD BVD_1821165.F, BVD_1821164.R, BVD_1821166.P | GGGAGTCGTCAATGGTTCGAC (SEQ ID NO: 252) TCCATGTGCCATGTACAGCAGAG (SEQ ID NO: 253) CCTCGTCCACITGGCATCTCGAG (SEQ ID NO: 254) | GGGAGTCGTCAATGGTTCGAC ACTCCATTAGTCGAGGAGTCTC GAGATGCCATGTGGACGAGGG CATGCCCACGGCACATCTTAAC CCACGCGGGGGTTGCATGGGT GAAAGCGCTATTCGTGGCGTTA TGGACACAGCCTGATAGGGTG TAGCAGAGACCTGCTATTCCGC TAGTAAAAACTCTGCTGTACAT GGCACATGGA (SEQ ID NO: 255) ref\|NC_002032.1\|gnl\|NCBI_GENOMES\| 12254\|gi\|9629506\|Bovine viral diarrhea virus genotype 2, complete genome\|kpath_id\|885447 204 |
| BTV BTV10_1810207 | GCACCCTATATGTTTCCAGACCA (SEQ ID NO: 256) CAGCTAACTCTTCAGCCACACG (SEQ ID NO: 257) CTAACTCGTGGGCCAATCATCAT CTTCTGT (SEQ ID NO: 258) | GCACCCTATATGTTTCCAGACC AAAATTTGTCTCCGCAGTTCTA TATACAGAAGATGATGATTGG CCCACGAGTTAGCTCACGAGTG CGGAATTCTTATGTTGATCGAA TTGATGTGATATTAAGAAAGG ATGTCGTAATGCGAGGTTTTAT TACTGCCAATACGATTCTGAAC GTAATTGAAAAATTAGGGACT AATCACTCAGTGGGAGATCTG GTTACGGTCTTCACGCTTATGA ATATCGAAACACGTGTGGCTG AAGAGTTAGCTG (SEQ ID NO: 259) ref\|NC_006023.1\|gnl\|NCBI_GENOMES\| 17828\|gi\|50253391\|Bluetongue virus segment 1, complete sequence\|kpath_id\|1106954 271 |
| BTV BTV10_1810207 | CAAACACAAAAGGCGGAGAAG (SEQ ID NO: 260) GGCGTTTAATCTGTCTTAGTCTTA CGT (SEQ ID NO: 261) GAAACGCTTCTGCGTACGATGCGA (SEQ ID NO: 262) | CAAACACAAAAGGCGGAGAAG GCTGCATTCGCATCGTACGCAG AAGCGTTTCGTGATGACGTAAG ACTAAGACAGATTAAACGCC (SEQ ID NO: 263) ref\|NC_006015.1\|gnl\|NCBI_GENOMES\| 17820\|gi\|50253387\|Bluetongue virus segment 10, complete sequence\|kpath_id\|1106952 85 |
| BTV BTV10_1810199 | CACATGTCGCTTAATTTGTCTTAA CC (SEQ ID NO: 264) | GCGGAGAAGGCTGCATTCGCA TCGTACGCGGAAGCGTTTCGTG ATGATGTGAGGTTGAGACAAA TTAAACGACATGTG (SEQ ID NO: 267) |

TABLE 12-continued

Bovine Panel

| organism<br>Assay ID | Forward Primer<br>Reverse Primer<br>Luminex Proble | Amplicon sequence<br>Reference genome<br>Amplicon size |
|---|---|---|
| | GCGGAGAAGGCTGCATT<br>(SEQ ID NO: 265) | gb\|AY426602.1\|gi\|37723339\|Bluetongue virus isolate BT4-2227 segment S10, complete sequence\|kpath_id\|1136623 |
| | ACGAAACGCTTCCGCGTACGATG<br>(SEQ ID NO: 266) | 78 |
| BTV<br>BTV10_1810205 | TCAATTTTGGTAGAATTTGTTCATTCA<br>(SEQ ID NO: 268) | GCGGAGAAGGCTGCATTCGCATCGTACGCAGAAGCGTTTCGTGATGATGTGAGATTGAGACAGATTAAACGACATGTGAATGAACAAATTCTACCAAAGTTGA<br>(SEQ ID NO: 271) |
| | GCGGAGAAGGCTGCATTC<br>(SEQ ID NO: 269) | gb\|AY426602.1\|gi\|37723339\|Bluetongue virus isolate BT4-2227 segment S10, complete sequence\|kpath_id\|1136623 |
| | ACGAAACGCTTCCGCGTACGATG<br>(SEQ ID NO: 270) | 103 |
| VSV<br>VSV_1798943 | CGCCACAAGGCAGAGATGT<br>(SEQ ID NO: 272) | CGCCACAAGGCAGAGATGTGGTCGAATGGCTCGGATGGTTTGAAGATCAAAACAGAAAACCGACTCCTGATATGATGCAGTATGCGAAAAGAGCAGTCATGTCACTGCAAGGCCTAAGAGAGAAGACAATTGGCAAGTATGCTAAGTCAGAATTTGACA<br>(SEQ ID NO: 275) |
| | TGTCAAATTCTGACTTAGCATACTTGC<br>(SEQ ID NO: 273) | ref\|NC_001560.1\|gnl\|NCBI_GENOMES\|10405\|gi\|9627229\|Vesicular stomatitis Indiana virus, complete genome\|kpath_id\|1100794 |
| | GCATACTGCATCATATCAGGAGTCGGTTTTCTG<br>(SEQ ID NO: 274) | 159 |
| VSV<br>VSV_1798947 | CCCAATCAATGCCATGATACA<br>(SEQ ID NO: 276) | CCCAATCAATGCCATGATACAGTACAATTATTTTGGGACATTTGCTAGACTCTTGTTGATGATGCATGATCCTGCTCTTCGTCAATCATTGTATGAAGTTCAAGATAAGATACCGGGCTTGCACAGTTCTACTTTCAAATACGCCATGTTGTATTTGGACCCTTCCATTGGAG<br>(SEQ ID NO: 279) |
| | CTCCAATGGAAGGGTCCAAA<br>(SEQ ID NO: 277) | ref\|NC_001560.1\|gnl\|NCBI_GENOMES\|10405\|gi\|9627229\|Vesicular stomatitis Indiana virus, complete genome\|kpath_id\|1100794 |
| | TTTGAAAGTAGAACTGTGCAAGCCCGGTATC<br>(SEQ ID NO: 278) | 173 |
| VSV<br>VSV_1798949 | GGCGCTCATTATAAAATTCGGA<br>(SEQ ID NO: 280) | GGCGCTCATTATAAAATTCGGAGTATATTACATGGAATGGGAATCCATTACAGGGACTTCTTGAGTTGTGGAGACGGCTCCGGAGGGATGACTGCTGCATTACTACGAGAAAATGT<br>(SEQ ID NO: 283) |
| | ACATTTTCTCGTAGTAATGCAGCAG<br>(SEQ ID NO: 281) | ref\|NC_001560.1\|gnl\|NCBI_GENOMES\|10405\|gi\|9627229\|Vesicular stomatitis Indiana virus, complete genome\|kpath_id\|1100794 |
| | GAAGTCCCTGTAATGGATTCCCATTCCATGT<br>(SEQ ID NO: 282) | 116 |
| VSV<br>VSV_1811408 | CTCACAACATGGGTCCTGAA<br>(SEQ ID NO: 284) | CTCACAACATGGGTCCTGAATAGGGAAGTTGCAGACGAGCTATGCCAGATGATGTATCCGGGTCAAGAA<br>(SEQ ID NO: 287) |

TABLE 12-continued

Bovine Panel

| organism Assay ID | Forward Primer Reverse Primer Luminex Proble | Amplicon sequence Reference genome Amplicon size |
|---|---|---|
| | TTCTTGACCTGGATACATCAT (SEQ ID NO: 285) | ref\|NC_001560.1\|gnl\|NCBI_GENOMES\| 10405\|gi\|9627229\|Vesicular stomatitis Indiana virus, complete genome\|kpath_id\|1100794 |
| | GGCATAGYTCGTCTGCRACTTCC CT (SEQ ID NO: 286) | 69 |
| RPV RPV_1814853 | GGATCGCTGAAATGATCTGTGA (SEQ ID NO: 288) | GGATCGCTGAAATGATCTGTGA CATTGATACCTACATAGTGGAG GCAGGGTTGGCCAGTTTTATAC TCACTATCAAATTTGGTATAGA AACGATGTACCCAGCACTGGG CCTGCATGAATTCGCCGGAGA GCTCTCCACAATCGAGTCTCTT ATGAATCTGTACCAGCAAATG GGTGAACTGGCTCC (SEQ ID NO: 291) |
| | GGAGCCAGTTCACCCATTTG (SEQ ID NO: 289) | ref\|NC_006296.2\|gnl\|NCBI_GENOMES\| 17932\|gi\|56410431\|Rinderpest virus (strain Kabete O), complete genome\|kpath_id\|882961 |
| | CTGGCCAACCCTGCCTCCACTAT GTA (SEQ ID NO: 290) | 187 |
| RPV RPV_1814855 | TGCATCTTATGTGACTTTGGTTCA (SEQ ID NO: 292) | TGCATCTTATGTGACTTTGGTT CAGCCAATTATGGTTGGTTTTT TGTACCATCGAACTGTCAGTTG GATGACATAGATAGAGAGACG TCAGCACTCAGGGTCCCCTACA TCGGATCGACAACAGATGAGA GGACTGATATGAAGCTCGCATT TGTTAAGTCACCCAGTCGAACC CTGCGGTCAGCTGTGCGGATAG CC (SEQ ID NO: 295) |
| | GGCTATCCGCACAGCTGAC (SEQ ID NO: 293) | ref\|NC_006296.2\|gnl\|NCBI_GENOMES\| 17932\|gi\|56410431\|Rinderpest virus (strain Kabete O), complete genome\|kpath_id\|882961 |
| | CAGTCCTCTCATCTGTTGTCGATC CGATGTA (SEQ ID NO: 294) | 198 |
| RPV RPV_1814856 | AACTCCTGACCTCATTCCTTGC (SEQ ID NO: 296) | AACTCCTGACCTCATTCCTTGC AAGGATGAGTAAGAGCGTATT CAAGGTCTTTGTGAATGCACTG AGCCACCCCAAGATTTACAGG AAGTTCTGGCATAGTGGGATTA TAGAGCC (SEQ ID NO: 299) |
| | GGCTCTATAATCCCACTATGCCA (SEQ ID NO: 297) | ref\|NC_006296.2\|gnl\|NCBI_GENOMES\| 17932\|gi\|56410431\|Rinderpest virus (strain Kabete O), complete genome\|kpath_id\|882961 |
| | TGGCTCAGTGCATTCACAAAGAC CTTGAATA (SEQ ID NO: 298) | 115 |
| Maritima N/A | NT NT CAAAGTGGGAGACGTCGTTG (SEQ ID NO: 300) | Probe only |
| N/A N/A | NT NT CAAAGTGGGAGACGTCGTTG (SEQ ID NO: 301) | Probe only |
| N/A N/A | NT NT CAAAGTGGGAGACGTCGTTG (SEQ ID NO: 302) | Probe only |

TABLE 12-continued

Bovine Panel

| organism<br>Assay ID | Forward Primer<br>Reverse Primer<br>Luminex Proble | Amplicon sequence<br>Reference genome<br>Amplicon size |
|---|---|---|
| None<br>Alien RNA | GACATCAAGGCTCAAACTAATTT<br>TACC<br>(SEQ ID NO: 303)<br>CAAAGGCTGCCAACATAAAATG<br>(SEQ ID NO: 304)<br>CAAGCGTAAATGCAGCGTCCA<br>(SEQ ID NO: 305) | Proprietary |

Example 13

Testing of the Additional Bovine and Porcine Signature Sequences

1. Bovine Viral Diarrhea Virus (BVDV)—Bovine Panel

Signature candidates: Two signatures, BVD_1a and BVD_2, are available for consideration. BVD_1a was adopted from the Version 1.0 panel without change. BVD_2 is a redesigned version of BVD_1a. The BVD_2 forward primer includes 2 nucleotide substitutions, the reverse primer was shifted 2 nucleotides, and the probe uses the same sequence except for 1 inosine substitution.

Signature origin: BVD primers designed by Ridpath et al. were adapted to Taqman format by Faaberg et al., and subsequently modified by scientists at the California Animal Health and Food Safety Laboratories. The CAHFS version of the Taqman signature was adapted to the Luminex multiplex format.

The BVD_1A signature was tested in singleplex format using a dilution series of BVDV RNA (Singer strain, NVSL) from titered virus-infected cell culture. The results in FIG. 1 are plotted together with data acquired using Version 1.0. The qualitative limit of detection was similar for both singleplex and multiplex Version 1.0.

Near-neighbor screening: In the Version 1.0 panel, BVD_1a signature responded to Border Disease Virus (BDV) Aveyron and Frijters strains but not 137-7. Also in the Version 1.0 panel, BVD_1a signature responded to Classical Swine Fever Virus (CSFV) Brescia ($\geq$550 TCID$_{50}$/mL) and Paderborn ($\geq$6550 TCID50/mL) but not Kanagawa.

Figure 2:
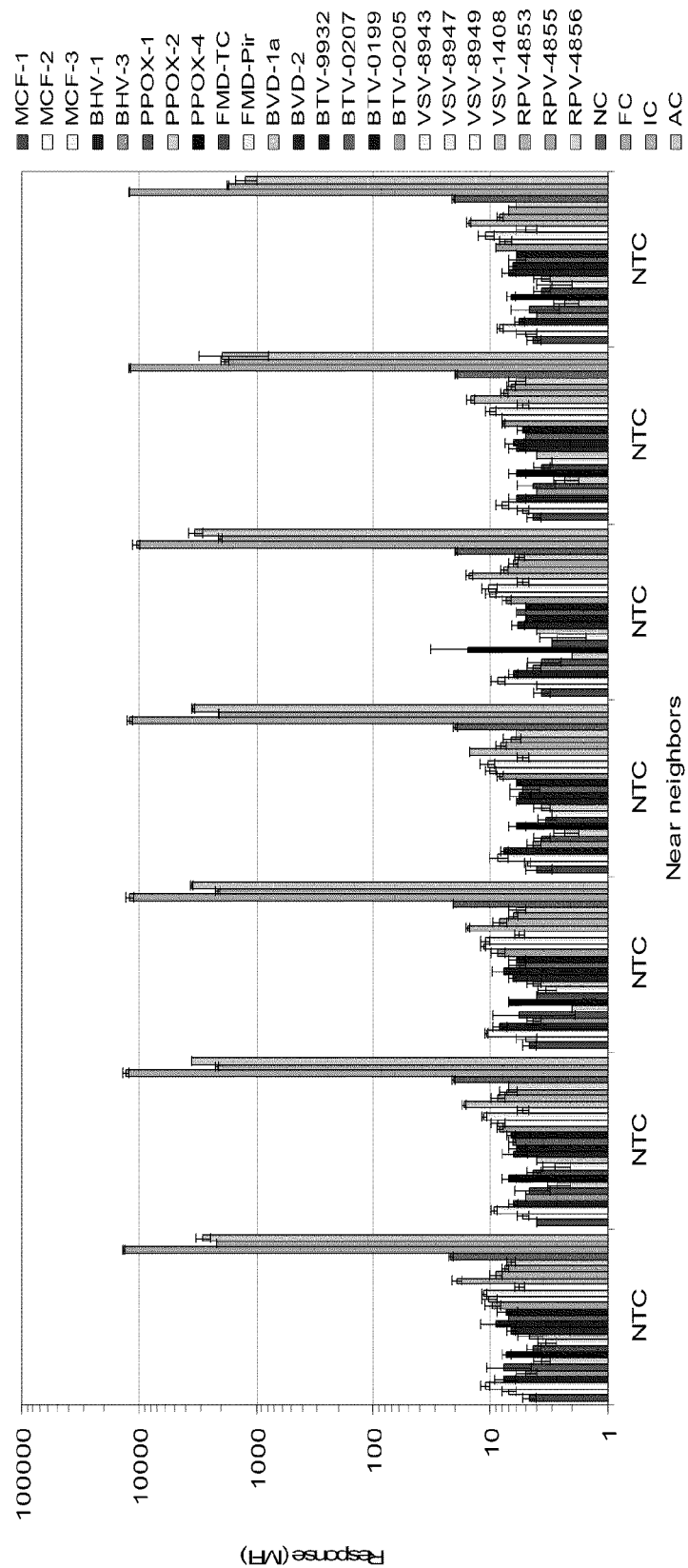
FIG. 2: Response of the bovine panel to no template control (NTC, water) showing that the signature response for detection channels is typically less than 20 MFI units. The response of the four control channels should remain constant and are included for reference. Testing was conducted at PIADC. Each sample was analyzed in triplicate. For each signature, the responses (MFI) from triplicate analyses were averaged. Error bars indicate ±1σ of the mean response.

All near-neighbor and target screening conducted at PIADC for the bovine multiplex assay was conducted using a total of three 96-well plates. The responses of the bovine panel to no template control (NTC, water) are shown in FIG. 2. The response of each signature used for viral detection was typically less than 20 MFI units. Each signature requires a distinct cutoff. To determine cutoffs for PIADC target and near-neighbor screening the results from blank samples (no template control, NTC) from all plates analyzed were pooled. To establish cutoffs in the later stages of analytical and diagnostic characterization requires more rigorous experimentation and data analysis. Generally, this would require a finalized panel, analysis of many blank samples of the desired sample matrix, application of non-parametric statistics to determine cutoff for a given false positive rate, and determination of limit of detection at a given probability of detection.

Figure 3:
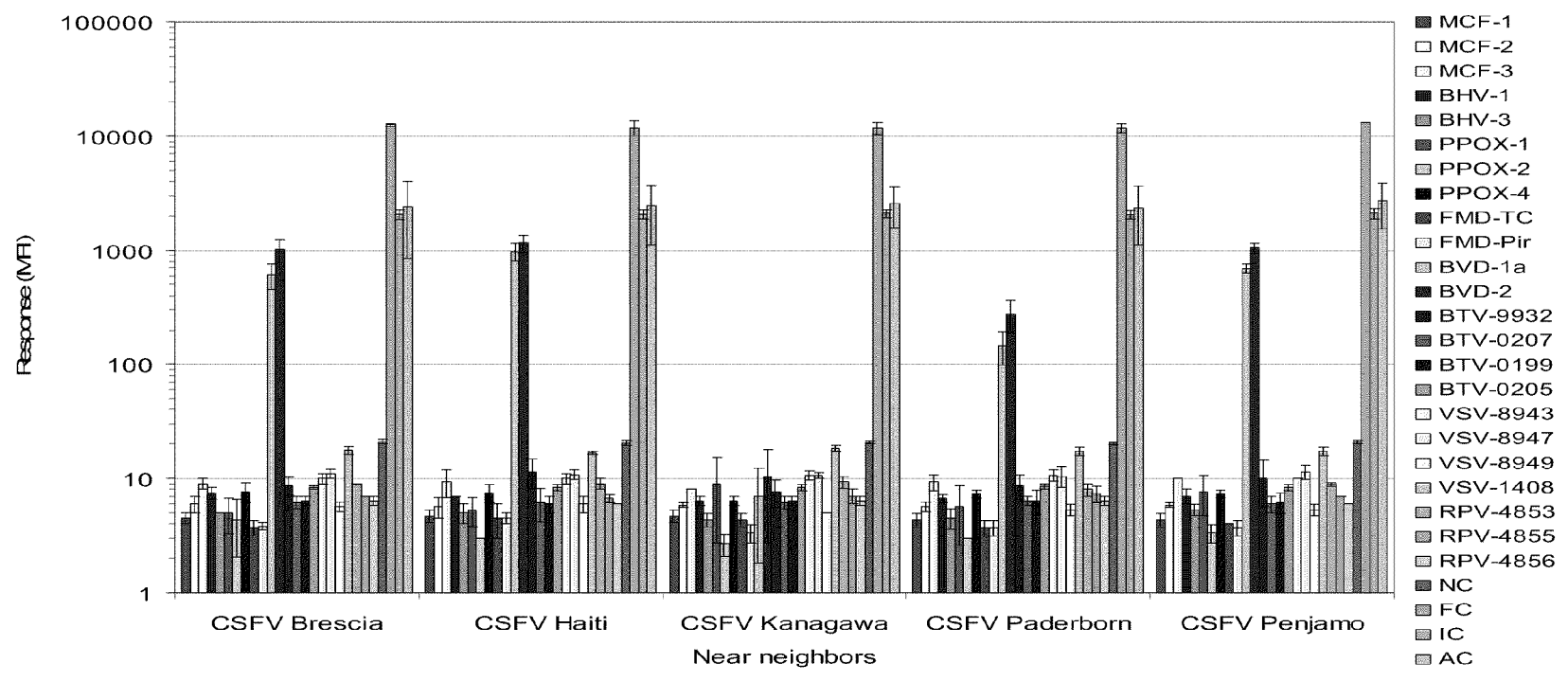
Figure 4:
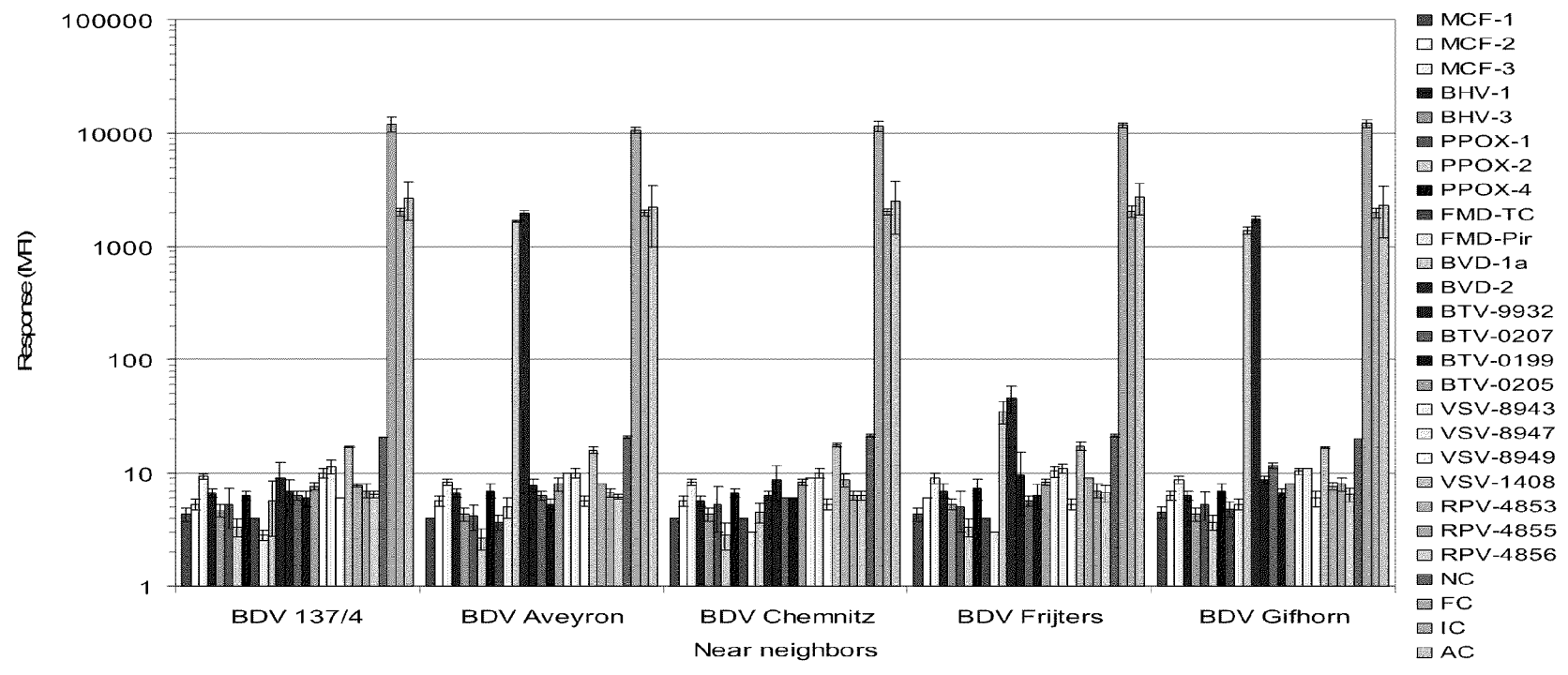

Results of the near-neighbor screening of the BVD-1a and BVD-2 signatures in the bovine panel against CSFV and BDV isolates are presented in FIG. 3 and FIG. 4, respectively.

Figure 5:
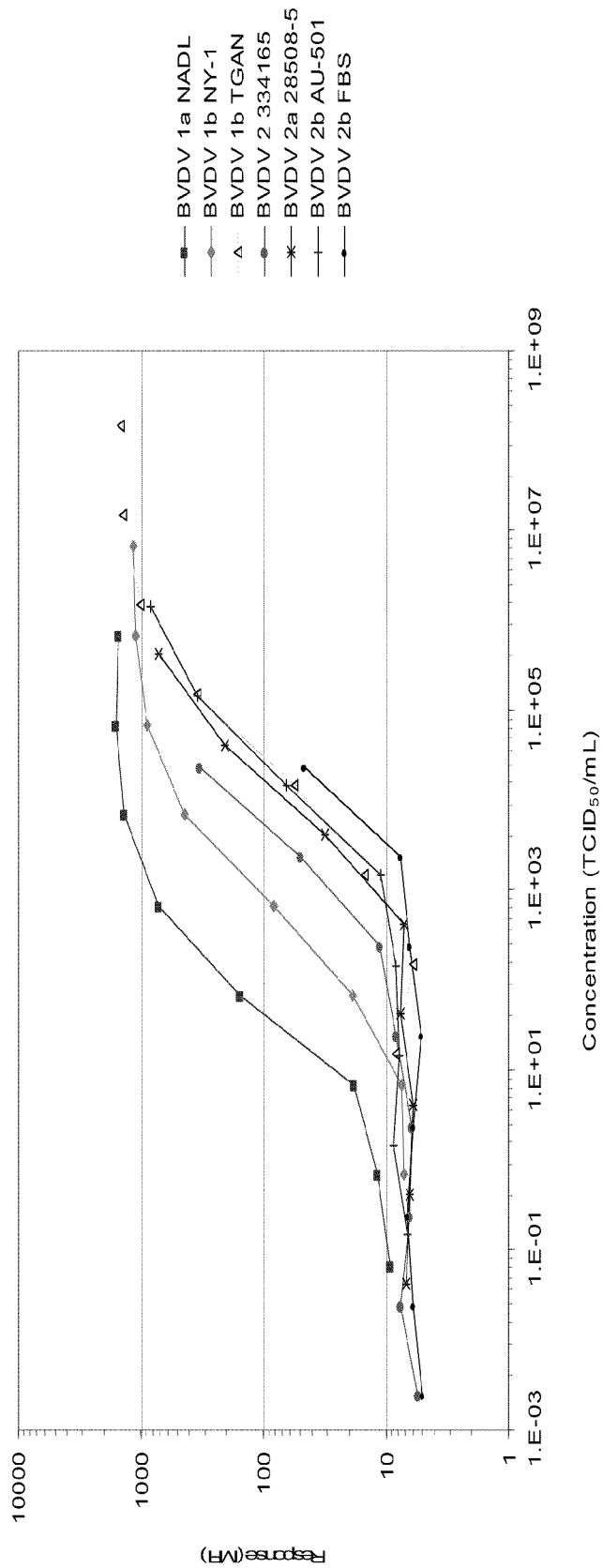
FIG. 5: BVD-1a signature response in the Version 1.0 panel to BVDV strains of both genotypes. Each titration series was constructed from stock solutions of titered virus-infected cell culture for both BVDV genotypes that was subsequently extracted (Ambion MagMax96). Each point represents the mean response (n=4) of four replicate analyses from extraction through detection.

Target screening: Titration curves were acquired for the BVD_1a signatures in the Version 1.0 panel and the results are shown in FIG. 5. Each titration series was constructed from serially diluted samples of titered virus-infected cell culture for both BVDV genotypes that were subsequently extracted (Ambion MagMax 96). In general, the BVD_1a signature response was stronger for lower concentrations of BVDV Type 1 compared to Type 2.

Figure 6:
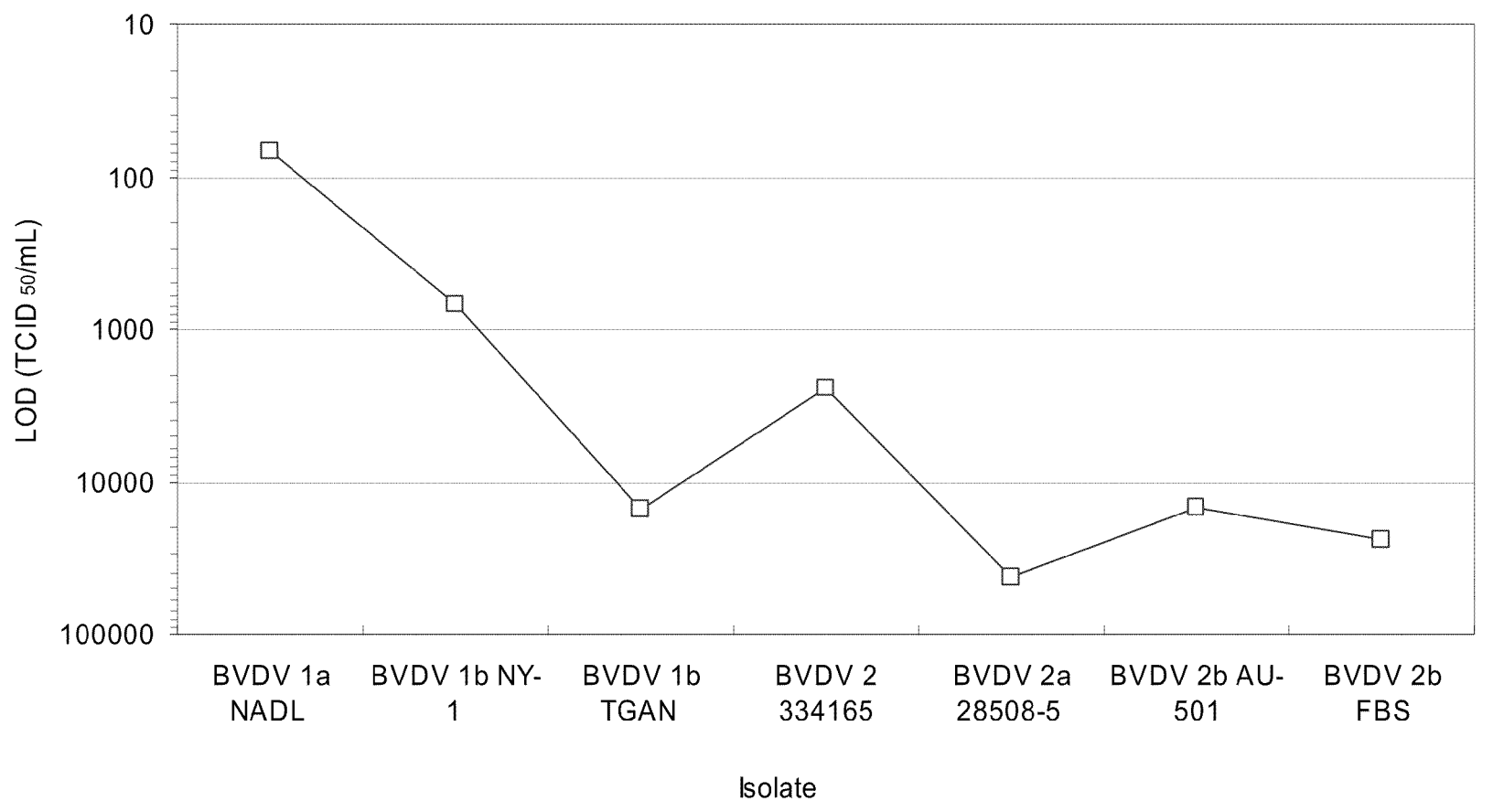

The results presented in FIG. 5 are summarized further in FIG. 6 where the qualitative limit of detection of the BVD_1a signature is shown for each strain.

Figure 7:
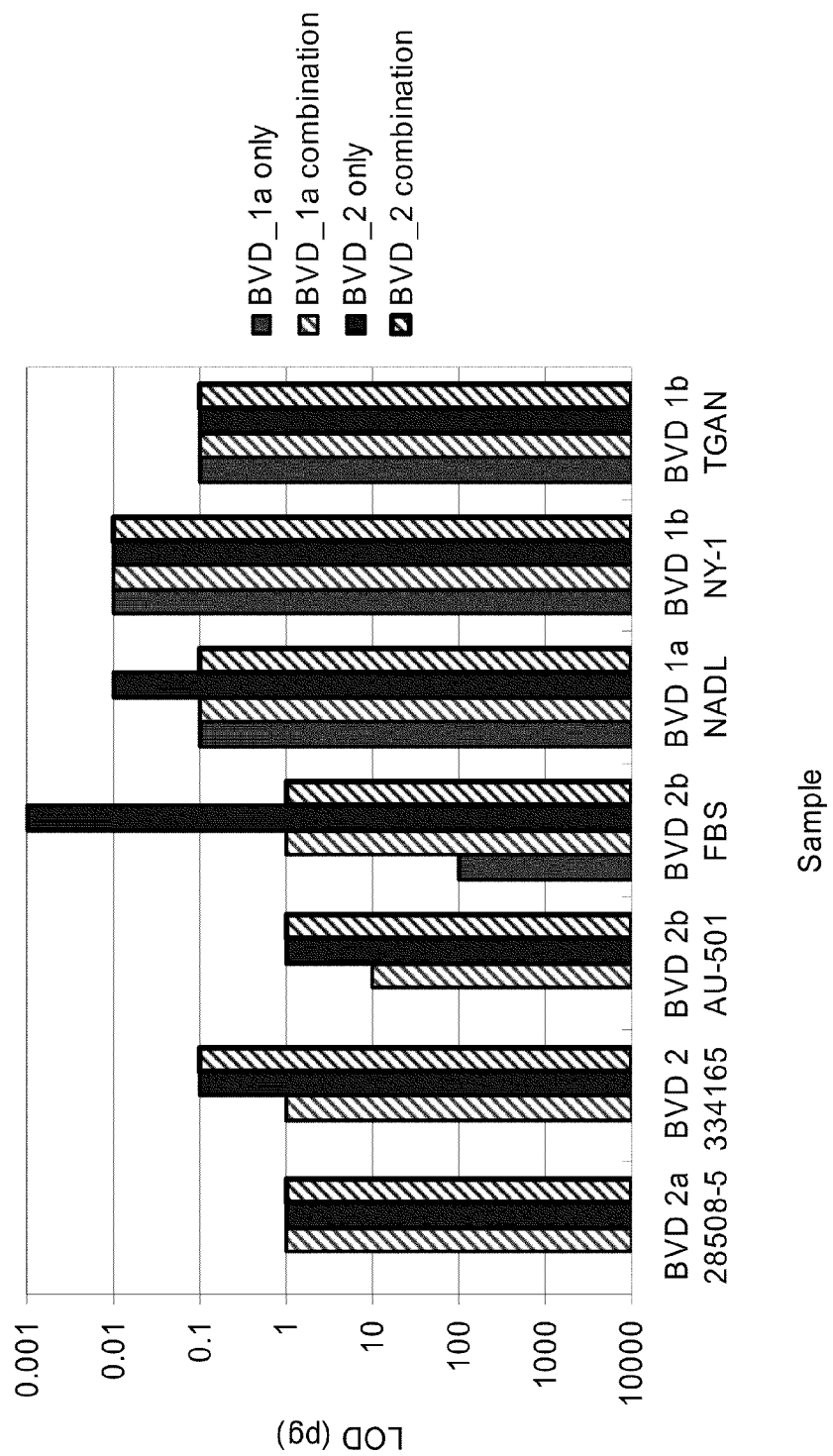
FIG. 7: Comparison of the response of BVD signatures (BVD_1a and BVD_2) when incorporated into a developmental Bovine multiplex panel showing that addition of the new BVD_2 only generated the best response for the seven strains tested. Multiplex titrations were performed using serial dilutions of total RNA extracted (Trizol) from live virus. The LOD (pg) represents the lowest amount of RNA tested that generated response above threshold. The threshold value of 40 MFI units was used for both BVD signatures. The means response (n=2) was determine from duplicate measurements for each mass of template in the calibration series.

To improve the response of a candidate Bovine multiplex panel to BVD Type 2 strains, the BVD_1a signature was modified leading to the generation of an additional signature BVD_2. Signature responses were compared using three developmental Bovine panels that included either BVD-1a only, BVD-2 only, or BVD_1a and BVD_2 in combination. FIG. 7 shows that the BVD-1a LOD for BVD Type 2 strains improved when BVD_2 was present in the multiplex. However, the new BVD_2 signature alone performed as well as, or better than the BVD_1a signature alone or in combination. No signature combination responded to the near-neighbor BDV (Coos Bay #4, 4-6-92).

The new BVD_2 signature alone or in combination with BVD_1a when added to the Bovine panel provides better coverage for BVDV Type 2.

2. Bluetongue Virus (BTV)—Bovine Panel

Signature candidates: One signature, BTV_1759932, was adopted from the Version 1.0 panel without change. The three new BTV signatures for consideration are BTV_1810199, BTV_1810205 and BTV_1810207.

Signature origin: BTV_1759932 was developed by LLNL was adopted without change from the Version 1.0 panel. BTV_1810199, BTV_1810205 and BTV_1810207 were developed in 2006 as part of a collaborative effort between LLNL and USDA ARS ABADRL using published (Genbank) and unpublished (ABADRL) sequence information for segments 5 and 10. Signature screening and characterization was also performed in partnership between LLNL and USDA ARS ABADRL.

Near-neighbor screening: Signatures were screened at USDA ABADRL against eleven EHDV isolates from all eight EHDV serotypes. Samples were dsRNA purified by LiCl precipitation of RNA extracted from virus-infected cell culture. No signature cross-reaction was observed at 200 pg of EHDV dsRNA.

Figure 8:
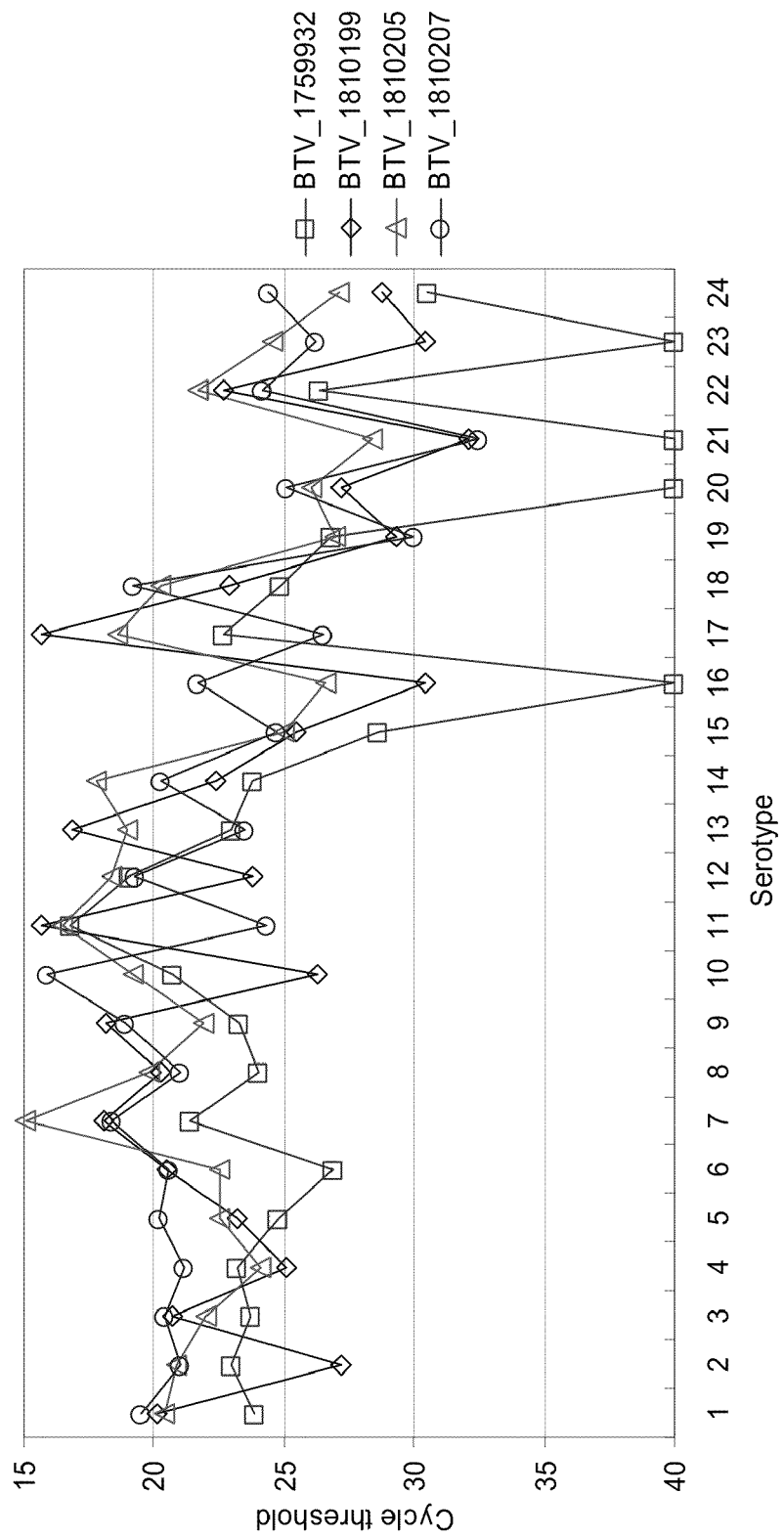
FIG. 8: Taqman screening of BTV signatures against isolates representing twenty-four BTV serotypes. Testing was conducted at UDSA ABARDL (University of Wyoming) Samples were dsRNA purified by LiCl precipitations of RNA extracted (Pure Script, Gentra Systems) from virus-infected cell culture. Each reaction was spiked with 200 pg of template. Each point represents the mean (n=3) cycle threshold. If no cycle threshold was reached (i.e. infinite cycle threshold), a cycle threshold of 40 was assigned in this plot.

Target screening: All signatures were screened against purified dsRNA from BTV strains representing twenty-four serotypes. Samples were dsRNA purified by LiCl precipitations of RNA extracted from virus-infected cell culture. The results summarized in FIG. 8 show that the new signatures BTV_1810199, BTV_1810205 and BTV_1810207 responded to 24/24 serotypes tested. BTV_1759932 responded to 20/24 serotypes tested; no response was observed for BTV_1759932 for serotypes 16, 20, 21 and 23. Additional Taqman screening was conducted at LLNL and USDA ABARDL to determine qualitative limits of detection for each signature.

Singleplex screening was conducted for BTV_1759932 using one strain of BTV (data not shown). These four signatures were incorporated into the Bovine multiplex panel.

Near-neighbor screening Version 1.0: In Version 1.0, BTV_1759932 did not respond to nucleic acid (200 pg) extracted from three EHD-1 serotypes (isolates Georgia, New Jersey, Santa Barbara) and EHD-2 serotype Alberta.

Figure 9:
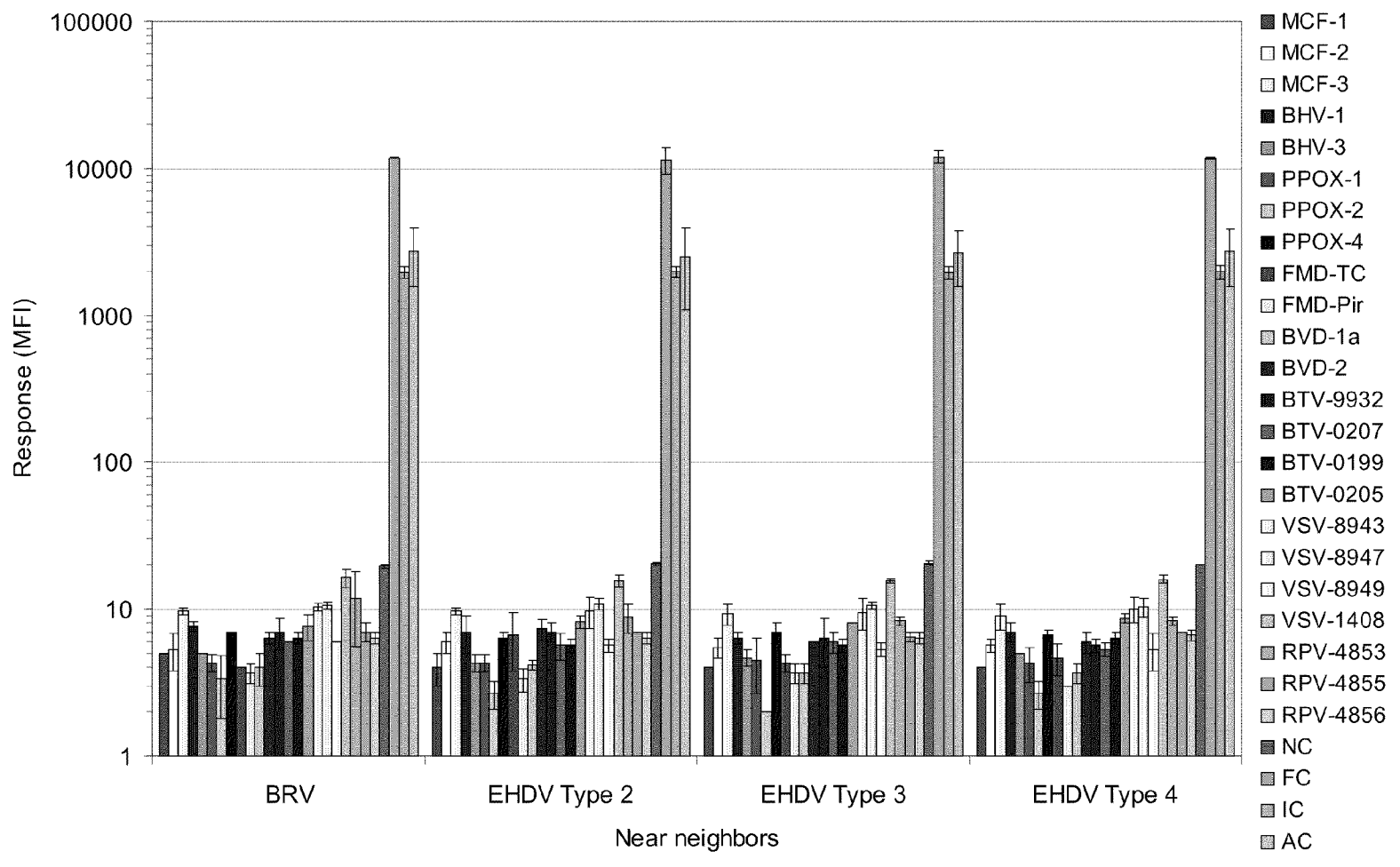
Figure 10:
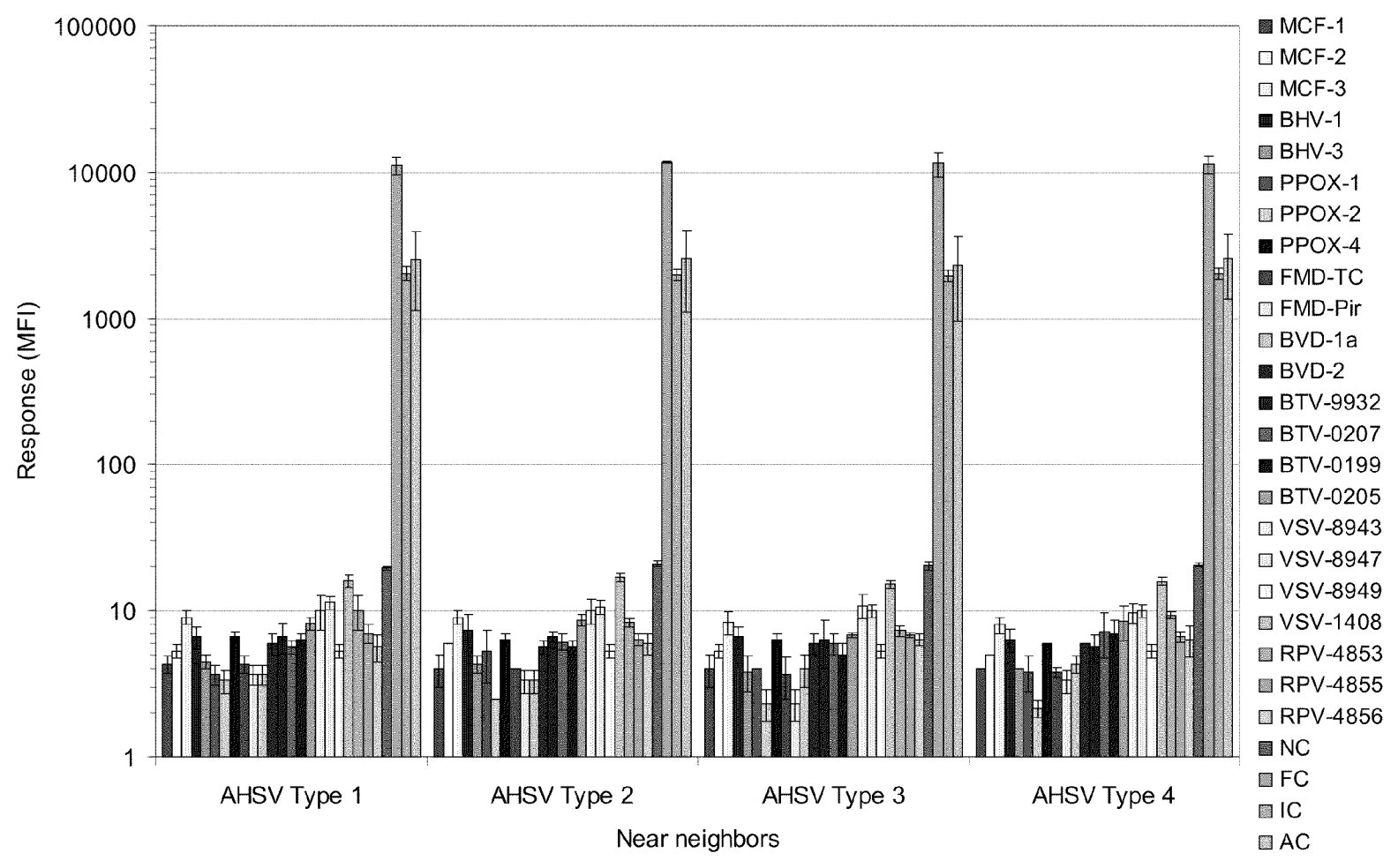

Near-neighbor screening (Bovine panel): The BTV signatures did not cross-react with BRV, EHDV Types 2, 3 or 4, or AHSV Types 1-4 as shown in FIG. 9 and FIG. 10. This testing was conducted at PIADC.

Figure 11A:
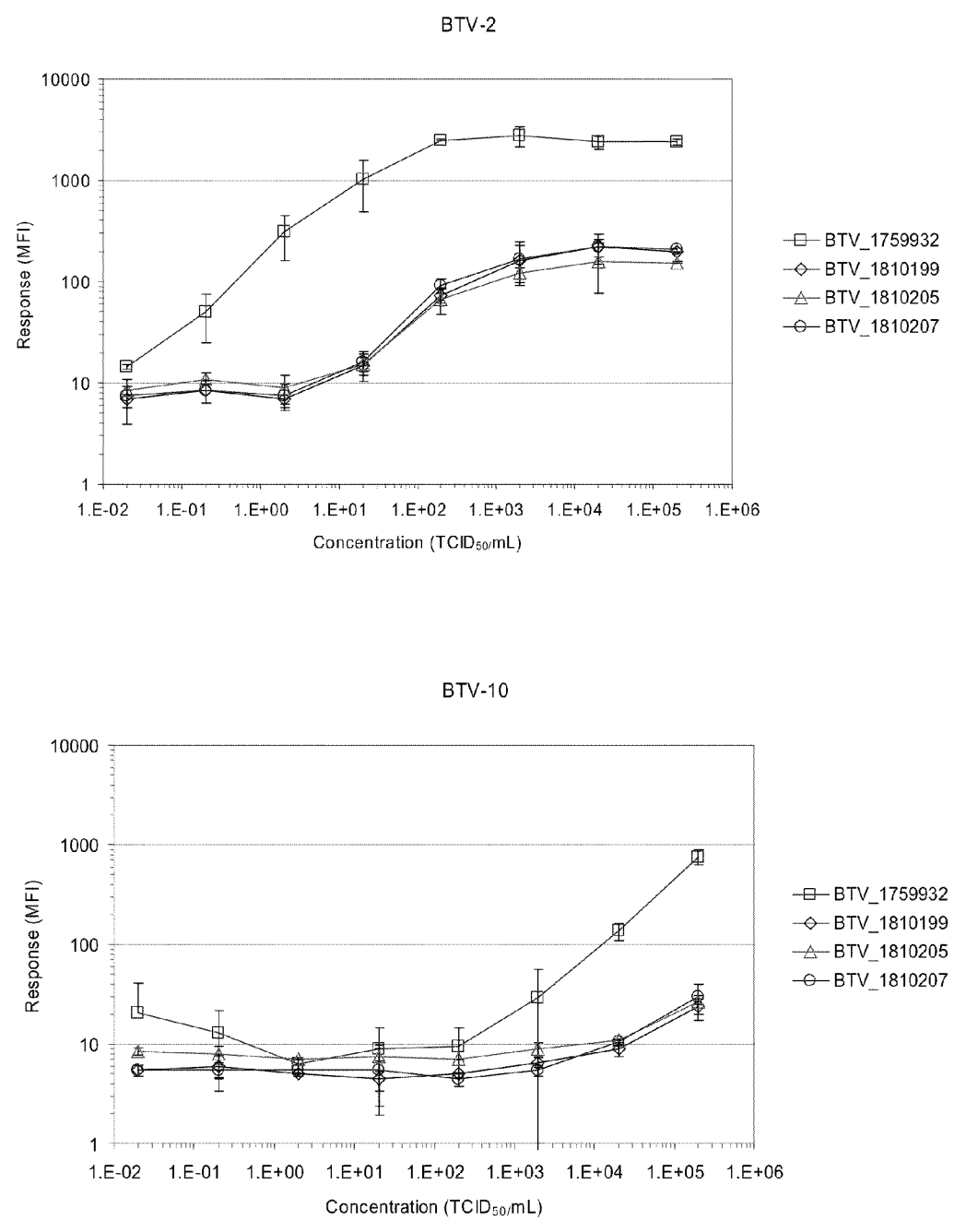
Figure 11B:
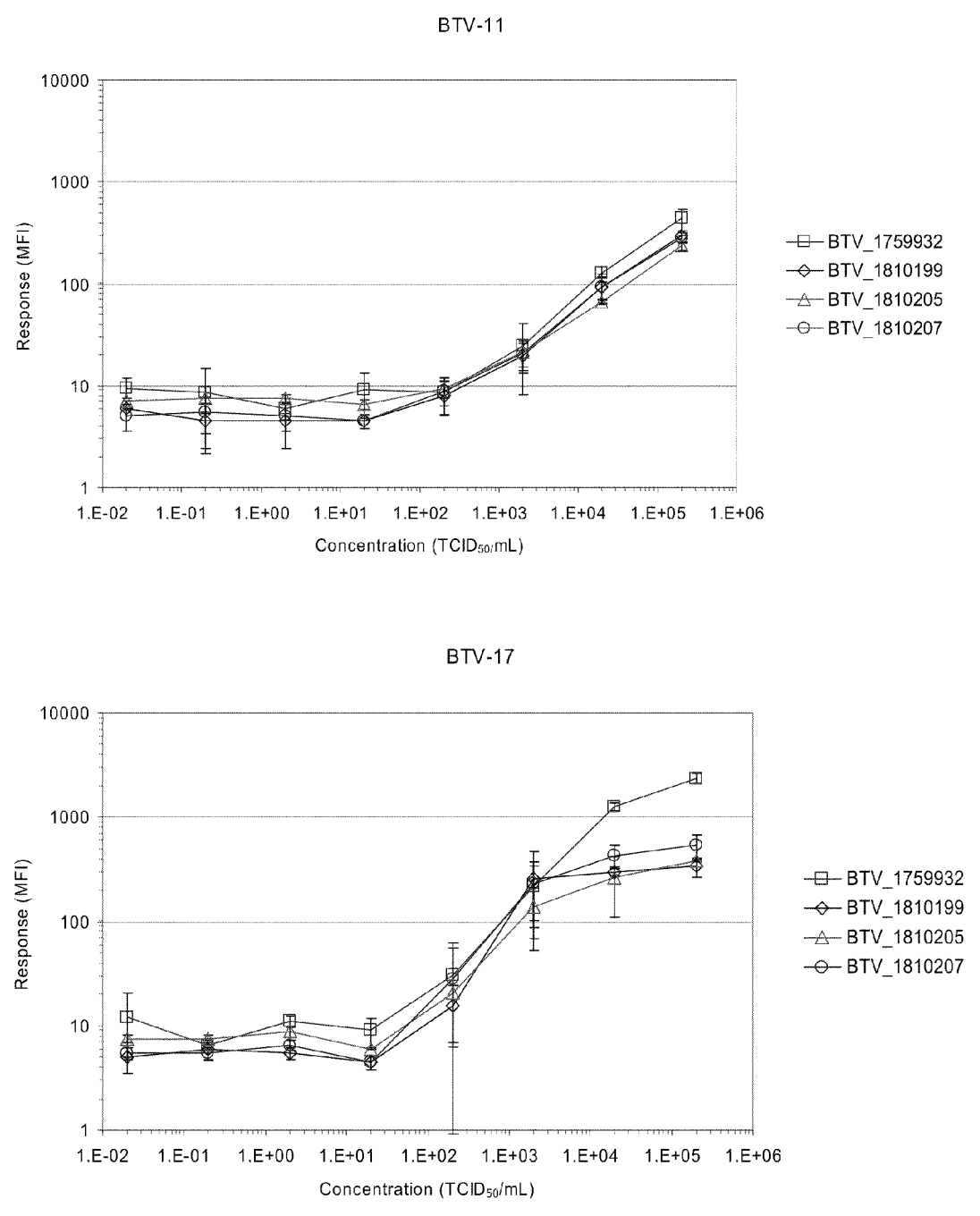

Target screening: The four signatures have consistently low background response in the absence of template in the current Bovine panel. The Bovine panel was screened against five US strains of BTV (2, 10, 11, 13 and 17). The signatures responded over a wide concentration range as shown in FIG. 11. BTV_1759932 generated a stronger response to BTV serotypes 2 and 10, compared to the three newly developed signatures. Testing conducted at USDA ABARDL was done using BTV strains different to those used for at LLNL.

The BTV signatures together demonstrated promising performance in both Taqman and multiplex formats. The four signatures may provide pan-serotype detection capability for BTV.

3. Foot-and-Mouth Disease Virus (FMDV)—Bovine and Porcine Panels

Signature candidates: FMDV-TC (USDA ARS/Tetracore) and FMDV-Pir (Institute for Animal Health, Pirbright). Both signatures were adopted from published assays and the Version 1.0 panel without change.

Signature origin: Two independent real-time reverse transcriptase polymerase chain reaction (rRT-PCR) assays targeting conserved regions of the internal ribosomal entry site of 5' untranslated region (5'UTR) and the viral RNA polymerase (3D) on the highly variable FMD genome. An in-depth comparative evaluation of diagnostic sensitivity (D-SN) was reported in which samples of epithelial suspension from tissue collected from suspect FMD cases were analyzed. In combination, these singleplex Taqman assays reported higher D-SN compare to virus isolation and antigen-ELISA. The 5'UTR (FMD_PIR) and 3D (FMD_TC) Taqman signatures were adapted directly to the multiplex format.

Figure 12:
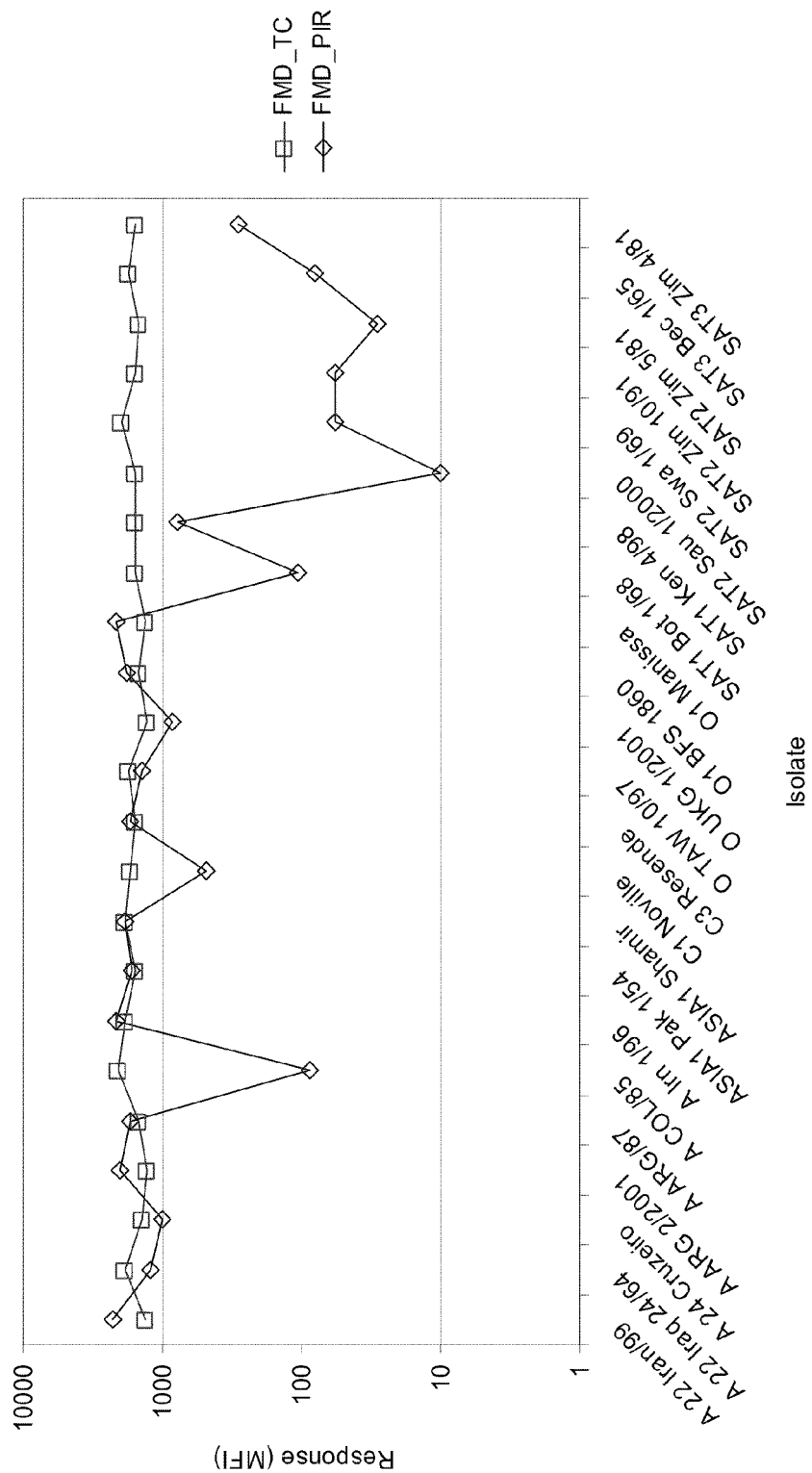
FIG. 12: FMDV signature screening in singleplex against multiple FMDV isolates. Samples were total nucleic acid extracted from untitered virus-infected cell culture. Each point represents the mean response (n=2). No template control response was <10 MFI units for both signatures.

Singleplex screening of the FMD signatures against twenty-three isolates representing all seven serotypes was conducted. The FMD¬_TC signature showed a high response to all serotypes tested (FIG. 12). The FMD_Pir signature had a weaker response to SAT 1, 2 and 3 samples, as well as A COL/85 and C1 Noville.

Figure 13:
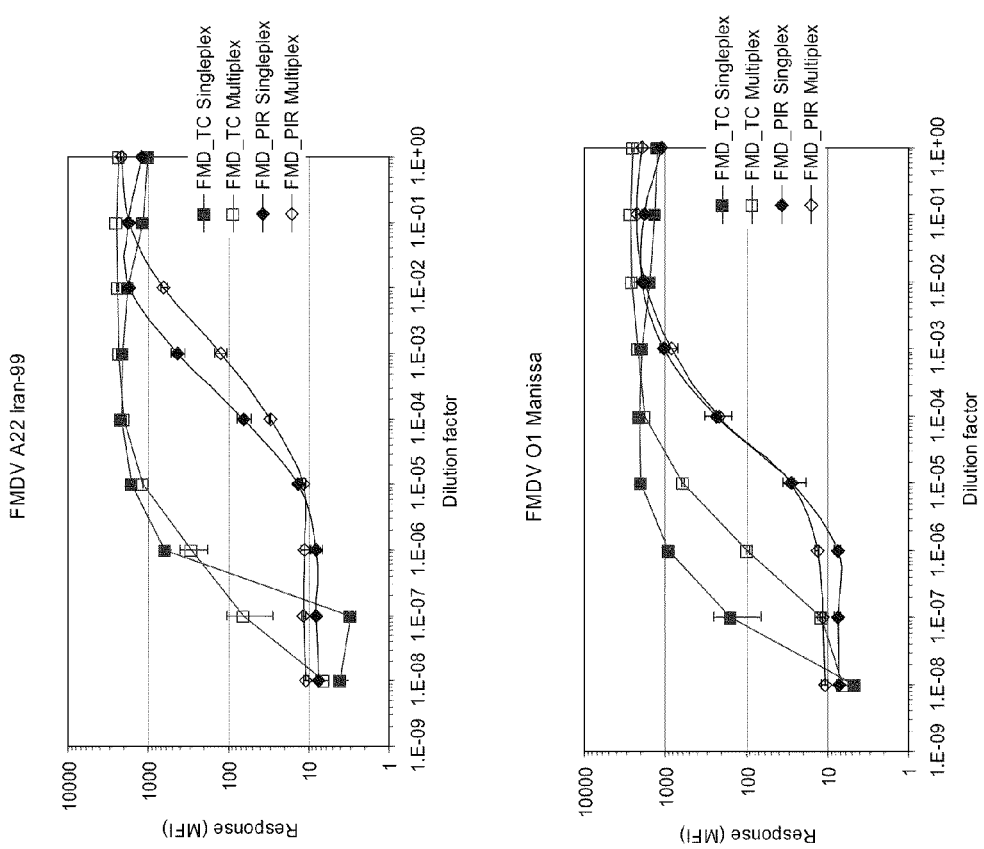
FIG. 13: FMDV signature screening in singleplex and multiplex Version 1.0 format against two FMD isolates A22 Iran-99 and O1 Manissa. The two samples were serially diluted from a stock sample of total RNA extracted from virus-infected cell culture. The original sample concentration is unknown so the results are plotted as response vs. dilution factor of the original sample. Each point represents the mean response (n=2). Error bars indicate ±1σ of the mean.

Both signatures were tested in singleplex format using a dilution series of FMDV A22 Iran-99 and O1 Manissa extracted RNA. The results in FIG. 13 are plotted together with data acquired with a developmental multiplex assay comprised of eight primer sets. The singleplex and multiplex responses were comparable over the entire dilution series that spanned eight orders of magnitude. The FMD_PIR signature had a higher qualitative limit of detection than FMD-TC in both singleplex and multiplex formats against these two samples.

Near-neighbor screening (Version 1.0): FMD signatures in the Version 1.0 multiplex was examined by assays by running titrations against SVD (UKG-72), VSV (NJ 95366), VESV (A48), Rinderpest (Nig Buffalo), BHV-1 and BVDV (NY 1). No response greater than the background was observed for either FMD signature.

Figure 14:
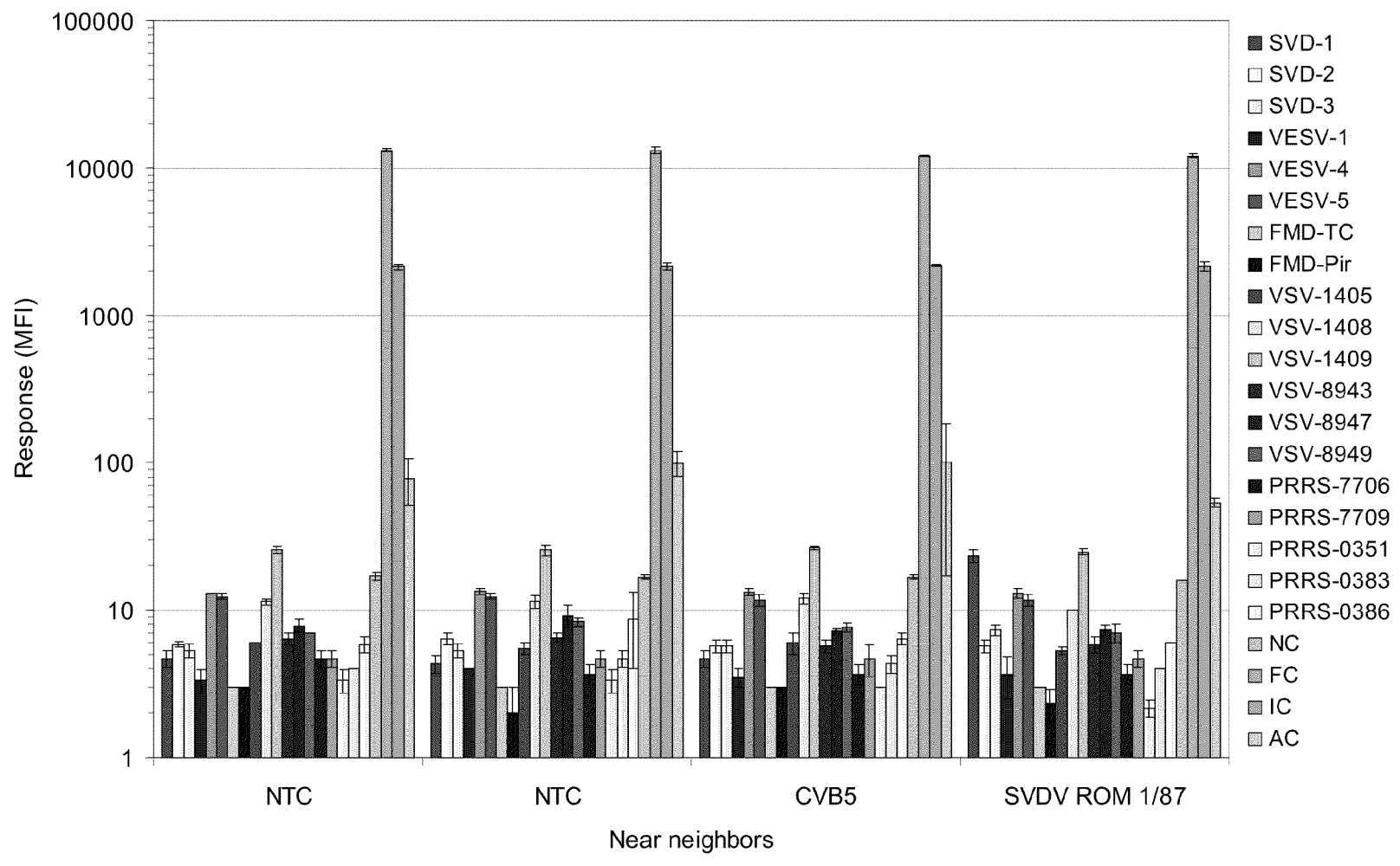
Figure 15:
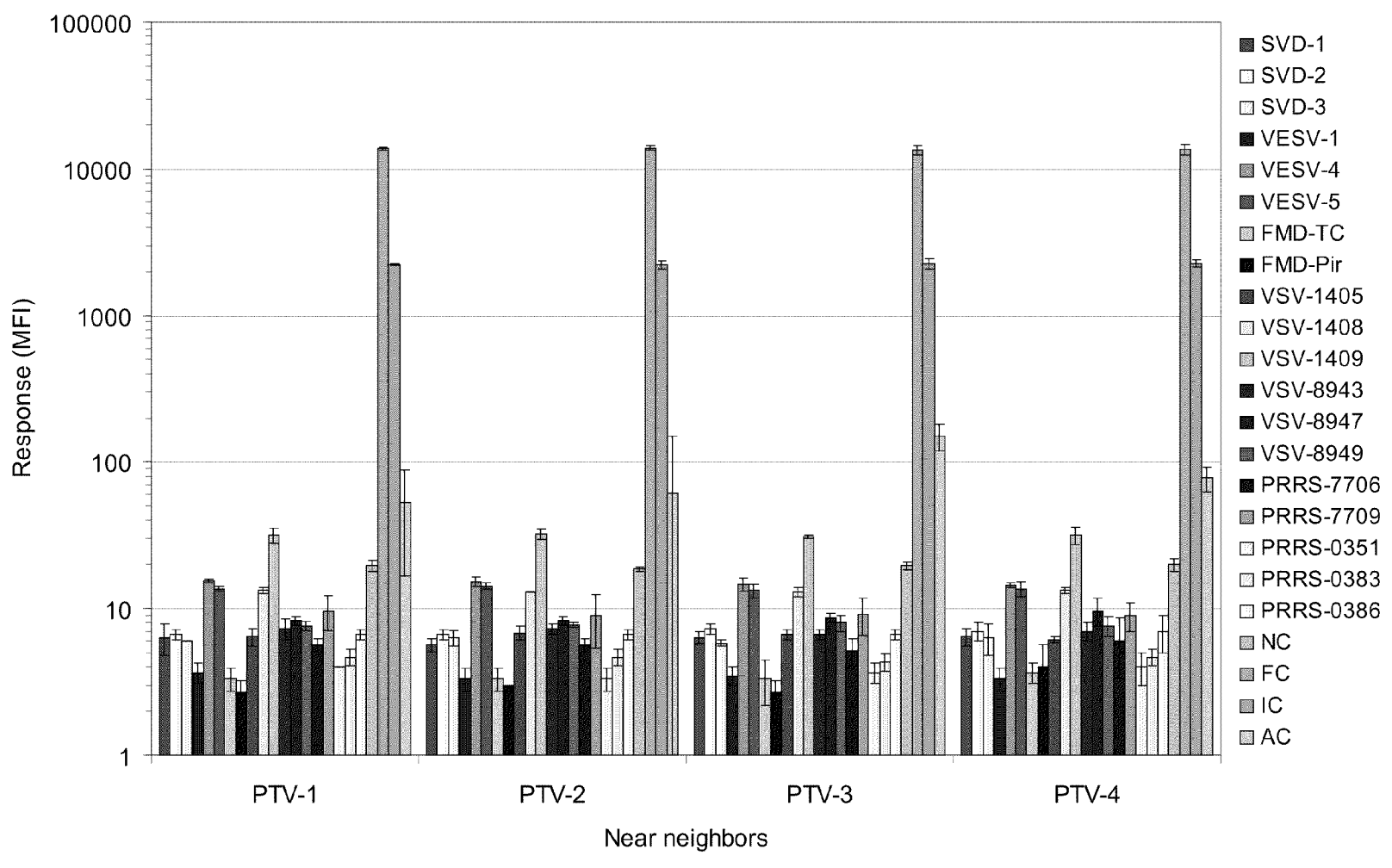
Figure 16:
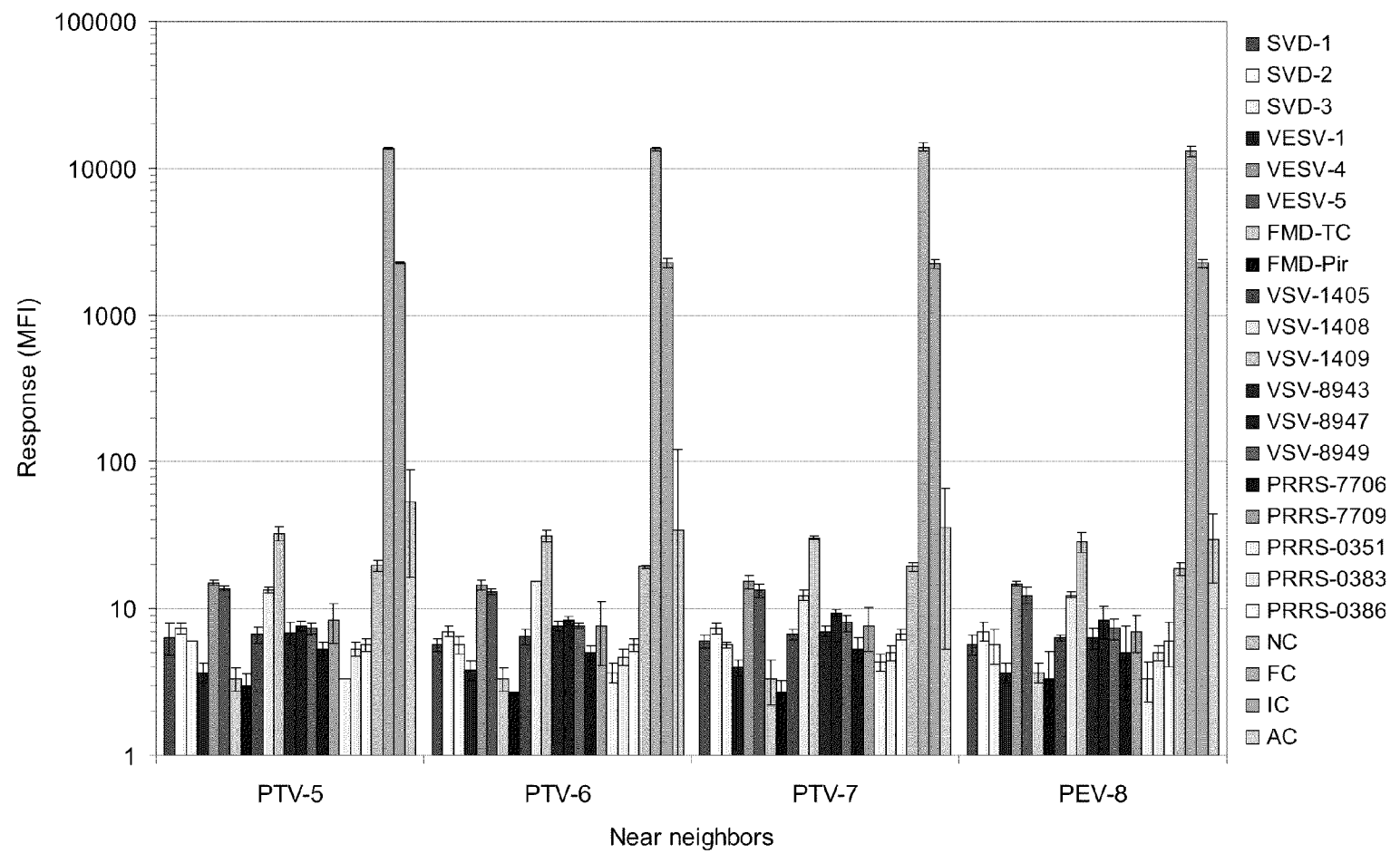

Near-neighbor screening (Porcine panel): FMD signatures in the Porcine panel were screened against C5B5 and an isolate of SVDV as shown in FIG. 14. PTV serotypes 1-7 and PEV-8 were also tested and did not elicit responses on either FMD signature as shown in FIG. 15 and FIG. 16.

Figure 17:
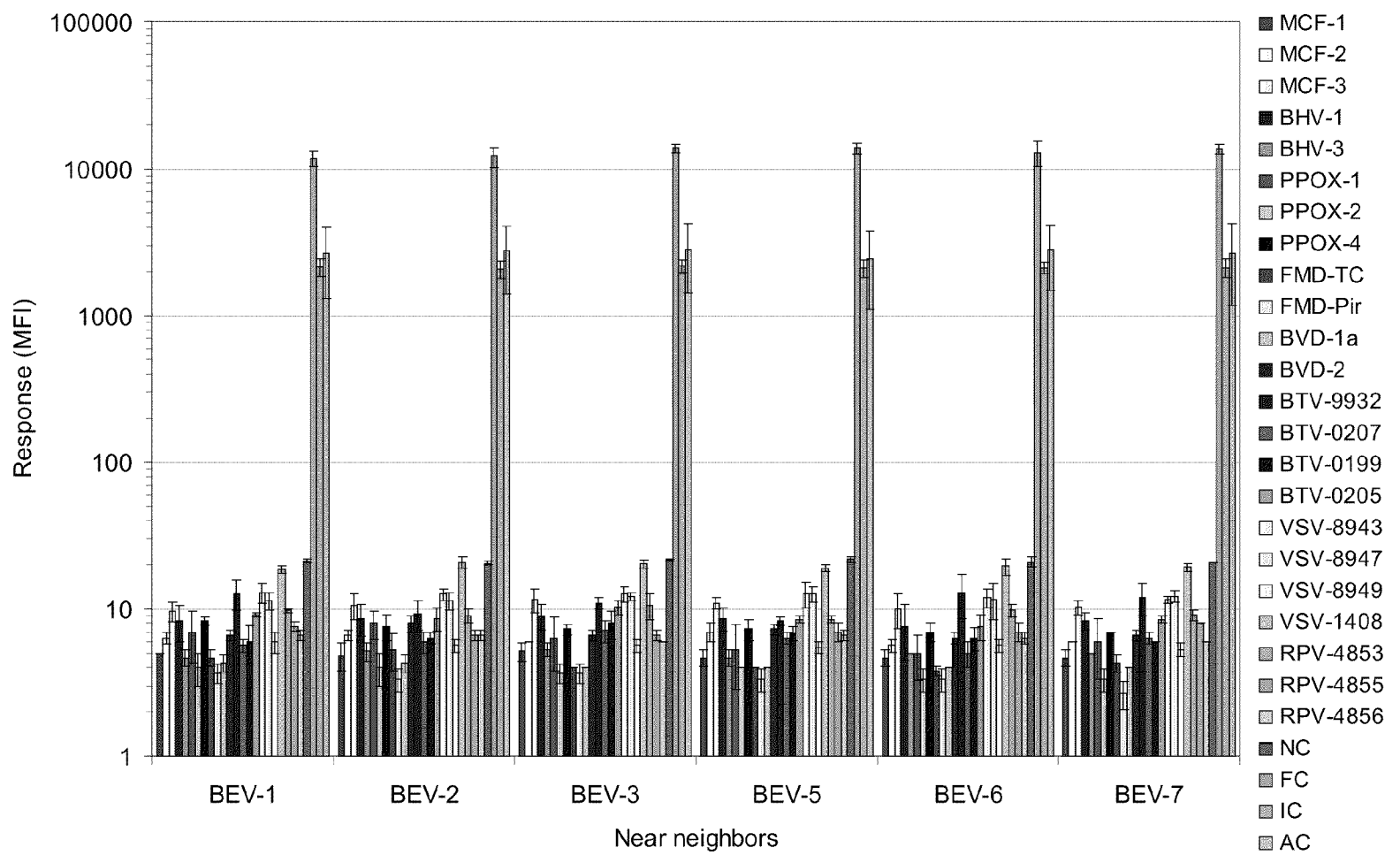
Figure 18:
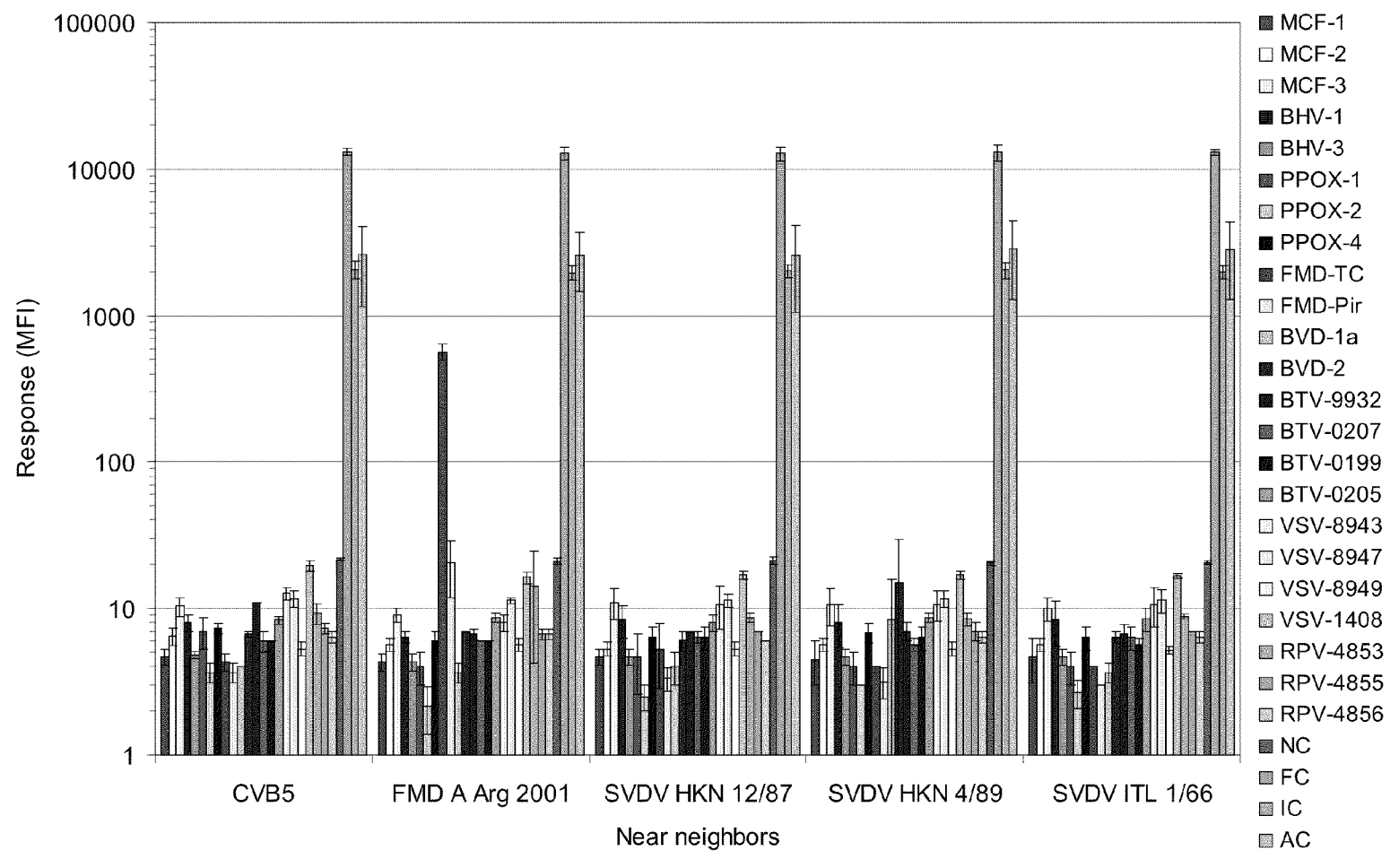
Figure 19:
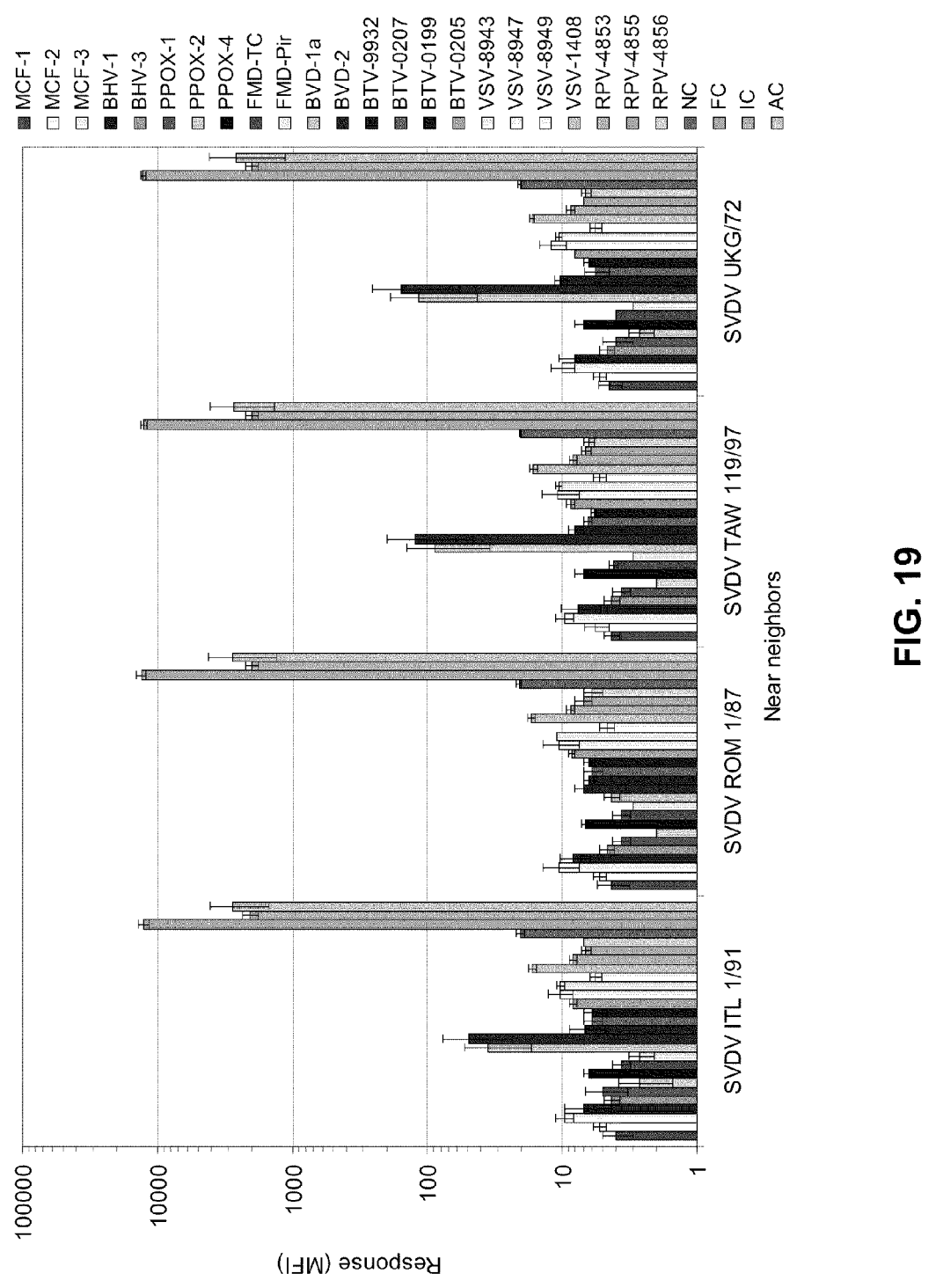

Near-neighbor screening (Bovine panel): FMD signatures in the Bovine panel were screened against BEV 1-7 with no cross reaction observed (FIG. 17). CVB5 did not cross-react with the FMD signatures, nor did the isolated of SVDV as shown in FIG. 18 and FIG. 19. The response of the BVD-1a and BVD-2 assays to SVD ITL 1/91, ROM 1/87, TAW 119/97 and UKG/72 are indicative of low-level BVDV contamination. BVD is a prevalent disease, and BVDV contamination is a common occurrence and often detectable in bovine-derived cell lines and proteins (e.g. BSA) used in media preparations. Evidence of low-level BVDV contamination is evident on several titration series.

Figure 20:
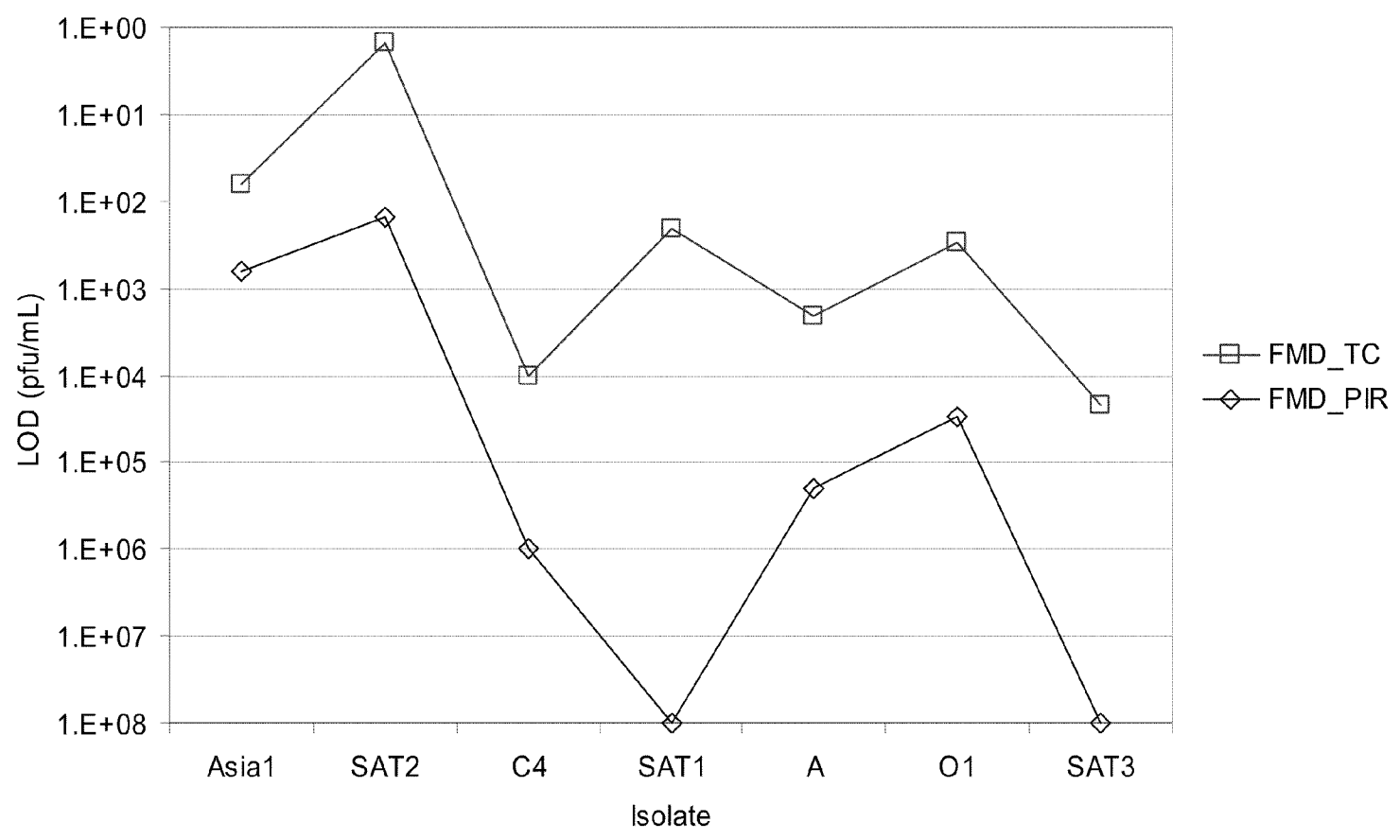

Target screening: Titration curves were acquired for the FMDV signatures in the Version 1.0 panel. The samples were a titration series constructed from titered virus-infected cell culture for each FMDV serotype. The FMD¬ _TC signature had a qualitative limit of detection typically 1-2 orders of magnitude better than FMD_PIR (FIG. 20). The FMD_PIR signature did not detect SAT1/6 SWA or SAT3/3 Bech 1Nov05 samples at any concentration tested.

Additional testing conducted at LLNL enabled the comparison of FMD signature response across three different versions of the multiplex assay panels. The results are presented in FIG. 21.

Figure 21A:
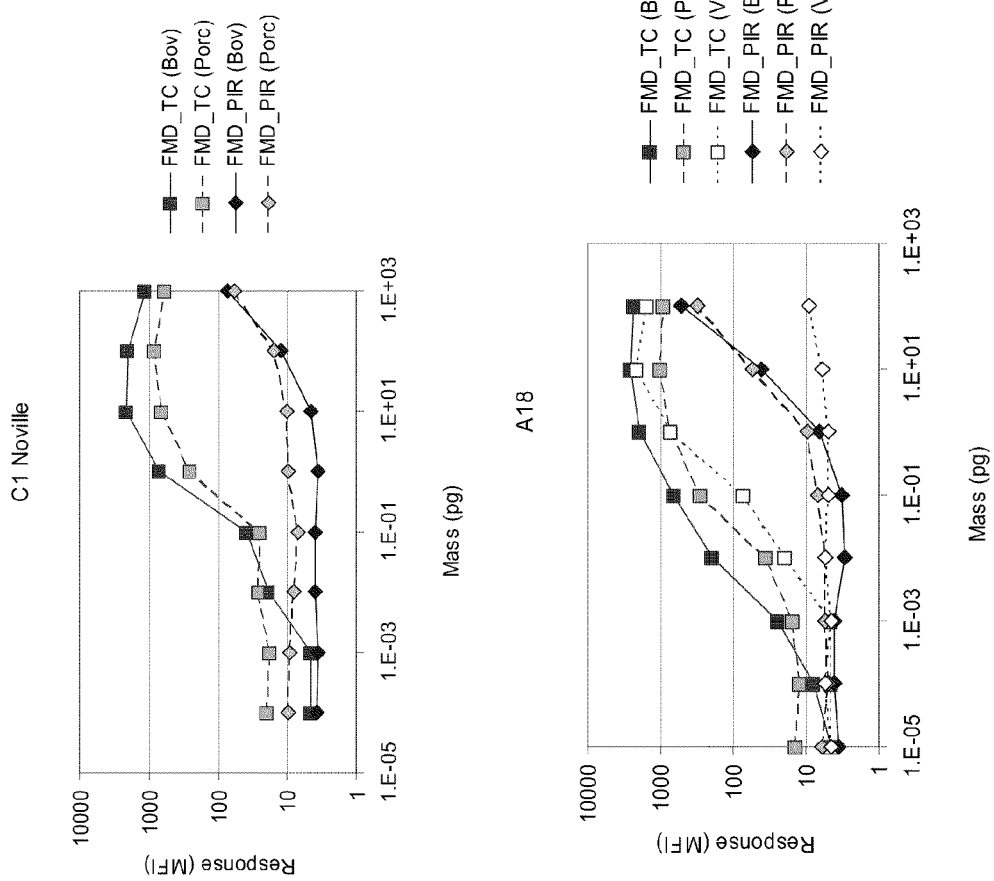
FIG. 21: Comparison of the response of two FMD signatures (FMD_TC and FMD_PIR) when incorporated into three different multiplex panels including the current Bovine (Bov), Porcine (Porc) and Version 1.0 (V1). Samples were serial dilution of extracted (Trizol) RNA from BEI inactivated FMDV virus representing five serotypes of FMDV. The Version 1.0 panel was not tested against C1 Noville.
Figure 21B:
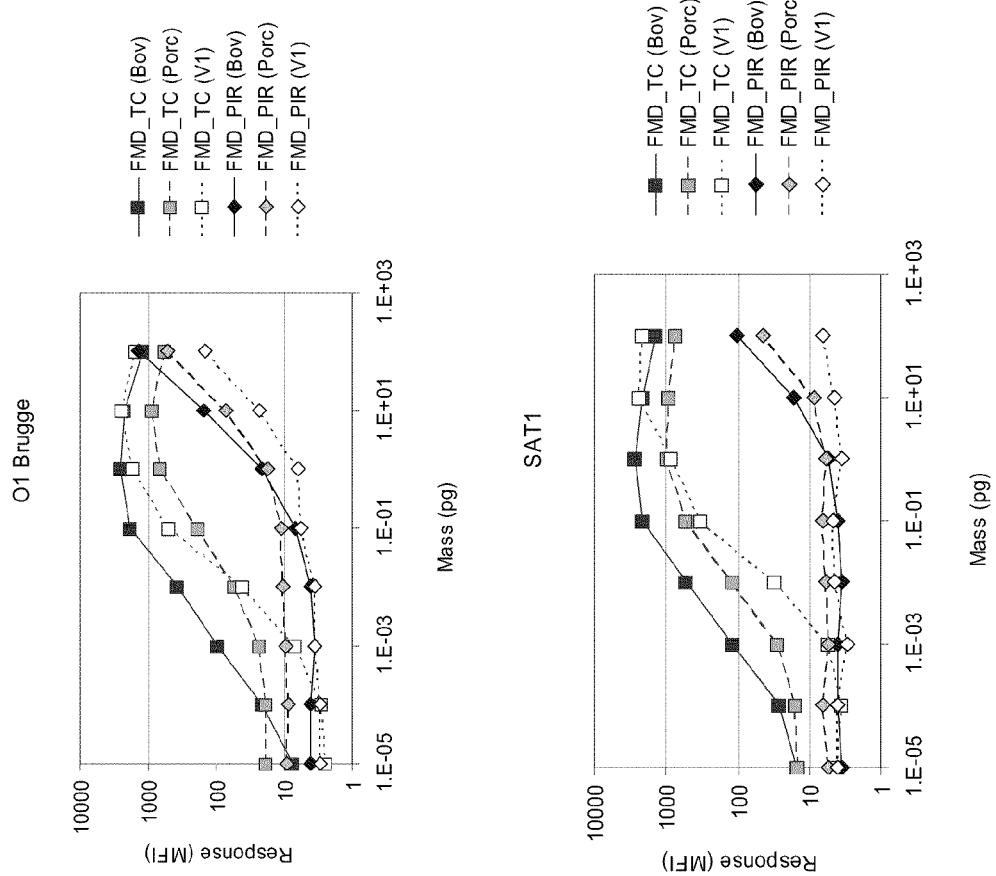
Figure 21C:
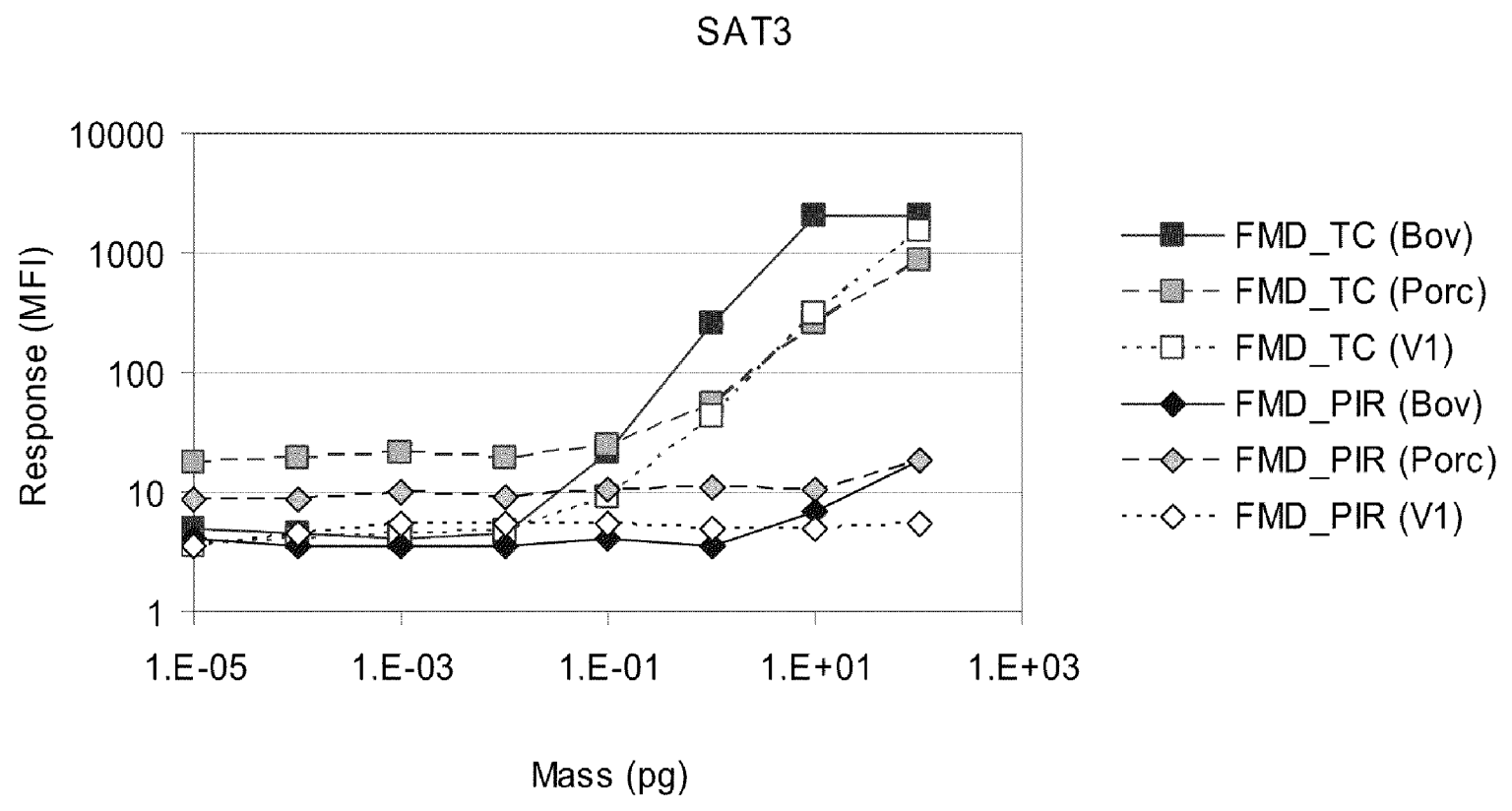
Figure 22:
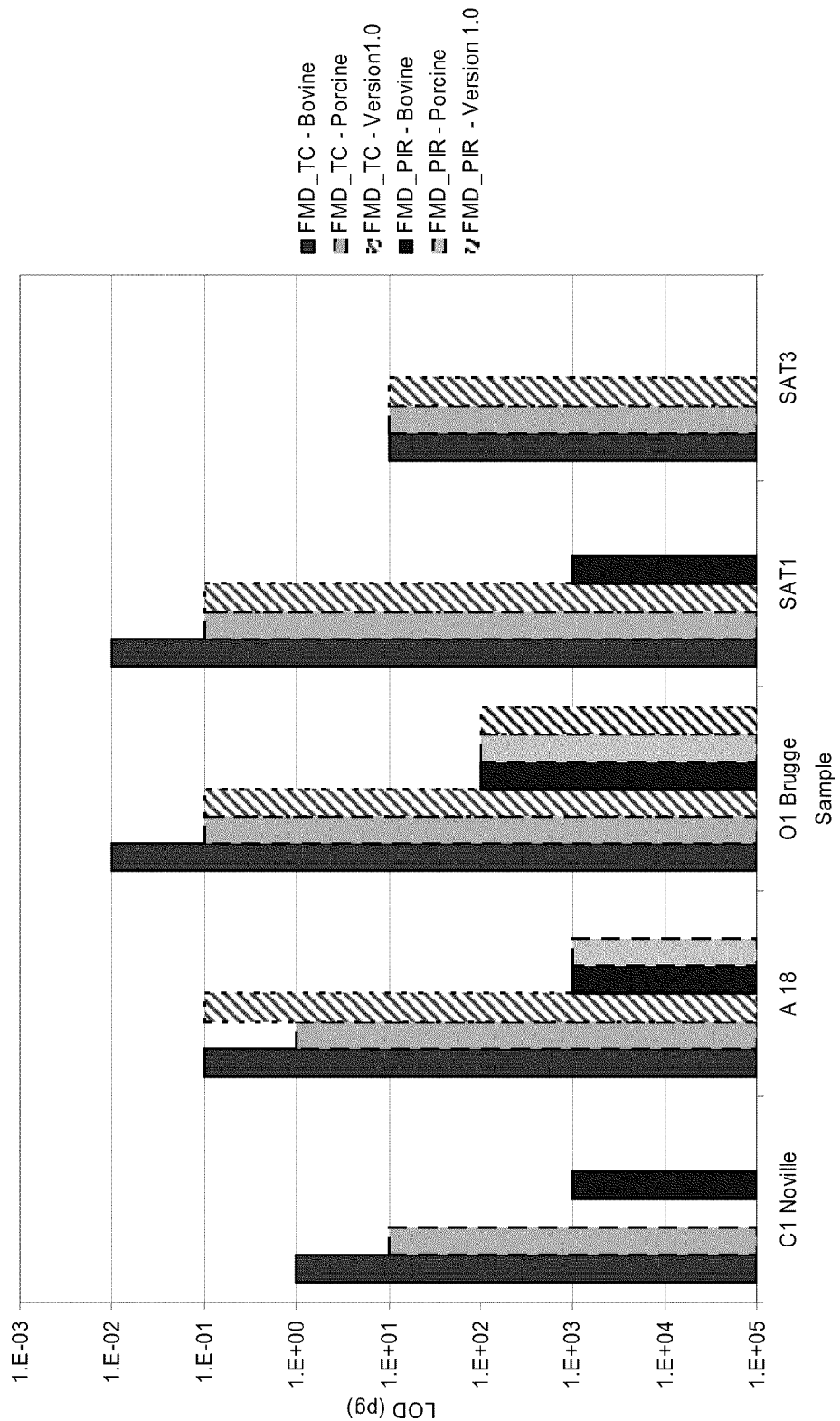
FIG. 22: Comparison of the response of two FMD signatures (FMD_TC and FMD_PIR) when incorporated into three different multiplex panels including the current Bovine (Bov), Porcine (Porc) and Version 1.0 (V1). Samples were serial dilution of purified RNA from BEI inactivated FMDV virus representing five serotypes of FMDV.

The results presented in FIG. 21 are summarized further in FIG. 22 where the qualitative limit of detection for each signature, in each panel, for each serotype of FMDV sample is presented. The qualitative LOD for FMD_TC has not changed more than one order of magnitude between panels. In some cases, the LOD of the FMD_TC signature in the Bovine panel improved over Version 1.0. Compared with Version 1.0, the FMD_PIR LOD improved for serotype A in the Bovine and Porcine panel. The between signature difference in LOD is also evident in the new Bovine and Porcine panels.

Target screening (Porcine panel): Titration data were obtained for the FMD signatures in the Porcine panel for strains representing each of the seven serotypes of FMDV. This testing was conducted at PIADC. The titration aimed to demonstrate that a given assay responds to the analyte of interest over a relevant concentration range. The titration series conducted were serial dilutions of nucleic acid purified from tittered virus-infected cell culture. The titration series enabled the estimation of the limit of detection for each assay for each strain of virus tested. The estimated limits of detection for the FMD signature in the porcine panel are shown in Table 26. The LOD of the FMD-Pir assay was superior to that of the FMD-Pir signature. To gauge fitness for purpose, this LOD data should be evaluated in context of the amount of FMDV likely to be present in the target sample matrix. For example, a loss of 3 orders of magnitude of analytical sensitivity may translate to a few percent loss of diagnostic sensitivity.

TABLE 26

Estimated LOD data for FMD signatures in the bovine
panel determined from target screening data acquired at PIADC.

| Serotype or strain | LOD, pfu/mL (MFI) | |
| --- | --- | --- |
| | FMD-TC | FMD-Pir |
| A Arg 2001 | 20000 (54.5) | 2000 (34.0) |
| O1 Korea | 2000 (41.5) | 11000 (32.5) |
| C4 Tierra | 200000 (60.5) | 200000 (10.5) |
| Asia 1 | 1100 (50.5) | 20 (10.5) |
| SAT 1 | 2000 (31.0) | 1100000 (14.0) |
| SAT 2 | 2 (17.5) | 20000 (9.5) |
| SAT 3 | 200000 (23.0) | 20000 (35.0) |
| Cutoff | (14.0) | (7.1) |

The concentration is represented as pfu/mL, division by 200 is required to concert to pfu/reaction. The signature response (MFI) at the estimated limit of detection is provided in parentheses, together with the cutoff.

Target screening (Bovine panel): Titration data were obtained for the FMD signatures in the Bovine panel for strains representing each of the seven serotypes of FMDV. This testing was conducted at PIADC. The estimated limits of detection for the FMD signatures in the porcine panel are shown in Table 27.

TABLE 27

Estimated LOD data for FMD signatures in the bovine
panel determined from target screening data acquired at PIADC.

| Serotype or strain | LOD, pfu/mL (MFI) | |
| --- | --- | --- |
| | FMD-TC | FMD-Pir |
| A Arg 2001 | 20 (31.5) | 2000 (6.0) |
| O1 Korea | 11 (87.0) | 1100 (14.5) |
| C4 Tierra | 1100 (77.0) | 20000 (7.0) |
| Asia 1 | 2 (20.5) | 11 (13.0) |
| SAT 1 | 11 (34.5) | 200000 (10.0) |
| SAT 2 | 0.11 (175.0) | 20000 (20.0) |
| SAT 3 | 1100 (20.5) | 2000 (11.0) |
| Cutoff | (7.6) | (4.8) |

The concentration is represented as pfu/mL, division by 200 is required to convert to pfu/reaction.

As described in a separate report, the LOD of both FMD signatures in the multiplex assay is higher than the singleplex Taqman assays, which in effect causes a reduction of diagnostic sensitivity. Using the signatures in combination does increase the overall diagnostic sensitivity of the multiplex assay. The combination of signatures in a finalized panel can cause LOD for any signature within the panel to change. Once a panel's composition has been finalized, further work could be conducted to determine the analytical sensitivity of all signatures including FMDV and undertake further optimization if required. Near-neighbor screening indicated that the specificity of the FMD signatures was preserved after their incorporation into the multiplex bovine and porcine panels.

4. Malignant Catarrhal Fever (MCF)—Bovine Panel

Signature candidates: Three new signatures are available for consideration, including MCF-1, MCF-2 and MCF-3. MCF can be caused by two viruses: ovine herpesvirus-2 (OvHV-2) and alcelaphine herpesvirus-1 (AHV1).

Signature origin: Signatures were designed at LLNL using one complete genome. All three signatures target different genes. MCF-1 targets the DNA polymerase gene ORF09. MCF-2 was not found to be associated with a known gene region. MCF-3 targets the putative major envelope glycoprotein gene ORF68.

Figure 23:
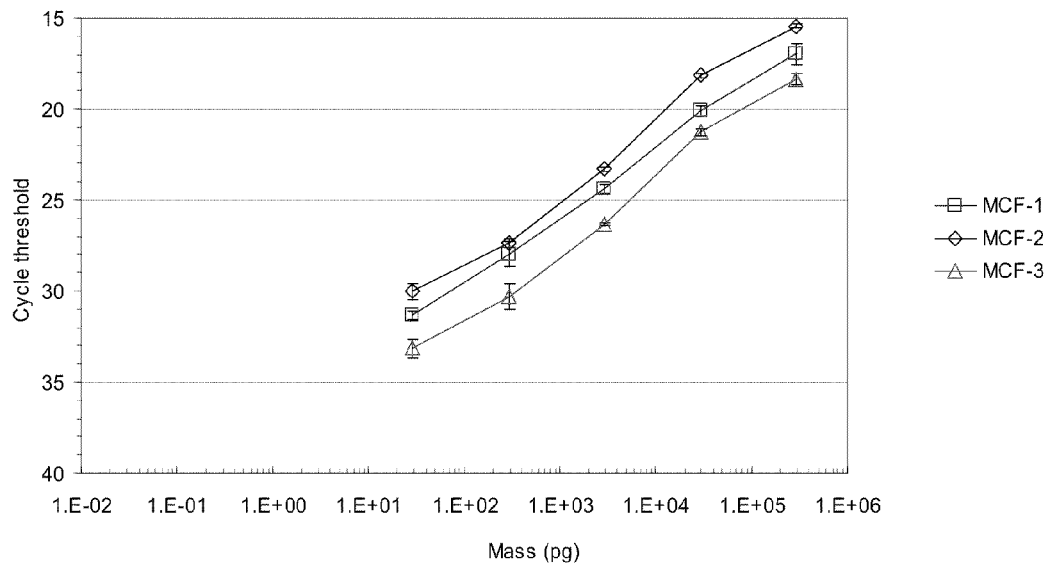
FIG. 23: Taqman screening of MCF signatures against A1HV-1 (MN, WC11). Total nucleic acid extracted (Ambion MagMax) from virus-infected cell culture media was used as template. Each point represents the mean response (n=3). Error bars indicate ±1σ of the mean. If no cycle threshold was reached (i.e. infinite cycle threshold), a cycle threshold of 40 was assigned in this plot.
Figure 23:
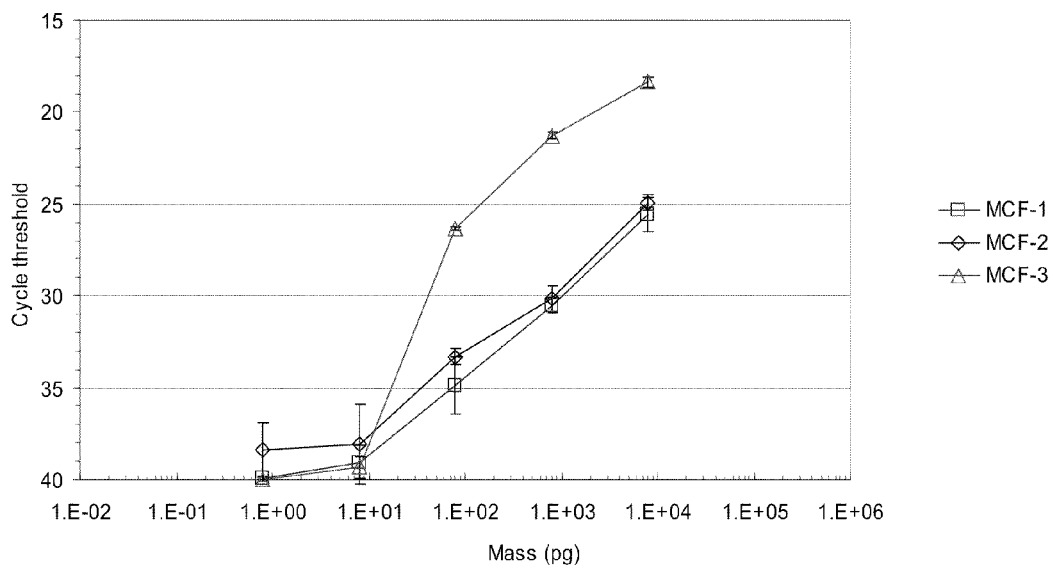

Target screening: The three signatures were screened against A1HV-1 (MN), A1HV-1 (WC11, an attenuated isolate) and OvHV-2 over a wide concentration range. All signatures responded well to A1HV-1 and the results are shown in FIG. 23. The signatures did not respond to the OvHV-2 strain. At the time the signatures were generated, no complete genome sequence information was available for OvHV-2.

Figure 24:
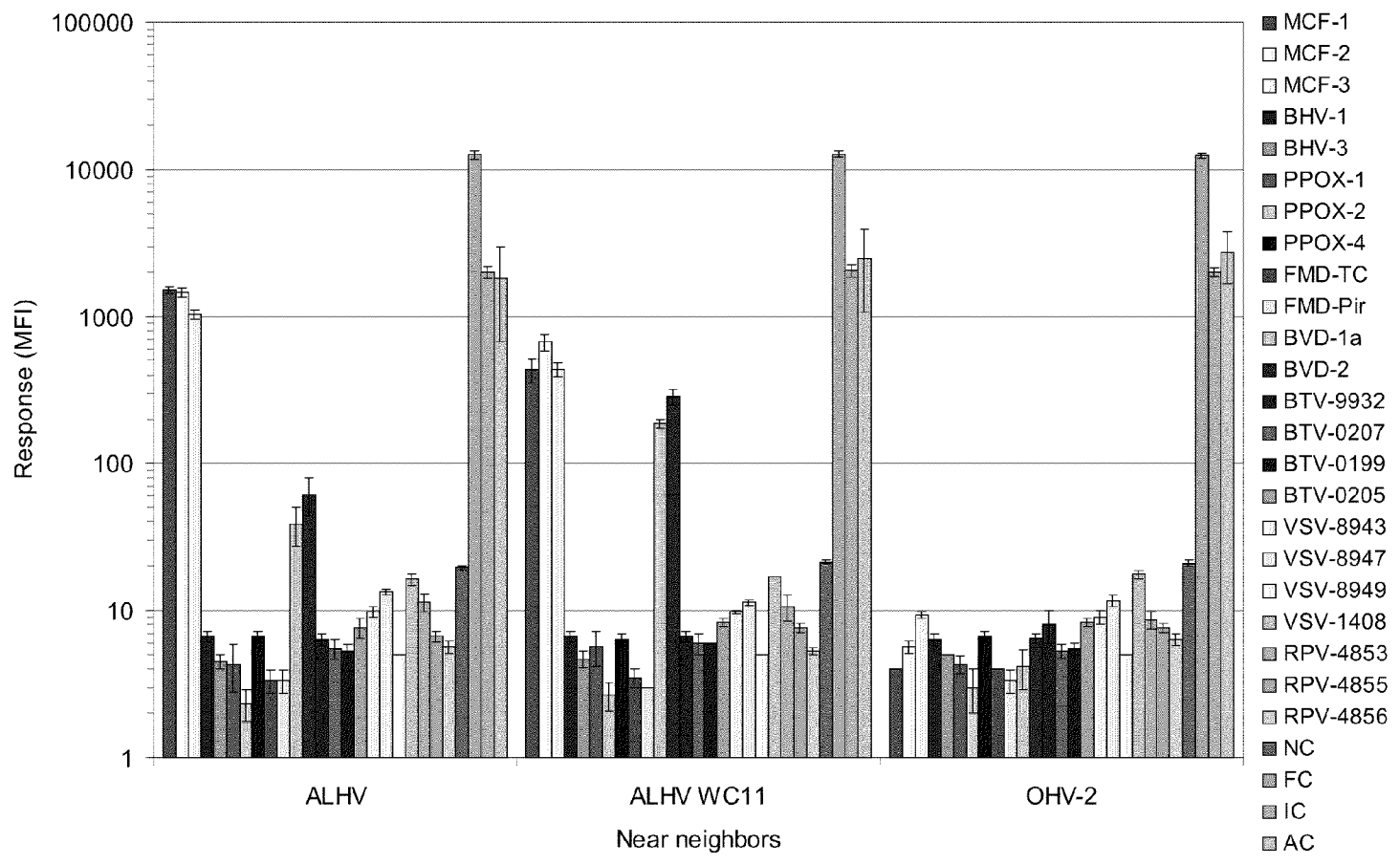

Near-neighbor screening: Near-neighbor testing conducted at PIADC shows that the MCF signatures detect AHV but not OVH-2 (FIG. 24). Other viruses considered near-neighbors include other common herpes viruses of cattle. The specificity or the MCF signatures is evident in screening at titration data presented for other viruses belonging to the Herpesviridae family presented in the bovine herpes virus-1 section.

Figure 25:
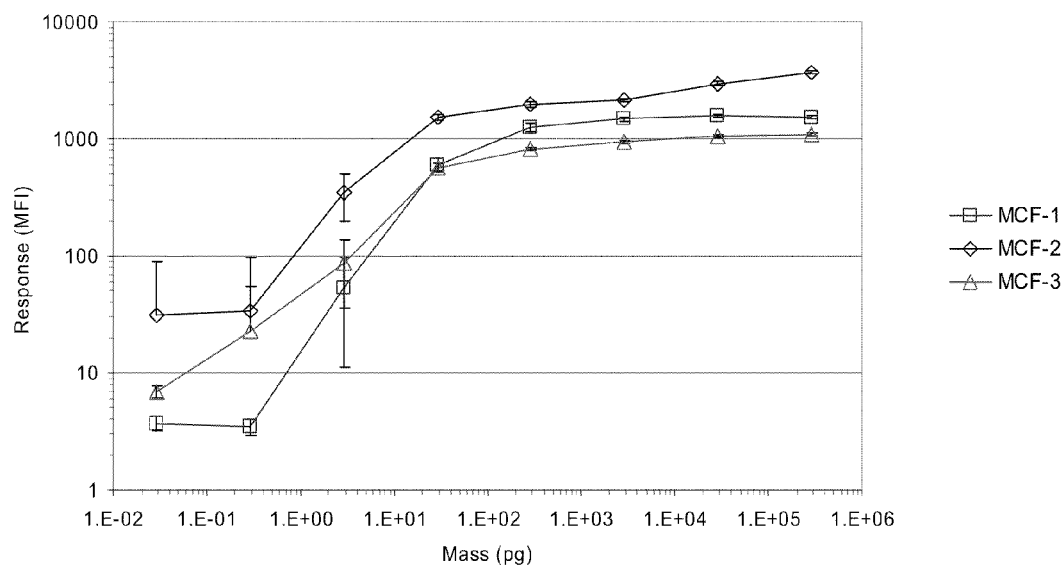
FIG. 25: Multiplex screening data for the three MCF signatures against AIHV-1 (MN, WC11) using a developmental version of the Bovine Panel. Serial dilution of nucleic acid extracted (Ambion MagMax 96) from virus-infected cell culture. Each point represents the mean response (n=4). Error bars indicate ±1σ of the mean.
Figure 25:
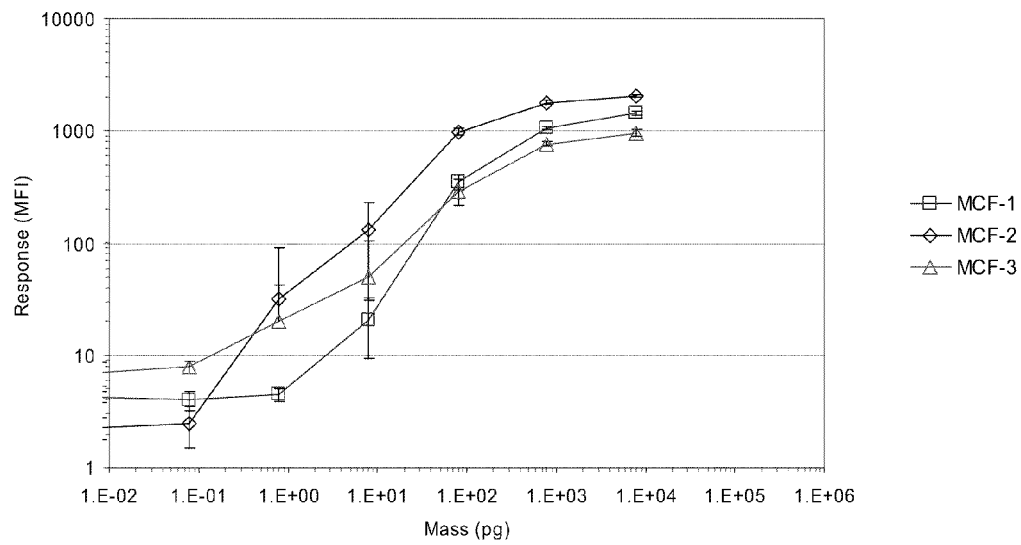

Target screening: All three signatures were added to current Bovine panel where they show low background response in the absence of template. The same samples used during the TaqMan screening phase were used to conduct multiplex screening using a developmental version of the Bovine panel. The multiplex titration results in FIG. 25 show that all three signatures responded similarly to both A1HV-1 strains. The results obtained in Taqman and multiplex formats agreed over the concentration ranges tested. Likewise, the three signatures did not respond to OvHV-2 DNA (6.4 ng) in multiplex format (data not shown).

Titration data were obtained for the MCF signatures in the Bovine panel. This testing was conducted at PIADC. The estimated limits of detection for the RPV signatures in the bovine panel are shown in Table 28.

TABLE 28

Estimated LOD data for MCF signatures in the bovine
panel determined from target screening data acquired at PIADC.

| Serotype or strain | LOD, copies/reaction (MFI) | | |
| --- | --- | --- | --- |
| | MCF-1 | MCF-2 | MCF-3 |
| A1Hv-1 MN | 55 (321.0) | 0.055 (9.0) | 1 (34.0) |
| WC11 | $10^a$ (100.0) | $5.5^a$ (95.5) | $10^a$ (166.0) |
| OvHv-2 | ND | ND | ND |
| Cutoff | (6.0) | (8.0) | (12.6) |

ND = not detected;
$^a$ = pg

All three signatures perform equivalently against the limited strains of material available during the development phase. The data indicates that all three MCF signatures could be incorporated into a Bovine panel. AHV-1 causes wildebeest-associated MCF and therefore warrants inclusion in a bovine multiplex FMDV rule-out assay. OHV-2 causes sheep-associated MCF, a prevalent disease of sheep. Cattle can become infected with OHV-2. If detection of OHV-2 is desired, LLNL has signatures for OHV-2 that could be considered for inclusion in a bovine multiplex assay panel.

5. Porcine Respiratory Reproductive Syndrome Virus (PRRSV)—Porcine Panel

Signature candidates: Five new signatures are available. Two signatures designed to detect North America (domestic) PRRSV include PRRS__1807706 and PRRS__1807709. Three signatures designed to detect European PPRSV include PRRS__1810351, PRRS__1810383 and PRRS__1810386.

Signature origin: Signatures were designed at LLNL in two main sets North American or domestic and European. For the domestic signatures PRRS genomes cluster into two sets identified by Dr. Kay Faaberg (our collaborator) as VR-2332/Minn and those identified as belonging to the RFLP 142 group. We used 8 complete genomes of the 142 group and 14 genomes for the VR-2332/Minn group which contained two unpublished complete genomic sequences of genomes from the latter group. For the European signatures we used a set of three complete genomes suggested by Dr. Faaberg that constitute that group. North American signatures PRRS_1807706 and PRRS_1807709 target the envelope protein GP2 and the nucleocapsid protein N genes, respectively. The European signatures PRRS_1810351, PRRS_1810383 and PRRS_1810386 target the replicase polyprotein 1A, GP2, and GP3-GP4 genes, respectively.

Figure 26:
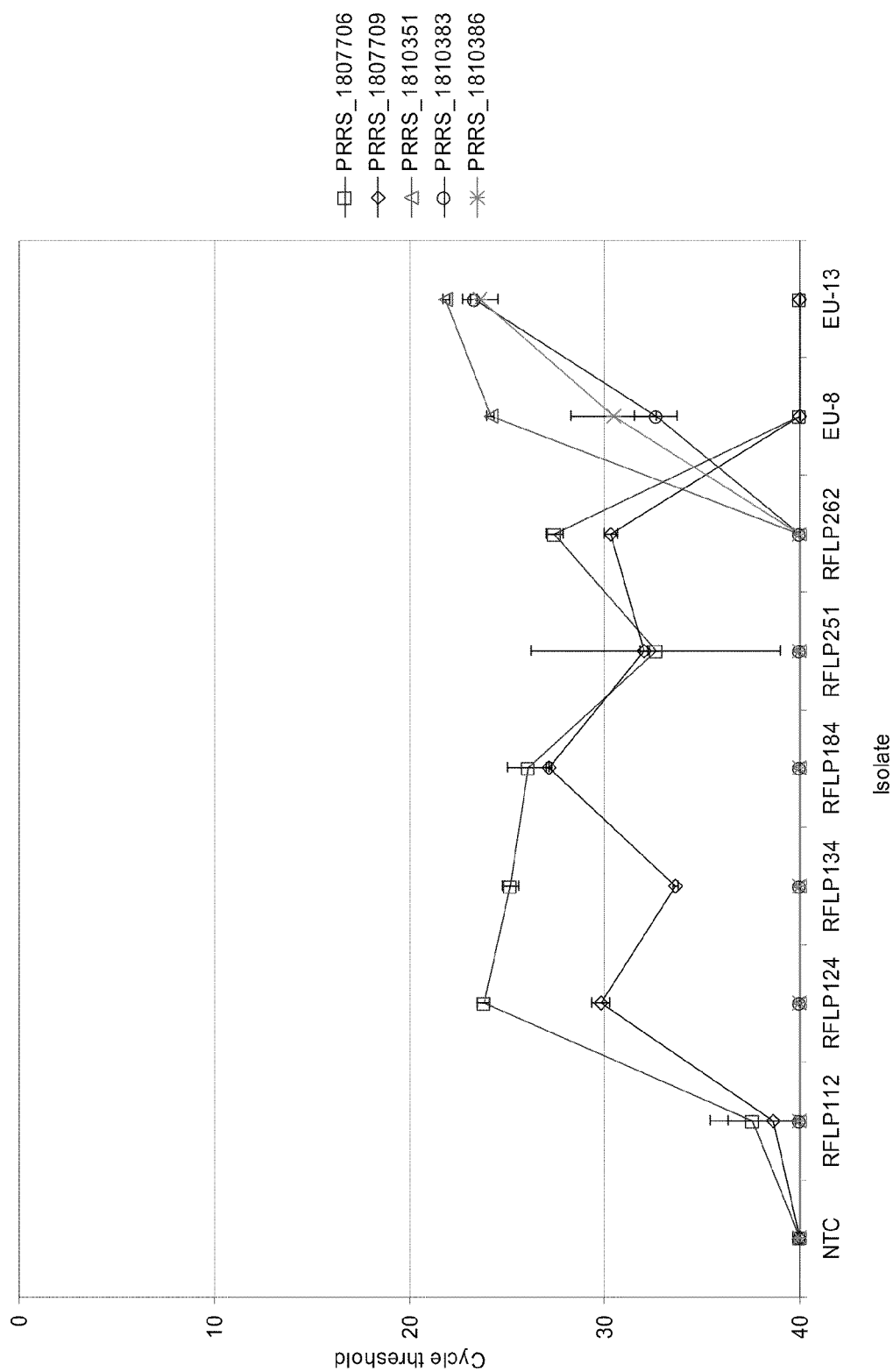
FIG. 26: Taqman screening of PRRS signatures against six North American and two European isolates. Total RNA (Trizol extracted) from non-infected (no template control, NTC) and virus-infected cell culture media wad used as a template. Each reaction was spiked with 200 pg. Each point represents the mean (n=3) cycle threshold. If no cycle threshold was reached (i.e. infinite cycle threshold), a cycle threshold of 40 was assigned in this plot. Error bars indicate ±1σ of the mean.

Target screening: Taqman screening of PRRS signatures was conducted at the University of Minnesota using seven North American (RFLP112, 124, 134, 184, 251 and 262) and two European (EU-8, EU-13) isolates shown in FIG. 26. As intended, PRRS_1807706 and PRRS_1807709 signatures responded to North American isolates, although the response to RFLP112 was weak for both signatures. The signatures PRRS_1810351, PRRS_1810383 and PRRS_1810386 only responded to European isolates.

Near-neighbor screening: The PRRS signatures in the current porcine panel were screened against two porcine coronaviruses. No cross-reaction was observed.

Target screening: All five signatures were added to the Porcine panel. The PRRS_1807709 exhibits an elevated background response (–50 to 200 MFI) in the Porcine panel. One possible cause of this behavior is a non-specific interaction between the PRRS_1807709 signature with another primer in the reaction mixture.

Figure 27:
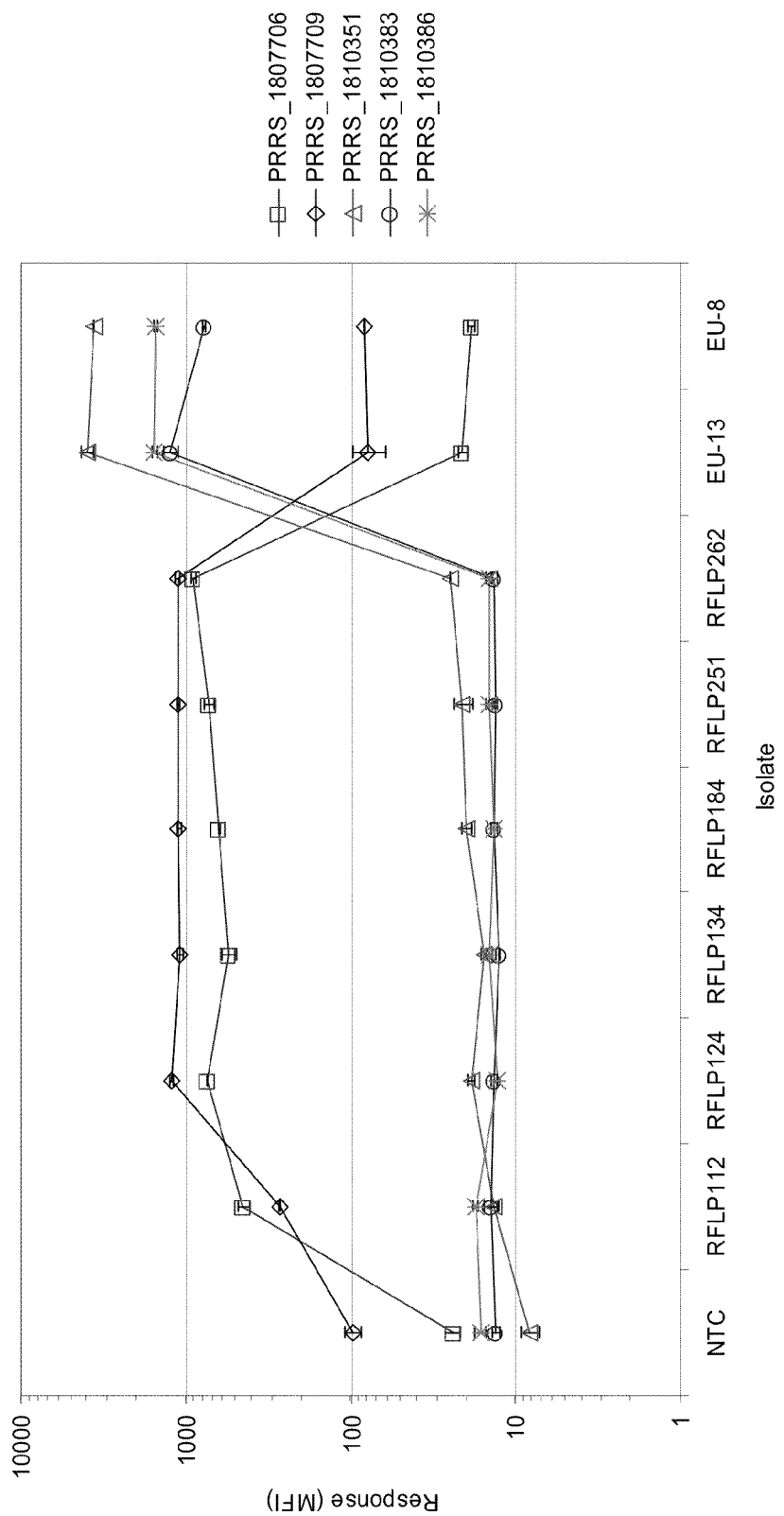
FIG. 27: Multiplex screening data for five PRRS signatures against six North American and two European isolates. Total nucleic acid was Trizol extracted from non-infected (no template control, NTC) and virus-infected cell culture media then used as a template. Each reaction was spiked with 200 pg. Each point represents the mean response (n=2). Error bars indicate ±1σ of the mean.

Different samples of the same isolates used during the Taqman screening phase (U. Minnesota) were used to conduct multiplex screening at LLNL. The multiplex spot-test results in FIG. 27 show that PRRS_1807706 and PRRS_1807709 signatures responded only to North American isolates, although their response to RFLP112 was weak. The signatures PRRS_1810351, PRRS_1810383 and PRRS_1810386 designed to respond to European PRRS strains only responded to European isolates. Taqman and multiplex target screening results agree.

Figure 28:
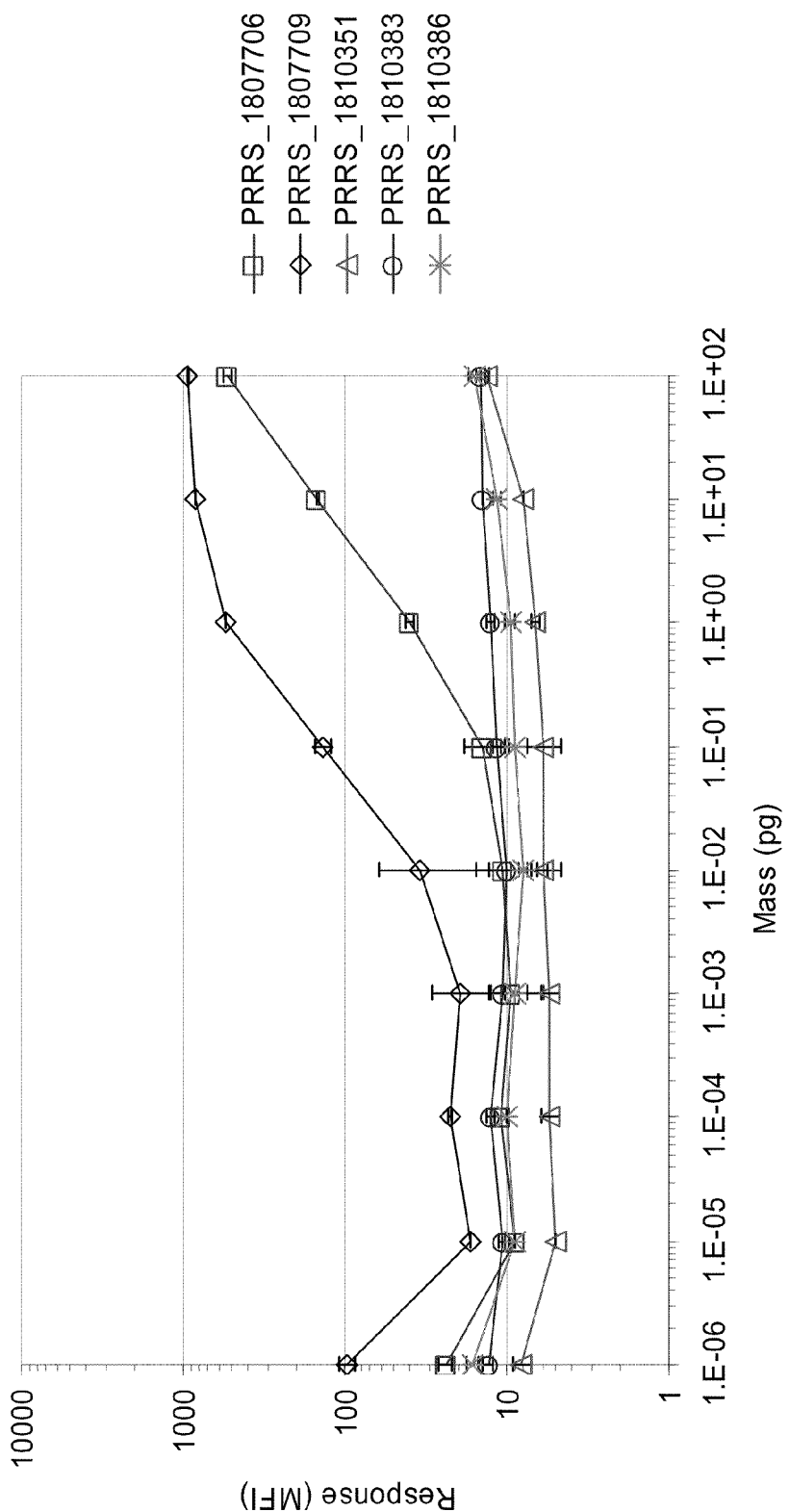
FIG. 28: Multiplex screening data for five PRRS signatures against the North American Strain (NVSL, 1989). Serial dilution of total nucleic acid Trizol extracted from virus-infected cell culture. Total nucleic acid was Trizol extracted from non-infected (no template control, NTC) and virus-infected cell culture media then used as template. Each point represents the mean response (n=2). Error bars indicate ±1σ of the mean.

Target screening using a North American strain (NVSL 89) was conducted at LLNL. FIG. 28 shows that both signatures PRRS_1807706 and PRRS_1807709 responded as expected to the North American strain over four orders of magnitude in concentration. The signatures PRRS_1810351, PRRS_1810383 and PRRS_1810386 designed to detect European strains did not respond to the North American strain.

Taman and multiplex target screening results are supportive of the advancement of these signatures to subsequent phases. Additional target screening may be required if further down-selection is required prior to addition in to the Porcine multiplex.

6. Rinderpest Virus (RPV)—Bovine Panel

Signature candidates: Three new RPV signature candidates are available for consideration. RPV signatures were not included in the Version 1.0 panel. The signatures are designated RPV_1814853, RPV_1814855 and RPV_1814856.

Signature origin: Signatures developed by LLNL using one published genome and five unpublished genomes. RPV_1814853 targets the nucleocapsid (N) protein RPV_1814855 and RPV_1814856 both target the polymerase (L protein) gene.

Near-neighbor screening: Signatures were screened at PIADC against five Peste de Petits Ruminants virus (PPRV) strains (RCA, Burkina Faso, Egypt 87, Dorcas and Ghana 76/1) at 200 pg (n=3) using extracted RNA template from virus-infected cell culture (Qiagen RNeasy Mini kit). No cross-reactivity was observed.

Figure 29:
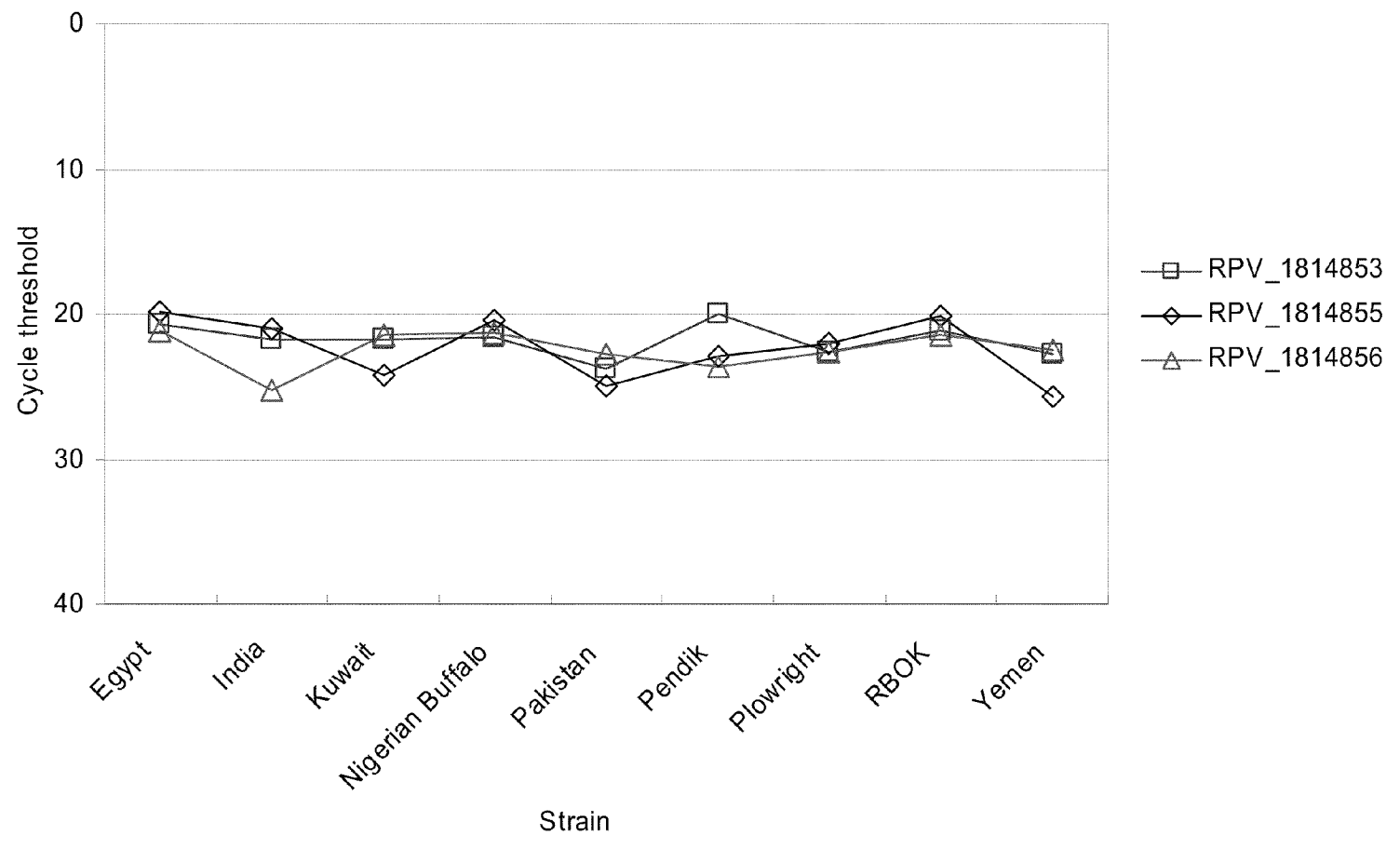

Target screening: All signatures were screened against nine RPV strains and the results are shown in FIG. 29. All three signatures responded well to 9/9 strains tested.

Figure 30A:
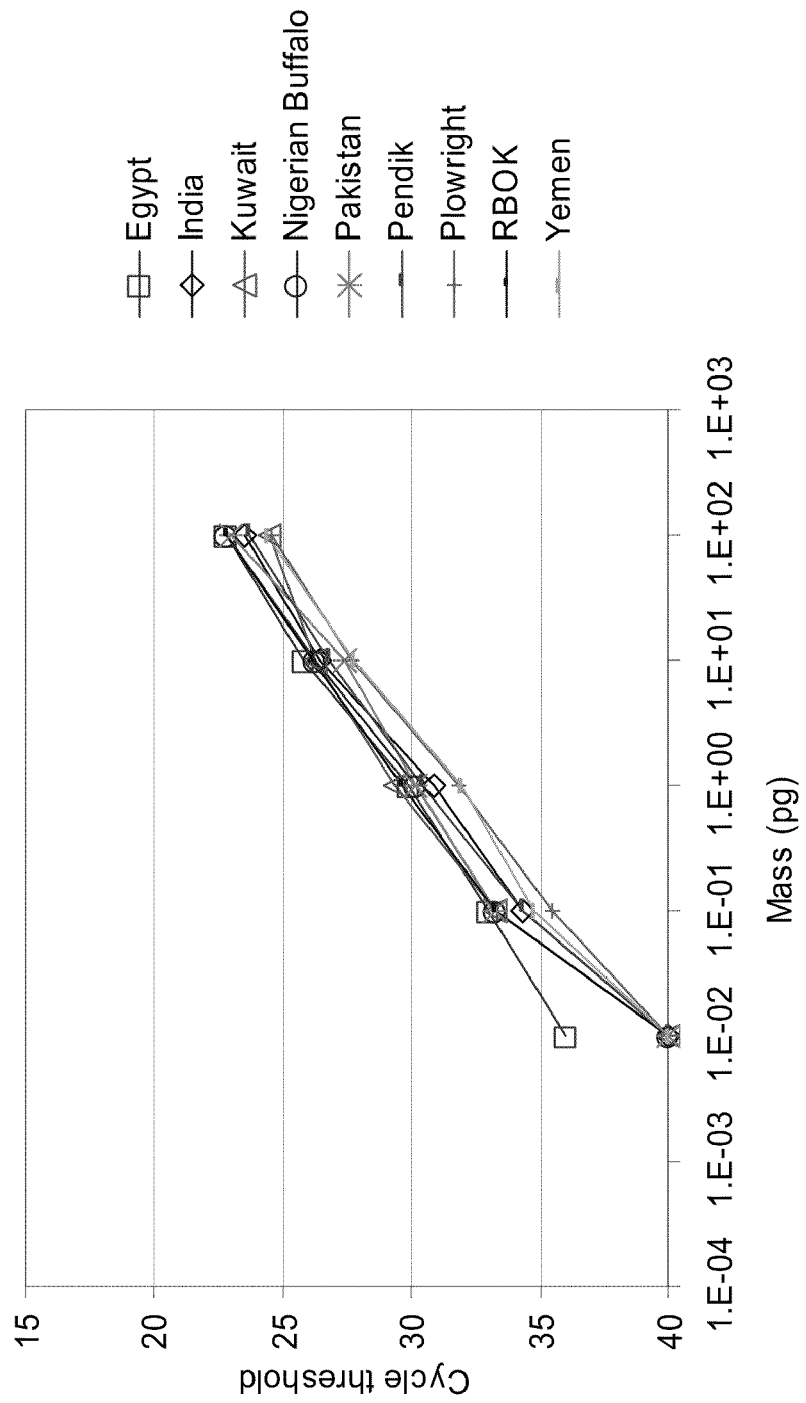
FIG. 30: Taqman response of RPV signatures (RPV_1814853, RPV_1814855 and RPV_1814856) against nine RPV strains over four orders of magnitude in template concentration. Samples were serial dilutions of total RNA extracted (Qiagen RNeasy Mini kit) from virus-infected cell culture (Qiagen RNeasy Mini kit). Each point represents the mean (n=3) cycle threshold. If no cycle threshold was reached (i.e. infinite cycle threshold), a cycle threshold of 40 was assigned in this plot.
Figure 30B:
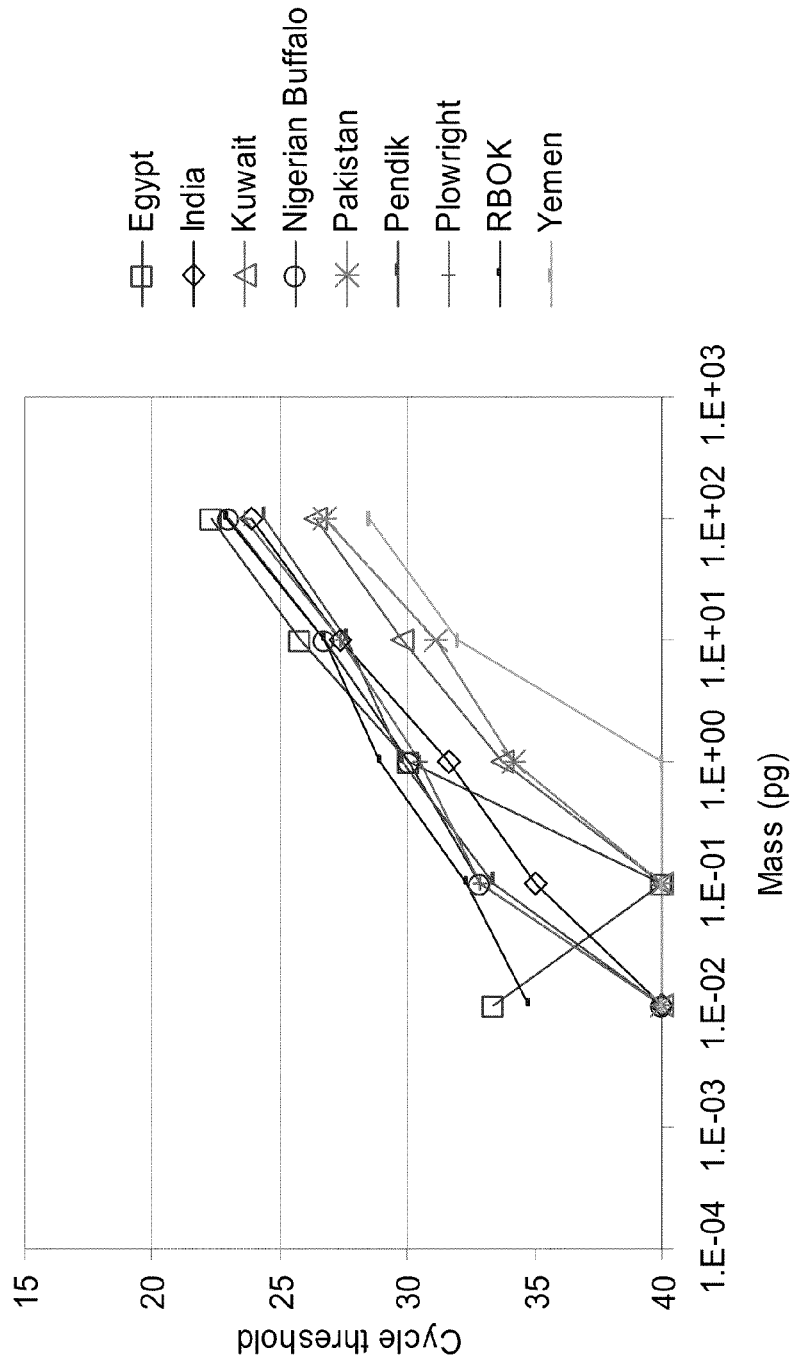
Figure 30C:
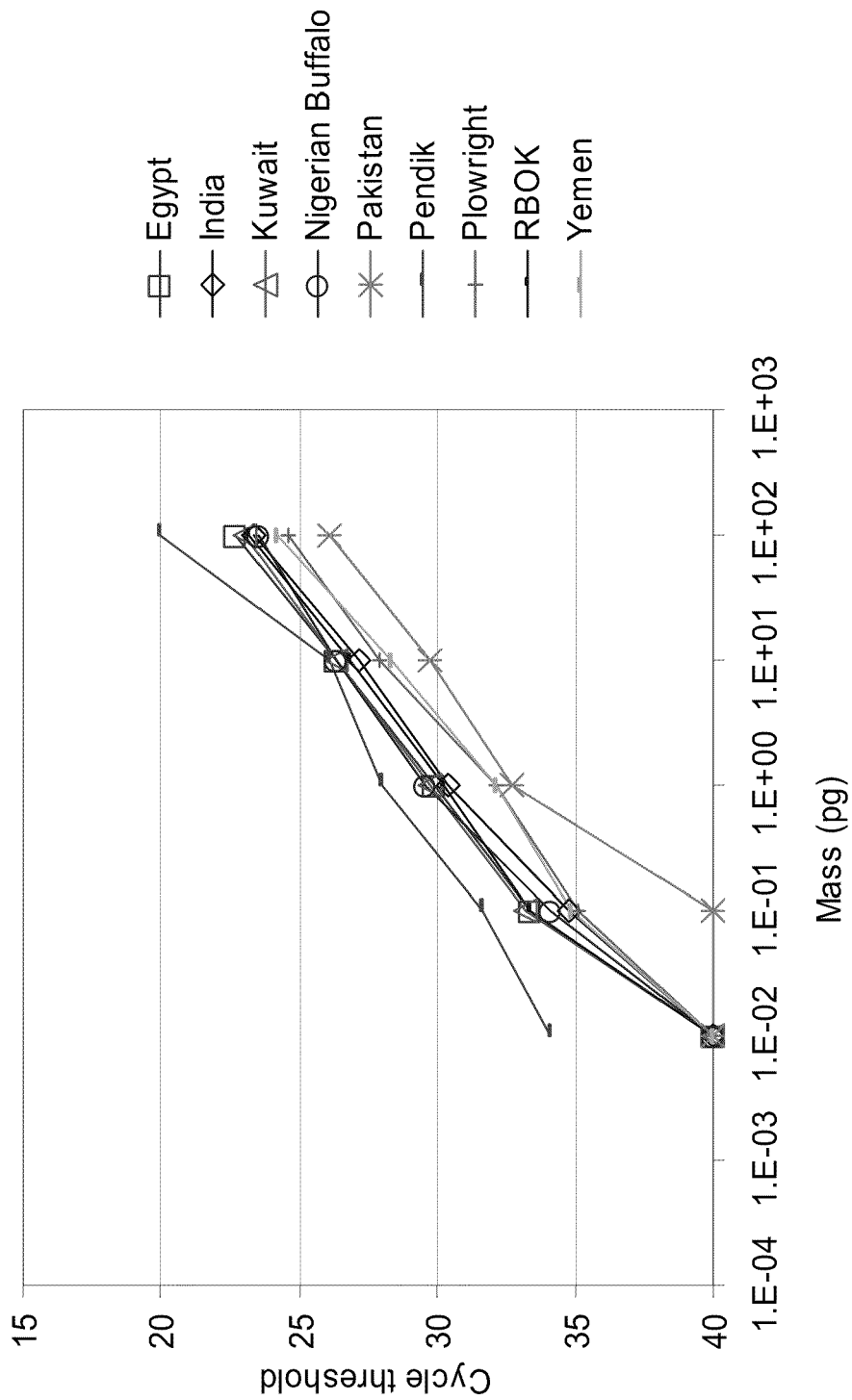

Additional Taqman screening was conducted at PIADC using serial dilutions of purified RNA of the same nine strains. The results summarized in FIG. 30 show that the cycle threshold decreased as the mass of template per reaction increased. RPV_1814853 signature showed the most consistent results over all concentrations for all strains.

Near-neighbor screening: Signatures were screened at PIADC against five PPRV strains (Burkina Faso, Dorcas, Egypt 87, Ghana 76/1 and RCA,) at 200 pg (n=3) using extracted RNA template from virus-infected cell culture (Qiagen RNeasy Mini kit). No cross-reactivity was observed.

Target screening: All three RPV signatures have been added to the current Bovine panel where they show consistently low background response in the absence of template. Target screening was conducted at PIADC against available strains of RPV. All three signatures responded to all strains of RPV tested. The estimated limits of detection for the RPV signatures in the bovine panel are shown in Table 29.

TABLE 29

Estimated LOD data for RPV signatures in the bovine panel determined from target screening data acquired at PIADC.

| Serotype or strain | LOD, TCID$_{50}$/mL (MFI) | | |
| --- | --- | --- | --- |
| | RPV-4853 | RPV-4855 | RPV-4856 |
| India | 20 (20.0) | 110 (43.0) | 2000 (6.0) |
| Pakistan | 2 (40.5) | 200 (38.5) | 1100 (14.5) |
| Egypt | 11 (261.0) | 2 (20.5) | 20000 (7.0) |
| Kuwait | 20 (47.5) | 2000 (30.5) | 11 (13.0) |
| Nigerian buffalo | 110 (127.0) | 110 (40.0) | 200000 (10.0) |
| Plowright | 101 (178.5) | 200 (87.5) | 20000 (20.0) |
| RBOK | 200 (51.0) | 200 (19.0) | 2000 (11.0) |
| Cutoff | (11.0) | (9.6) | (8.9) |

The RPV signatures together demonstrate promising performance in Taqman formats. Multiplex screening against target and near-neighbor material indicates that the three RPV signatures perform well in the prototype bovine panel.

7. Swine Vesicular Disease Virus (SVDV)—Porcine Panel

Signature candidates: SVD_1, SVD_2, SVD_3. These signatures were adopted from the Version 1.0 panel without change.

Signature origin: Signatures were designed at LLNL using five complete genomes. SVD_1, SVD_2 and SVD_3 signatures target ID protein (coat protein), membrane permeability enhancement and RdRp genes, respectively Near-neighbor screening: SVD-1 and SVD-2 did not cross-react with 10 human enterovirus B strains (Cox A9, B1, B4, B5, B6, Echo 11, Echo 9H11 and Echo24).

Figure 32:
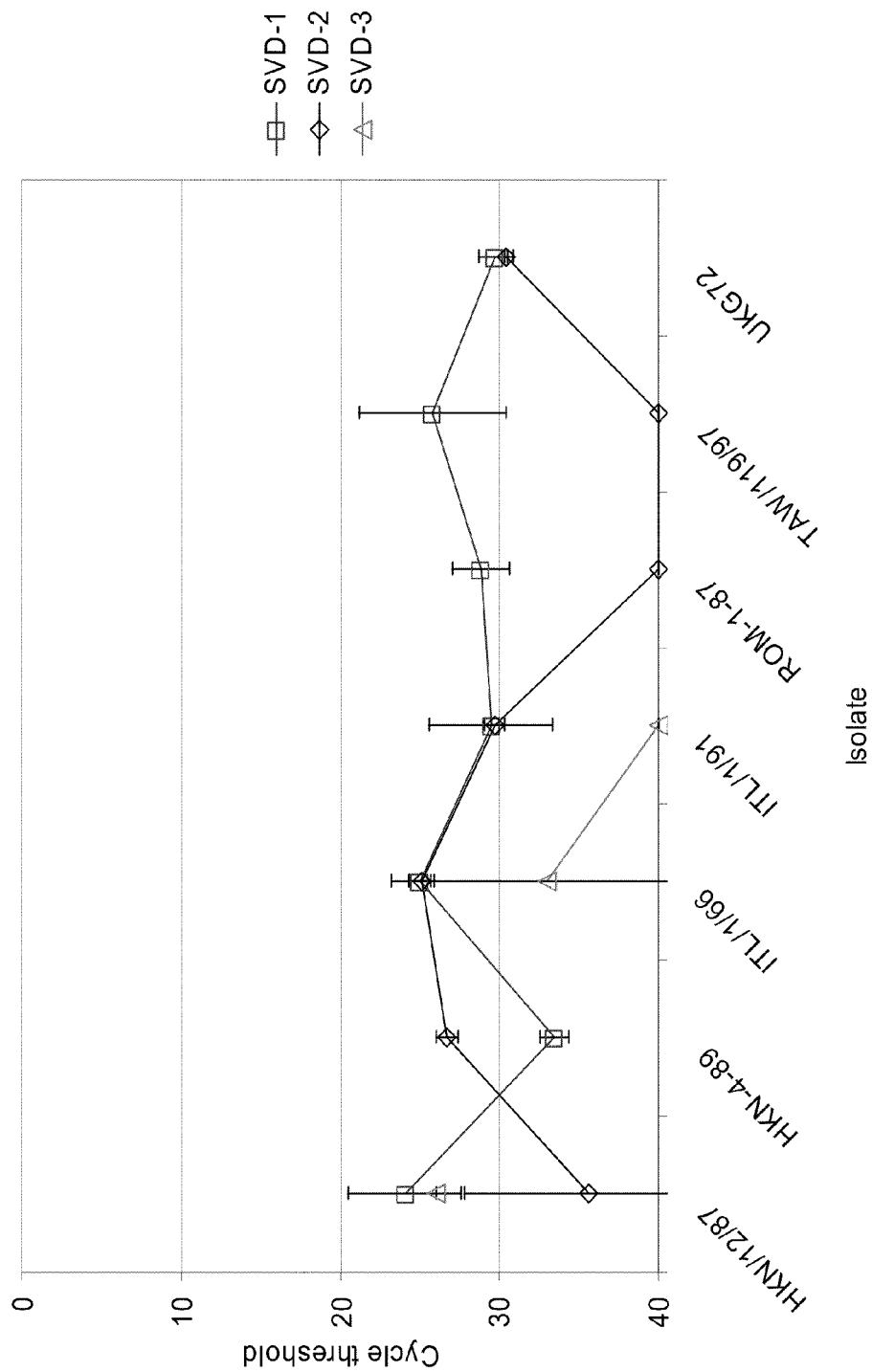
FIG. 32: Taqman screening of SVD signatures against seven isolates of SVDV (PIADC). Virus-infected cell culture media was used as template. Each point represents the mean (n=3) cycle threshold. If no cycle threshold was reached (i.e. infinite cycle threshold), a cycle threshold of 40 was assigned in this plot.

Target screening: The three SVD signatures were screened against eleven isolates of SVDV at PIADC (FIG. 32). SVD-1 detected 7/7 isolates. SVD-2 detected 4/7 isolates, missing HKN/12/8, RON-1-87, TAW/119/97. Taqman target screening for the SVD-3 signature is lacking data for five isolates and may need to be screened further. Of the two isolates screened to date, one generated a weak response (ITL/1/88) and the other no response (ITL/1/99).

Figure 33:
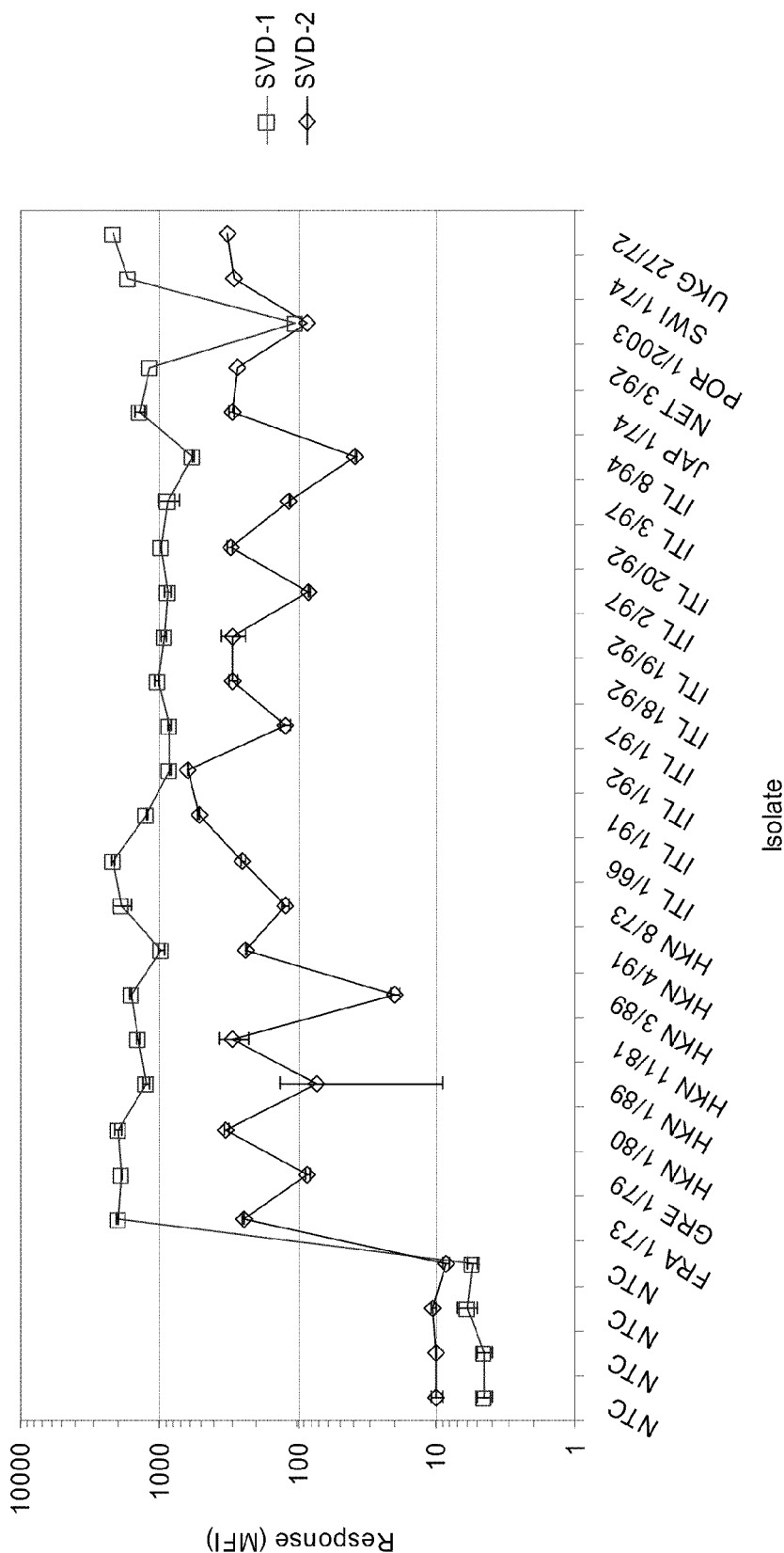
FIG. 33: SVDV signature screening in singleplex format against twenty-three isolates of SVDV (Canada). Samples comprised of a non-infected culture media (no template control, NTC) and virus-infected culture media spiked into each PCR reaction. Each point represents the mean response (n=2). Error bars indicate ±1σ of the mean.

Target screening: Spot-testing results using virus-infected cell culture as the template are shown in FIG. 33. SVD-1 showed a strong response to 23/23 isolates. SVD-2 response was up to 100 times weaker than SVD-1.

Figure 34:
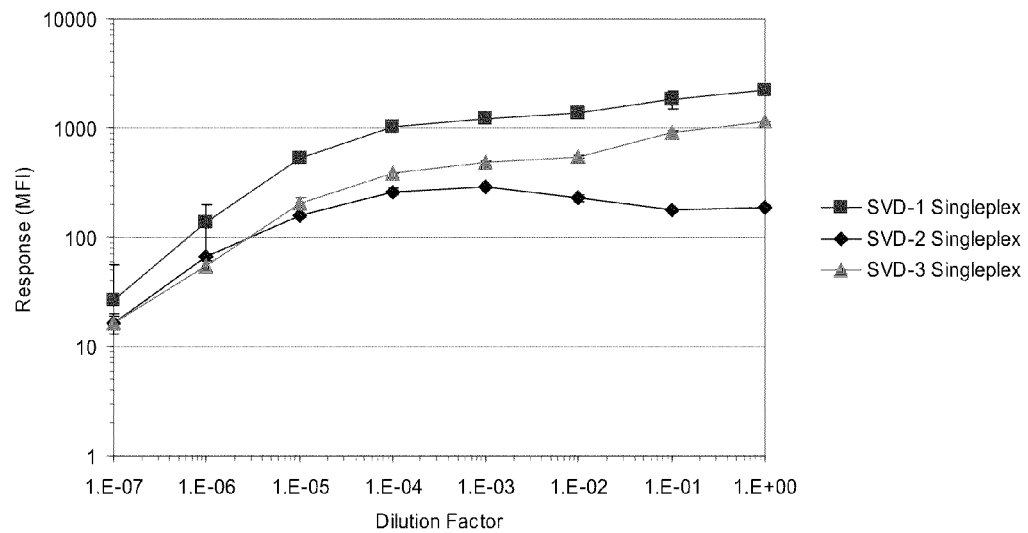
FIG. 34: SVDV signature screening in singleplex format showing signature response to two strains ITL1/66 and ITL 1/91. Samples were serial dilutions of total nucleic acid extracted from untitered virus-infected cell culture and are presented as dilution factor. Each point represents the mean response (n=2). Error bars indicate ±1σ of the mean.
Figure 34:
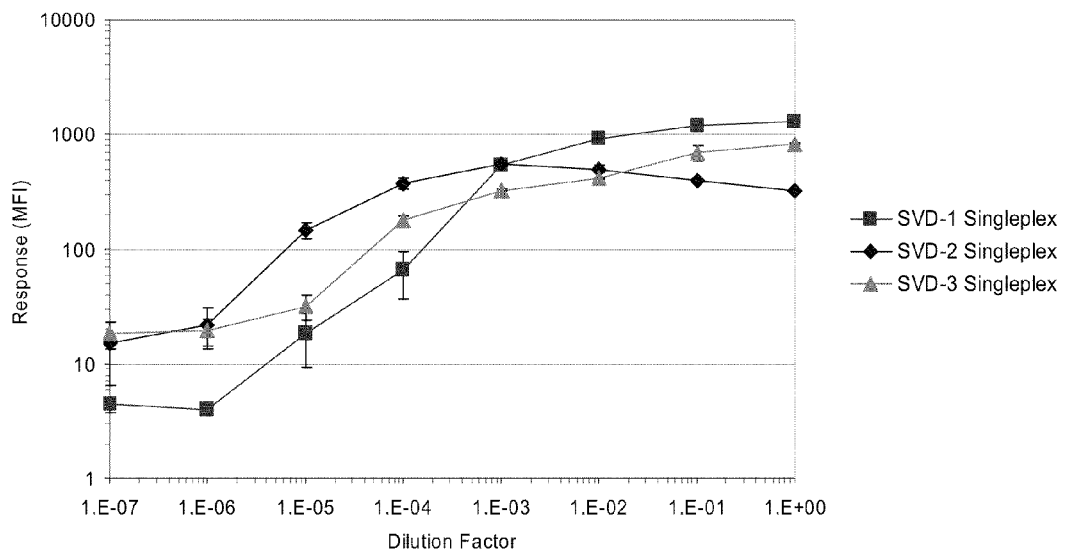

Further testing of the three signatures was undertaken in singleplex format during testing at NCFAD (Winnipeg, Canada). The results are shown in FIG. 34. These serial dilutions of untitered virus indicate that all three signatures responded over seven orders of magnitude of template concentration.

Near-neighbor screening: Near-neighbor testing of the SVD signatures was for the porcine panel. FMDV is considered a near-neighbor for SVDV. Specificity of the SVDV signatures is evident in data presented during FMDV target and near-neighbor screening. The SVDV signatures did not cross-react with FMDV, CVB5, PEV or PTV.

Figure 35:
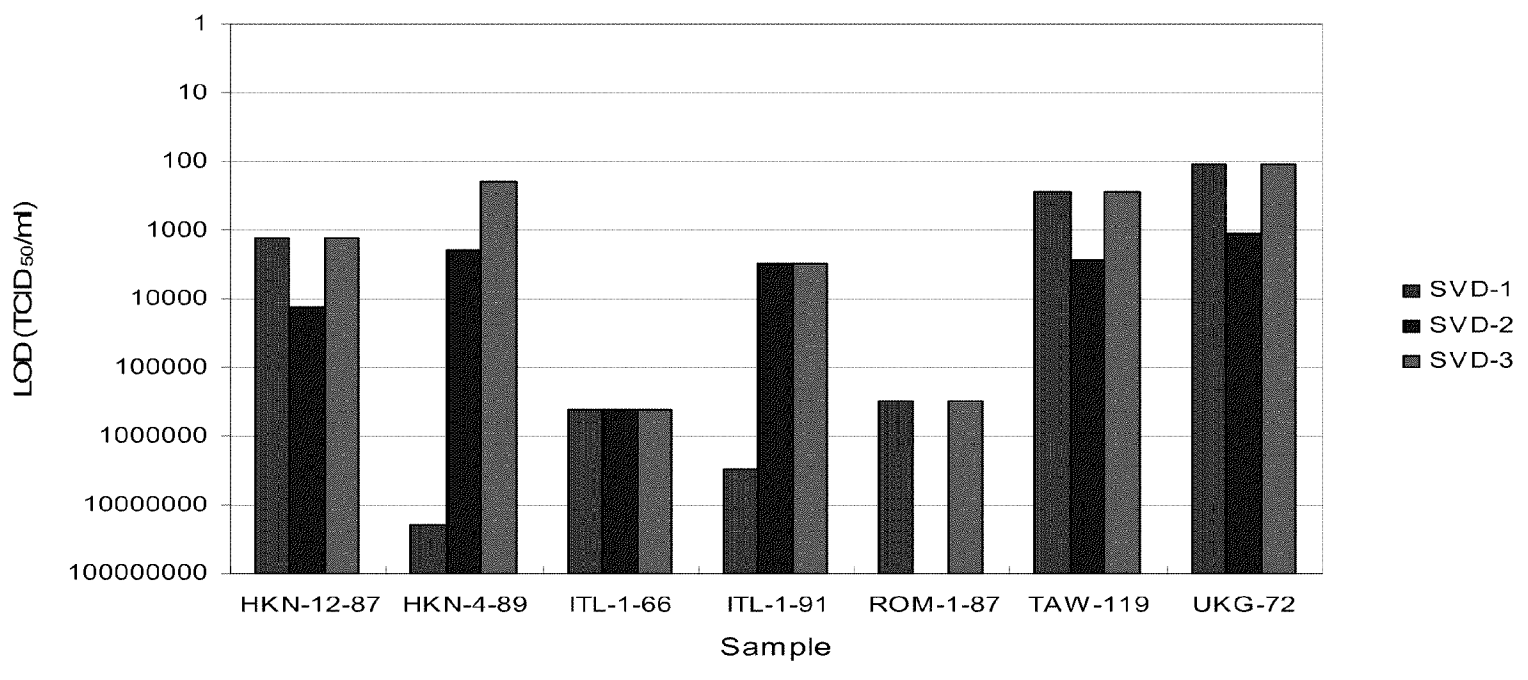

Target screening: Characterization data captured for these signatures in the Version 1.0 panel as supporting information. FIG. 35 indicates that three SVD signatures offer complementary coverage of SVD isolates.

The three signatures were added to the Porcine panel and were screened against targets at PIADC. The estimated limits of detection for the SVD signatures in the porcine panel are shown in Table 30.

TABLE 30

Estimated LOD data for SVD signatures in the porcine panel determined from target screening data acquired at PIADC.

| Strain | LOD, TCID$_{50}$/mL (MFI) | | |
|---|---|---|---|
| | SVD-1 | SVD-2 | SVD-3 |
| ITL 1/91 | 110000 (28.5) | 2000 (12.5) | 2000 (15.0) |
| HKN 12/87 | 1100 (27.0) | 20000 (27.5) | 2000 (29.5) |
| TAW 119/97 | 200 (14.0) | 20000 (13.0) | 200 (29.0) |
| ITL 1/66 | 110 (13.5) | 1100 (19.5) | 200 (11.0) |
| HKN 4/89 | 200000 (26.0) | 2000 (26.5) | 20 (8.0) |
| ROM 1/87 | 20000 (15.5) | ND | 20000 (8.3) |
| UKG 72 | 20 (9.5) | 200 (17.0) | 110 (22.0) |
| Cutoff | (8.6) | (9.4) | (7.8) |

ND = not detected

All three SVD signatures are suitable candidates for inclusion in the Porcine panel. Further screening of the SVD_3 signature against target and near-neighbors may need to be acquired to support signature selection.

8. Vesicular Exanthema of Swine Virus (VESV)—Porcine Panel

Signature candidates: VESV_1, VESV_4, VESV_5. These three signatures were adopted from the Version 1.0 panel without change.

Signature origin: Signatures were designed at LLNL using one complete genome. All three signatures target different regions of a large polyprotein gene that spans over 5000 base pairs.

Figure 36:
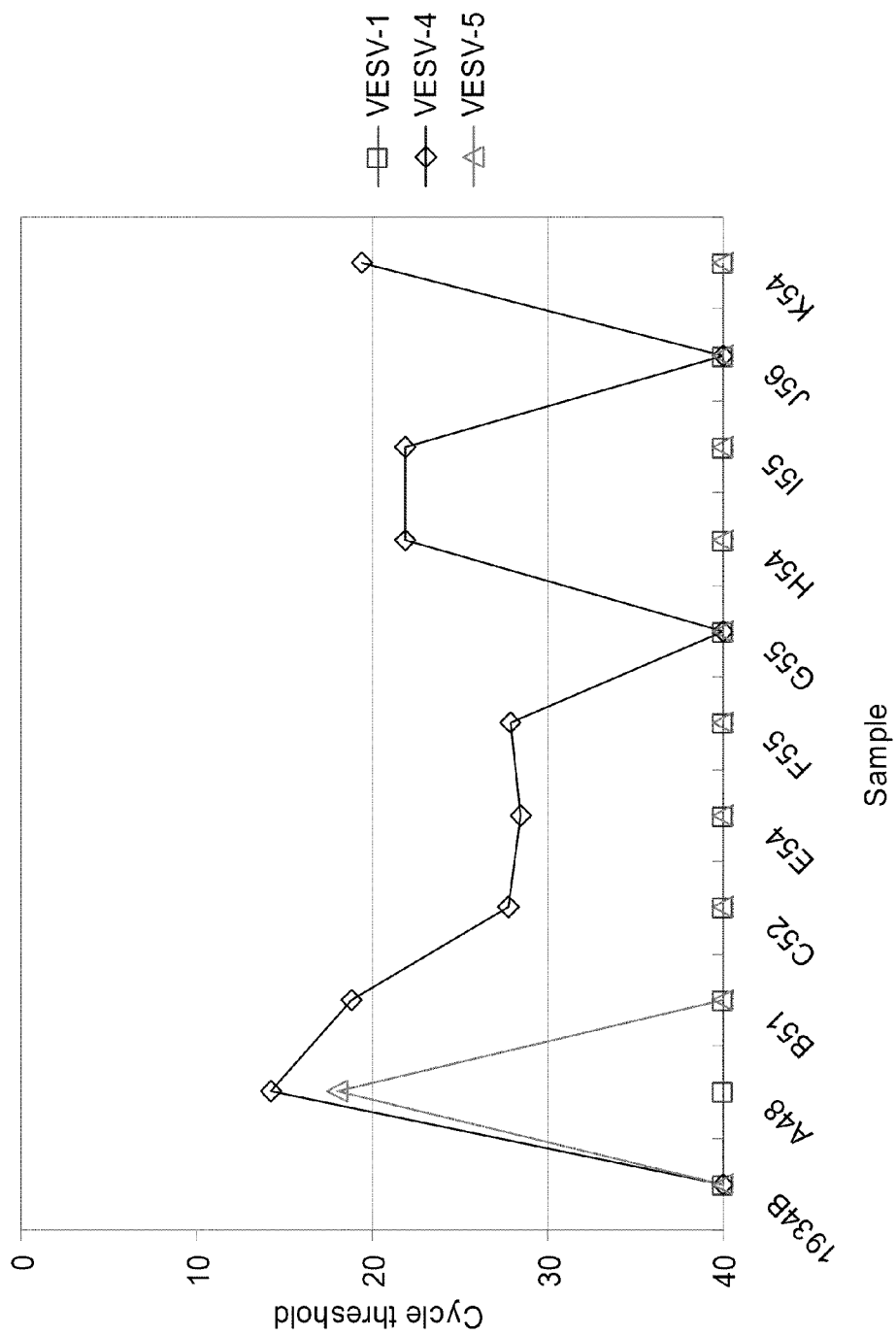
FIG. 36: Taqman screening of VESV signatures against eleven isolates of VESV. Virus-infected cell culture media was used as a template. Each point represent the mean (n=3) cycle threshold. If no cycle threshold was reached (i.e. infinite cycle threshold), a cycle threshold of 40 was assigned in this plot. Each point represents the mean response (n=3).

Target screening: VESV isolates 1934B, $A_{48}$, $B_{51}$, $C_{52}$, $D_{53}$, $E_{54}$, $F_{55}$, $G_{55}$, $H_{54}$, $I_{55}$, $J_{56}$ and $K_{54}$ were screened and the results are shown in FIG. 36. VESV_4 detected 8/11 strains tested. VESV_5 only detected 1/11 strains.

Figure 37:
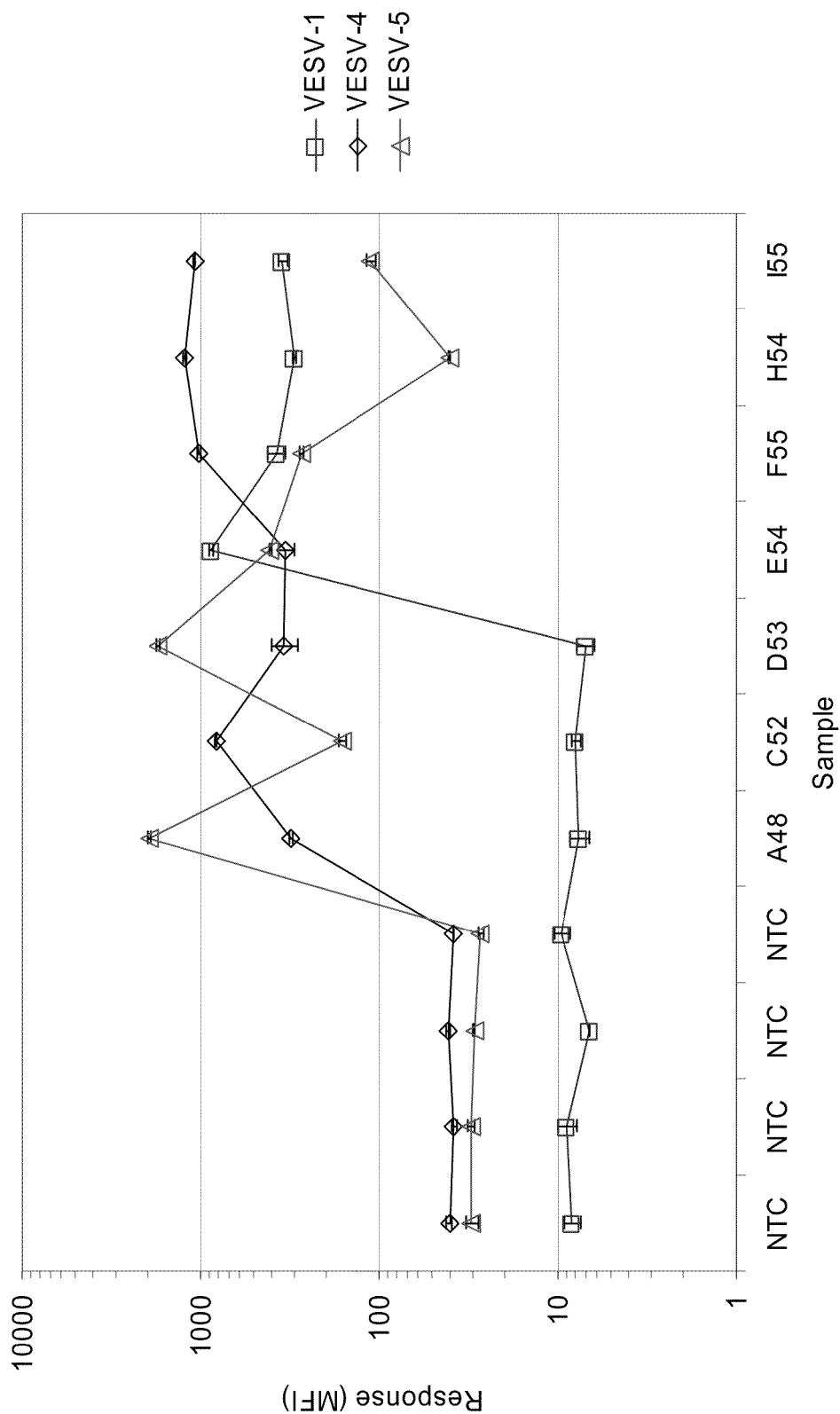
FIG. 37: VESV signature screening in singleplex format against seven strains of VESV. Samples comprised of a negative control (NTC, non-infected culture media) and virus-infected culture media. Each point represents the mean response (n=2). Error bars indicate ±1σ of the mean. VESV_1 response represents corrected data; raw data was on average 4.1 times higher for all channels during VESV_1 screening due to an operator error in instrument calibration.

Target screening: Spot-testing was conducted in singleplex format using virus-infected cell culture as the template shown in FIG. 37. VESV-4 detected 7/7 isolates which was consistent with Taqman target screening. VESV-5 detected 6/7 isolates (weak response on $H_{54}$) whereas VESV-1 detected 4/7 isolates.

Figure 38:
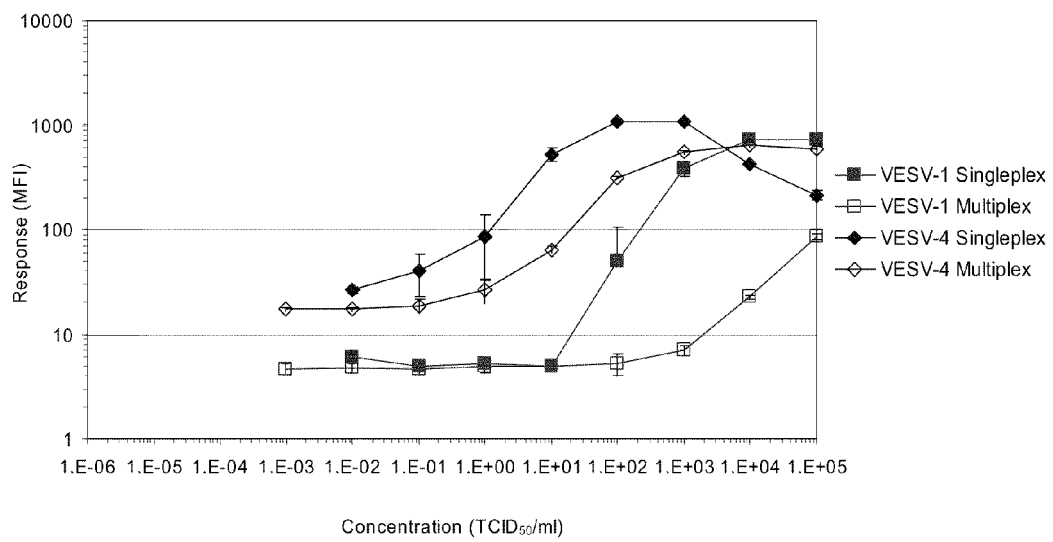
FIG. 38: VESV signature screening in singleplex format against two strains of VESV (E54 and H54) showing that the qualitative limit of detection increased approximately 10 to 100 times from Singleplex to Multiplex formats. Samples were serial dilutions of total nucleic acid extracted from titered virus-infected cell culture. Each point represents the mean response (n=4). Error bars indicate ±1σ of the mean.
Figure 38:
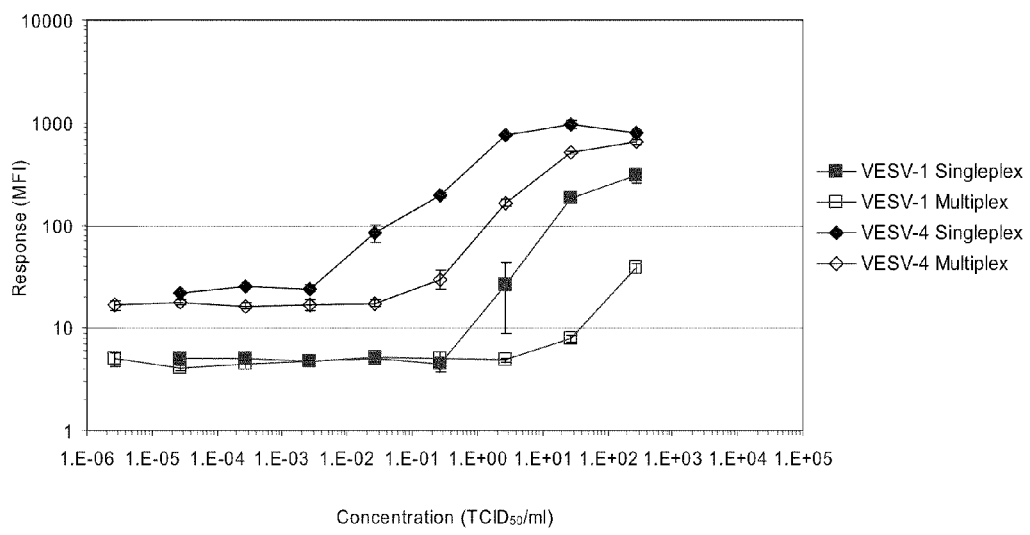

Further testing of the three signatures was undertaken in singleplex format. The results are shown in FIG. 38. The results are plotted together with the multiplex Version 1.0 results for comparison. These serial dilutions of titered virus indicate that VESV_1 and VESV_4 signatures have a higher qualitative limit of detection in multiplex than singleplex by approximately 10 to 100 times. The response of VESV_5 signature did not increase above the background for either strain in both singleplex and multiplex formats and was therefore omitted from FIG. 38 for clarity.

Near-neighbor and Target screening (Version 1.0): In Version 1.0, VESV_4 was the best performing signature against the samples available for testing. VESV_1 had a qualitative limit of detection approximately 100 to 1000 times higher than VESV_4. During characterization of the Version 1.0 panel at the Institute for Animal Health, Pirbright, target screening was conducted against the following nucleic acids extracted from virus-infected cell culture; VESV serotypes B1-34 (1934B), B51, and H54m; San Miguel Sea Lion Virus (SMSV) serotypes 6-13; bovine, cetacean, feline, primate, reptile and skunk caliciviruses. VESV_4 exhibited strong response to Cetacean calicivirus, SMSV serotypes 7, 10 and 13. VESV_4 generated weak responses to SMSV Serotypes 6 and 9, whilst 11 and 12 were not detected. VESV_4 generated strong responses to VESV serotypes B51 and H54 but did not response to B1-34 (1934B) which is consistent with Taqman target screening results. VESV_1 and VESV_5 signatures did not response to any of these isolates.

Figure 40:
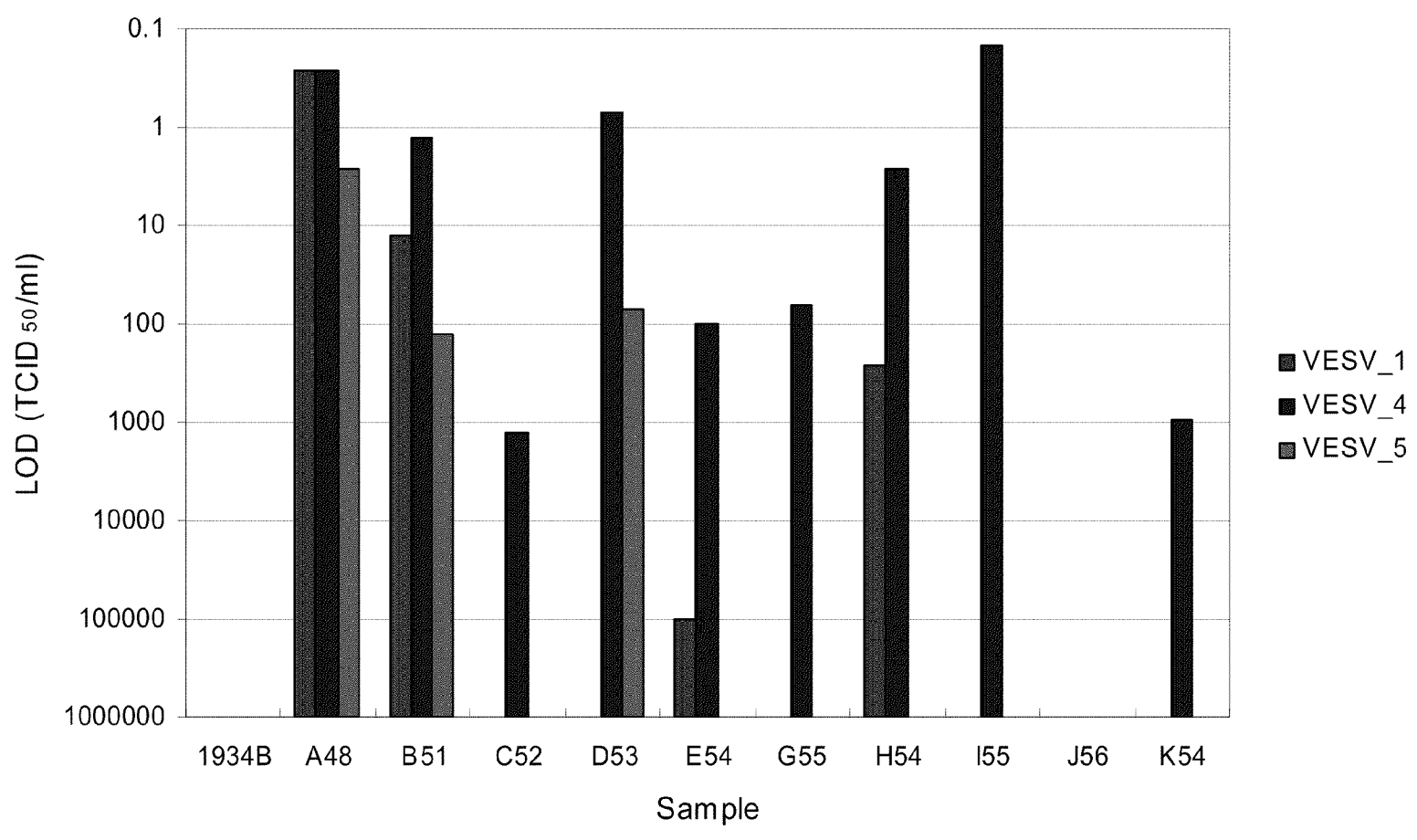

VESV_4 was the best performing signature in multiplex Version 1.0 as summarized in FIG. 40. VESV_1 and VESV_5 signatures were weak assays in Taqman, singleplex and multiplex assay formats against the sample set tested.

Near-neighbor and Target screening (Porcine panel): The three signatures were added the Porcine panel and screened against near-neighbors and targets at PIADC. The VESV-4 signature responded to SMSV Type 2. This is not surprising as SMSV and the vesicular exanthema of swine VESV cause vesicular disease in swine and other hosts, are very similar at the genetic level and constitute a single genotype.

The VESV signatures were screened against targets at PIADC. The estimated limits of detection for the VESV signatures in the porcine panel are shown in Table 31.

TABLE 31

Estimated LOD data for VESV signatures in the porcine panel determined from target screening data acquired at PIADC.

| Serotype or strain | LOD, TCID$_{50}$/mL (MFI) | | |
|---|---|---|---|
| | VESV-1 | VESV-4 | VESV-5 |
| E54 | 2000 (7.3) | 0.2 (22.3) | 2000 (29.0) |
| H54 | 110 (8.5) | 0.101 (37.0) | 110 (19.5) |
| K54 | ND | 20 (38.5) | 200 (22.0) |
| C52 | 2000 (10.0) | 1100 (41.5) | 2000 (22.5) |
| G55 | ND | 0.2 (21.0) | 200 (22.5) |
| D53 | ND | 0.11 (27.5) | 2 (19.0) |
| A48 | 0.11 (15.0) | 0.02 (167.5) | 0.02 (28.0) |
| Cutoff | (6.2) | (18.5) | (17.6) |

The data acquired on the samples tested thus far indicates that VESV_4 is the most promising signature to carry forward in the Porcine panel.

9. Vesicular Stomatitis Virus (VSV)—Bovine and Porcine Panel

Signature candidates: Six new VSV signature candidates are available for consideration for the Porcine panel. VSV signatures were not included in the Version 1.0 panel. Four signatures intended to detect VSV IND are designated VSV_1793943, VSV_1798947, VSV_1798949 and VSV_1811405. Two signatures intended to detect VSV NJ are designated VSV_1811408 and VSV_1811409. Four of these signatures including VSV signature candidates are candidates for the Bovine panel. VSV_1793943, VSV_1798947, VSV_1798949 and VSV_1811409.

Signature origin: Signatures developed by others were modified to match LLNL's assay design criteria to increase compatibility in the multiplex format. VSV_1811405 targets the polymerase (L protein) gene whilst VSV_1811408 and VSV_1811409 both target the nucleocapsid (N) protein gene. The three signatures VSV_1793943, VSV_1798947, VSV_1798949 were designed at LLNL using four complete VSV IND genomes. VSV_1793943 targets the nucleocapsid (N) protein gene whilst VSV_1798947, VSV_1798949 both target the polymerase (L protein) gene.

Near-neighbor screening: Signatures were screened at PIADC against eight vesiculovirus near-neighbors (as determined by serological analysis, not sequence) at 200 pg (n=3) of extracted RNA template from virus-infected cell culture (Qiagen RNeasy Mini kit). These included BeAr, Hilo CT AN, Calchaqui, Klamath, NM-85-488, Jurona, Piry, Chandipura isolates. No cross-reactivity was observed.

Figure 42:
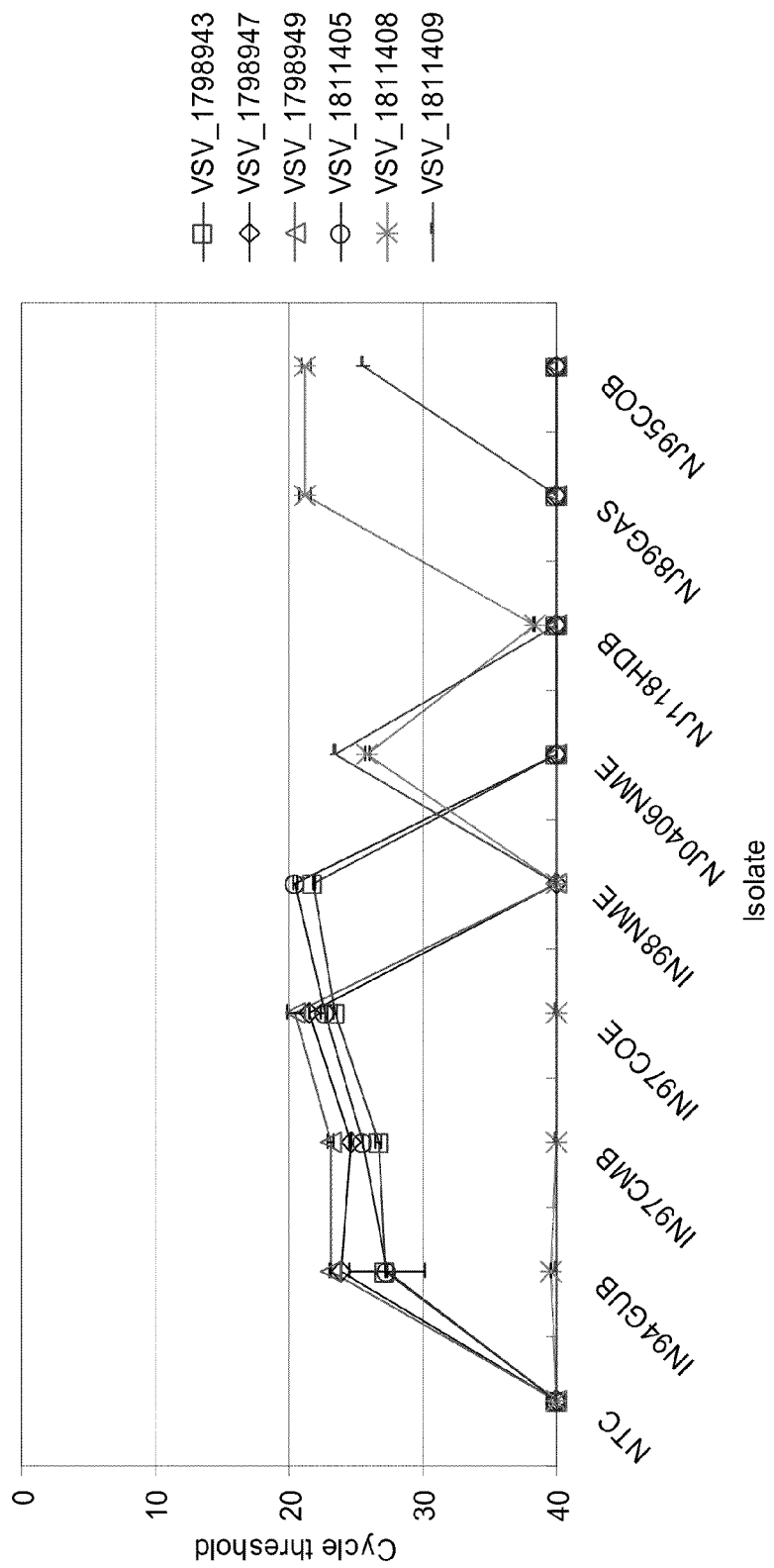
FIG. 42: Taqman screening of VSV signatures against eight VSV isolates conducted at PIADC. Samples were serial dilutions of total nucleic acid Trizol extracted from virus-infected cell culture. Each reaction was spiked with 200 pg of template. Each point represents the mean (n=3) cycle threshold. If no cycle threshold was reached (i.e. infinite cycle threshold), a cycle threshold of 40 was assigned in this plot.

Target screening: All signatures were screened against four IND-1 and four NJ strains and the results are shown in FIG. 42. These results indicate selectivity between signature sets in that IND signatures responded to IND-1 but not NJ strains, whereas NJ signatures responded to NJ but not IND-1 strains. NJ strain NJ118HDB generated a weak response on VSV_1811408 and VSV_1811409 signatures. In concert, the two signature sets responded to 7/8 strains tested and worked well to provide complementary coverage.

Figure 43:
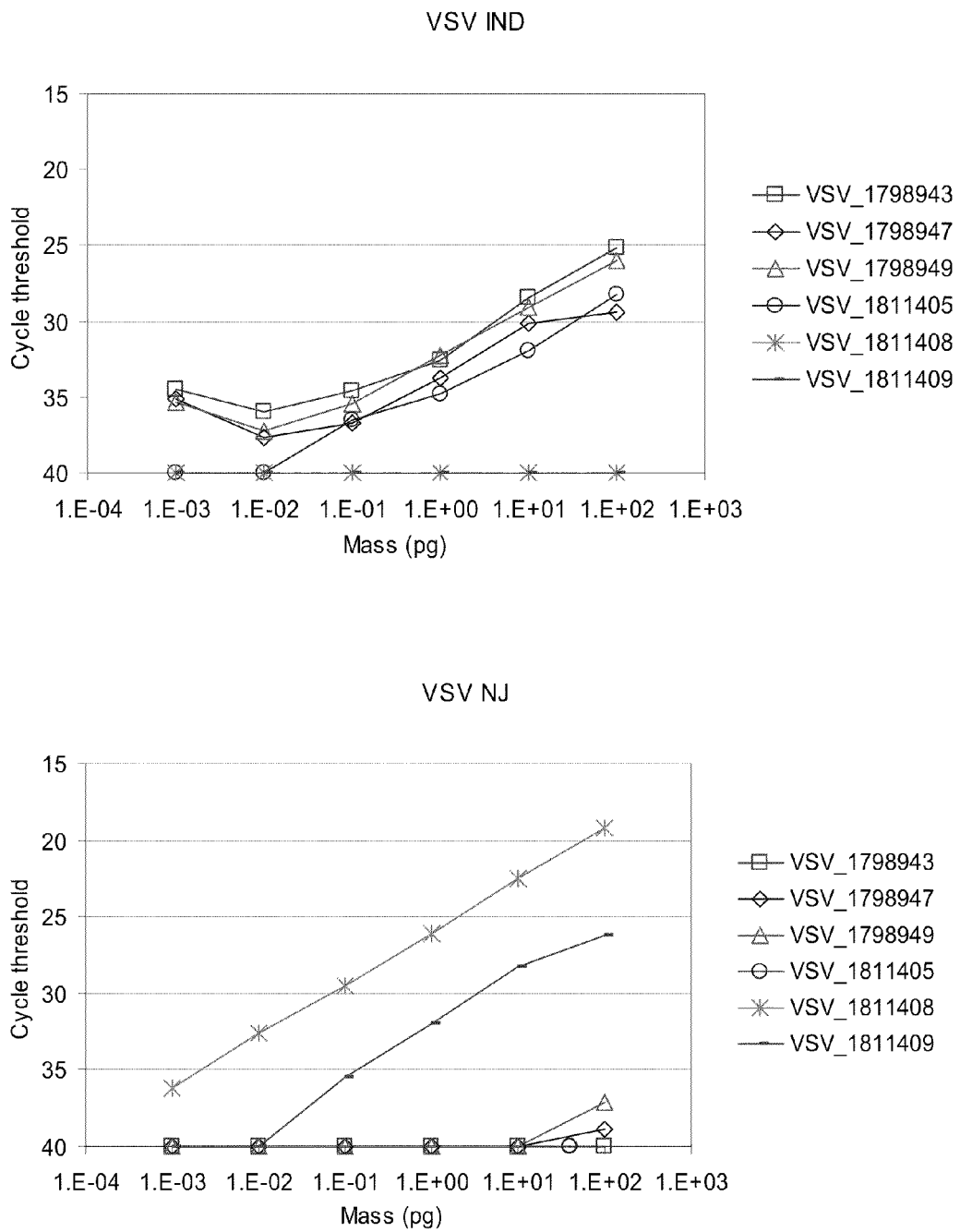
FIG. 43: Taqman screening of six VSV signatures against one VSV IND and one NJ strain showing response over a wide range of template concentrations. Samples were serial dilutions of total RNA Trizol extracted from virus-infected cell culture. Each reaction was spiked with 200 pg of template. Each point represents the mean (n=3) cycle threshold. If no cycle thresh sequences in the target and hybridization to probes covalently coupled to beads. Individual primer pairs (biotinylated forward and standard reverse) that bracket the target genomic sequence are included in an automated PCR master mix of buffers, Taq polymerase, dNTPs, etc. After target amplification by PCR, the amplicons are mixed with beads where target amplicons containing the forward biotinylated primer hybridize to the complementary probe on the appropriate beads. A fluorescent reporter molecule (strepavidin-phycoerythrin) then binds biotin functional groups. Therefore, the completed assay comprises a bead+probe+biotinylated (and fluorescently tagged) amplicon. The sample is then analyzed using a Luminex detector.

Additional Taqman screening was conducted at LLNL using one IND and one NJ strain acquired from the NVSL. The results summarized in FIG. 43 also show selectivity between signature sets. As expected, the cycle threshold decreased as the mass of template per reaction increased. VSV_1811408 showed a stronger response than VSV_1811409 against this single NJ strain.

Figure 44:
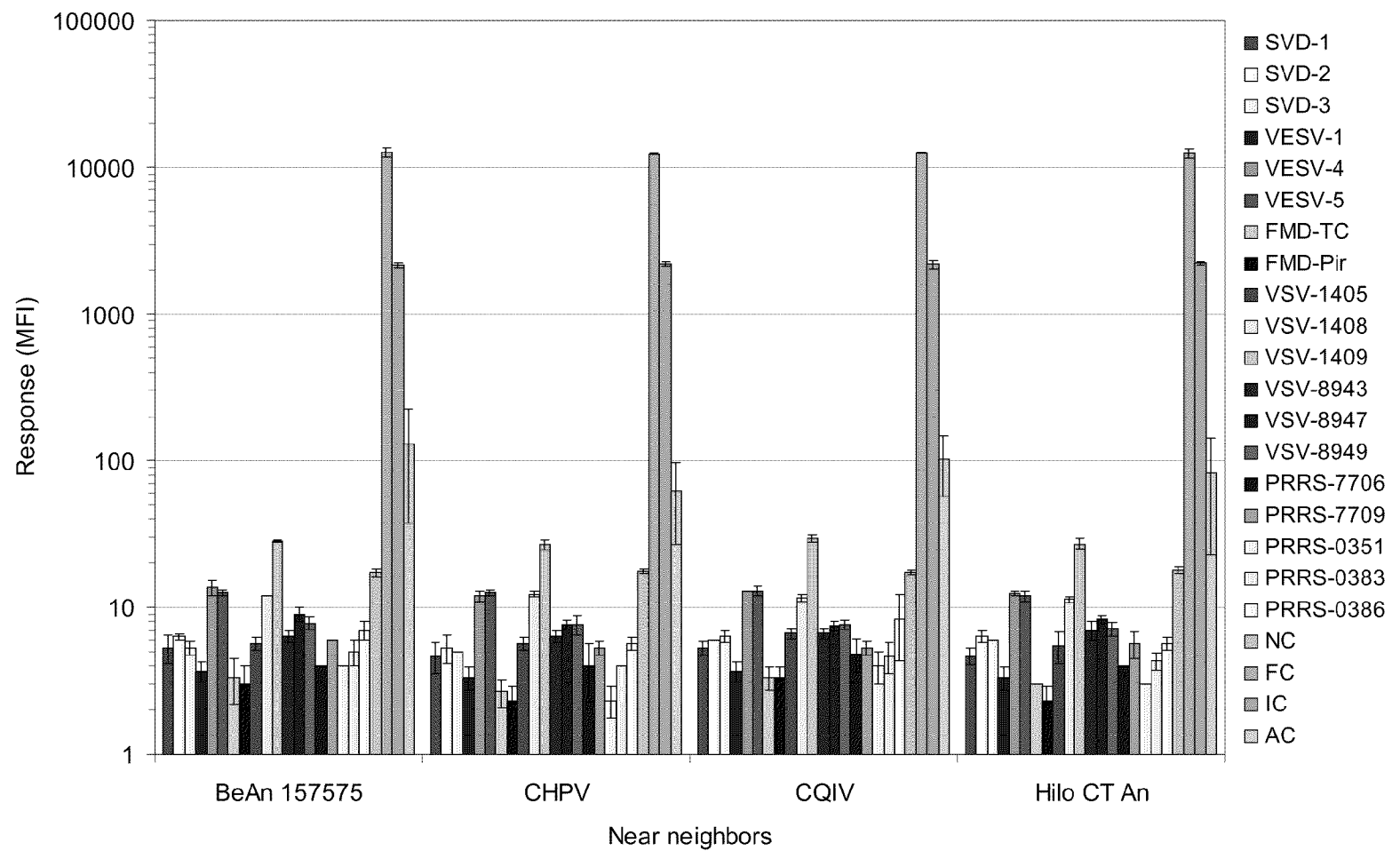
Figure 45:
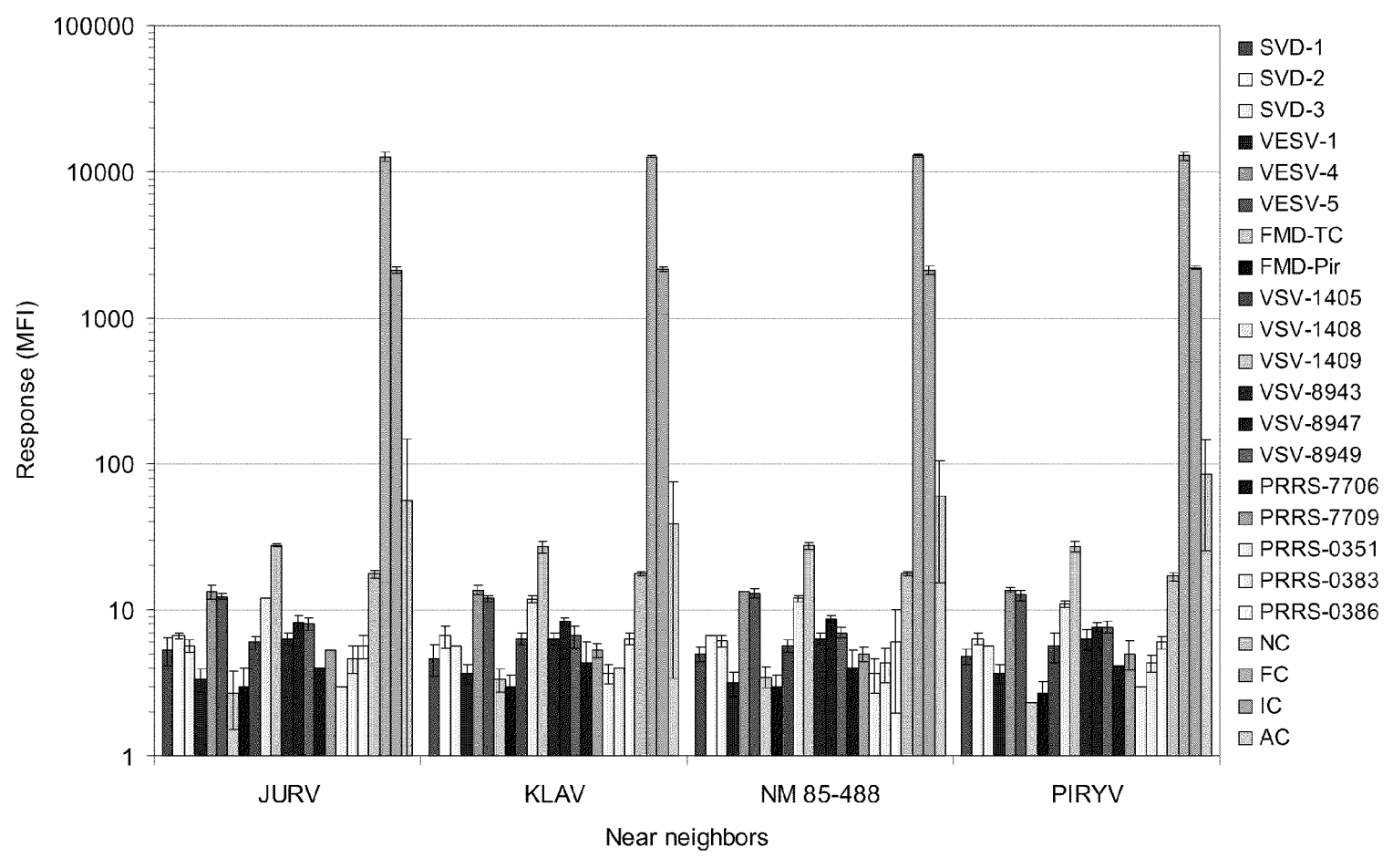

Near-neighbor screening (Porcine Panel): This work was conducted at PIADC. The VSV signatures did not cross react with vesiculoviruses as shown in FIG. 44 and FIG. 45.

Figure 46:
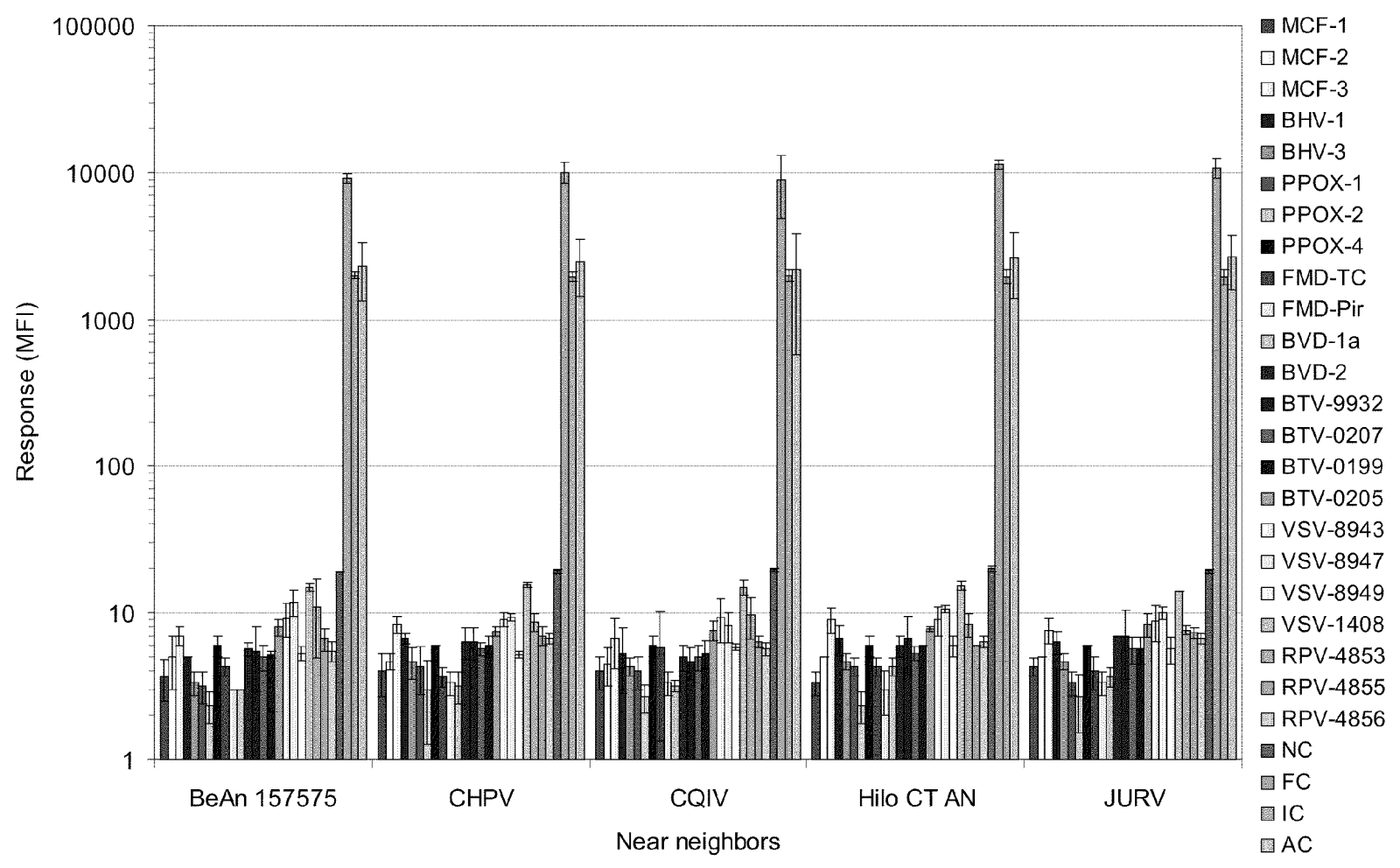
Figure 47:
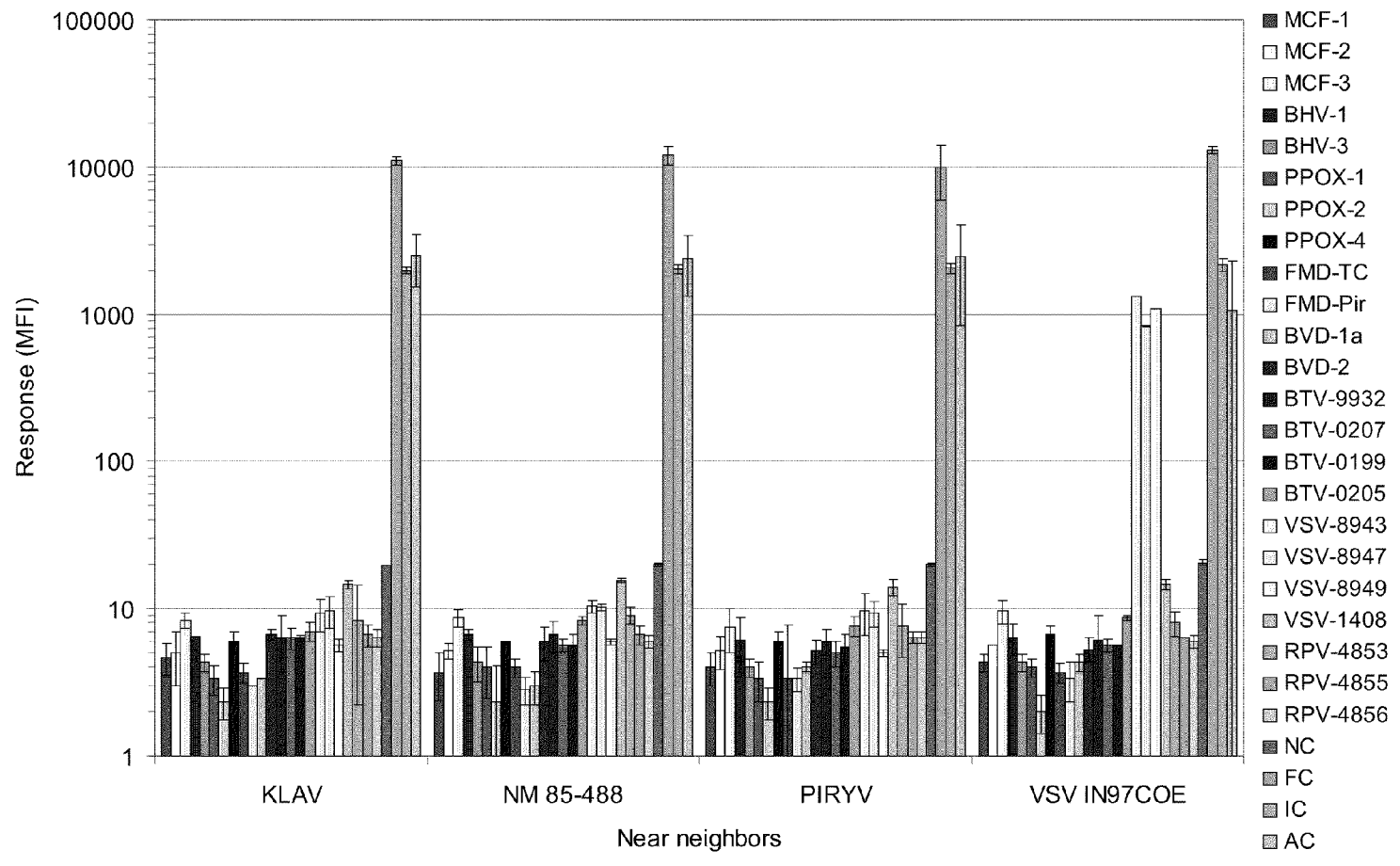

Near-neighbor screening (Bovine Panel): This work was conducted at PIADC. The VSV signatures did not cross react with vesiculoviruses as shown in FIG. 46 and FIG. 47.

Target screening (Porcine Panel): All six VSV signatures have been added to the current porcine multiplex. Five of the signatures show consistently low background response in the absence of template. VSV_1811409 in the current panel configuration exhibits an elevated background response (MFI values ranging from 50-200) which may be caused by a non-specific interaction with other primers in the reaction mixture.

Figure 48:
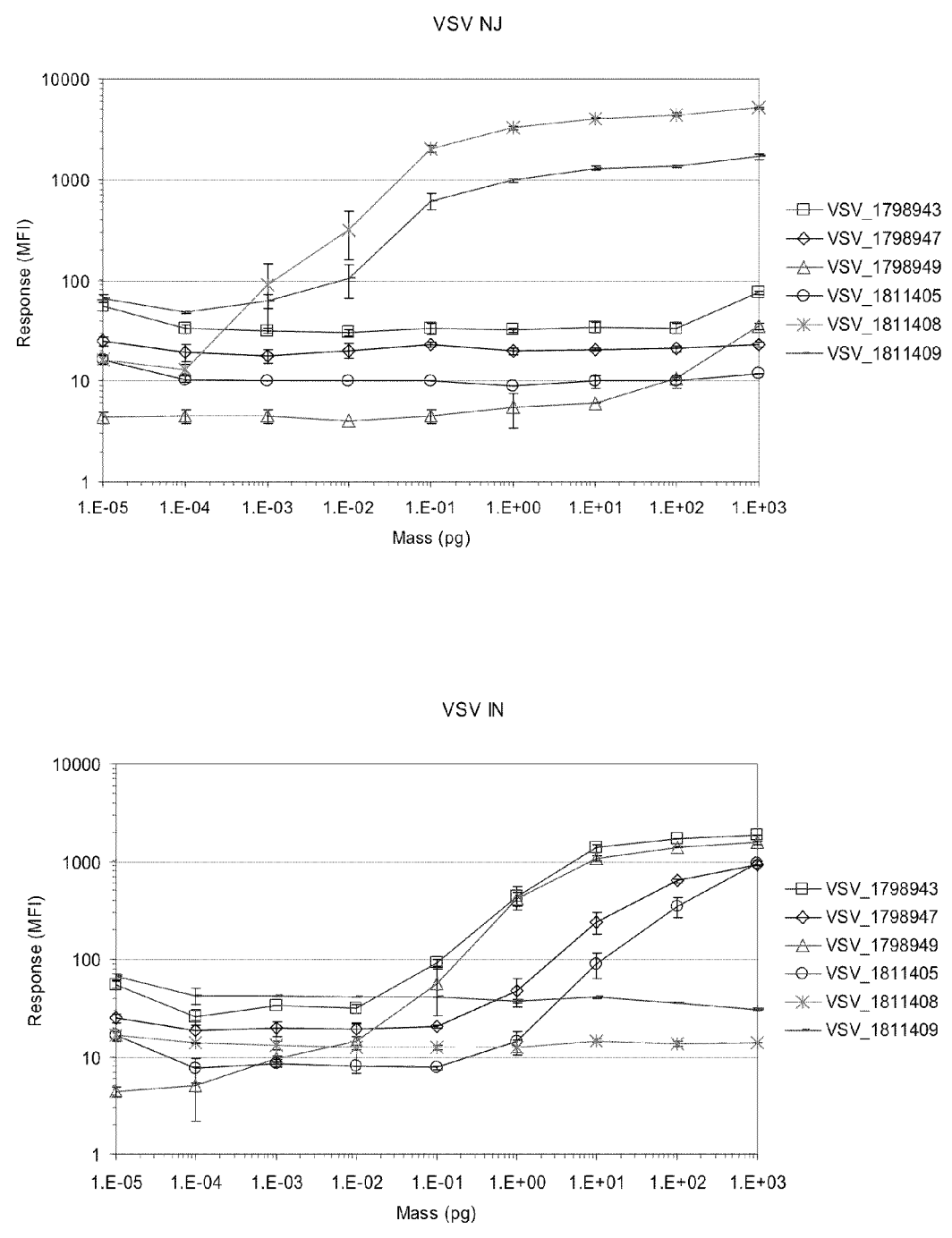

Multiplex screening results (FIG. 48) were in excellent agreement with the Taqman results. In multiplex, the VSV_1811408 also showed a stronger response than VSV_1811409 against the NJ species. Additional calibration data has been acquired at LLNL using titered material for the two NVSL isolates.

Multiplex screening results (FIG. 48) were also acquired using total RNA Trizol extracted from titered virus-infected cell culture.

The VSV signatures were screened against targets at PIADC. The estimated limits of detection for the VSV signatures in the porcine panel are shown in Table 32.

TABLE 32

Estimated LOD data for VSV signatures in the porcine panel determined from target screening data acquired at PIADC.

| Serotype or strain | LOD, TCID$_{50}$/mL (MFI) | | | | | |
| --- | --- | --- | --- | --- | --- | --- |
| | VSV-1405 | VSV-1408 | VSV-1409 | VSV-8943 | VSV-8947 | VSV-8949 |
| IN97COE | 2000 (14.0) | ND | ND | 200 (33.0) | 200 (22.5) | 110 (32.0) |
| IN97CMB | 110000 (40.5) | ND | ND | 1100 (10.0) | 20000 (63.0) | 2000 (17.0) |
| IN94GUB | 110000 (11.5) | ND | ND | 20000 (13.5) | 110000 (53.0) | 2000 (12.5) |
| IN98NME | 0.01$^a$ (10.5) | ND | ND | 5.5 × 10$^{-4a}$ (18.0) | 0.01$^a$ (62.0) | 5.5 × 10$^{-4a}$ (25.5) |
| NJ95COB | ND | 200 (60.0) | 2000 (105.0) | ND | ND | ND |
| NJ89GAS | ND | 1100 (80.5) | 110000 (96.0) | ND | ND | ND |
| NJ0604NME | ND | 110 (117.5) | 110 (213.0) | ND | ND | ND |
| NJ1184HDB | ND | ND | ND | ND | ND | ND |
| Cutoff | (8.5) | (21.0) | (76.0) | (9.6) | (21.0) | (21.0) |

ND = not detected;
$^a$ = fg

Target screening (Bovine Panel): Four VSV signatures have been added to the current Bovine multiplex. The Bovine panel has two less VSV signatures than the Porcine panel, as two signatures were found to be incompatible during attempts to add them to multiplex. All four signatures show consistently low background response in the absence of template. Multiplex screening results (FIG. 52) were also acquired using total RNA Trizol extracted from titered virus-infected cell culture. Good agreement was obtained between the performance of these signatures in the current Bovine and Porcine panels.

The VSV signatures were screened against targets at PIADC. The estimated limits of detection for the VSV signatures in the porcine panel are shown in Table 33.

TABLE 33

Estimated LOD data for VSV signatures in the porcine panel determined from target screening data acquired at PIADC.

| Serotype or strain | LOD, TCID$_{50}$/mL (MFI) | | | |
|---|---|---|---|---|
| | VSV-8943 | VSV-8947 | VSV-8949 | VSV-1408 |
| IN97COE | 20 (65.0) | 110 (132.0) | 200 (158.0) | ND |
| IN97CMB | 1100 (49.0) | 1100 (93.5) | 1100 (44.0) | ND |
| IN94GUB | 20000 (189.5) | 2000 (20.0) | 2000 (38.0) | ND |
| IN98NME | 0.55$^b$ (62.0) | 0.1$^b$ (31.5) | 0.55$^b$ (30.0) | ND |
| NJ95COB | ND | ND | ND | 110 (58.0) |
| NJ89GAS | ND | ND | ND | 110 (70.0) |
| NJ0604NME | ND | ND | ND | 20 (75.5) |
| NJ1184HDB | ND | ND | ND | ND |
| Cutoff | (13.6) | (14.0) | (7.9) | (27.5) |

ND = not detected;
$^b$ = fg

The VSV signatures together demonstrate promising performance in both Taqman and multiplex formats. Together, the signatures are capable of detecting VSV NJ and IND and with apparent serotype selectivity.

10. Bovine Herpesvirus-1 (BHV-1)—Bovine Panel

Signature candidates: The two signatures available for consideration are BHV__1 and BHV__3. These two signatures were adopted from the Version 1.0 panel without change.

Signature origin: Signatures were designed at LLNL using one complete genome for the BHV-1.1 subtype (respiratory subtype). The two signatures target two different genes for glycoproteins. The BHV__1 signature targets the glycoprotein C gene and the BHV__3 signature targets the glycoprotein B gene.

Near-neighbor screening: The signatures did not respond to twenty near-neighbors including Rhadinovirus Caprine Herpes-2, V. Pseudorabies, Psuedorabies Shope, Equine Herpesvirus-1, Equine Herpesvirus-2, Feline herpes and Bovine Herpesvirus-5.

Figure 51:
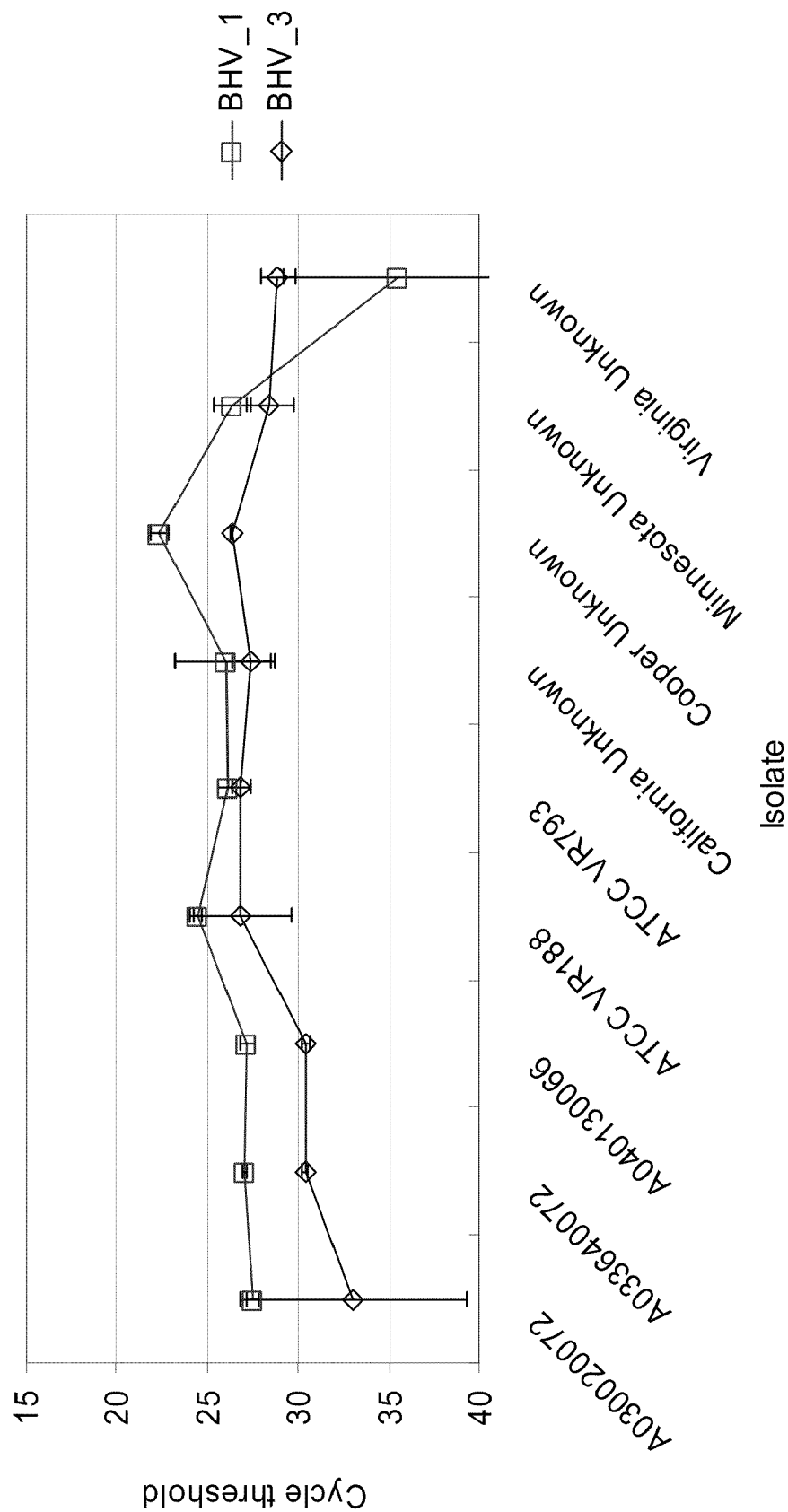

Target screening: Ten BHV-isolates were screened and the results are shown in FIG. 51. Both signatures responded to 10/10 isolates and did not cross-react with BHV-5.

Figure 52:
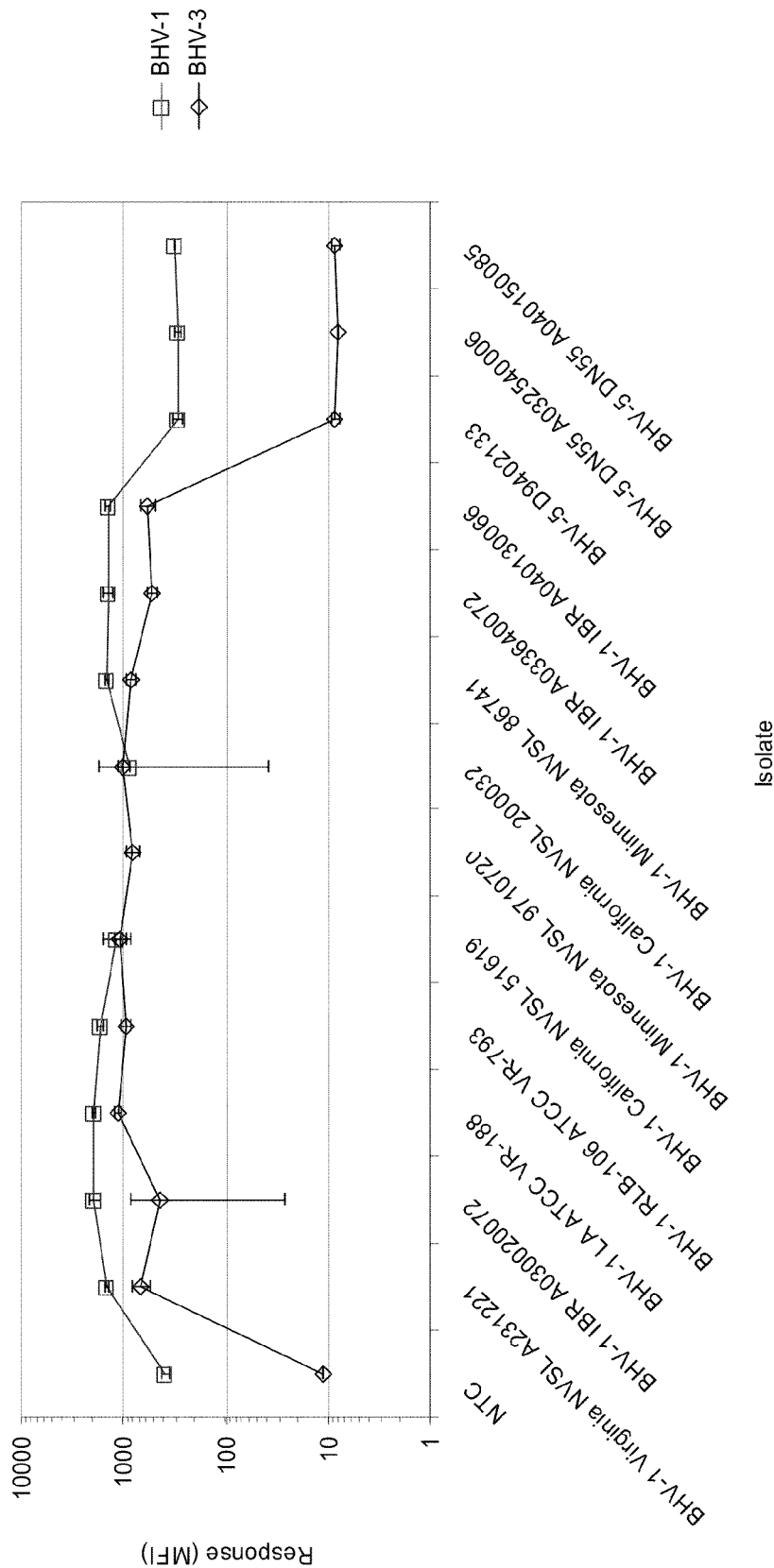

Target screening: FIG. 52 shows that both BHV__1 and BHV__3 signatures responded to 10/10 BHV-1 isolates but not to near-neighbor BHV-5.

Figure 53:
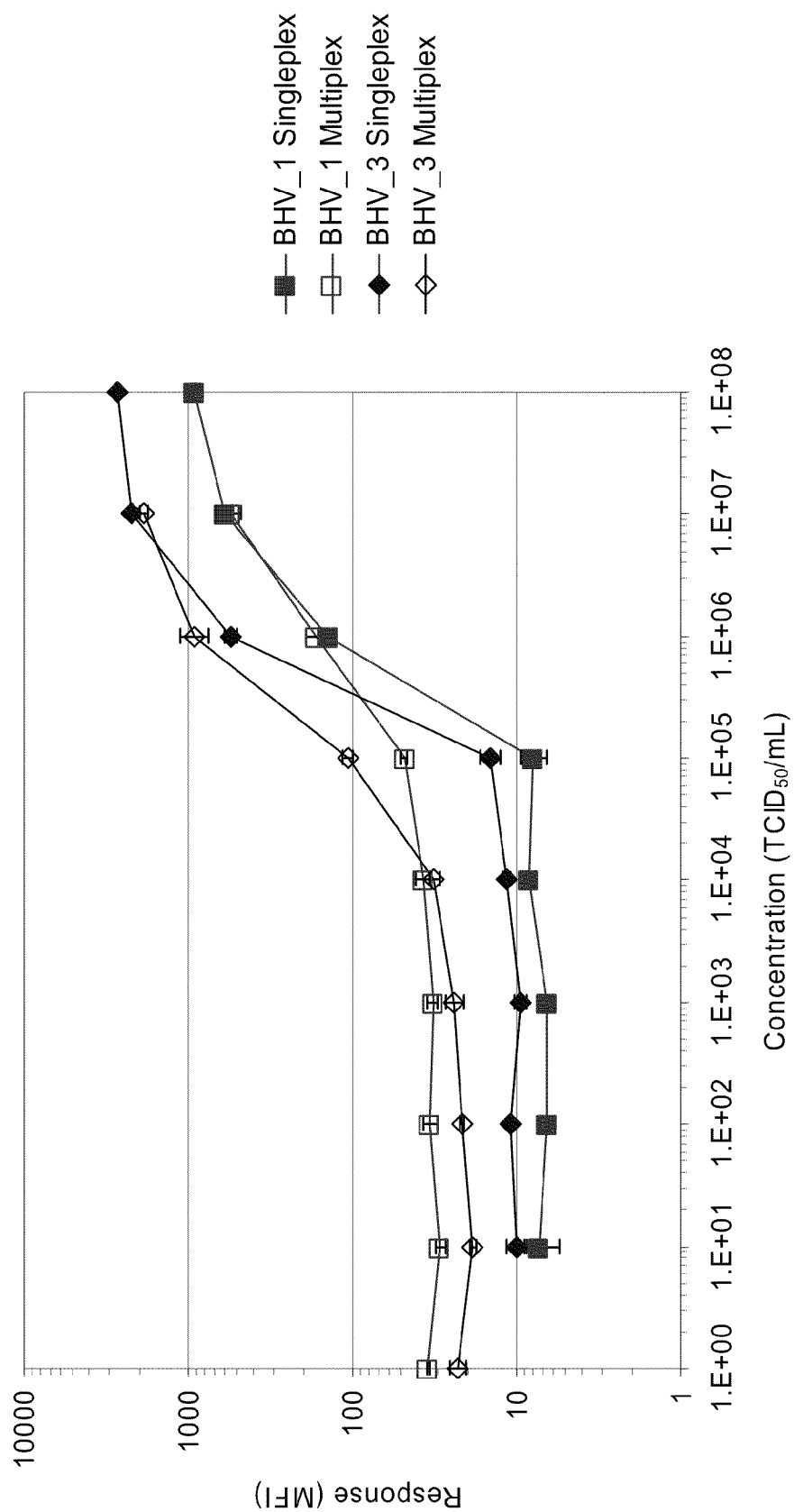

Both signatures were tested in singleplex format using a dilution series of a single BHV-1 strain (Colorado, NVSL). The singleplex results are plotted together with data acquired with the Version 1.0 panel (FIG. 53). Signature responses to template were comparable in singleplex and multiplex formats over the concentration range tested for this particular strain.

Near-neighbor screening: The signatures in multiplex did not generate responses above background when screened against near-neighbors including Rhadinovirus Caprine Herpes-2, V. Pseudorabies, Pseudorabies Shope, Equine Herpesvirus-1, Equine Herpesvirus-2, Feline herpes and Bovine Herpesvirus-5. These results agree with those obtained during Taqman screening.

Figure 54:
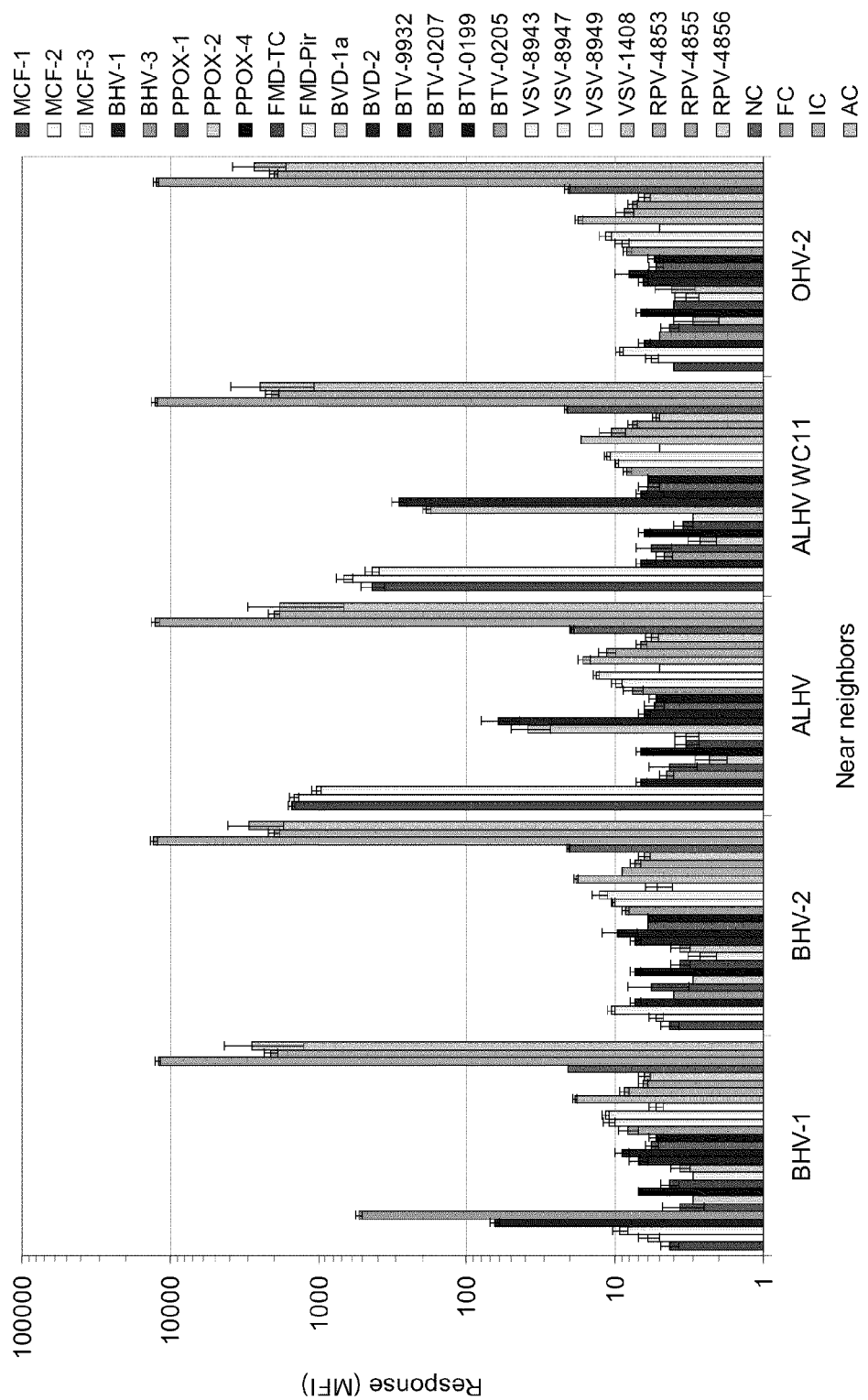

Additional screening at PIADC was conducted. FIG. 54 shows the results of screening of the BHV signatures against viruses belonging to the Herpesviridae family. Low-level BVDV contamination is noted on the ALHV samples. These data indicate specificity of the BHV signatures.

Figure 55:
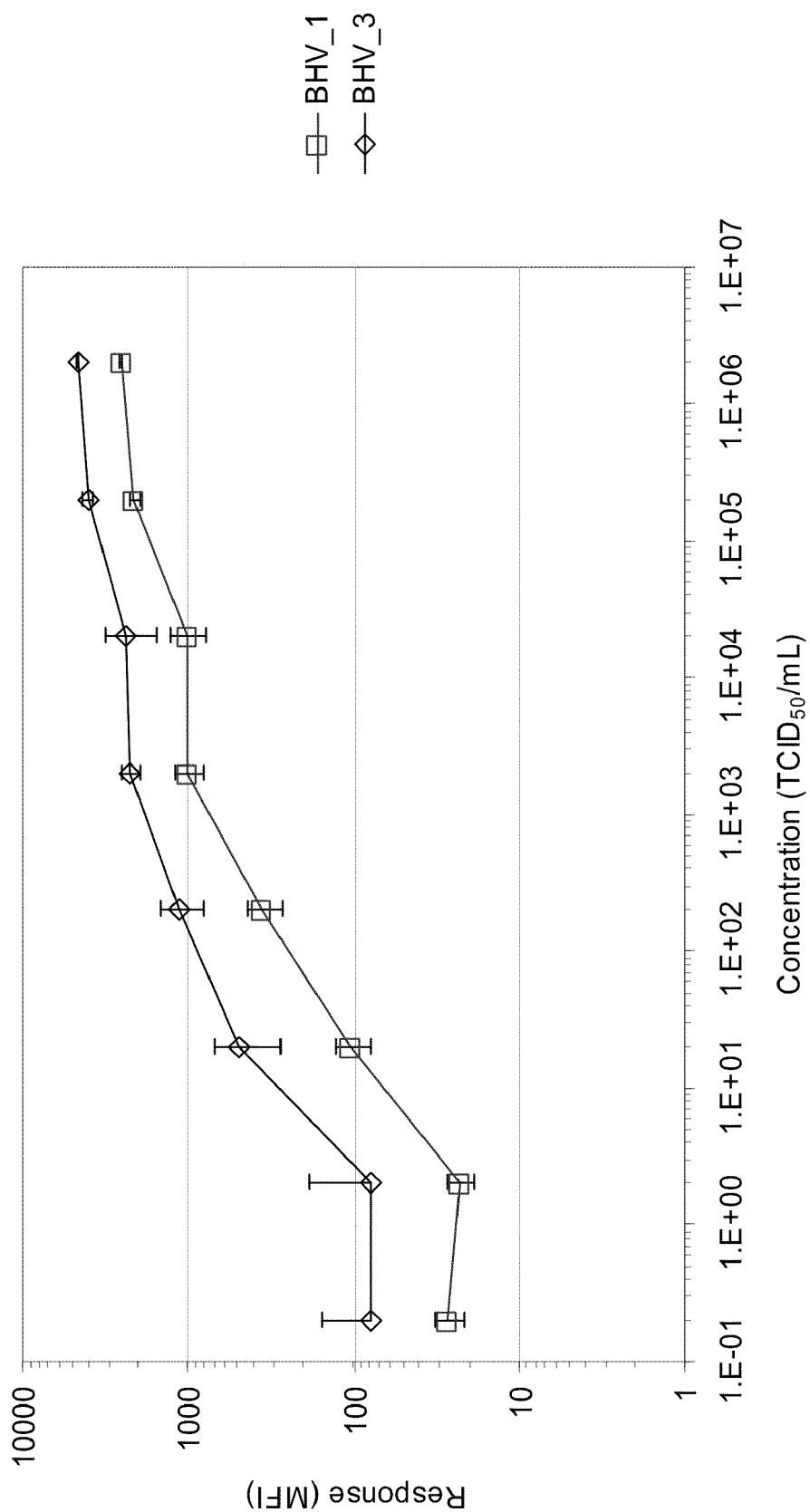

Target screening: Both signatures were added to the current Bovine panel where they generate consistently low background response in the absence of template. Both signatures responded as shown in FIG. 55. These results compare to results from the Version 1.0 panel.

The two BHV signatures BHV__1 and BHV__3 respond to the target when incorporated into the current Bovine panel. The near-neighbor testing conducted to date indicates that both signatures do not respond to genetic near-neighbors. The signature response indicates that the signatures could be capable of detecting BHV-1 virus at clinically relevant concentrations.

11. Parapox (PPox)—Bovine Panel

Signature candidates: Three signatures were adopted from the Version 1.0 panel without change, including PPOX__1, PPOX__2 and PPOX__4.

Signature origin: Signatures were designed at LLNL using a four genome alignment each varying in size from 134,000-137,000 bp. The PPOX__1 signature targets the ORF108 DNA packaging protein ATPase gene with similarities to Vaccinia strain Copenhagen A32L and Molluscum contagiosum virus MC140L. The PPOX__2 signature targets the ORF025 DNA polymerase. The PPOX__4 signature targets the ORF083 DNA early transcription factor VETFL gene.

Near-neighbor screening: Seven near-neighbor isolates of goatpox (V717 Pendik, Held LT5, Nigerian G165), sheeppox (Kenyan LT1, Vaccine 0-180 15LK V2164 and X783 6LT) were screened found to not cross react with any of the signatures.

Figure 56:
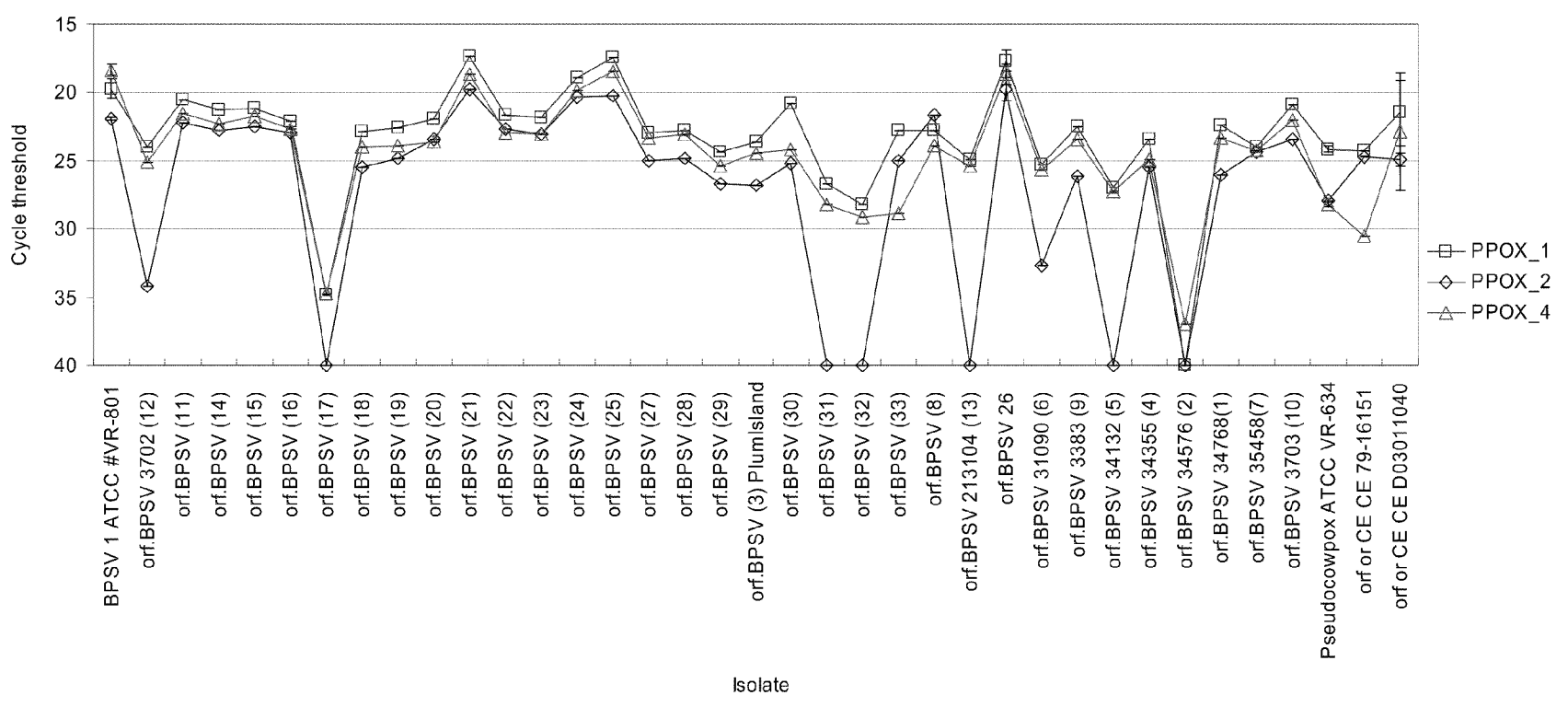

Target screening: Thirty-seven parapoxvirus isolates were screened and the results are shown in FIG. 56. Signatures PPOX-1 and PPOX-4 detected 36/37 isolates, while PPOX__2 detected 31/37.

Figure 57:
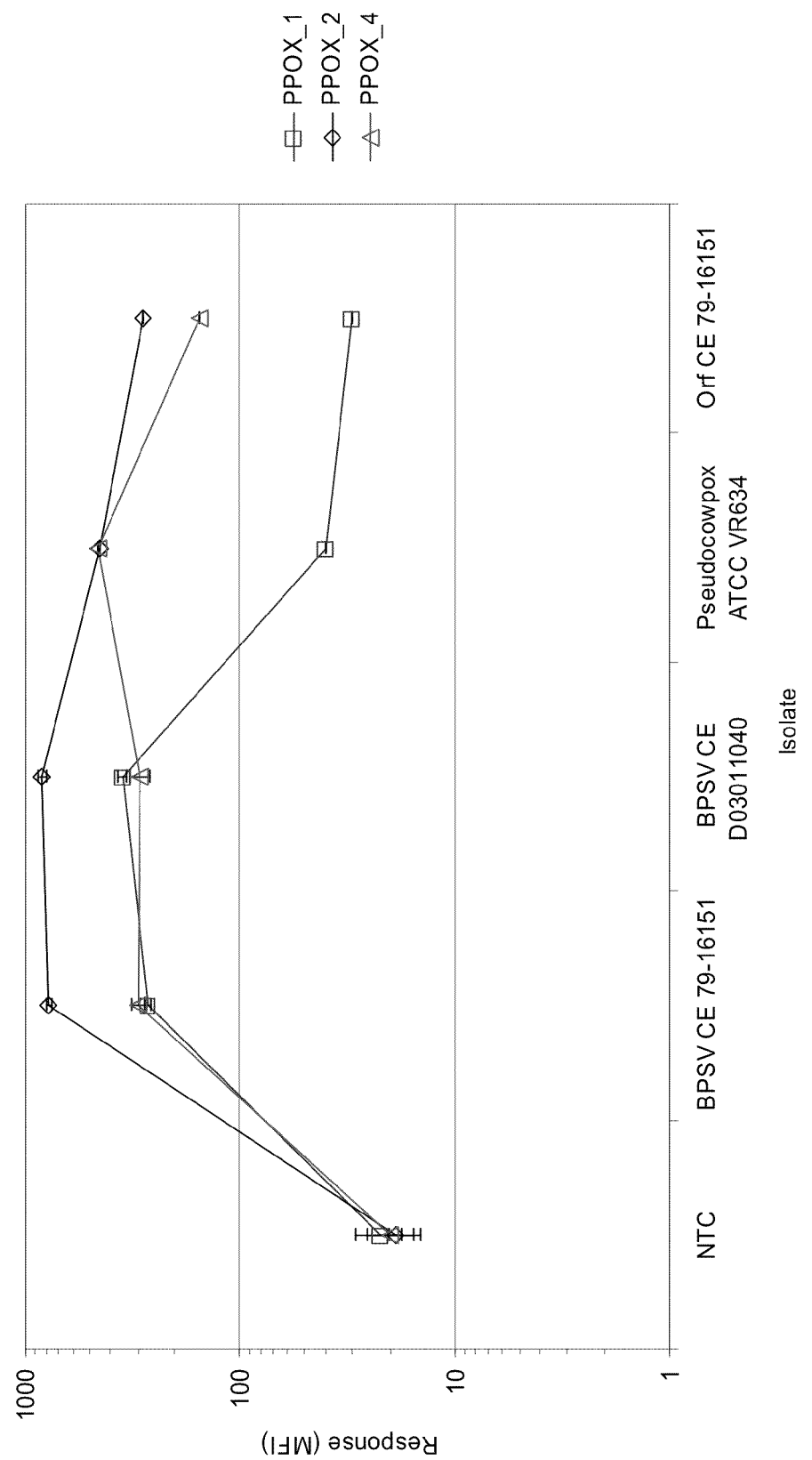

Target screening: Spot-testing was conducted in singleplex format using nucleic acid extracted virus-infected cell culture as the template (FIG. 57). PPOX__1 and PPOX__2 responded to all four strains tested. The PPOX__4 signature did not respond to 2/4 strains tested.

Figure 58:
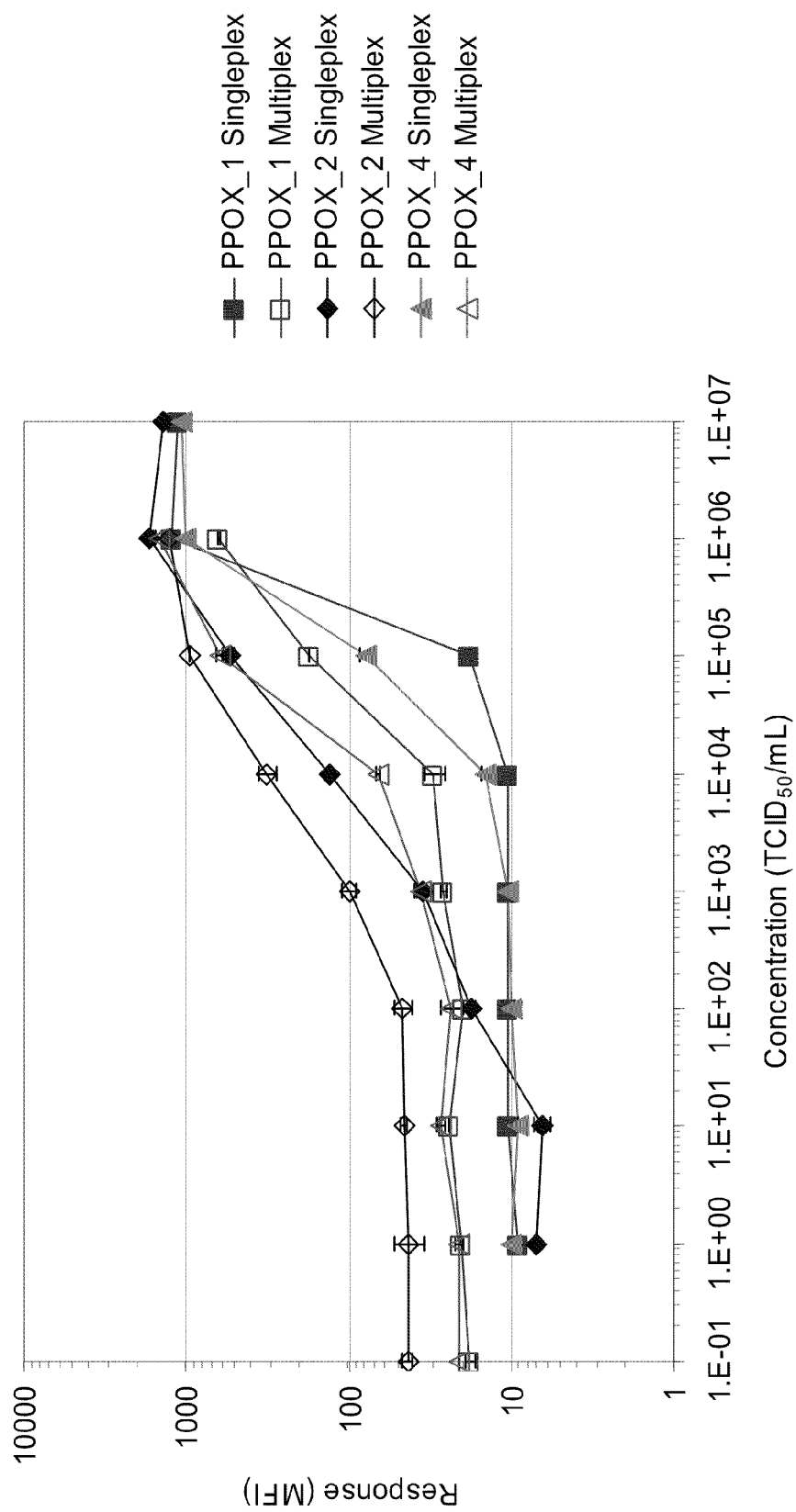
Figure 60:
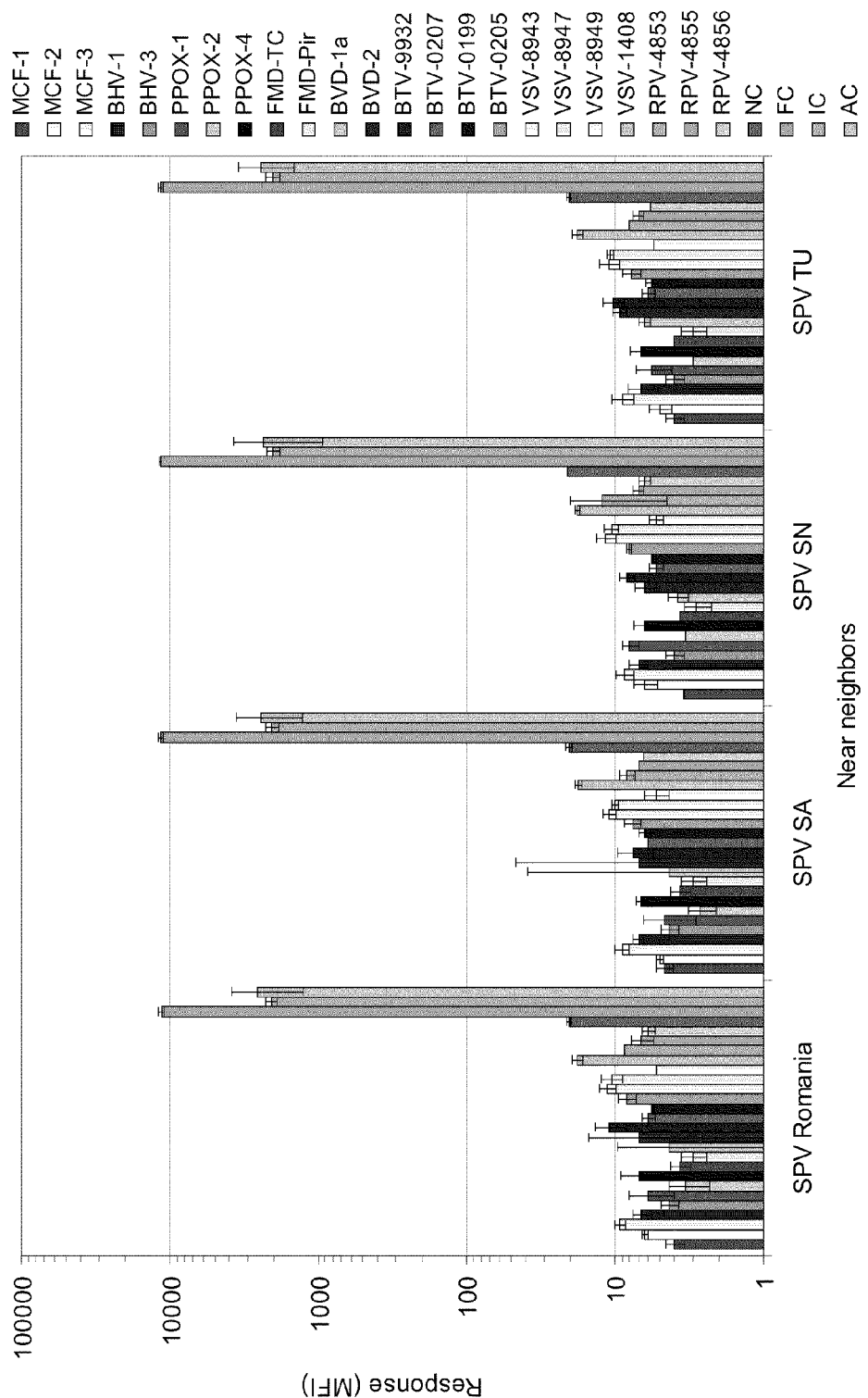

Further testing of the three signatures was undertaken in singleplex format. The singleplex results are compared directly to those acquired using the Version 1.0 panel (FIG. 58). The background response increased for all three signatures from singleplex to multiplex; however, similar responses were obtained over the concentration ranges tested.

Figure 61:
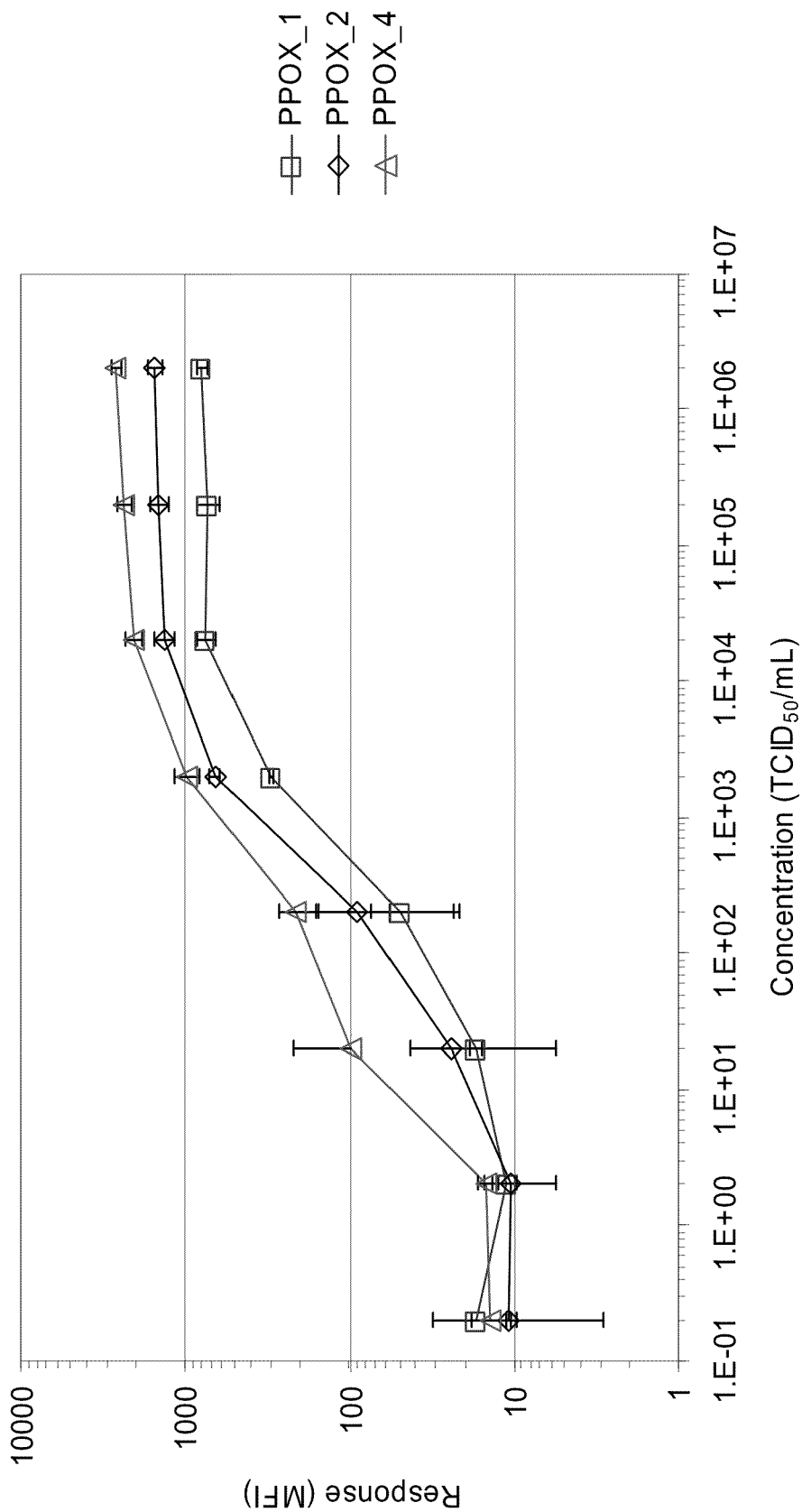

Target screening: The three Parapox signatures have been incorporated into the current Bovine panel where they showed consistently low background response. All three signatures responded equivalently to target material over a wide range of concentrations (FIG. 61).

Figure 62:
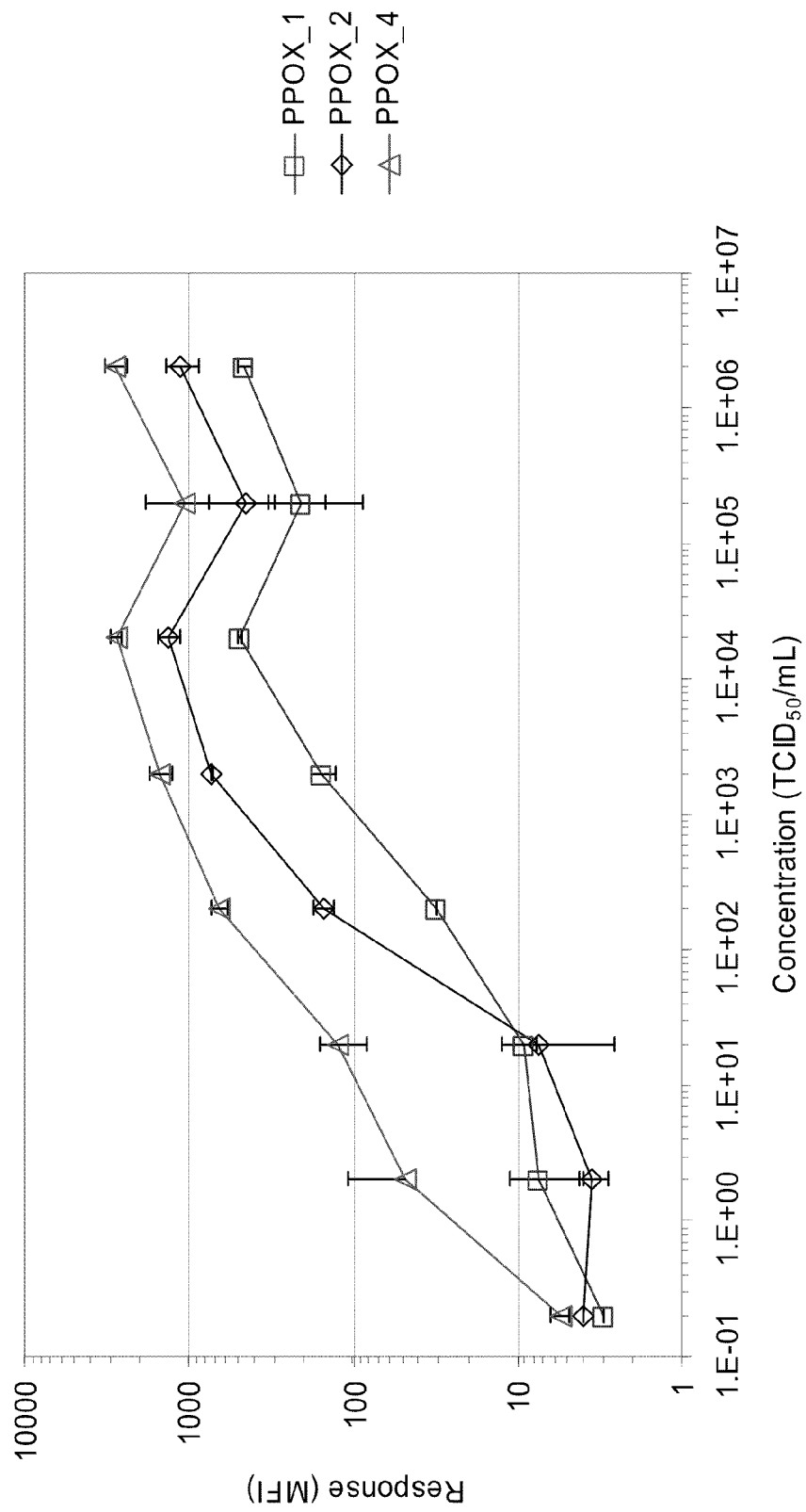
Figure 63:
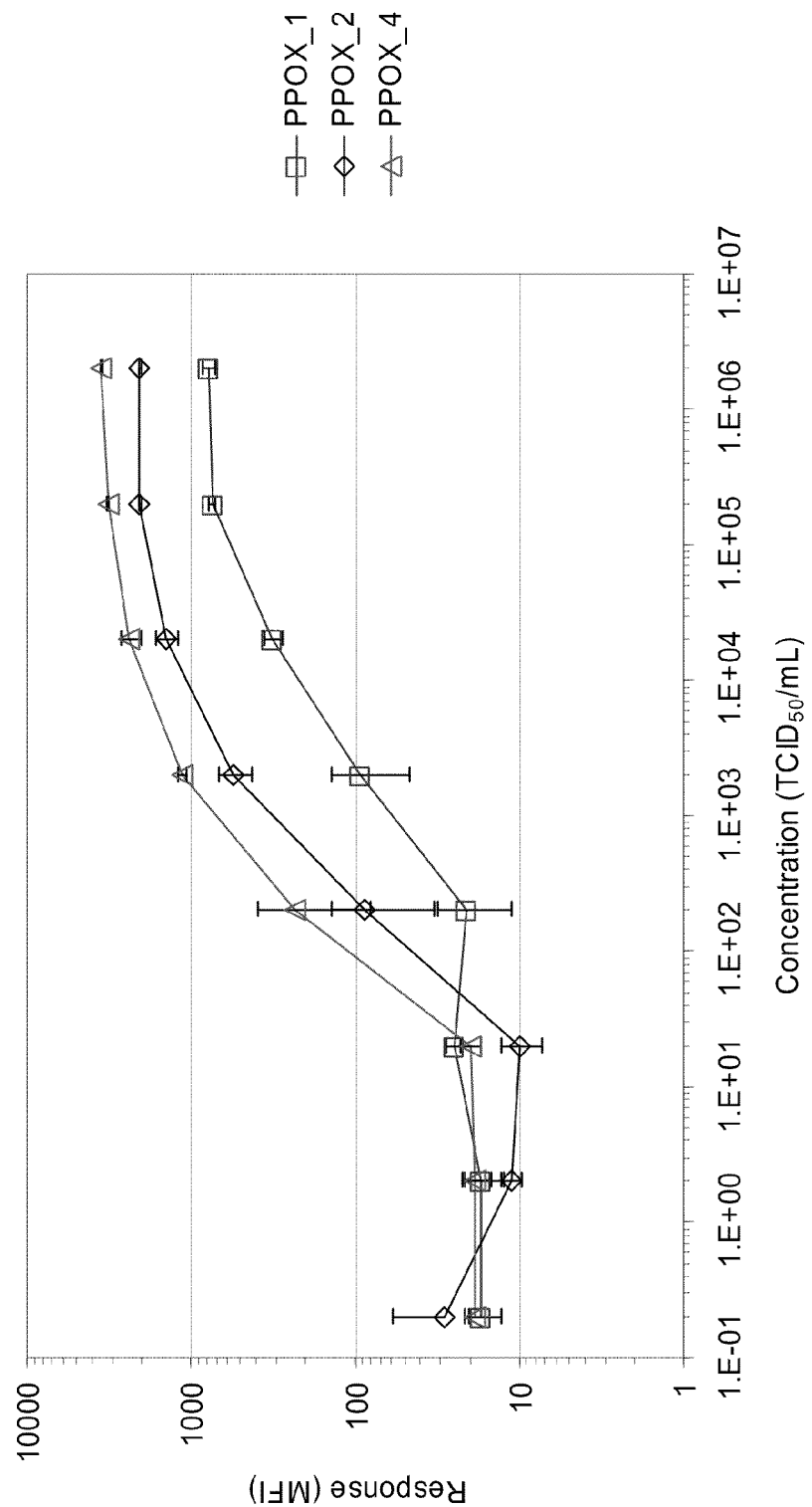

The three Parapox signatures in the current Bovine panel were also screened against Pseudocowpox (FIG. 62) and Orf (FIG. 63) strains and generated a positive response over a wide range of concentrations.

Figure 64:
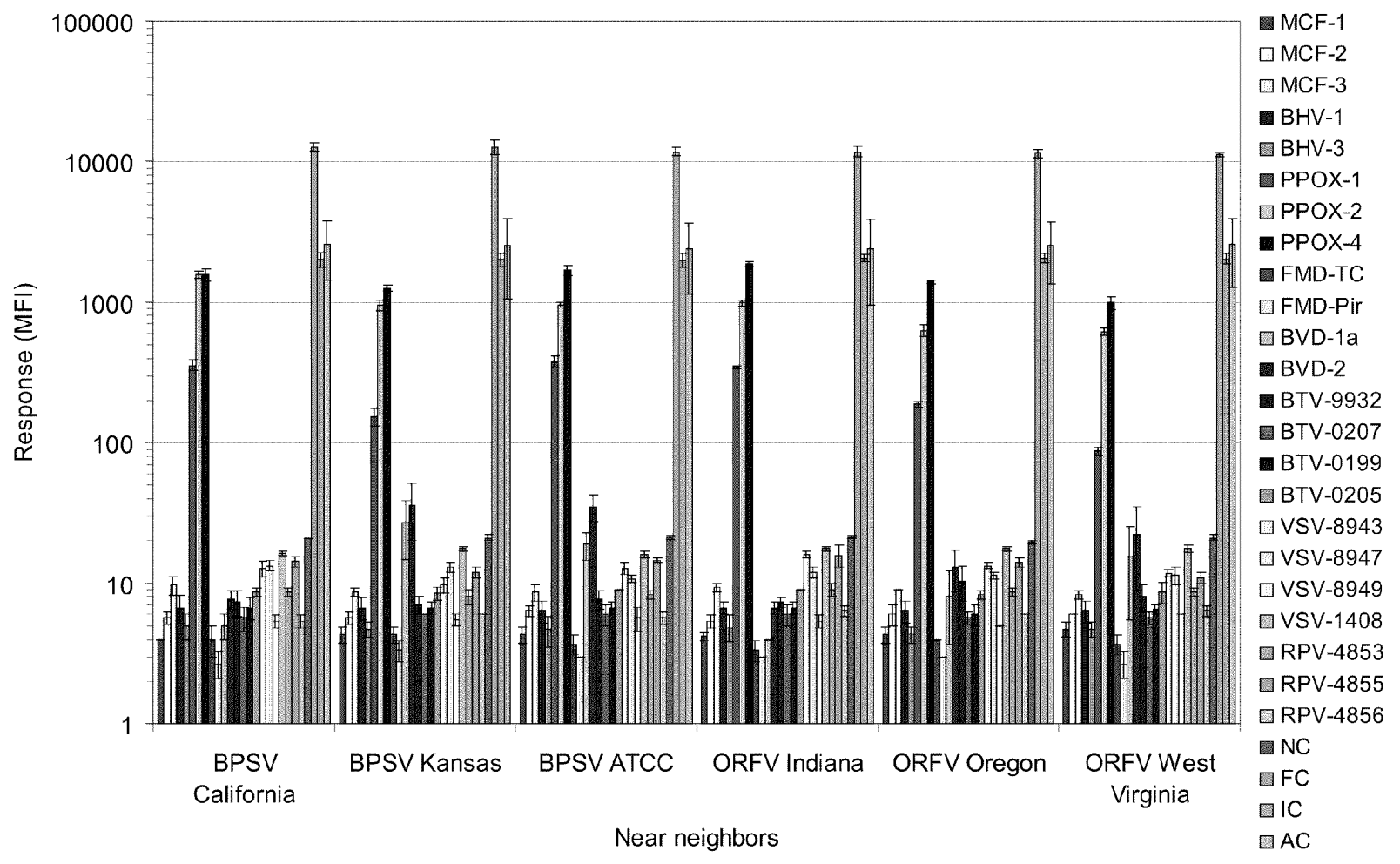

Additional target screening was conducted at PIADC. The results shown in FIG. 64 indicate specific detection of BPSV and ORFV.

The three Parapox signatures performed well when incorporated into the current Bovine multiplex panel. Together the signatures provide detection capability for Bovine Papular Stomatitis, Contagious Ecthyma and Pseudocowpox and potentially laboratory differentiation from foot-and-mouth disease within a multiplex panel.

Example 14

Multiplexed Detection of FMDV, PRRS, SVD, VESV, VSV, OvHV-2, AHV1, BHV, PPDX, BVD, BTV, and RPV Using a Microarray Approach In another embodiment, the signature sequences in Tables 11-12 are used for detection of FMDV, PRRS, SVD, VESV, VSV, OvHV-2, AHV1, BHV, PPDX, BVD, BTV, and RPV pathogens in a sample using a microarray coupled with the probes from Tables 11-12 as described in Example 10 above. To detect the pathogens, the pathogen nucleic acid sample can be amplified with fluorescently labeled random primers and the labeled DNA is hybridized to the chip. Alternatively, the pathogen nucleic acid sample can be fluorescently labeled, as described in, e.g., Example 16 below; and the labeled DNA is hybridized to the chip. The chip is washed to remove non-specifically bound samples and scanned using a laser scanner at high resolution. The raw data and images are analyzed using statistical tools and presence/absence calls are made for the signature sequences.

Example 15

Selection of Probes for Detection of Agricultural Pathogens on an Array

An initial genomic collection was obtained by downloading complete pathogen genomes, segments, and plasmid sequences from, e.g., NCBI Genbank, the Integrated Microbial Genomics (IMG) project at the Joint Genome Institute, the Comprehensive Microbial Resource (CMR) at the JC Venter Institute, and The Sanger Institute in the United Kingdom. The sequence data was then organized by family for all organisms or targets.

It has been shown that the length of longest perfect match (PM) is a strong predictor of hybridization intensity, and that for probes at least 50 nucleotide (nt) long, a PM≦20 base pairs (bp) have signal less than 20% of that with a PM over the entire length of the probe. Therefore, for each target family, regions with perfect matches to sequences outside the target family were eliminated. Using, e.g., the suffix array software vmatch (Giegerich, R., Kurtz, S, and Stoye, J. (2003) Efficient implementation of lazy suffix trees, Software-Practice and Experience, 33, 1035-1049.), perfect match subsequences of, e.g., at least 17 nt long present in non-target viral families or, e.g., 25 nt long present in the human genome or non-target bacterial families were eliminated from consideration as possible probe subsequences. Sequence similarity of probes to non-target sequences below this threshold was allowed. From these family-specific regions, probes 50-66 bases long were designed for one family at a time. Candidate probes were generated using, for example, MIT's Primer3 software. See, e.g., Steve Rozen, Helen J. Skaletsky (1998) Primer3.

The following Primer3 settings were modified from the default values:

PRIMER_TASK=pick_hyb_probe_only
PRIMER_PICK_ANYWAY=1
PRIMER_INTERNAL_OLIGO_OPT_SIZE=55
PRIMER_INTERNAL_OLIGO_MIN_SIZE=50
PRIMER_INTERNAL_OLIGO_MAX_SIZE=60
PRIMER_INTERNAL_OLIGO_OPT_TM=90
PRIMER_INTERNAL_OLIGO_MIN_TM=80
PRIMER_INTERNAL_OLIGO_MAX_TM=110
PRIMER_INTERNAL_OLIGO_MIN_GC=25
PRIMER_INTERNAL_OLIGO_MAX_GC=75
PRIMER_NUM_NS_ACCEPTED=0
PRIMER_EXPLAIN_FLAG=0
PRIMER_FILE_FLAG=1
PRIMER_INTERNAL_OLIGO_SALT_CONC=450
PRIMER_INTERNAL_OLIGO_DNA_CONC=100
PRIMER_INTERNAL_OLIGO_MAX_POLY_X=4

These settings identify candidate probes in the desired length range, melting temperature ($T_m$) range, GC % range, and without homopolymer repeats longer than 4 (i.e. regions with AAAAA, GGGGG, etc. are not selected as probe candidates).

The above step was followed by $T_m$ and homodimer, hairpin, and probe-target free energy (ΔG) prediction using, for example, Unafold (see, e.g., Markham, N. R. & Zuker, M. (2005) DINAMelt web server for nucleic acid melting prediction. Nucleic Acids Res., 33, W577-W581). Homodimers occur when an oligo hybridizes to another copy of the same sequence, and hairpining occurs when an oligo folds so that one part of the oligo hybridizes with another part of the same oligo. Candidate probes with unsuitable ΔG's, GC % or $T_m$'s were excluded as described in Jaing, C., Gardner, S., McLoughlin, K., Mulakken, N., Alegria-Hartman, M., Banda, P., Williams, P., Gu, P., Wagner, M., Manohar, C. and Slezak, T. (2008) A Functional Gene Array for Detection of Bacterial Virulence Elements, PLoS ONE, 3, e2163. Desirable range for these parameters was 50≦length≦66, $T_m$≧80° C., 25%≦GC %≦75%, trimer entropy>4.5, $\Delta G_{homodimer}=\Delta G$ of homodimer formation>15 kcal/mol, $\Delta G_{hairpin}=\Delta G$ of hairpin formation>−11 kcal/mol, and $\Delta G_{adjusted}=\Delta G_{complement}-1.45\ \Delta G_{hairpin}-0.33\ \Delta G_{homodimer}\leqq -52$ kcal/mol. In some cases, an additional minimum sequence complexity constraint was enforced, requiring a trimer frequency entropy of at least 4.5.

Probes with suitable annealing characteristics or preferred binding properties (e.g., polynucleotides from target specific regions with favored thermodynamic characteristics) were selected, in order to remove probes that are likely to bind to non-target sequences, whether the non-target sequence is the probe itself or a low complexity non-specific sequence. If fewer than a user-specified minimum number of candidate probes per target sequence (the specific value of which can depend upon the particular application needs and available number of probes on a particular array platform) passed all the criteria, then those criteria were relaxed to allow a sufficient number of probes per target. Candidates that passed the above mentioned first step but failed the above mentioned second step can be allowed. If no candidates passed the first step, then regions passing target-specificity (e.g. family specific) and minimum length constraints can be allowed.

From these candidates, probes were selected in decreasing order of the number of targets represented by that probe (i.e., probes detecting more targets in the family were chosen preferentially over those that detected fewer targets in the family), where a target was considered to be represented if, for example, a probe matched it with at least 85% sequence similarity over the total probe length, and a perfectly matching subsequence of at least 29 contiguous bases spanned the middle of the probe. It should be noted that the perfect-match stretch did not have to be centered, and data gathered by the applicants indicate, in some embodiments, higher probe sensitivity if the match falls toward the 5' end of the probe (for probes tethered to the solid support at the 3' end), so long as it extends over the middle of the probe.

For probes that tie in the number of targets represented, a secondary ranking was used to favor probes most dispersed across the target from those probes which had already been selected to represent that target. The probe with the same conservation rank that occurs at the farthest distance from any probe already selected from the target sequence is the next probe to be chosen to represent that target. The probes are shown in Tables 13-25.

Following probe selection, the probes are then arranged on a suitable substrate to form an array, as described in more detail below.

Example 16

Detection of Bovine Pathogens Using an Array

DNA microarrays are synthesized with probes from Tables 13-25 as described in, e.g., Jaing, C., Gardner, S., McLoughlin, K., Mulakken, N., Alegria-Hartman, M., Banda, P., Williams, P., Gu, P., Wagner, M., Manohar, C. and Slezak, T. (2008) A Functional Gene Array for Detection of Bacterial Virulence Elements, PLoS ONE, 3, e2163. The array probes can detect at least one or more of the following pathogens: OvHV-2, AHV1, BHV, PPDX, FMDV, BVD, BTV, VSV, and RPV. A bovine sample with cells that is possibly infected by one or more pathogens (e.g., OvHV-2, AHV1, BHV, PPDX, FMDV, BVD, BTV, VSV, and RPV) is obtained.

After treatment with Trizol reagent, RNA from cells is precipitated with isopropanol and washed with 70% ethanol. The RNA pellet is dried and reconstituted with RNase free water. 1 µg of RNA is transcribed into double-strand cDNA with random hexamers using Superscript™ double-stranded cDNA synthesis kit from Invitrogen (Carlsbad, Calif.). The DNA or cDNA is labeled using Cy-3 labeled nonamers from Trilink Biotechnologies and 4 µg of labeled sample is hybridized to the microarray for 16 hours as previously described (see Jaing, C., Gardner, S., McLoughlin, K., Mulakken, N., Alegria-Hartman, M., Banda, P., Williams, P., Gu, P., Wagner, M., Manohar, C. and Slezak, T. (2008) A Functional Gene Array for Detection of Bacterial Virulence Elements, PLoS ONE, 3, e2163).

Upon completion of hybridization and washing of the array, the array is scanned to determine the position on the array to which the target sequence(s) hybridize. The hybridization data obtained from the scan is typically in the form of fluorescence intensities (e.g., via Cy3) as a function of location on the array.

Example 17

Detection of Porcine Pathogens Using an Array

DNA microarrays are synthesized with probes from Tables 13-25 as described in, e.g., Jaing, C., Gardner, S., McLoughlin, K., Mulakken, N., Alegria-Hartman, M., Banda, P., Williams, P., Gu, P., Wagner, M., Manohar, C. and Slezak, T. (2008) A Functional Gene Array for Detection of Bacterial Virulence Elements, PLoS ONE, 3, e2163. The array probes can detect at least one or more of the following pathogens: FMDV, PRRS, SVD, VESV, and VSV. A porcine sample with cells that is possibly infected by one or more pathogens (e.g., FMDV, PRRS, SVD, VESV, and VSV) is obtained.

After treatment with Trizol reagent, RNA from cells is precipitated with isopropanol and washed with 70% ethanol. The RNA pellet is dried and reconstituted with RNase free water. 1 µg of RNA is transcribed into double-strand cDNA with random hexamers using Superscript™ double-stranded cDNA synthesis kit from Invitrogen (Carlsbad, Calif.). The DNA or cDNA is labeled using Cy-3 labeled nonamers from Trilink Biotechnologies and 4 µg of labeled sample is hybridized to the microarray for 16 hours as previously described (see Jaing, C., Gardner, S., McLoughlin, K., Mulakken, N., Alegria-Hartman, M., Banda, P., Williams, P., Gu, P., Wagner, M., Manohar, C. and Slezak, T. (2008) A Functional Gene Array for Detection of Bacterial Virulence Elements, PLoS ONE, 3, e2163).

Upon completion of hybridization and washing of the array, the array is scanned to determine the position on the array to which the target sequence(s) hybridize. The hybridization data obtained from the scan is typically in the form of fluorescence intensities (e.g., via Cy3) as a function of location on the array.

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

SEQUENCE LISTING (23190 sequences)

SEQ ID NO: 1 - DNA, 140 bp, Artificial Sequence
  Description of Artificial Sequence: Synthetic polynucleotide
gtgccagccgcgtaaaagcggcgctccatgttagcgctctggaaccaggagacgtcgcagcgcaggttgggcgggtgggcggttggcgtcgcgtcctcgagcgtaaggacggacgtgcgcgaaaagagcccggagtcgtc

SEQ ID NO: 2 - DNA, 18 bp, Artificial Sequence
  Description of Artificial Sequence: Synthetic primer
gtgccagccgcgtaaaag

SEQ ID NO: 3 - DNA, 19 bp, Artificial Sequence
  Description of Artificial Sequence: Synthetic primer
gacgactccgggctctttt

SEQ ID NO: 4 - DNA, 27 bp, Artificial Sequence
  Description of Artificial Sequence: Synthetic probe
tcctggttccagagcgctaacatggag

SEQ ID NO: 5 - DNA, 114 bp, Artificial Sequence
  Description of Artificial Sequence: Synthetic polynucleotide
gtccccacgggcgtagtagcaccgggcgtgctgtcctctggcgtagcgtcggggctgttgggcgtggggggcgttgcgccggtggtcccagcggagctttccgtctcggttggg

SEQ ID NO: 6 - DNA, 22 bp, Artificial Sequence
  Description of Artificial Sequence: Synthetic primer
tgaggcctatgtatgggcagtt

SEQ ID NO: 7 - DNA, 20 bp, Artificial Sequence
  Description of Artificial Sequence: Synthetic primer
gcgcgccaaacataagtaaa

SEQ ID NO: 8 - DNA, 34 bp, Artificial Sequence
  Description of Artificial Sequence: Synthetic probe
aaataacacggtgtgcacttaaataagattcgcg

SEQ ID NO: 9 - DNA, 178 bp, Artificial Sequence
  Description of Artificial Sequence: Synthetic polynucleotide
gcagatgcgctcctggttctggcagaacaccgagtcttcgatgatcaacaccctcctggtcccggccgaccgcatgatggccatggcccggatgagcctcttcttcgatccgcgtatggacatggaccggagcacgttctccacgtcggagtcggagacgttgcagcagcagaggtgc

SEQ ID NO: 10 - DNA, 18 bp, Artificial Sequence
  Description of Artificial Sequence: Synthetic primer
gcagatgcgctcctggtt

SEQ ID NO: 11 - DNA, 18 bp, Artificial Sequence
  Description of Artificial Sequence: Synthetic primer
gcacctctgctgctgcaa

SEQ ID NO: 12 - DNA, 23 bp, Artificial Sequence
  Description of Artificial Sequence: Synthetic probe
ccgactccgacgtggagaacgtg

SEQ ID NO: 13 - DNA, 95 bp, Artificial Sequence
  Description of Artificial Sequence: Synthetic oligonucleotide
gatggccgtgcagctcttggccgaggcgtacgagaagagcgcgctgttgcggaagcccatgagcccgtacacggagttggccgtgatcttgtacg

SEQ ID NO: 14 - DNA, 18 bp, Artificial Sequence
  Description of Artificial Sequence: Synthetic primer
gatggccgtgcagctctt

SEQ ID NO: 15 - DNA, 21 bp, Artificial Sequence
  Description of Artificial Sequence: Synthetic primer
cgtacaagatcacggccaact

SEQ ID NO: 16 - DNA, 22 bp, Artificial Sequence
  Description of Artificial Sequence: Synthetic probe
tgtacgggctcatgggcttccg

SEQ ID NO: 17 - DNA, 167 bp, Artificial Sequence
  Description of Artificial Sequence: Synthetic polynucleotide
gcagcagtgcaccacgtagtacccggcggtggcgcgcaggcgcttgttgtccgcctcgaagtccgcctccaacccctcgttgaagtacttgtcgaatatgatgggcaggaaggatagttttgactcggtgaccaccttcccgaagttgaggatgtacgggttcagcg

SEQ ID NO: 18 - DNA, 20 bp, Artificial Sequence
  Description of Artificial Sequence: Synthetic primer
gcagcagtgcaccacgtagt

SEQ ID NO: 19 - DNA, 19 bp, Artificial Sequence
  Description of Artificial Sequence: Synthetic primer
cgctgaacccgtacatcct

SEQ ID NO: 20 - DNA, 23 bp, Artificial Sequence
  Description of Artificial Sequence: Synthetic probe
gacttcgaggcggacaacaagcg

SEQ ID NO: 21 - DNA, 107 bp, Artificial Sequence
  Description of Artificial Sequence: Synthetic polynucleotide
actgggttttacaaacctgtgatggcctcgaagaccctcgaggccatcctctcctttgcacgccgtgggaccatacaggagaagttgatctccgtggcaggactcgc

SEQ ID NO: 22 - DNA, 22 bp, Artificial Sequence
  Description of Artificial Sequence: Synthetic primer
actgggttttacaaacctgtga

SEQ ID NO: 23 - DNA, 17 bp, Artificial Sequence
  Description of Artificial Sequence: Synthetic primer
gcgagtcctgccacgga

SEQ ID NO: 24 - DNA, 20 bp, Artificial Sequence
  Description of Artificial Sequence: Synthetic probe
gtcccacggcgtgcaaagga

SEQ ID NO: 25 - DNA, 97 bp, Artificial Sequence
  Description of Artificial Sequence: Synthetic oligonucleotide
cactttaaagtgacactgaaactggtacccaatcactggtgacaggctaaggatgccctccaggtaccccgaggtaacacgagacactcgggatctg

SEQ ID NO: 26 - DNA, 28 bp, Artificial Sequence
  Description of Artificial Sequence: Synthetic primer
cacytyaagrtgacaytgrtactggtac

SEQ ID NO: 27 - DNA, 23 bp, Artificial Sequence
  Description of Artificial Sequence: Synthetic primer
  modified_base (16)..(16): Inosine
  modified_base (18)..(18): Inosine
cagatyccragtgwcncntgtta

SEQ ID NO: 28 - DNA, 24 bp, Artificial Sequence
  Description of Artificial Sequence: Synthetic probe
cctcggggtacctgaagggcatcc

SEQ ID NO: 29 - DNA, 202 bp, Artificial Sequence
  Description of Artificial Sequence: Synthetic polynucleotide
ggtagtcgtcagtggttcgacacctcggaaagaaggtctcgagatgccacgtggacgagggcatgcccaaagcacatcttaacctggacgggggtcgcccaggtaaaagcagttttgaccaactgttatggacacagcctgatagggtgctgcagaggcccactgaattgctactaaaaatctctgctgtacatggcacatg

SEQ ID NO: 30 - DNA, 21 bp, Artificial Sequence
  Description of Artificial Sequence: Synthetic primer
ggtagtcgtcagtggttcgac

SEQ ID NO: 31 - DNA, 23 bp, Artificial Sequence
  Description of Artificial Sequence: Synthetic primer
catgtgccatgtacagcagagat

SEQ ID NO: 32 - DNA, 23 bp, Artificial Sequence
  Description of Artificial Sequence: Synthetic probe
cctcgtccacgtggcatctcgag

SEQ ID NO: 33 - DNA, 255 bp, Artificial Sequence
  Description of Artificial Sequence: Synthetic polynucleotide
tcaagacgaatgaatgaggagaagatcttagaggcggtgaagtattcgcaaaatttaggctcgcacgatcgtaggctacctctttttgaaaaaatgttaaagatggtttatactacaccattctacccgcataagagctcgaacatgatattagcatctttcctattaagcattcaaaccattactggatatggcagggcgtgggtgaagaacgtgagcaccgagttcgataaacagctgaaaccgaacccaagc

SEQ ID NO: 34 - DNA, 23 bp, Artificial Sequence
  Description of Artificial Sequence: Synthetic primer
gcaccctatatgtttccagacca

SEQ ID NO: 35 - DNA, 22 bp, Artificial Sequence
  Description of Artificial Sequence: Synthetic primer
cagctaactcttcagccacacg

SEQ ID NO: 36 - DNA, 30 bp, Artificial Sequence
  Description of Artificial Sequence: Synthetic probe
ctaactcgtgggccaatcatcatcttctgt

SEQ ID NO: 37 - DNA, 253 bp, Artificial Sequence
  Description of Artificial Sequence: Synthetic polynucleotide
ggatttgcgatatgaaggttatacgttagaacagatcatagattttggatatggagaggggagggtagcgaatacgttgtggaacggaaagcgaagactgtttaagactacatttgacgcgtatatacgattagatgagagcgagcgagacaaaggtggtttcaaggtccccaagggagtgcttccagtatcgagtgttgacgttgcgaatcgaatcgcggtggacaagggattcgacacgcttatcgcggca

SEQ ID NO: 38 - DNA, 23 bp, Artificial Sequence
  Description of Artificial Sequence: Synthetic primer
gcaccctatatgtttccagacca

SEQ ID NO: 39 - DNA, 22 bp, Artificial Sequence
  Description of Artificial Sequence: Synthetic primer
cagctaactcttcagccacacg

SEQ ID NO: 40 - DNA, 30 bp, Artificial Sequence; identical to SEQ ID NO: 36
  Description of Artificial Sequence: Synthetic probe

SEQ ID NO: 41 - DNA, 299 bp, Artificial Sequence
  Description of Artificial Sequence: Synthetic polynucleotide
caggataatttcttccaagggcccccaggagaggtgatgggaagagccatttccagccctaaccgccgcagagacagggcacacgtcacaagttgtaccatcagacacaatgcaaactagacacgtgaagaattaccattcaagatcagagtcgacagtggagaacttcctgtgcagatctgcatgcgtcttctacaccacatacaagaaccatgactccgatggcgacaacttcgcctactgggtgatcaacacacggcaagttgctcaactgcgtcggaagctcgaaatgttcacgt

SEQ ID NO: 42 - DNA, 22 bp, Artificial Sequence
  Description of Artificial Sequence: Synthetic primer
caggataatttcttccaagggc

SEQ ID NO: 43 - DNA, 21 bp, Artificial Sequence
  Description of Artificial Sequence: Synthetic primer
acgtgaacatttcgagcttcc

SEQ ID NO: 44 - DNA, 31 bp, Artificial Sequence
  Description of Artificial Sequence: Synthetic probe
tgcattgtgtctgatggtacaacttgtgacg

SEQ ID NO: 45 - DNA, 281 bp, Artificial Sequence
  Description of Artificial Sequence: Synthetic polynucleotide
gacttgttgtggctggaggacgacgccatggagcaaggagttagggattatgtggaacaactcggcaactgcttcggctcaggattcaccaatcaaatttgcgaacaggttacccttctaaaagagtcgttaattggacaggattctatccttgagaagtctctcaaggccctcgtcaagatagtatcagcactcgtgatcgtggtgagaaatcacgatgacctcattacggtcaccgccacactggcgttaataggatgcactacctcaccatggcgctg

SEQ ID NO: 46 - DNA, 20 bp, Artificial Sequence
  Description of Artificial Sequence: Synthetic primer
gacttgttgtggctggagga

SEQ ID NO: 47 - DNA, 19 bp, Artificial Sequence
  Description of Artificial Sequence: Synthetic primer
cagcgccatggtgaggtag

SEQ ID NO: 48 - DNA, 31 bp, Artificial Sequence
  Description of Artificial Sequence: Synthetic probe
tgaccgtaatgaggtcatcgtgatttctcac

SEQ ID NO: 49 - DNA, 248 bp, Artificial Sequence
  Description of Artificial Sequence: Synthetic polynucleotide
gacaaagtggccaagggaaagtccaggctcatcgaggcttctagcctcaacgactcagtagcaatgaggcagacatttggaaacctatataagactttccacctcaacccgggcatcgttacgggtagcgccgttgggtgtgacccagatgtcttttggagcaagattcccgtcatgctcgatggacatctcatagcgtttgactattcaggctatgacgccagcctcagcccagtgtggtttacgtg

SEQ ID NO: 50 - DNA, 20 bp, Artificial Sequence
  Description of Artificial Sequence: Synthetic primer
gacaaagtggccaagggaaa

SEQ ID NO: 51 - DNA, 20 bp, Artificial Sequence
  Description of Artificial Sequence: Synthetic primer
cacgtaaaccacactgggct

SEQ ID NO: 52 - DNA, 31 bp, Artificial Sequence
  Description of Artificial Sequence: Synthetic probe
ctggcgtcatagcctgaatagtcaaacgcta

SEQ ID NO: 53 - DNA, 153 bp, Artificial Sequence
  Description of Artificial Sequence: Synthetic polynucleotide
gccttctcccttcccaaaacggacggacccaccggaaacgaacccgaattcatcgctgaggcttgccctagctgcgctctttacgacacgtgtccaaattgcacatctaaggttatcaacgatgatggctcaactgacggaaccattccttca

SEQ ID NO: 54 - DNA, 19 bp, Artificial Sequence
  Description of Artificial Sequence: Synthetic primer
gccttctcccttcccaaaa

SEQ ID NO: 55 - DNA, 21 bp, Artificial Sequence
  Description of Artificial Sequence: Synthetic primer
tgaaggaatggttccgtcagt

SEQ ID NO: 56 - DNA, 34 bp, Artificial Sequence
  Description of Artificial Sequence: Synthetic probe
catcatcgttgataaccttagatgtgcaatttgg

SEQ ID NO: 57 - DNA, 199 bp, Artificial Sequence
  Description of Artificial Sequence: Synthetic polynucleotide
gggaatgaggtgtgcatcattgatgaattcgactcatctgacaaggttgattatgccaattttgtagtcaacatggttaacaccaaccccatggtcttaaattgtgatctaattgaaaacaaaggcaagacattcacctcaaaatacgtcatcatgacgtccaacacggaaacaccagtcaagccaacatcaagacgtg

SEQ ID NO: 58 - DNA, 21 bp, Artificial Sequence
  Description of Artificial Sequence: Synthetic primer
gggaatgaggtgtgcatcatt

SEQ ID NO: 59 - DNA, 22 bp, Artificial Sequence
  Description of Artificial Sequence: Synthetic primer
cacgtcttgatgttggcttgac

SEQ ID NO: 60 - DNA, 33 bp, Artificial Sequence
  Description of Artificial Sequence: Synthetic probe
aaattggcataatcaaccttgtcagatgagtcg

SEQ ID NO: 61 - DNA, 124 bp, Artificial Sequence
  Description of Artificial Sequence: Synthetic polynucleotide
ggtcgctctcactgatgatgagtacaatgattggaaacagtccaaagctgaaaaaaacctcgacctcacggtcaaggacttcctccaactcaggcaccgagctgcaatgggtgctgataacacc

SEQ ID NO: 62 - DNA, 24 bp, Artificial Sequence
  Description of Artificial Sequence: Synthetic primer
ggtcgctctcactgatgatgagta

SEQ ID NO: 63 - DNA, 21 bp, Artificial Sequence
  Description of Artificial Sequence: Synthetic primer
ggtgttatcagcacccattgc

SEQ ID NO: 64 - DNA, 24 bp, Artificial Sequence
  Description of Artificial Sequence: Synthetic probe
gctcggtgcctgagttggaggaag

SEQ ID NO: 65 - DNA, 200 bp, Artificial Sequence
  Description of Artificial Sequence: Synthetic polynucleotide
accacctctggaaacatctatggagcctgcggctcatcgtgttcactgacgagacagggtgactgcggtctcccctacgtcgacgatcacggtgttgtcgttggactccatgctgggtctggtggtgacaaatgcccgtcccgaaaactcattgttccctacgtcaaggtggatatgagaattcgtgacacgtgcacaaa

SEQ ID NO: 66 - DNA, 23 bp, Artificial Sequence
  Description of Artificial Sequence: Synthetic primer
accacctctggaaacatctatgg

SEQ ID NO: 67 - DNA, 20 bp, Artificial Sequence
  Description of Artificial Sequence: Synthetic primer
tttgtgcacgtgtcacgaat

SEQ ID NO: 68 - DNA, 21 bp, Artificial Sequence
  Description of Artificial Sequence: Synthetic probe
cgggacgggcatttgtcacca

SEQ ID NO: 69 - DNA, 27 bp, Artificial Sequence
  Description of Artificial Sequence: Synthetic probe
ctccatgttagcgctctggaacctgga

SEQ ID NO: 70 - DNA, 34 bp, Artificial Sequence
  Description of Artificial Sequence: Synthetic probe
cgcgaatcttatttaagtgcacaccgtgttattt

SEQ ID NO: 71 - DNA, 23 bp, Artificial Sequence
  Description of Artificial Sequence: Synthetic probe
cacgttctccacgtcggagtcgg

SEQ ID NO: 72 - DNA, 22 bp, Artificial Sequence
  Description of Artificial Sequence: Synthetic probe
cggaagcccatgagcccgtaca

SEQ ID NO: 73 - DNA, 23 bp, Artificial Sequence
  Description of Artificial Sequence: Synthetic probe
cgcttgttgtccgcctcgaagtc

SEQ ID NO: 74 - DNA, 30 bp, Artificial Sequence
  Description of Artificial Sequence: Synthetic probe
acagaagatgatgattggcccacgagttag

SEQ ID NO: 75 - DNA, 30 bp, Artificial Sequence; identical to SEQ ID NO: 36
  Description of Artificial Sequence: Synthetic probe

SEQ ID NO: 76 - DNA, 23 bp, Artificial Sequence
  Description of Artificial Sequence: Synthetic probe
ctcgagatgccacgtggacgagg

SEQ ID NO: 77 - DNA, 24 bp, Artificial Sequence
  Description of Artificial Sequence: Synthetic probe
cctcggggtacctgaagggcatcc

SEQ ID NO: 78 - DNA, 20 bp, Artificial Sequence
  Description of Artificial Sequence: Synthetic probe
gtcccacggcgtgcaaagga

SEQ ID NO: 79 - DNA, 31 bp, Artificial Sequence
  Description of Artificial Sequence: Synthetic probe
cgtcacaagttgtaccatcagacacaatgca

SEQ ID NO: 80 - DNA, 31 bp, Artificial Sequence; identical to SEQ ID NO: 48
  Description of Artificial Sequence: Synthetic probe

SEQ ID NO: 81 - DNA, 31 bp, Artificial Sequence; identical to SEQ ID NO: 52
  Description of Artificial Sequence: Synthetic probe

SEQ ID NO: 82 - DNA, 34 bp, Artificial Sequence
  Description of Artificial Sequence: Synthetic probe
ccaaattgcacatctaaggttatcaacgatgatg

SEQ ID NO: 83 - DNA, 33 bp, Artificial Sequence
  Description of Artificial Sequence: Synthetic probe
cgactcatctgacaaggttgattatgccaattt

SEQ ID NO: 84 - DNA, 24 bp, Artificial Sequence
  Description of Artificial Sequence: Synthetic probe
cttcctccaactcaggcaccgagc

SEQ ID NO: 85 - DNA, 21 bp, Artificial Sequence
  Description of Artificial Sequence: Synthetic probe
tggtgacaaatgcccgtcccg

SEQ ID NO: 86 - DNA, 22 bp, Artificial Sequence
  Description of Artificial Sequence: Synthetic primer
  modified_base (8)..(8): iBiodT
  modified_base (21)..(21): iBiodT
tgaggcctatgtatgggcagtt

SEQ ID NO: 87 - DNA, 18 bp, Artificial Sequence
  Description of Artificial Sequence: Synthetic primer
  modified_base (6)..(6): iBiodT
  modified_base (14)..(14): iBiodT
gcagatgcgctcctggtt

SEQ ID NO: 88 - DNA, 18 bp, Artificial Sequence
  Description of Artificial Sequence: Synthetic primer
  modified_base (9)..(9): iBiodT
  modified_base (15)..(15): iBiodT
gatggccgtgcagctctt

SEQ ID NO: 89 - DNA, 20 bp, Artificial Sequence
  Description of Artificial Sequence: Synthetic primer
  modified_base (8)..(8): iBiodT
  modified_base (17)..(17): iBiodT
gcagcagtgcaccacgtagt

SEQ ID NO: 90 - DNA, 23 bp, Artificial Sequence
  Description of Artificial Sequence: Synthetic primer
  modified_base (7)..(7): iBiodT
  modified_base (15)..(15): iBiodT
gcaccctatatgtttccagacca

SEQ ID NO: 91 - DNA, 20 bp, Artificial Sequence
  Description of Artificial Sequence: Synthetic primer
  modified_base (6)..(6): iBiodT
  modified_base (12)..(12): iBiodT
agaattcaggatgggcagga

SEQ ID NO: 92 - DNA, 21 bp, Artificial Sequence
  Description of Artificial Sequence: Synthetic primer
  modified_base (9)..(9): iBiodT
  modified_base (17)..(17): iBiodT
ggtagtcgtcagtggttcgac

SEQ ID NO: 93 - DNA, 28 bp, Artificial Sequence
  Description of Artificial Sequence: Synthetic primer
  modified_base (11)..(11): iBiodT
  modified_base (23)..(23): iBiodT
cacytyaagrtgacaytgrtactggtac

SEQ ID NO: 94 - DNA, 22 bp, Artificial Sequence
  Description of Artificial Sequence: Synthetic primer
  modified_base (7)..(7): iBiodT
  modified_base (18)..(18): iBiodT
actgggttttacaaacctgtga

SEQ ID NO: 95 - DNA, 22 bp, Artificial Sequence
  Description of Artificial Sequence: Synthetic primer
  modified_base (6)..(6): iBiodT
  modified_base (14)..(14): iBiodT
caggataatttcttccaagggc

SEQ ID NO: 96 - DNA, 20 bp, Artificial Sequence
  Description of Artificial Sequence: Synthetic primer
  modified_base (7)..(7): iBiodT
  modified_base (14)..(14): iBiodT
gacttgttgtggctggagga

SEQ ID NO: 97 - DNA, 20 bp, Artificial Sequence
  Description of Artificial Sequence: Synthetic primer
  modified_base (8)..(8): iBiodT
gacaaagtggccaagggaaa

SEQ ID NO: 98 - DNA, 19 bp, Artificial Sequence
  Description of Artificial Sequence: Synthetic primer
  modified_base (5)..(5): iBiodT
  modified_base (12)..(12): iBiodT
gccttctcccttcccaaaa

SEQ ID NO: 99 - DNA, 21 bp, Artificial Sequence
  Description of Artificial Sequence: Synthetic primer
  modified_base (6)..(6): iBiodT
  modified_base (17)..(17): iBiodT
gggaatgaggtgtgcatcatt

SEQ ID NO: 100 - DNA, 24 bp, Artificial Sequence
  Description of Artificial Sequence: Synthetic primer
  modified_base (7)..(7): iBiodT
  modified_base (19)..(19): iBiodT
ggtcgctctcactgatgatgagta

SEQ ID NO: 101 - DNA, 23 bp, Artificial Sequence
  Description of Artificial Sequence: Synthetic primer
  modified_base (7)..(7): iBiodT
  modified_base (19)..(19): iBiodT
accacctctggaaacatctatgg

SEQ ID NO: 102 - DNA, 20 bp, Artificial Sequence
  Description of Artificial Sequence: Synthetic probe
caaagtgggagacgtcgttg

SEQ ID NO: 103 - DNA, 20 bp, Artificial Sequence
  Description of Artificial Sequence: Synthetic probe
  modified_base (6)..(6): iBiodT
  modified_base (18)..(18): iBiodT
caaagtgggagacgtcgttg

SEQ ID NO: 104 - DNA, 20 bp, Artificial Sequence
  Description of Artificial Sequence: Synthetic probe
caaagtgggagacgtcgttg

SEQ ID NO: 105 - DNA, 27 bp, Artificial Sequence
  Description of Artificial Sequence: Synthetic primer
gacatcaaggctcaaactaattttacc

SEQ ID NO: 106 - DNA, 22 bp, Artificial Sequence
  Description of Artificial Sequence: Synthetic primer
caaaggctgccaacataaaatg

SEQ ID NO: 107 - DNA, 21 bp, Artificial Sequence
  Description of Artificial Sequence: Synthetic probe
caagcgtaaatgcagcgtcca

SEQ ID NO: 108 - DNA, 131 bp, Artificial Sequence
  Description of Artificial Sequence: Synthetic polynucleotide
  modified_base (81)..(98): a, c, t, g, unknown or other
caaacctgtgatggcttcgaagaccctcgaagctatcctctcctttgcacgccgtgggaccattcaggagaagttgatctnnnnnnnnnnnnnnnnnntccactccggacaagacgagtaccggcgtctct

SEQ ID NO: 109 - DNA, 20 bp, Artificial Sequence
  Description of Artificial Sequence: Synthetic primer
caaacctgtgatggcttcga

SEQ ID NO: 110 - DNA, 21 bp, Artificial Sequence
  Description of Artificial Sequence: Synthetic primer
agagacgccggtactcgtctt

SEQ ID NO: 111 - DNA, 20 bp, Artificial Sequence
  Description of Artificial Sequence: Synthetic probe
tgcacgccgtgggaccattc

SEQ ID NO: 112 - DNA, 131 bp, Artificial Sequence
  Description of Artificial Sequence: Synthetic polynucleotide
  modified_base (34)..(51): a, c, t, g, unknown or other
agagacgccggtactcgtcttgtccggagtggannnnnnnnnnnnnnnnnnagatcaacttctcctgaatggtcccacggcgtgcaaaggagaggatagcttcgagggtcttcgaagccatcacaggtttg

SEQ ID NO: 113 - DNA, 21 bp, Artificial Sequence
  Description of Artificial Sequence: Synthetic primer
agagacgccggtactcgtctt

SEQ ID NO: 114 - DNA, 20 bp, Artificial Sequence
  Description of Artificial Sequence: Synthetic primer
caaacctgtgatggcttcga

SEQ ID NO: 115 - DNA, 21 bp, Artificial Sequence
  Description of Artificial Sequence: Synthetic probe
tcctgaatggtcccacggcgt

SEQ ID NO: 116 - DNA, 166 bp, Artificial Sequence
  Description of Artificial Sequence: Synthetic polynucleotide
  modified_base (45)..(62): a, c, t, g, unknown or other
  modified_base (93)..(110): a, c, t, g, unknown or other
ccaacgcaggtaaagtgatctgtagcttggaatctcgaacgtccnnnnnnnnnnnnnnnnnngacgccggtactcgtcttgtccggagtggannnnnnnnnnnnnnnnnnagatcaacttctcctgaatggtcccacggcgtgcaaaggagaggatagcttcgagg

SEQ ID NO: 117 - DNA, 22 bp, Artificial Sequence
  Description of Artificial Sequence: Synthetic primer
ccaacgcaggtaaagtgatctg

SEQ ID NO: 118 - DNA, 22 bp, Artificial Sequence
  Description of Artificial Sequence: Synthetic primer
aacctgtgatggcttcgaagac

SEQ ID NO: 119 - DNA, 21 bp, Artificial Sequence
  Description of Artificial Sequence: Synthetic probe
tcctgaatggtcccacggcgt

SEQ ID NO: 120 - DNA, 343 bp, Artificial Sequence
  Description of Artificial Sequence: Synthetic polynucleotide
  modified_base (135)..(220): a, c, t, g, unknown or other
agcatcatcaacacaattctgaacaacatctacgtgctctacgcgctgcgtaggcactacgagggagttgagctggacacttacaccatgatctcctacggggacgacatcgtggttgcaagtgattacgatctnnnnnnnnnnnnnnnnnnnnnnnnnnnnnnnnnnnnnnnnnnnnnnnnnnnnnnnnnnnnnnnnnnnnnnnnnnnnnnnnnnnnnngtcactccattaccgatgtcactttcctcaaaagacacttccacatggattatggaactgggttttacaaacctgtgatggcttcgaagaccctcgaagccatcctctcctttgcacgccgtg

SEQ ID NO: 121 - DNA, 25 bp, Artificial Sequence
  Description of Artificial Sequence: Synthetic primer
agcatcatcaacacaattctgaaca

SEQ ID NO: 122 - DNA, 25 bp, Artificial Sequence
  Description of Artificial Sequence: Synthetic primer
catcacaggtttgtaaaacccagtt

SEQ ID NO: 123 - DNA, 35 bp, Artificial Sequence
  Description of Artificial Sequence: Synthetic probe
cactttcctcaaaagacacttccacatggattatg

SEQ ID NO: 124-125 - skipped (2 entries)

SEQ ID NO: 126 - DNA, 22 bp, Artificial Sequence
  Description of Artificial Sequence: Synthetic primer
actgggttttacaaacctgtga

SEQ ID NO: 127 - DNA, 17 bp, Artificial Sequence
  Description of Artificial Sequence: Synthetic primer
gcgagtcctgccacgga

SEQ ID NO: 128 - DNA, 20 bp, Artificial Sequence
  Description of Artificial Sequence: Synthetic probe
gtcccacggcgtgcaaagga

SEQ ID NO: 129 - DNA, 107 bp, Foot-and-mouth disease virus Asia 1
actgggttttacaaacctgtgatggcctcaaagacccttgaggctatcctctcctttgcacgccgtgggaccatacaggagaagttgatctccgtggcaggactcgc

SEQ ID NO: 130 - DNA, 28 bp, Artificial Sequence
  Description of Artificial Sequence: Synthetic primer
cacytyaagrtgacaytgrtactggtac

SEQ ID NO: 131 - DNA, 23 bp, Artificial Sequence
  Description of Artificial Sequence: Synthetic primer
  modified_base (16)..(16): Inosine
  modified_base (18)..(18): Inosine
cagatyccragtgwcncntgtta

SEQ ID NO: 132 - DNA, 24 bp, Artificial Sequence
  Description of Artificial Sequence: Synthetic probe
cctcggggtacctgaagggcatcc

SEQ ID NO: 133 - DNA, 97 bp, Foot-and-mouth disease virus A
cactttaaggtgacactgatactggtactcaaacactggtgacaggctaaggatgcccttcaggtaccccgaggtaacacgcgacactcgggatctg

SEQ ID NO: 134 - DNA, 20 bp, Artificial Sequence
  Description of Artificial Sequence: Synthetic primer
gagcggcaattgtgtctgtc

SEQ ID NO: 135 - DNA, 20 bp, Artificial Sequence
  Description of Artificial Sequence: Synthetic primer
gctgagggtgatgctgtgac

SEQ ID NO: 136 - DNA, 32 bp, Artificial Sequence
  Description of Artificial Sequence: Synthetic probe
cgcacagtatgatgcgtaggcaaactaaactc

SEQ ID NO: 137 - DNA, 158 bp, Porcine respiratory and reproductive syndrome virus
gagcggcaattgtgtctgtcgtcaatccagaccgcctttaatcaaggcgctgggacttgcaccctgtcagattcagggaggataagttacactgtggagtttagtttgcctacgcatcatactgtgcgcctgatccgcgtcacagcatcaccctcagc

SEQ ID NO: 138 - DNA, 20 bp, Artificial Sequence
  Description of Artificial Sequence: Synthetic primer
ttcttgtgaccacgattcgc

SEQ ID NO: 139 - DNA, 20 bp, Artificial Sequence
  Description of Artificial Sequence: Synthetic primer
gacccaccgagtaacttgcc

SEQ ID NO: 140 - DNA, 28 bp, Artificial Sequence
  Description of Artificial Sequence: Synthetic probe
gctcaagagccaaaagctcagcatgaca

SEQ ID NO: 141 - DNA, 141 bp, Porcine respiratory and reproductive syndrome virus
ttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtc

SEQ ID NO: 142 - DNA, 20 bp, Artificial Sequence
  Description of Artificial Sequence: Synthetic primer
attggtttgctccgcgatac

SEQ ID NO: 143 - DNA, 20 bp, Artificial Sequence
  Description of Artificial Sequence: Synthetic primer
aaatgagccaccacatccaa

SEQ ID NO: 144 - DNA, 26 bp, Artificial Sequence
  Description of Artificial Sequence: Synthetic probe
cggtacattcgacgcgacaccatttc

SEQ ID NO: 145 - DNA, 286 bp, Porcine respiratory and reproductive syndrome virus
attggtttgctccgcgatactccgtacgcgccctgccattcactctgagcaattacagaagatcttatgaggcctttctttcccagtgccaagtggacattcccacctggggaactaaacatcctttggggatgctttggcaccataaggtgtcaaccttgatagatgaaatggtgtcgcgtcgaatgtaccgcatcatggaaaaatcagggcaggctgcctggaaacaggtggtgagcgaggctacactgtctcgcattagtagtttggatgtggtggctcattt

SEQ ID NO: 146 - DNA, 20 bp, Artificial Sequence
  Description of Artificial Sequence: Synthetic primer
cagtgtgcacgcttccattt

SEQ ID NO: 147 - DNA, 20 bp, Artificial Sequence
  Description of Artificial Sequence: Synthetic primer
ctcgaatgatgtgttgccgt

SEQ ID NO: 148 - DNA, 31 bp, Artificial Sequence
  Description of Artificial Sequence: Synthetic probe
aaacatagcgtagagctggaattcgaagcca

SEQ ID NO: 149 - DNA, 129 bp, Porcine respiratory and reproductive syndrome virus
cagtgtgcatgcttccattttttcctctgtggcttcatctgttaccttgttcatagtgctttggctgcgaattccagctctacgctatgtttttggtttccattggcccacggcaacacatcattcgag

SEQ ID NO: 150 - DNA, 20 bp, Artificial Sequence
  Description of Artificial Sequence: Synthetic primer
gctttctgcgtgccttttct

SEQ ID NO: 151 - DNA, 20 bp, Artificial Sequence
  Description of Artificial Sequence: Synthetic primer
acaacgccagagacattccc

SEQ ID NO: 152 - DNA, 31 bp, Artificial Sequence
  Description of Artificial Sequence: Synthetic probe
tgactttgaagcctttctcgctcatttctga

SEQ ID NO: 153 - DNA, 81 bp, Porcine respiratory and reproductive syndrome virus
gctttctgcgtgccttttccacgcctcagaaatgagcgagaaaggcttcaaagttatctttgggaatgtctctggcgttgt

SEQ ID NO: 154 - DNA, 22 bp, Artificial Sequence
  Description of Artificial Sequence: Synthetic primer
caggataatttcttccaagggc

SEQ ID NO: 155 - DNA, 21 bp, Artificial Sequence
  Description of Artificial Sequence: Synthetic primer
acgtgaacatttcgagcttcc

SEQ ID NO: 156 - DNA, 31 bp, Artificial Sequence; identical to SEQ ID NO: 44
  Description of Artificial Sequence: Synthetic probe

SEQ ID NO: 157 - DNA, 349 bp, Swine vesicular disease virus
caggataatttcttccaagggcccccaggagaggtgatggaaagagccattgcccgcgtcgctgatactactgggagcggaccagttaactcggaatccattccagctctaaccgccgcagagacagggcacacgtcacaagttgtaccatcagacacaatgcaaactaggcacgtgaagaattaccattcaaggtcagagtcgacagtggagaacttcctgtgcagatctgcatgcgttttctacaccacatacaagaaccatgactctgatggcgacaacttcgcctactgggtgatcaacacacggcaagttgctcaactgcgtcggaagctcgaaatgttcacgt

SEQ ID NO: 158 - DNA, 20 bp, Artificial Sequence
  Description of Artificial Sequence: Synthetic primer
gacttgttgtggctggagga

SEQ ID NO: 159 - DNA, 19 bp, Artificial Sequence
  Description of Artificial Sequence: Synthetic primer
cagcgccatggtgaggtag

SEQ ID NO: 160 - DNA, 31 bp, Artificial Sequence; identical to SEQ ID NO: 48
  Description of Artificial Sequence: Synthetic probe

SEQ ID NO: 161 - DNA, 281 bp, Swine vesicular disease virus
gacttgttgtggctggaggacgatgccatggagcaaggagttagggattatgtggaacaactcggcaatgccttcggctcaggattcaccaatcaaatttgcgaacaggttacccttctaaaagagtcgttaattggacaggattctgtccttgagaagtctctcaaggccctcgtcaagatagtatcagcactcgtgatcgtggtgagaaatcacgatgacctcattacggtcaccgccacactggcgttaataggatgtactacctcaccatggcgctg

SEQ ID NO: 162 - DNA, 20 bp, Artificial Sequence
  Description of Artificial Sequence: Synthetic primer
gacaaagtggccaagggaaa

SEQ ID NO: 163 - DNA, 20 bp, Artificial Sequence
  Description of Artificial Sequence: Synthetic primer
cacgtaaaccacactgggct

SEQ ID NO: 164 - DNA, 31 bp, Artificial Sequence; identical to SEQ ID NO: 52
  Description of Artificial Sequence: Synthetic probe

SEQ ID NO: 165 - DNA, 248 bp, Swine vesicular disease virus
gacaaagtggccaagggaaagtccaggctcatcgaggcttctagcctcaacgactcagtggcaatgaggcagacatttggaaacctatataagactttccacctcaacccgggcatcgttacgggtagcgccgttgggtgtgacccagatgtcttttggagcaagatccccgtcatgctcgatggacatctcatagcgtttgactattcaggctatgacgccagcctcagcccagtgtggtttacgtg

SEQ ID NO: 166 - DNA, 19 bp, Artificial Sequence
  Description of Artificial Sequence: Synthetic primer
gccttctcccttcccaaaa

SEQ ID NO: 167 - DNA, 21 bp, Artificial Sequence
  Description of Artificial Sequence: Synthetic primer
tgaaggaatggttccgtcagt

SEQ ID NO: 168 - DNA, 34 bp, Artificial Sequence; identical to SEQ ID NO: 56
  Description of Artificial Sequence: Synthetic probe

SEQ ID NO: 169 - DNA, 153 bp, Vesicular exanthema of swine virus; identical to SEQ ID NO: 53

SEQ ID NO: 170 - DNA, 24 bp, Artificial Sequence
  Description of Artificial Sequence: Synthetic primer
ggtcgctctcactgatgatgagta

SEQ ID NO: 171 - DNA, 21 bp, Artificial Sequence
  Description of Artificial Sequence: Synthetic primer
ggtgttatcagcacccattgc

SEQ ID NO: 172 - DNA, 24 bp, Artificial Sequence
  Description of Artificial Sequence: Synthetic probe
gctcggtgcctgagttggaggaag

SEQ ID NO: 173 - DNA, 124 bp, Vesicular exanthema of swine virus; identical to SEQ ID NO: 61

SEQ ID NO: 174 - DNA, 23 bp, Artificial Sequence
  Description of Artificial Sequence: Synthetic primer
accacctctggaaacatctatgg

SEQ ID NO: 175 - DNA, 20 bp, Artificial Sequence
  Description of Artificial Sequence: Synthetic primer
tttgtgcacgtgtcacgaat

SEQ ID NO: 176 - DNA, 21 bp, Artificial Sequence
  Description of Artificial Sequence: Synthetic probe
cgggacgggcatttgtcacca

SEQ ID NO: 177 - DNA, 200 bp, Vesicular exanthema of swine virus; identical to SEQ ID NO: 65

SEQ ID NO: 178 - DNA, 19 bp, Artificial Sequence
  Description of Artificial Sequence: Synthetic primer
cgccacaaggcagagatgt

SEQ ID NO: 179 - DNA, 27 bp, Artificial Sequence
  Description of Artificial Sequence: Synthetic primer
tgtcaaattctgacttagcatacttgc

SEQ ID NO: 180 - DNA, 33 bp, Artificial Sequence
  Description of Artificial Sequence: Synthetic probe
gcatactgcatcatatcaggagtcggttttctg

SEQ ID NO: 181 - DNA, 159 bp, Vesicular stomatitis Indiana virus
cgccacaaggcagagatgtggtcgaatggctcggatggtttgaagatcaaaacagaaaaccgactcctgatatgatgcagtatgcgaaaagagcagtcatgtcactgcaaggcctaagagagaagacaattggcaagtatgctaagtcagaatttgaca

SEQ ID NO: 182 - DNA, 20 bp, Artificial Sequence
  Description of Artificial Sequence: Synthetic primer
ctcacaacatgggtcctgaa

SEQ ID NO: 183 - DNA, 21 bp, Artificial Sequence
  Description of Artificial Sequence: Synthetic primer
ttcttgccccggatacatcat

SEQ ID NO: 184 - DNA, 25 bp, Artificial Sequence
  Description of Artificial Sequence: Synthetic probe
ggcacagctcatctgcgacttccct

SEQ ID NO: 185 - DNA, 69 bp, Vesicular stomatitis virus
ctcacaacatgggtcctgaatagggaagttgcagacgagctatgccagatgatgtatccgggtcaagaa

SEQ ID NO: 186 - DNA, 21 bp, Artificial Sequence
  Description of Artificial Sequence: Synthetic primer
cccaatcaatgccatgataca

SEQ ID NO: 187 - DNA, 20 bp, Artificial Sequence
  Description of Artificial Sequence: Synthetic primer
ctccaatggaagggtccaaa

SEQ ID NO: 188 - DNA, 31 bp, Artificial Sequence
  Description of Artificial Sequence: Synthetic probe
tttgaaagtagaactgtgcaagcccggtatc

SEQ ID NO: 189 - DNA, 173 bp, Vesicular stomatitis Indiana virus
cccaatcaatgccatgatacagtacaattattttgggacatttgctagactcttgttgatgatgcatgatcctgctcttcgtcaatcattgtatgaagttcaagataagataccgggcttgcacagttctactttcaaatacgccatgttgtatttggacccttccattggag

SEQ ID NO: 190 - DNA, 22 bp, Artificial Sequence
  Description of Artificial Sequence: Synthetic primer
ggcgctcattataaaattcgga

SEQ ID NO: 191 - DNA, 25 bp, Artificial Sequence
  Description of Artificial Sequence: Synthetic primer
acattttctcgtagtaatgcagcag

SEQ ID NO: 192 - DNA, 31 bp, Artificial Sequence
  Description of Artificial Sequence: Synthetic probe
gaagtccctgtaatggattcccattccatgt

SEQ ID NO: 193 - DNA, 116 bp, Vesicular stomatitis Indiana virus
ggcgctcattataaaattcggagtatattacatggaatgggaatccattacagggacttcttgagttgtggagacggctccggagggatgactgctgcattactacgagaaaatgt

SEQ ID NO: 194 - DNA, 20 bp, Artificial Sequence
  Description of Artificial Sequence: Synthetic primer
aagagatggtcacgagtgac

SEQ ID NO: 195 - DNA, 21 bp, Artificial Sequence
  Description of Artificial Sequence: Synthetic primer
gagcatttgtggaaaccgagc

SEQ ID NO: 196 - DNA, 25 bp, Artificial Sequence
  Description of Artificial Sequence: Synthetic probe
tgggtatttggtcattggtgacaca

SEQ ID NO: 197 - DNA, 85 bp, Vesicular stomatitis Indiana virus
aagagatggtcacgagtgacttgtgtcaccaatgaccaaatacccacttgtgctaatataatgagctcagtttccacaaatgctc

SEQ ID NO: 198 - DNA, 20 bp, Artificial Sequence
  Description of Artificial Sequence: Synthetic primer
ctcacaacatgggtcctgaa

SEQ ID NO: 199 - DNA, 21 bp, Artificial Sequence
  Description of Artificial Sequence: Synthetic primer
ttcttgacctggatacatcat

SEQ ID NO: 200 - DNA, 25 bp, Artificial Sequence
  Description of Artificial Sequence: Synthetic probe
ggcatagytcgtctgcracttccct

SEQ ID NO: 201 - DNA, 69 bp, Vesicular stomatitis Indiana virus; identical to SEQ ID NO: 185

SEQ ID NO: 202 - DNA, 20 bp, Artificial Sequence
  Description of Artificial Sequence: Synthetic probe
caaagtgggagacgtcgttg

SEQ ID NO: 203 - DNA, 20 bp, Artificial Sequence
  Description of Artificial Sequence: Synthetic probe
caaagtgggagacgtcgttg

SEQ ID NO: 204 - DNA, 20 bp, Artificial Sequence
  Description of Artificial Sequence: Synthetic probe
caaagtgggagacgtcgttg

SEQ ID NO: 205 - DNA, 27 bp, Artificial Sequence
  Description of Artificial Sequence: Synthetic primer
gacatcaaggctcaaactaattttacc

SEQ ID NO: 206 - DNA, 22 bp, Artificial Sequence
  Description of Artificial Sequence: Synthetic primer
caaaggctgccaacataaaatg

SEQ ID NO: 207 - DNA, 21 bp, Artificial Sequence
  Description of Artificial Sequence: Synthetic probe
caagcgtaaatgcagcgtcca

SEQ ID NO: 208 - DNA, 20 bp, Artificial Sequence
  Description of Artificial Sequence: Synthetic primer
atgccagtcactggctctca

SEQ ID NO: 209 - DNA, 24 bp, Artificial Sequence
  Description of Artificial Sequence: Synthetic primer
gggtgttgtagaatcctgaaatgg

SEQ ID NO: 210 - DNA, 22 bp, Artificial Sequence
  Description of Artificial Sequence: Synthetic probe
gttgatcacggtggcaccctgg

SEQ ID NO: 211 - DNA, 76 bp, Alcelaphine herpesvirus 1
atgccagtcactggctctcaagaggggtaccagggtgccaccgtgatcaaccccatttcaggattctacaacaccc

SEQ ID NO: 212 - DNA, 25 bp, Artificial Sequence
  Description of Artificial Sequence: Synthetic primer
gttctggaaactgaccaaacagtgt

SEQ ID NO: 213 - DNA, 27 bp, Artificial Sequence
  Description of Artificial Sequence: Synthetic primer
agtggcacttgagtgtaacttttattg

SEQ ID NO: 214 - DNA, 28 bp, Artificial Sequence
  Description of Artificial Sequence: Synthetic probe
gcactctggcaggcataagggaaataca

SEQ ID NO: 215 - DNA, 99 bp, Alcelaphine herpesvirus 1
gttctggaaactgaccaaacagtgttcttatgtgcacttattttgtatttcccttatgcctgccagagtgctcaataaaagttacactcaagtgccact

SEQ ID NO: 216 - DNA, 22 bp, Artificial Sequence
  Description of Artificial Sequence: Synthetic primer
ccctggaagctgtcatacaaaa

SEQ ID NO: 217 - DNA, 24 bp, Artificial Sequence
  Description of Artificial Sequence: Synthetic primer
aaacattggcatatcttgcaaggt

SEQ ID NO: 218 - DNA, 29 bp, Artificial Sequence
  Description of Artificial Sequence: Synthetic probe
cagtagagtccagggctgcagttgtctca

SEQ ID NO: 219 - DNA, 127 bp, Alcelaphine herpesvirus 1
ccctggaagctgtcatacaaaaagctttcctgccaggagacccagctgaggctctaaacagtagccagttttgtgagacaactgcagccctggactctactgcaccttgcaagatatgccaatgttt

SEQ ID NO: 220 - DNA, 18 bp, Artificial Sequence
  Description of Artificial Sequence: Synthetic primer
gtgccagccgcgtaaaag

SEQ ID NO: 221 - DNA, 19 bp, Artificial Sequence
  Description of Artificial Sequence: Synthetic primer
gacgactccgggctctttt

SEQ ID NO: 222 - DNA, 27 bp, Artificial Sequence
  Description of Artificial Sequence: Synthetic probe
tcctggttccagagcgctaacatggag

SEQ ID NO: 223 - DNA, 140 bp, Bovine herpesvirus 1; identical to SEQ ID NO: 1

SEQ ID NO: 224 - DNA, 22 bp, Artificial Sequence
  Description of Artificial Sequence: Synthetic primer
tgaggcctatgtatgggcagtt

SEQ ID NO: 225 - DNA, 20 bp, Artificial Sequence
  Description of Artificial Sequence: Synthetic primer
gcgcgccaaacataagtaaa

SEQ ID NO: 226 - DNA, 34 bp, Artificial Sequence; identical to SEQ ID NO: 8
  Description of Artificial Sequence: Synthetic probe

SEQ ID NO: 227 - DNA, 186 bp, Bovine herpesvirus 1
tgaggcctatgtatgggcagttcgggtgccaataataaattttgcgcgaatcttatttaagtgcacaccgtgttatttgcggctgtttgtttttcttggaggcgggacgtgcgcgcgagctcggccggattagggttcggcgccacccgggcacggcagggcgccctttacttatgtttggcgcgc

SEQ ID NO: 228 - DNA, 18 bp, Artificial Sequence
  Description of Artificial Sequence: Synthetic primer
gcagatgcgctcctggtt

SEQ ID NO: 229 - DNA, 18 bp, Artificial Sequence
  Description of Artificial Sequence: Synthetic primer
gcacctctgctgctgcaa

SEQ ID NO: 230 - DNA, 23 bp, Artificial Sequence
  Description of Artificial Sequence: Synthetic probe
ccgactccgacgtggagaacgtg

SEQ ID NO: 231 - DNA, 178 bp, Bovine papular stomatitis virus
gcagatgcgctcctggttctggcagaacaccgagtcttcgatgatcaacactctcctgctcccggccgaccgcatgatggccatggcccggatgagcctcttcttcgagccccggatggacatggaccggagcacgttctccacgtcggagtcggacacgttgcagcagcagaggtgc

SEQ ID NO: 232 - DNA, 18 bp, Artificial Sequence
  Description of Artificial Sequence: Synthetic primer
gatggccgtgcagctctt

SEQ ID NO: 233 - DNA, 21 bp, Artificial Sequence
  Description of Artificial Sequence: Synthetic primer
cgtacaagatcacggccaact

SEQ ID NO: 234 - DNA, 22 bp, Artificial Sequence
  Description of Artificial Sequence: Synthetic probe
tgtacgggctcatgggcttccg

SEQ ID NO: 235 - DNA, 95 bp, Bovine papular stomatitis virus
gatggccgtgcagctcttggcggaggcgtacgagaagagcgcgctgttccggaagcccatgagcccgtacacggagttggccgtgatcttgtacg

SEQ ID NO: 236 - DNA, 20 bp, Artificial Sequence
  Description of Artificial Sequence: Synthetic primer
gcagcagtgcaccacgtagt

SEQ ID NO: 237 - DNA, 19 bp, Artificial Sequence
  Description of Artificial Sequence: Synthetic primer
cgctgaacccgtacatcct

SEQ ID NO: 238 - DNA, 23 bp, Artificial Sequence
  Description of Artificial Sequence: Synthetic probe
gacttcgaggcggacaacaagcg

SEQ ID NO: 239 - DNA, 167 bp, Bovine papular stomatitis virus
gcagcagtgcaccacgtagtacccggcggtggcgcgcagacgcttgttgtccgcctcgaagtcggcctccaggccctcgttgaagtacttgtcgaagatgatgggcaggaaggagagcttggactcggtgaccaccttcccgaagttgaggatgtacgggttcagcg

SEQ ID NO: 240 - DNA, 22 bp, Artificial Sequence
  Description of Artificial Sequence: Synthetic primer
actgggttttacaaacctgtga

SEQ ID NO: 241 - DNA, 17 bp, Artificial Sequence
  Description of Artificial Sequence: Synthetic primer
gcgagtcctgccacgga

SEQ ID NO: 242 - DNA, 20 bp, Artificial Sequence
  Description of Artificial Sequence: Synthetic probe
gtcccacggcgtgcaaagga

SEQ ID NO: 243 - DNA, 107 bp, Foot-and-mouth disease virus A; identical to SEQ ID NO: 129

SEQ ID NO: 244 - DNA, 28 bp, Artificial Sequence
  Description of Artificial Sequence: Synthetic primer
cacytyaagrtgacaytgrtactggtac

SEQ ID NO: 245 - DNA, 23 bp, Artificial Sequence
  Description of Artificial Sequence: Synthetic primer
  modified_base (16)..(16): Inosine
  modified_base (18)..(18): Inosine
cagatyccragtgwcncntgtta

SEQ ID NO: 246 - DNA, 24 bp, Artificial Sequence
  Description of Artificial Sequence: Synthetic probe
cctcggggtacctgaagggcatcc

SEQ ID NO: 247 - DNA, 97 bp, Foot-and-mouth disease virus Asia 1; identical to SEQ ID NO: 133

SEQ ID NO: 248 - DNA, 21 bp, Artificial Sequence
  Description of Artificial Sequence: Synthetic primer
ggtagtcgtcagtggttcgac

SEQ ID NO: 249 - DNA, 23 bp, Artificial Sequence
  Description of Artificial Sequence: Synthetic primer
catgtgccatgtacagcagagat

SEQ ID NO: 250 - DNA, 23 bp, Artificial Sequence
  Description of Artificial Sequence: Synthetic probe
cctcgtccacgtggcatctcgag

SEQ ID NO: 251 - DNA, 202 bp, Bovine viral diarrhea virus 1
ggtagtcgtcagtggttcgacgccttggaataaaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcacatg

SEQ ID NO: 252 - DNA, 21 bp, Artificial Sequence
  Description of Artificial Sequence: Synthetic primer
gggagtcgtcaatggttcgac

SEQ ID NO: 253 - DNA, 23 bp, Artificial Sequence
  Description of Artificial Sequence: Synthetic primer
tccatgtgccatgtacagcagag

SEQ ID NO: 254 - DNA, 23 bp, Artificial Sequence
  Description of Artificial Sequence: Synthetic probe
  modified_base (11)..(11): Inosine
cctcgtccacntggcatctcgag

SEQ ID NO: 255 - DNA, 204 bp, Bovine viral diarrhea virus 2
gggagtcgtcaatggttcgacactccattagtcgaggagtctcgagatgccatgtggacgagggcatgcccacggcacatcttaacccacgcgggggttgcatgggtgaaagcgctattcgtggcgttatggacacagcctgatagggtgtagcagagacctgctattccgctagtaaaaactctgctgtacatggcacatgga

SEQ ID NO: 256 - DNA, 23 bp, Artificial Sequence
  Description of Artificial Sequence: Synthetic primer
gcaccctatatgtttccagacca

SEQ ID NO: 257 - DNA, 22 bp, Artificial Sequence
  Description of Artificial Sequence: Synthetic primer
cagctaactcttcagccacacg

SEQ ID NO: 258 - DNA, 30 bp, Artificial Sequence; identical to SEQ ID NO: 36
  Description of Artificial Sequence: Synthetic probe

SEQ ID NO: 259 - DNA, 271 bp, Bluetongue virus
gcaccctatatgtttccagaccaaaatttgtctccgcagttctatatacagaagatgatgattggcccacgagttagctcacgagtgcggaattcttatgttgatcgaattgatgtgatattaagaaaggatgtcgtaatgcgaggttttattactgccaatacgattctgaacgtaattgaaaaattagggactaatcactcagtgggagatctggttacggtcttcacgcttatgaatatcgaaacacgtgtggctgaagagttagctg

SEQ ID NO: 260 - DNA, 21 bp, Artificial Sequence
  Description of Artificial Sequence: Synthetic primer
caaacacaaaaggcggagaag

SEQ ID NO: 261 - DNA, 27 bp, Artificial Sequence
  Description of Artificial Sequence: Synthetic primer
ggcgtttaatctgtcttagtcttacgt

SEQ ID NO: 262 - DNA, 24 bp, Artificial Sequence
  Description of Artificial Sequence: Synthetic probe
gaaacgcttctgcgtacgatgcga

SEQ ID NO: 263 - DNA, 85 bp, Bluetongue virus
caaacacaaaaggcggagaaggctgcattcgcatcgtacgcagaagcgtttcgtgatgacgtaagactaagacagattaaacgcc

SEQ ID NO: 264 - DNA, 26 bp, Artificial Sequence
  Description of Artificial Sequence: Synthetic primer
cacatgtcgcttaatttgtcttaacc

SEQ ID NO: 265 - DNA, 17 bp, Artificial Sequence
  Description of Artificial Sequence: Synthetic primer
gcggagaaggctgcatt

SEQ ID NO: 266 - DNA, 23 bp, Artificial Sequence
  Description of Artificial Sequence: Synthetic probe
acgaaacgcttccgcgtacgatg

SEQ ID NO: 267 - DNA, 78 bp, Bluetongue virus
gcggagaaggctgcattcgcatcgtacgcggaagcgtttcgtgatgatgtgaggttgagacaaattaaacgacatgtg

SEQ ID NO: 268 - DNA, 27 bp, Artificial Sequence
  Description of Artificial Sequence: Synthetic primer
tcaattttggtagaatttgttcattca

SEQ ID NO: 269 - DNA, 18 bp, Artificial Sequence
  Description of Artificial Sequence: Synthetic primer
gcggagaaggctgcattc

SEQ ID NO: 270 - DNA, 23 bp, Artificial Sequence
  Description of Artificial Sequence: Synthetic probe
acgaaacgcttccgcgtacgatg

SEQ ID NO: 271 - DNA, 103 bp, Bluetongue virus
gcggagaaggctgcattcgcatcgtacgcagaagcgtttcgtgatgatgtgagattgagacagattaaacgacatgtgaatgaacaaattctaccaaagttga

SEQ ID NO: 272 - DNA, 19 bp, Artificial Sequence
  Description of Artificial Sequence: Synthetic primer
cgccacaaggcagagatgt

SEQ ID NO: 273 - DNA, 27 bp, Artificial Sequence
  Description of Artificial Sequence: Synthetic primer
tgtcaaattctgacttagcatacttgc

SEQ ID NO: 274 - DNA, 33 bp, Artificial Sequence; identical to SEQ ID NO: 180
  Description of Artificial Sequence: Synthetic probe

SEQ ID NO: 275 - DNA, 159 bp, Vesicular stomatitis Indiana virus; identical to SEQ ID NO: 181

SEQ ID NO: 276 - DNA, 21 bp, Artificial Sequence
  Description of Artificial Sequence: Synthetic primer
cccaatcaatgccatgataca

SEQ ID NO: 277 - DNA, 20 bp, Artificial Sequence
  Description of Artificial Sequence: Synthetic primer
ctccaatggaagggtccaaa

SEQ ID NO: 278 - DNA, 31 bp, Artificial Sequence; identical to SEQ ID NO: 188
  Description of Artificial Sequence: Synthetic probe

SEQ ID NO: 279 - DNA, 173 bp, Vesicular stomatitis Indiana virus; identical to SEQ ID NO: 189

SEQ ID NO: 280 - DNA, 22 bp, Artificial Sequence
  Description of Artificial Sequence: Synthetic primer
ggcgctcattataaaattcgga

SEQ ID NO: 281 - DNA, 25 bp, Artificial Sequence
  Description of Artificial Sequence: Synthetic primer
acattttctcgtagtaatgcagcag

SEQ ID NO: 282 - DNA, 31 bp, Artificial Sequence; identical to SEQ ID NO: 192
  Description of Artificial Sequence: Synthetic probe

SEQ ID NO: 283 - DNA, 116 bp, Vesicular stomatitis Indiana virus; identical to SEQ ID NO: 193

SEQ ID NO: 284 - DNA, 20 bp, Artificial Sequence
  Description of Artificial Sequence: Synthetic primer
ctcacaacatgggtcctgaa

SEQ ID NO: 285 - DNA, 21 bp, Artificial Sequence
  Description of Artificial Sequence: Synthetic primer
ttcttgacctggatacatcat

SEQ ID NO: 286 - DNA, 25 bp, Artificial Sequence
  Description of Artificial Sequence: Synthetic probe
ggcatagytcgtctgcracttccct

SEQ ID NO: 287 - DNA, 69 bp, Vesicular stomatitis Indiana virus; identical to SEQ ID NO: 185

SEQ ID NO: 288 - DNA, 22 bp, Artificial Sequence
  Description of Artificial Sequence: Synthetic primer
ggatcgctgaaatgatctgtga

SEQ ID NO: 289 - DNA, 20 bp, Artificial Sequence
  Description of Artificial Sequence: Synthetic primer
ggagccagttcacccatttg

SEQ ID NO: 290 - DNA, 26 bp, Artificial Sequence
  Description of Artificial Sequence: Synthetic probe
ctggccaaccctgcctccactatgta

SEQ ID NO: 291 - DNA, 187 bp, Rinderpest virus
ggatcgctgaaatgatctgtgacattgatacctacatagtggaggcagggttggccagttttatactcactatcaaatttggtatagaaacgatgtacccagcactgggcctgcatgaattcgccggagagctctccacaatcgagtctcttatgaatctgtaccagcaaatgggtgaactggctcc

SEQ ID NO: 292 - DNA, 24 bp, Artificial Sequence
  Description of Artificial Sequence: Synthetic primer
tgcatcttatgtgactttggttca

SEQ ID NO: 293 - DNA, 19 bp, Artificial Sequence
  Description of Artificial Sequence: Synthetic primer
ggctatccgcacagctgac

SEQ ID NO: 294 - DNA, 31 bp, Artificial Sequence
  Description of Artificial Sequence: Synthetic probe
cagtcctctcatctgttgtcgatccgatgta

SEQ ID NO: 295 - DNA, 198 bp, Rinderpest virus
tgcatcttatgtgactttggttcagccaattatggttggttttttgtaccatcgaactgtcagttggatgacatagatagagagacgtcagcactcagggtcccctacatcggatcgacaacagatgagaggactgatatgaagctcgcatttgttaagtcacccagtcgaaccctgcggtcagctgtgcggatagcc

SEQ ID NO: 296 - DNA, 22 bp, Artificial Sequence
  Description of Artificial Sequence: Synthetic primer
aactcctgacctcattccttgc

SEQ ID NO: 297 - DNA, 23 bp, Artificial Sequence
  Description of Artificial Sequence: Synthetic primer
ggctctataatcccactatgcca

SEQ ID NO: 298 - DNA, 31 bp, Artificial Sequence
  Description of Artificial Sequence: Synthetic probe
tggctcagtgcattcacaaagaccttgaata

SEQ ID NO: 299 - DNA, 115 bp, Rinderpest virus
aactcctgacctcattccttgcaaggatgagtaagagcgtattcaaggtctttgtgaatgcactgagccaccccaagatttacaggaagttctggcatagtgggattatagagcc

SEQ ID NO: 300 - DNA, 20 bp, Artificial Sequence
  Description of Artificial Sequence: Synthetic probe
caaagtgggagacgtcgttg

SEQ ID NO: 301 - DNA, 20 bp, Artificial Sequence
  Description of Artificial Sequence: Synthetic probe
caaagtgggagacgtcgttg

SEQ ID NO: 302 - DNA, 20 bp, Artificial Sequence
  Description of Artificial Sequence: Synthetic probe
caaagtgggagacgtcgttg

SEQ ID NO: 303 - DNA, 27 bp, Artificial Sequence
  Description of Artificial Sequence: Synthetic primer
gacatcaaggctcaaactaattttacc

SEQ ID NO: 304 - DNA, 22 bp, Artificial Sequence
  Description of Artificial Sequence: Synthetic primer
caaaggctgccaacataaaatg

SEQ ID NO: 305 - DNA, 21 bp, Artificial Sequence
  Description of Artificial Sequence: Synthetic probe
caagcgtaaatgcagcgtcca

SEQ ID NO: 306 - DNA, 60 bp, Artificial Sequence
  Description of Artificial Sequence: Synthetic probe
gcaacaagatgtgtttaagccccaaccacctctacagaatgtctaccaacttgttcagga

SEQ ID NO: 307 - DNA, 60 bp, Artificial Sequence
  Description of Artificial Sequence: Synthetic probe
acttgcttcacactggaatcggtaccgccttgcgaccaagcgaagtgtgtatggtggacg

SEQ ID NO: 308 - DNA, 57 bp, Artificial Sequence
  Description of Artificial Sequence: Synthetic probe
ggcgacgcggaaaagaaccctctggagacgagtgccgctagcgctgtcggtttcaga

SEQ ID NO: 309 - DNA, 60 bp, Artificial Sequence
  Description of Artificial Sequence: Synthetic probe
ggtggcgatggtaccggagctctgttccatcagcaagagagagttgtaccagcttacgct

SEQ ID NO: 310 - DNA, 60 bp, Artificial Sequence
  Description of Artificial Sequence: Synthetic probe
tacggcaaatgccccattgagcatctacgagccaatcaaaggtgtcgacgggctcgatgc

SEQ ID NO: 311 - DNA, 53 bp, Artificial Sequence
  Description of Artificial Sequence: Synthetic probe
catcccgcccatggcttcactcgaggataaaggcaagcctttcaacagcaaag

SEQ ID NO: 312 - DNA, 60 bp, Artificial Sequence
  Description of Artificial Sequence: Synthetic probe
aaacaacttcacggcgcggtgatatggcggctcttgcaacaaaggtcagtgggcagctgc

SEQ ID NO: 313 - DNA, 60 bp, Artificial Sequence
  Description of Artificial Sequence: Synthetic probe
tacttctcagacctggaggttgcgcttgtacacacaggcccagcaacctgggtgcccaac

SEQ ID NO: 314 - DNA, 60 bp, Artificial Sequence
  Description of Artificial Sequence: Synthetic probe
ctaccacaaccggcgagtcagcggacccagtaacaaccacggttgagaactacggaggag

SEQ ID NO: 315 - DNA, 60 bp, Artificial Sequence
  Description of Artificial Sequence: Synthetic probe
tgggtgtgcatctaccagatcacccatggcaaagctgaaggtgacgcactggtcgtttct

SEQ ID NO: 316 - DNA, 60 bp, Artificial Sequence
  Description of Artificial Sequence: Synthetic probe
cggcagtcttatggattcgtacgcctacatgagaaatgggtgggacatagaggtgactgc

SEQ ID NO: 317 - DNA, 60 bp, Artificial Sequence
  Description of Artificial Sequence: Synthetic probe
gcctttcccggcgttaacgggatgcaatcacatgacaaaccttcactcggaagtaaaacg

SEQ ID NO: 318 - DNA, 60 bp, Artificial Sequence
  Description of Artificial Sequence: Synthetic probe
acagactaaggtgatggagccgcttcgtgcgagccagtcgcctggtgtgcttcggctgtc

SEQ ID NO: 319 - DNA, 54 bp, Artificial Sequence
  Description of Artificial Sequence: Synthetic probe
cgtcgcgacccacactgacgtttgggcgcgcgcgtgaaccgatggacttttgtt

SEQ ID NO: 320 - DNA, 60 bp, Artificial Sequence
  Description of Artificial Sequence: Synthetic probe
ggtgaacgccgtgtgcggtgacgcataatccctcagatgtcacagttgaagacgctgagg

SEQ ID NO: 321 - DNA, 60 bp, Artificial Sequence
  Description of Artificial Sequence: Synthetic probe
ggcaaacatagtgattatgatccacgagacccgcaagagacagcagatggtggatgatgc

SEQ ID NO: 322 - DNA, 60 bp, Artificial Sequence
  Description of Artificial Sequence: Synthetic probe
tgaccgctgttgggaaccaattcaacggcggttgtcttctcgtcgcacttgtgccagagc

SEQ ID NO: 323 - DNA, 60 bp, Artificial Sequence
  Description of Artificial Sequence: Synthetic probe
tgtacggcagtctcatgggctcgtacgcctacatgagggacggctgggacattgaggtga

SEQ ID NO: 324 - DNA, 60 bp, Artificial Sequence
  Description of Artificial Sequence: Synthetic probe
cgcctgacccgtcagacgtgttggtgttggtcccgtacgatcaagaaccactcaacggag

SEQ ID NO: 325 - DNA, 60 bp, Artificial Sequence
  Description of Artificial Sequence: Synthetic probe
gggtggaacgcgatcgatgatgaagacttttacccctggacgcctgacccgtcagacgtg

SEQ ID NO: 326 - DNA, 60 bp, Artificial Sequence
  Description of Artificial Sequence: Synthetic probe
tttcctgaagggacaagagcacgctgtgtttgcttgcgccacctccaacgggtggaacgc

SEQ ID NO: 327 - DNA, 60 bp, Artificial Sequence
  Description of Artificial Sequence: Synthetic probe
gaaactccgcctggtctttccaggtctacaggggtgacactttgtactgtgcttgacacc

SEQ ID NO: 328 - DNA, 60 bp, Artificial Sequence
  Description of Artificial Sequence: Synthetic probe
ccgtcgttcccgacgttaaagggatgcaaccacaagcttgagaccgtcttgcccgacgtt

SEQ ID NO: 329 - DNA, 52 bp, Artificial Sequence
  Description of Artificial Sequence: Synthetic probe
gcgagttggtcgtttggtgtgccttggctgtcacccggcgcccgcctttcat

SEQ ID NO: 330 - DNA, 60 bp, Artificial Sequence
  Description of Artificial Sequence: Synthetic probe
gtcttgaactcacggagggtgggccacccgctctcgtcatctggaacatcaagcacttgc

SEQ ID NO: 331 - DNA, 60 bp, Artificial Sequence
  Description of Artificial Sequence: Synthetic probe
gagaacctcactcttgaggcgatcaaacaattggaagaggttactggtcttgaactcacg

SEQ ID NO: 332 - DNA, 60 bp, Artificial Sequence
  Description of Artificial Sequence: Synthetic probe
cagtaccgactgctttatcgctttgttgtacgccattagagagatcaaagcacgacttct

SEQ ID NO: 333 - DNA, 60 bp, Artificial Sequence
  Description of Artificial Sequence: Synthetic probe
catgaccgactgctttatcgctttgttgtacgccatcagggagatcaaagcacgacttct

SEQ ID NO: 334 - DNA, 60 bp, Artificial Sequence
  Description of Artificial Sequence: Synthetic probe
ggtgaccggaggccggcacctttcccttttataaccactgaatacatgaatacaactgac

SEQ ID NO: 335 - DNA, 58 bp, Artificial Sequence
  Description of Artificial Sequence: Synthetic probe
agtttcggagctccgactctattggctgggctggtcaaggtcgcctcgagtttcttcc

SEQ ID NO: 336 - DNA, 57 bp, Artificial Sequence
  Description of Artificial Sequence: Synthetic probe
gcctactacaaagcaccgcttactcgactggccctcccctacacggccccacaccgc

SEQ ID NO: 337 - DNA, 60 bp, Artificial Sequence
  Description of Artificial Sequence: Synthetic probe
ccccagacctctgttggctcttgacaccactcaagaccgccgtaaacaggagatcattgc

SEQ ID NO: 338 - DNA, 60 bp, Artificial Sequence
  Description of Artificial Sequence: Synthetic probe
cacgccgccaaactactactaccggcgagtcggcggacccggtaaccaccacggttgaga

SEQ ID NO: 339 - DNA, 60 bp, Artificial Sequence
  Description of Artificial Sequence: Synthetic probe
gtgggacactggtcttaactccaatttcacctttccatacccttacctctctgctgctga

SEQ ID NO: 340 - DNA, 60 bp, Artificial Sequence
  Description of Artificial Sequence: Synthetic probe
gccggcctggcgcagtactacacacaatacagtggtaccatgaatattcacttcatgttc

SEQ ID NO: 341 - DNA, 60 bp, Artificial Sequence
  Description of Artificial Sequence: Synthetic probe
gcagtctcatggactcgtacgccaacatgaggaacggctgggacatagaggtgaccgctg

SEQ ID NO: 342 - DNA, 58 bp, Artificial Sequence
  Description of Artificial Sequence: Synthetic probe
cgttcttgccaaggacggtgctgaaacattcattgtgggcacgcactccgcaggtggc

SEQ ID NO: 343 - DNA, 60 bp, Artificial Sequence
  Description of Artificial Sequence: Synthetic probe
gaaacaacttcacggcgcggtgacatggcaaccctcgcacagaggctgagtgggcaactg

SEQ ID NO: 344 - DNA, 60 bp, Artificial Sequence
  Description of Artificial Sequence: Synthetic probe
tgggtgcccaatggctcacccaaaaccgctctcgacaaccagaccaacccaactgcctac

SEQ ID NO: 345 - DNA, 60 bp, Artificial Sequence
  Description of Artificial Sequence: Synthetic probe
gttcaccttttccataccctacctctccgctgctgactatgcatacaccgcttctgacac

SEQ ID NO: 346 - DNA, 60 bp, Artificial Sequence
  Description of Artificial Sequence: Synthetic probe
aaagcccggtacatggtagcctacatccctcctggcatgacaccgcccacggaccctgag

SEQ ID NO: 347 - DNA, 60 bp, Artificial Sequence
  Description of Artificial Sequence: Synthetic probe
tggctctgaacagattaaggtttacatgaacgcggcaccaacctacgtgcacgtggcagg

SEQ ID NO: 348 - DNA, 60 bp, Artificial Sequence
  Description of Artificial Sequence: Synthetic probe
ggtgactgctgttggaaatcagttcaacggcggctgtctccttgttgcacttgtaccaga

SEQ ID NO: 349 - DNA, 60 bp, Artificial Sequence
  Description of Artificial Sequence: Synthetic probe
tcacctccaacgggtggtacgcgatcgacgatgaggacttctacccttggacaccggatc

SEQ ID NO: 350 - DNA, 60 bp, Artificial Sequence
  Description of Artificial Sequence: Synthetic probe
cgcacgaaacgcgccgtcgcttgaggacgccttgtacaaacacgatctaagcaggtctcc

SEQ ID NO: 351 - DNA, 60 bp, Artificial Sequence
  Description of Artificial Sequence: Synthetic probe
tgcttcacggtttctacgcgtagcagactacggtgatggggccgcttcgtgcgggttgat

SEQ ID NO: 352 - DNA, 60 bp, Artificial Sequence
  Description of Artificial Sequence: Synthetic probe
gctgcgctacgggagtgttcgggacggcttatctcgtgcctcgtcatcttttcgcagaga

SEQ ID NO: 353 - DNA, 60 bp, Artificial Sequence
  Description of Artificial Sequence: Synthetic probe
cgacagcatcaaggaagagcttaaaccgcttctggagcaaaccagcttcgcgaaacgtgc

SEQ ID NO: 354 - DNA, 60 bp, Artificial Sequence
  Description of Artificial Sequence: Synthetic probe
ctcaagaacggcaacgtccacattgctaacctgtgtaaagtcaacgcaccagcacccagc

SEQ ID NO: 355 - DNA, 60 bp, Artificial Sequence
  Description of Artificial Sequence: Synthetic probe
gtccaaccctgggcccttcttcttcgccgatgtcagggagaacttcacaaaactggtgga

SEQ ID NO: 356 - DNA, 60 bp, Artificial Sequence
  Description of Artificial Sequence: Synthetic probe
gacaccacccgctttgcgctgccctacactgcaccacacagatgcttggcaacatcctac

SEQ ID NO: 357 - DNA, 60 bp, Artificial Sequence
  Description of Artificial Sequence: Synthetic probe
ttcaccgtgccgtacgtgtcgaccgctgatttcgcgtacacctactctgacgagcccgaa

SEQ ID NO: 358 - DNA, 60 bp, Artificial Sequence
  Description of Artificial Sequence: Synthetic probe
gctacggcggtttccaaaacacagaccccaaaacttcggaccccgtgtacgggcacgtgt

SEQ ID NO: 359 - DNA, 60 bp, Artificial Sequence
  Description of Artificial Sequence: Synthetic probe
gctgcccacagaccacaaaggcatctacggccaactcgttgactctcactcttacatccg

SEQ ID NO: 360 - DNA, 60 bp, Artificial Sequence
  Description of Artificial Sequence: Synthetic probe
gtcgatgagccgctctttgagtctgagtacctctccccggagaacaagacattggacatg

SEQ ID NO: 361 - DNA, 60 bp, Artificial Sequence
  Description of Artificial Sequence: Synthetic probe
tcgtcatcaccgcgcctccattaggctggtcgtcgtacctcctctaggctgacaactgtc

SEQ ID NO: 362 - DNA, 60 bp, Artificial Sequence
  Description of Artificial Sequence: Synthetic probe
cgcgccgataagactcgcattgtcgacgtcttgcctgttgaacatattctttacaccagg

SEQ ID NO: 363 - DNA, 60 bp, Artificial Sequence
  Description of Artificial Sequence: Synthetic probe
ttgtcagacgccgctctcatagtgctgcaccgtgggaaccgcatgcgggacatcacgaaa

SEQ ID NO: 364 - DNA, 60 bp, Artificial Sequence
  Description of Artificial Sequence: Synthetic probe
tttcagggagaggaccctcccggagagggaacaaccgcaatctgaaggaccctacgccgg

SEQ ID NO: 365 - DNA, 59 bp, Artificial Sequence
  Description of Artificial Sequence: Synthetic probe
atctttaagcaaatctcaattccttcccgaaagtctgtgctttactttctcattgagaa

SEQ ID NO: 366 - DNA, 55 bp, Artificial Sequence
  Description of Artificial Sequence: Synthetic probe
caacggaagctgcaggtacaacaacagtaacgtgagcaacgtgcgtggtgatctc

SEQ ID NO: 367 - DNA, 57 bp, Artificial Sequence
  Description of Artificial Sequence: Synthetic probe
ccccatcaacgtccacgttgcgggtgagttcccttccaaggaggggattttccctgt

SEQ ID NO: 368 - DNA, 59 bp, Artificial Sequence
  Description of Artificial Sequence: Synthetic probe
cccctgacggtcaacaatgaaggtgccccacaaatcaaggtatatgccaacatcgcccc

SEQ ID NO: 369 - DNA, 60 bp, Artificial Sequence
  Description of Artificial Sequence: Synthetic probe
aagagagagctgtaccagcccacgctcttccctcaccagttcatcaacccacggacgaac

SEQ ID NO: 370 - DNA, 60 bp, Artificial Sequence
  Description of Artificial Sequence: Synthetic probe
gagaaccttactcttgaggctattaggcagttggaggaggtaactggtcttgagctgcac

SEQ ID NO: 371 - DNA, 56 bp, Artificial Sequence
  Description of Artificial Sequence: Synthetic probe
tggtgcacgcactcagagagattaagacactgtttctttcacggacacaaggaaaa

SEQ ID NO: 372 - DNA, 60 bp, Artificial Sequence
  Description of Artificial Sequence: Synthetic probe
gtgtgtttaaccctgaattcgggcctgctgccttgtccaacagggacccgcgcctgaatg

SEQ ID NO: 373 - DNA, 60 bp, Artificial Sequence
  Description of Artificial Sequence: Synthetic probe
ccggtttgtgaaggtccctgtgtcggacagacaacaacacacactggacgtgatgcaggt

SEQ ID NO: 374 - DNA, 60 bp, Artificial Sequence
  Description of Artificial Sequence: Synthetic probe
ggccgctgactacgcgtacaccgcgtccaacgaggctgaaacaacatgtgtacagggatg

SEQ ID NO: 375 - DNA, 60 bp, Artificial Sequence
  Description of Artificial Sequence: Synthetic probe
tacgggtatgcaacagctgaggacagctcgtcagggcctaacacgtctggccttgagacg

SEQ ID NO: 376 - DNA, 60 bp, Artificial Sequence
  Description of Artificial Sequence: Synthetic probe
ctcaacggagaatggaagactaaggttcagcagaagcttaagggagccgggcaatccagc

SEQ ID NO: 377 - DNA, 60 bp, Artificial Sequence
  Description of Artificial Sequence: Synthetic probe
ccgtcgttcccgacgtaaaagggatgtaaccacaagcttagcaccgtctctcccgacgtt

SEQ ID NO: 378 - DNA, 54 bp, Artificial Sequence
  Description of Artificial Sequence: Synthetic probe
gcgttgcactccacacttacgttgtgcgcgcgcgggacccgatggactatcgtt

SEQ ID NO: 379 - DNA, 59 bp, Artificial Sequence
  Description of Artificial Sequence: Synthetic probe
acggaccgcaaactggttcggcggtcggttgcaaccctgatattgattggcaacgattt

SEQ ID NO: 380 - DNA, 60 bp, Artificial Sequence
  Description of Artificial Sequence: Synthetic probe
caggctgaggggccttatgccgggccgctagagagacaacaaccactgaaactgaaagaa

SEQ ID NO: 381 - DNA, 60 bp, Artificial Sequence
  Description of Artificial Sequence: Synthetic probe
ccgacggtttcactttgacatcgatgtgagtgctagggacgggtacaaagttaacaacag

SEQ ID NO: 382 - DNA, 60 bp, Artificial Sequence
  Description of Artificial Sequence: Synthetic probe
tccatgacggatcttgtgccgcgtattctcgagtgccagcgcaacctgaacgacccgtca

SEQ ID NO: 383 - DNA, 60 bp, Artificial Sequence
  Description of Artificial Sequence: Synthetic probe
acaacccagtcgtcttctcacacggaggcactactcgcttcgcgctcccttacaccgcac

SEQ ID NO: 384 - DNA, 60 bp, Artificial Sequence
  Description of Artificial Sequence: Synthetic probe
acacaccctctccccagcacaccggagatggcgtcacactgctaccatgctgagtgggat

SEQ ID NO: 385 - DNA, 60 bp, Artificial Sequence
  Description of Artificial Sequence: Synthetic probe
cccgagctctgcaaattggacaccagggagaagtaccaactcactcttttcccgcaccag

SEQ ID NO: 386 - DNA, 60 bp, Artificial Sequence
  Description of Artificial Sequence: Synthetic probe
cgggtatgccctgatcgacaagtttctccccggtccaaacaccaacgggctggagacaag

SEQ ID NO: 387 - DNA, 60 bp, Artificial Sequence
  Description of Artificial Sequence: Synthetic probe
ccgaaatctttcacaggttcagacacacgttcaaaacaggcagagagatggaattcacac

SEQ ID NO: 388 - DNA, 60 bp, Artificial Sequence
  Description of Artificial Sequence: Synthetic probe
ccacacgatttgccgtcttttccgacgttaaaggaatgaaaccgcatgatttcgccttct

SEQ ID NO: 389 - DNA, 60 bp, Artificial Sequence
  Description of Artificial Sequence: Synthetic probe
gtggccatctgctgcgccaccggagtgtttggcactgcctacctagttcctcgtcatctt

SEQ ID NO: 390 - DNA, 60 bp, Artificial Sequence
  Description of Artificial Sequence: Synthetic probe
gcggcaccatcaacctgcatttcatgttcacagggcccactgacgccaaagcgcgttaca

SEQ ID NO: 391 - DNA, 60 bp, Artificial Sequence
  Description of Artificial Sequence: Synthetic probe
agacgccgctctcatggtgcttcaccgtgggaatcgcatgcgggacatcacgaagcactt

SEQ ID NO: 392 - DNA, 60 bp, Artificial Sequence
  Description of Artificial Sequence: Synthetic probe
ggcacggtcgggcccgaagtcgaggatgccttgaagctcatggagaaaagagagtacaag

SEQ ID NO: 393 - DNA, 60 bp, Artificial Sequence
  Description of Artificial Sequence: Synthetic probe
acttgcttcacaccggaatcggtaccgcctcgcgaccaagcgaagtgtgtatggtggacg

SEQ ID NO: 394 - DNA, 60 bp, Artificial Sequence
  Description of Artificial Sequence: Synthetic probe
aggcacttgcttcacaccggaatcggtaccgcctcgcgcccaagcgaagtgtgtatggtc

SEQ ID NO: 395 - DNA, 51 bp, Artificial Sequence
  Description of Artificial Sequence: Synthetic probe
cagagacagcgactgtttctggggcgcgcgacgccgctggagtgaaaaggc

SEQ ID NO: 396 - DNA, 60 bp, Artificial Sequence
  Description of Artificial Sequence: Synthetic probe
aaggtcatcattgcaaccaccaatctgtactcgggtttcaccccaaggactatggtgtgc

SEQ ID NO: 397 - DNA, 58 bp, Artificial Sequence
  Description of Artificial Sequence: Synthetic probe
accagcgggcgataggcacaaacaaccgctcattgcgccagcgaaacagctgctgaac

SEQ ID NO: 398 - DNA, 60 bp, Artificial Sequence
  Description of Artificial Sequence: Synthetic probe
ctggacgttatgcaggtacacaaggacagtattgtgggtgcactcctacgcgcagccaca

SEQ ID NO: 399 - DNA, 60 bp, Artificial Sequence
  Description of Artificial Sequence: Synthetic probe
cacagtacgctgggacaatcaacctgcacttcatgttcactgggccaaccgacgcgaaag

SEQ ID NO: 400 - DNA, 60 bp, Artificial Sequence
  Description of Artificial Sequence: Synthetic probe
acacatcaggtgcccagcagatcaaggtgtatgccaacatagccccaaccaacgttcacg

SEQ ID NO: 401 - DNA, 60 bp, Artificial Sequence
  Description of Artificial Sequence: Synthetic probe
ccctcccagagttttggacacatgcacaaggtcgttctgccctcagaaccgaaaggtgtc

SEQ ID NO: 402 - DNA, 60 bp, Artificial Sequence
  Description of Artificial Sequence: Synthetic probe
agtggtggctccaacgagggctccacagatacaacttccacccacacaaccaacactcaa

SEQ ID NO: 403 - DNA, 60 bp, Artificial Sequence
  Description of Artificial Sequence: Synthetic probe
ccttcttcgactgggtctacaactcgcccgagaacctcacgctgtcggccattgaacaac

SEQ ID NO: 404 - DNA, 60 bp, Artificial Sequence
  Description of Artificial Sequence: Synthetic probe
tgacgactacggtgatggggccgtagcgcgcgggctgatcgcctggtgtgctttggctgt

SEQ ID NO: 405 - DNA, 60 bp, Artificial Sequence
  Description of Artificial Sequence: Synthetic probe
aagcgccgtggtgccctgatcgacttcgagagcggcacggttggacccgaaattgaggct

SEQ ID NO: 406 - DNA, 60 bp, Artificial Sequence
  Description of Artificial Sequence: Synthetic probe
gtgctgctgactacgcgtcacgcctacactccgtgctgggtacggcaaatgccccactga

SEQ ID NO: 407 - DNA, 60 bp, Artificial Sequence
  Description of Artificial Sequence: Synthetic probe
accgtcgcacacggtgtgttcaaccctgcgtttggccccgctgccttgtctaacagggac

SEQ ID NO: 408 - DNA, 60 bp, Artificial Sequence
  Description of Artificial Sequence: Synthetic probe
gtcgcctcgagtttcttccggtccacacctgaagaccttgagagagcagagaaacagctc

SEQ ID NO: 409 - DNA, 60 bp, Artificial Sequence
  Description of Artificial Sequence: Synthetic probe
gcggtgacatggcagcccttacacagagactaagcgagcggctgcccacctccttcaact

SEQ ID NO: 410 - DNA, 60 bp, Artificial Sequence
  Description of Artificial Sequence: Synthetic probe
gtgacggactacggtgatggagccgcctcgtgcgagttggtcgtctggtgtgctttggct

SEQ ID NO: 411 - DNA, 60 bp, Artificial Sequence
  Description of Artificial Sequence: Synthetic probe
ttgaaaaggggcgctagggtctcacccctagtataccaccggcagctcctgcgttgcact

SEQ ID NO: 412 - DNA, 60 bp, Artificial Sequence
  Description of Artificial Sequence: Synthetic probe
ctacactggcagaattgattcagtttggtactgcccgcctgaccttgaccacttcgacgg

SEQ ID NO: 413 - DNA, 60 bp, Artificial Sequence
  Description of Artificial Sequence: Synthetic probe
tggtgatctcgccgcccttgcacgcagagtgaacaaccggctgcccacttccttcaacta

SEQ ID NO: 414 - DNA, 60 bp, Artificial Sequence
  Description of Artificial Sequence: Synthetic probe
tacaacgggaagacaacgtacggagaagaatcctcgcggcgtggtgatctcgccgccctt

SEQ ID NO: 415 - DNA, 60 bp, Artificial Sequence
  Description of Artificial Sequence: Synthetic probe
cgccttgaacaaccacaccaacccgactgcttaccagaagcagcctatcacccgcttggc

SEQ ID NO: 416 - DNA, 57 bp, Artificial Sequence
  Description of Artificial Sequence: Synthetic probe
ggtggcttacatacctcctggtatgacgccgccaacggacccggagcgggctgcaca

SEQ ID NO: 417 - DNA, 60 bp, Artificial Sequence
  Description of Artificial Sequence: Synthetic probe
gcggcactatgaatatccacttcatgttcaccggacccacggatgccaaagcccgctaca

SEQ ID NO: 418 - DNA, 60 bp, Artificial Sequence
  Description of Artificial Sequence: Synthetic probe
gcgcttctcgcgtgaccggttaatactctcaccactctccgcctacttggtcgttagcgc

SEQ ID NO: 419 - DNA, 60 bp, Artificial Sequence
  Description of Artificial Sequence: Synthetic probe
gagagaatacaaatttgcttgtcagaccttcctgaaggacgagattcgcccgttggagaa

SEQ ID NO: 420 - DNA, 58 bp, Artificial Sequence
  Description of Artificial Sequence: Synthetic probe
agctgaaggaccctacaccgggccactcgagcgtcagaagcctctgaaagtgaaagcc

SEQ ID NO: 421 - DNA, 60 bp, Artificial Sequence
  Description of Artificial Sequence: Synthetic probe
aattggcacactggctctggggcgcgcgacgccgtaggagtgaaaagcccgaggggcttt

SEQ ID NO: 422 - DNA, 60 bp, Artificial Sequence
  Description of Artificial Sequence: Synthetic probe
cgcgctggcaaaactcgcattgtcgacgtcctgcctgtcgagcacattctctacaccagg

SEQ ID NO: 423 - DNA, 60 bp, Artificial Sequence
  Description of Artificial Sequence: Synthetic probe
cccgctgccttgtcaaacaaagacccgcgcctgaatgagggagttgtcctcgacgaagtc

SEQ ID NO: 424 - DNA, 60 bp, Artificial Sequence
  Description of Artificial Sequence: Synthetic probe
agcgctgttggcttcagagagaaaaccctcccaggccacgcggcacgcaatgacgtgaac

SEQ ID NO: 425 - DNA, 60 bp, Artificial Sequence
  Description of Artificial Sequence: Synthetic probe
caacggtgcccctgtctcggccttgtcgaacaccagcaaccccactgcctacaataaggc

SEQ ID NO: 426 - DNA, 60 bp, Artificial Sequence
  Description of Artificial Sequence: Synthetic probe
tcatgttcacaggctccactgactcaaaggctcggtacatggtggcctacatcccgcccg

SEQ ID NO: 427 - DNA, 60 bp, Artificial Sequence
  Description of Artificial Sequence: Synthetic probe
caacaccggtgcgcagcaaatcaaggtttacgccaacatagccccgacctacgtccacgt

SEQ ID NO: 428 - DNA, 60 bp, Artificial Sequence
  Description of Artificial Sequence: Synthetic probe
cagtggaggatccaacgaaggatccaccgacacgacttcaacacacacaaccaacaccca

SEQ ID NO: 429 - DNA, 60 bp, Artificial Sequence
  Description of Artificial Sequence: Synthetic probe
gcgcgacgcacaggaaagatggagttcactttgcacaacggcgagaagaaaactttctat

SEQ ID NO: 430 - DNA, 60 bp, Artificial Sequence
  Description of Artificial Sequence: Synthetic probe
gccgtctaccccgacgttaaagggaggtaaccacaagatttcgccgcctttcccggcgtt

SEQ ID NO: 431 - DNA, 60 bp, Artificial Sequence
  Description of Artificial Sequence: Synthetic probe
ggcgttaacgggacgtaaccacaagatttaactccacccgggagtaaaatggaacatcac

SEQ ID NO: 432 - DNA, 51 bp, Artificial Sequence
  Description of Artificial Sequence: Synthetic probe
aacgccatcaaagaggtaatagcacttttcctaccacggactgcaggaaaa

SEQ ID NO: 433 - DNA, 51 bp, Artificial Sequence
  Description of Artificial Sequence: Synthetic probe
aacgccatcaaagaggtaatagcacttttcctatcacggactgcaggaaaa

SEQ ID NO: 434 - DNA, 51 bp, Artificial Sequence
  Description of Artificial Sequence: Synthetic probe
gatccactagcgagtgttagtagcggtactgctgtctcgtagcggagcatg

SEQ ID NO: 435 - DNA, 52 bp, Artificial Sequence
  Description of Artificial Sequence: Synthetic probe
cgatccactagcgagtgttagtagcggtactgctgtctcgtagcggagcatg

SEQ ID NO: 436 - DNA, 60 bp, Artificial Sequence
  Description of Artificial Sequence: Synthetic probe
tccacgctcgatccactagcgagtgttagtagcggtactgctgtctcgtagcggagcatg

SEQ ID NO: 437 - DNA, 60 bp, Artificial Sequence
  Description of Artificial Sequence: Synthetic probe
cgttggcgtgatcaacaacgctgatgtcgggagactaattttctctggtgaggccctcac

SEQ ID NO: 438 - DNA, 60 bp, Artificial Sequence
  Description of Artificial Sequence: Synthetic probe
ccctgtgtctgaccctcttggccagtatagtggttatgatccgcgcgactcacaagagac

SEQ ID NO: 439 - DNA, 60 bp, Artificial Sequence
  Description of Artificial Sequence: Synthetic probe
ccagcaagtcgagacccgaacctgtggttgtttgcctccgtggtaaatccggccagggta

SEQ ID NO: 440 - DNA, 60 bp, Artificial Sequence
  Description of Artificial Sequence: Synthetic probe
cgaggccaaaccctggtacaaacttatcaagctcctaagccgcctgtcgtgtatggccgc

SEQ ID NO: 441 - DNA, 60 bp, Artificial Sequence
  Description of Artificial Sequence: Synthetic probe
ttgggtgcccaacggtgctcctgaatcggccctgcagaacaccagcaaccccactgccta

SEQ ID NO: 442 - DNA, 60 bp, Artificial Sequence
  Description of Artificial Sequence: Synthetic probe
cccttgccgcaaagcacatgtctaacacgtacctgtcaggaattgcccagtactacgcac

SEQ ID NO: 443 - DNA, 60 bp, Artificial Sequence
  Description of Artificial Sequence: Synthetic probe
cagcttacccttttcccacaccagtttatcagtcctagaaccaacatgactgcccacatc

SEQ ID NO: 444 - DNA, 60 bp, Artificial Sequence
  Description of Artificial Sequence: Synthetic probe
caccacctcgacaacacagtccagcgtgggcgttacatacgggtattccactgcggagga

SEQ ID NO: 445 - DNA, 60 bp, Artificial Sequence
  Description of Artificial Sequence: Synthetic probe
gtgaccggaggccggcacctttccttttacaaccactgatcatatgaacacaactgactg

SEQ ID NO: 446 - DNA, 59 bp, Artificial Sequence
  Description of Artificial Sequence: Synthetic probe
ggggcgctagggtttcacccctagcataccaacgacagctcctgcgttgcactccacac

SEQ ID NO: 447 - DNA, 60 bp, Artificial Sequence
  Description of Artificial Sequence: Synthetic probe
caaaccataactccagctgacaaaagcggcaaaggttttgttcttggtcactccatcacc

SEQ ID NO: 448 - DNA, 60 bp, Artificial Sequence
  Description of Artificial Sequence: Synthetic probe
cgcaaattggctcggcggtcggttgtaaccctgatgttgactggcagagatttggcacag

SEQ ID NO: 449 - DNA, 60 bp, Artificial Sequence
  Description of Artificial Sequence: Synthetic probe
gctgcgctaccggagtgtttggtactgcctaccttgtgcctcgtcatcttttcgcagaga

SEQ ID NO: 450 - DNA, 60 bp, Artificial Sequence
  Description of Artificial Sequence: Synthetic probe
cgcttttaagcgcctgaaggacaactttgagatcgttgccctgtgcttgactcttttggc

SEQ ID NO: 451 - DNA, 60 bp, Artificial Sequence
  Description of Artificial Sequence: Synthetic probe
attgctaacctctgcaaagtggtcgcccggcaccccagcaagtcgagacctgaacctgtg

SEQ ID NO: 452 - DNA, 60 bp, Artificial Sequence
  Description of Artificial Sequence: Synthetic probe
gcgggcagctacccacttctttcaactacggcgctgtaaaggctgataccatcactgagc

SEQ ID NO: 453 - DNA, 60 bp, Artificial Sequence
  Description of Artificial Sequence: Synthetic probe
gtgggtgttaacaggtatgaccagtacgtgctccacaaaccatggacgctcgttgtgatg

SEQ ID NO: 454 - DNA, 60 bp, Artificial Sequence
  Description of Artificial Sequence: Synthetic probe
ccgctcaacggagaatggaaggccaaggttcagaaacgactcaaaggcgccgggcaatcc

SEQ ID NO: 455 - DNA, 60 bp, Artificial Sequence
  Description of Artificial Sequence: Synthetic probe
cgttacacggatgcaaggaaagatggaatttacactctacaacggcgagaagaagacttt

SEQ ID NO: 456 - DNA, 60 bp, Artificial Sequence
  Description of Artificial Sequence: Synthetic probe
ccgacgttaaagggatgcaaccacaagcttggaaccgtcttgtccgacgttaacgggctg

SEQ ID NO: 457 - DNA, 60 bp, Artificial Sequence
  Description of Artificial Sequence: Synthetic probe
ccatgctactcaagatgaaggcacacatcgaccctgagccacaccacgaggggctgatcg

SEQ ID NO: 458 - DNA, 60 bp, Artificial Sequence
  Description of Artificial Sequence: Synthetic probe
aaggaccctacgccgggccacttgagcgccagaaacctctgaaagtgagaaccaagctcc

SEQ ID NO: 459 - DNA, 60 bp, Artificial Sequence
  Description of Artificial Sequence: Synthetic probe
agggtcattatcgcgaccaccaacttgtactcaggcttcaccccgaggaccatggtctgc

SEQ ID NO: 460 - DNA, 60 bp, Artificial Sequence
  Description of Artificial Sequence: Synthetic probe
actgtctacaggaaagaaccacttacgagactcgcactcccctacaccgcgccgcaccgc

SEQ ID NO: 461 - DNA, 60 bp, Artificial Sequence
  Description of Artificial Sequence: Synthetic probe
cggcggtgagacacaagtccagaaacgtcaccacacagacatcggctttatcatggacag

SEQ ID NO: 462 - DNA, 60 bp, Artificial Sequence
  Description of Artificial Sequence: Synthetic probe
gacacacctgagagagctgcccactgcattcacgccgaatgggacactggactgaactcc

SEQ ID NO: 463 - DNA, 60 bp, Artificial Sequence
  Description of Artificial Sequence: Synthetic probe
accgtatgtcaccacgcggacggacgacactcgacttctggccaagtttgacctctccct

SEQ ID NO: 464 - DNA, 60 bp, Artificial Sequence
  Description of Artificial Sequence: Synthetic probe
agttcaacggtgggtgcctcttggtggccatggtacctgagtggaaagaactcgacgcgc

SEQ ID NO: 465 - DNA, 60 bp, Artificial Sequence
  Description of Artificial Sequence: Synthetic probe
ggttgacggtacggacatgtgcctggctgacttccacgcaggcatcttcctaaaaggcaa

SEQ ID NO: 466 - DNA, 60 bp, Artificial Sequence
  Description of Artificial Sequence: Synthetic probe
tactcttaccactctccgcctatttggtcgttagcgctgtattgggcactcctgttgggg

SEQ ID NO: 467 - DNA, 60 bp, Artificial Sequence
  Description of Artificial Sequence: Synthetic probe
gccccattgagcatctacgaggcaatcaaagttgttgacggactcgacgccatggaacca

SEQ ID NO: 468 - DNA, 60 bp, Artificial Sequence
  Description of Artificial Sequence: Synthetic probe
ccgctgccttgtctaacaaggacccgcggcttaacgagggcgttgtcctcgatgaagtca

SEQ ID NO: 469 - DNA, 51 bp, Artificial Sequence
  Description of Artificial Sequence: Synthetic probe
tgccacagcaggagggaccctacgctggccccatggagagacagaaaccac

SEQ ID NO: 470 - DNA, 60 bp, Artificial Sequence
  Description of Artificial Sequence: Synthetic probe
ggtcgtttgcctccgtggtaagtctggccaagggaagagtttccttgcgaacgtgctcgc

SEQ ID NO: 471 - DNA, 55 bp, Artificial Sequence
  Description of Artificial Sequence: Synthetic probe
gcgttgcactccacacttacgcccgtacactcgcgggaaccgatggactgtcgtt

SEQ ID NO: 472 - DNA, 60 bp, Artificial Sequence
  Description of Artificial Sequence: Synthetic probe
tttcatcgtcggcactcactccgcaggcggcaacggagttggatactgctcgtgcgtttc

SEQ ID NO: 473 - DNA, 60 bp, Artificial Sequence
  Description of Artificial Sequence: Synthetic probe
caaaccttcctgaaggacgagattcgccctctggagaaagtcaaggccggcaagactcgc

SEQ ID NO: 474 - DNA, 60 bp, Artificial Sequence
  Description of Artificial Sequence: Synthetic probe
caggagacgcactaacctacaaagacctagtcgtttgtatggacggtgacaccatgcctg

SEQ ID NO: 475 - DNA, 60 bp, Artificial Sequence
  Description of Artificial Sequence: Synthetic probe
cccctcgagcgacagcagccgctaaagctcaaggccaagctccctcaggcagaggggcct

SEQ ID NO: 476 - DNA, 60 bp, Artificial Sequence
  Description of Artificial Sequence: Synthetic probe
ccccgggcccttcttcttctccgacgtcagggagaacttcacaaagctggtggaaagcat

SEQ ID NO: 477 - DNA, 60 bp, Artificial Sequence
  Description of Artificial Sequence: Synthetic probe
tgtggttgtgtcggtgagcgctggacccgacctggagttcaggttcccggttgacccagt

SEQ ID NO: 478 - DNA, 60 bp, Artificial Sequence
  Description of Artificial Sequence: Synthetic probe
aacggttgggacgtccaggtttccgccaccagcacgcagttcaacggcgggtcactcctt

SEQ ID NO: 479 - DNA, 60 bp, Artificial Sequence
  Description of Artificial Sequence: Synthetic probe
ccactctgctcgaggaccgaatattgacaacacgacacggtacaaccacctccaccacac

SEQ ID NO: 480 - DNA, 60 bp, Artificial Sequence
  Description of Artificial Sequence: Synthetic probe
cgttcttcggctgatcaaagattgtcttcagactggcgttggcaccagcactcgccccag

SEQ ID NO: 481 - DNA, 60 bp, Artificial Sequence
  Description of Artificial Sequence: Synthetic probe
tagggtctagccccagcgtcgcgtaacgaccgtccccggttgaaacgccactactcagac

SEQ ID NO: 482 - DNA, 60 bp, Artificial Sequence
  Description of Artificial Sequence: Synthetic probe
gctcagcggtcggatgcaaccctgatgttgattggcaaagatttggtacacacttcgccc

SEQ ID NO: 483 - DNA, 60 bp, Artificial Sequence
  Description of Artificial Sequence: Synthetic probe
agaaatggttgggatatcgaggtgtctgccgttggcaaccagttcaacggcgggtgtctc

SEQ ID NO: 484 - DNA, 60 bp, Artificial Sequence
  Description of Artificial Sequence: Synthetic probe
caacggacaaggcttttggacacctggagaagctcggacttccaaccgaccaccacggtg

SEQ ID NO: 485 - DNA, 60 bp, Artificial Sequence
  Description of Artificial Sequence: Synthetic probe
aaacaacgcttcttgaggaccggatcctgaccacccgcaatgggcacaccacctcgacga

SEQ ID NO: 486 - DNA, 60 bp, Artificial Sequence
  Description of Artificial Sequence: Synthetic probe
cccgacgtaaaatggaagtaaccacaagcttgacaccgtctttccgacgttaaagggaag

SEQ ID NO: 487 - DNA, 60 bp, Artificial Sequence
  Description of Artificial Sequence: Synthetic probe
tggccaacatcgtgatcatgatccgcgagacccgtaagagacagaagatggtggacgatg

SEQ ID NO: 488 - DNA, 60 bp, Artificial Sequence
  Description of Artificial Sequence: Synthetic probe
aatctctacccacttcaccgggcggactgactcagtctggtactgcccacctgaccctga

SEQ ID NO: 489 - DNA, 51 bp, Artificial Sequence
  Description of Artificial Sequence: Synthetic probe
gtcggggagtccgcagaccctgtcaccaccgccgtggagaactacggcggt

SEQ ID NO: 490 - DNA, 60 bp, Artificial Sequence
  Description of Artificial Sequence: Synthetic probe
agaaacacaaaccttggacactggttgtcatggtagtgtcgcccctcacggttagcgaca

SEQ ID NO: 491 - DNA, 60 bp, Artificial Sequence
  Description of Artificial Sequence: Synthetic probe
gggcgctagggtttcacccctagcaggccaacgacagttcctgcgttgtactccacactt

SEQ ID NO: 492 - DNA, 60 bp, Artificial Sequence
  Description of Artificial Sequence: Synthetic probe
gatgtcaactggcagaaggactctggggcgagcgacgccgtaggagtgaacagctcgaaa

SEQ ID NO: 493 - DNA, 60 bp, Artificial Sequence
  Description of Artificial Sequence: Synthetic probe
cagtgacgcgatgaacatcatgtttgaggaggtattccgcacggacttcggtttccaccc

SEQ ID NO: 494 - DNA, 60 bp, Artificial Sequence
  Description of Artificial Sequence: Synthetic probe
gctcatggagaaaagggaatacaagtttgcatgtcagaccttcctgaaggacgagattcg

SEQ ID NO: 495 - DNA, 55 bp, Artificial Sequence
  Description of Artificial Sequence: Synthetic probe
gagccgttcttgctaaggacggcgccgacacattcatcgtcggcactcactccgc

SEQ ID NO: 496 - DNA, 56 bp, Artificial Sequence
  Description of Artificial Sequence: Synthetic probe
ttgatccgcatgaaacgcgcggagacgtactgccccaggcctttactagctcttga

SEQ ID NO: 497 - DNA, 60 bp, Artificial Sequence
  Description of Artificial Sequence: Synthetic probe
gacggccagacggcttcacacggatgttgccttcggtcttgacaggtttgtgaaactcac

SEQ ID NO: 498 - DNA, 60 bp, Artificial Sequence
  Description of Artificial Sequence: Synthetic probe
ttgtgccagagctgaagaaccttgacacacggcagaaataccagctgaccctctttcccc

SEQ ID NO: 499 - DNA, 60 bp, Artificial Sequence
  Description of Artificial Sequence: Synthetic probe
cgcctgagaacctcactcttgaggcgattaggcagcttgaggaagttactggtcttgagt

SEQ ID NO: 500 - DNA, 60 bp, Artificial Sequence
  Description of Artificial Sequence: Synthetic probe
gctctgttgcacgctttcgcagagattaaaacgctgtttctctcacggacacgaggaaag

SEQ ID NO: 501 - DNA, 60 bp, Artificial Sequence
  Description of Artificial Sequence: Synthetic probe
ccgtcgttcccgacgttaaaaggatgtaaccacaagcgcaaaaccgtcttgcccgacgtt

SEQ ID NO: 502 - DNA, 60 bp, Artificial Sequence
  Description of Artificial Sequence: Synthetic probe
ttagggacggcaaacgccccattgagtgtgtatgaggccatcaaaggcgtcgacgggctc

SEQ ID NO: 503 - DNA, 60 bp, Artificial Sequence
  Description of Artificial Sequence: Synthetic probe
tgagcccgtcgtgctcggcagggagcaaccgcgagctggaggaccctacgctgggccact

SEQ ID NO: 504 - DNA, 60 bp, Artificial Sequence
  Description of Artificial Sequence: Synthetic probe
atggtgtgtcccgatgcgcttaacaggcggttccacttcgacctcgacgtgagtgccaag

SEQ ID NO: 505 - DNA, 60 bp, Artificial Sequence
  Description of Artificial Sequence: Synthetic probe
ccagtctcttccacgtgccggctcccgccctcagtttcggagccccgatcctgttggccg

SEQ ID NO: 506 - DNA, 60 bp, Artificial Sequence
  Description of Artificial Sequence: Synthetic probe
acgaacctcctcgacgtggccgaggcgtgccctacgttcctacacttcgacggcgacgtt

SEQ ID NO: 507 - DNA, 60 bp, Artificial Sequence
  Description of Artificial Sequence: Synthetic probe
gcagtggggaaccagttcaacggaggctgtttgctggtagcgatggtaccggagctctgt

SEQ ID NO: 508 - DNA, 60 bp, Artificial Sequence
  Description of Artificial Sequence: Synthetic probe
ggtatatttctaaagggacaggatcacgccgtgttcgcctgcgtcacctccgacgggtgg

SEQ ID NO: 509 - DNA, 60 bp, Artificial Sequence
  Description of Artificial Sequence: Synthetic probe
tggcgggtgttagtagcagcactgttgtttcgtagcggagcatggtggccgtgggaactc

SEQ ID NO: 510 - DNA, 60 bp, Artificial Sequence
  Description of Artificial Sequence: Synthetic probe
cgtcgcactccacacttacgtctccgcaagtgcaggaaccgatggactgtcgcttacccc

SEQ ID NO: 511 - DNA, 60 bp, Artificial Sequence
  Description of Artificial Sequence: Synthetic probe
ggagtgaacactgagcctgtcaaaaccgagagggaacaaccacaagctgaaggaccctac

SEQ ID NO: 512 - DNA, 60 bp, Artificial Sequence
  Description of Artificial Sequence: Synthetic probe
gagtgggaacgttcacatcgccaacctgtgtaaagtggtcgccccagcacccagcaagtc

SEQ ID NO: 513 - DNA, 60 bp, Artificial Sequence
  Description of Artificial Sequence: Synthetic probe
gcccctccttgccatccacccgagtaaggctagatataagcagaagattgtggcacccgc

SEQ ID NO: 514 - DNA, 60 bp, Artificial Sequence
  Description of Artificial Sequence: Synthetic probe
cgggtggtacgcgattgatgacgaagacatttacccctggacgccggatccgtctgacgt

SEQ ID NO: 515 - DNA, 60 bp, Artificial Sequence
  Description of Artificial Sequence: Synthetic probe
tttccccgcgtgacgaactacggtgttggggccgtttcgcgtgggtcggcgtctggtgcg

SEQ ID NO: 516 - DNA, 60 bp, Artificial Sequence
  Description of Artificial Sequence: Synthetic probe
cgcataatccctcagacatcacaattggcagaaagattctgaggcgagcgacgccgtagg

SEQ ID NO: 517 - DNA, 60 bp, Artificial Sequence
  Description of Artificial Sequence: Synthetic probe
ggcacggtcggacccgaggtcgcggctgccctagagctcatggagaaaagagaatacaaa

SEQ ID NO: 518 - DNA, 60 bp, Artificial Sequence
  Description of Artificial Sequence: Synthetic probe
atcaagctcctgagccgcttgtcatgcatgaccgctgtagcagcacggtcaaaggaccca

SEQ ID NO: 519 - DNA, 60 bp, Artificial Sequence
  Description of Artificial Sequence: Synthetic probe
cgcggaaacatactgccccaggcctttgctggctcttgataccacccaagaccgccgtaa

SEQ ID NO: 520 - DNA, 60 bp, Artificial Sequence
  Description of Artificial Sequence: Synthetic probe
aacctacggggaagagtccacaagacgcggtgactttgcagccctcgcgcaaaggttgag

SEQ ID NO: 521 - DNA, 60 bp, Artificial Sequence
  Description of Artificial Sequence: Synthetic probe
ggtgacaatgctattagcggaggctccaacgagggttccacggataccacctccacacac

SEQ ID NO: 522 - DNA, 60 bp, Artificial Sequence
  Description of Artificial Sequence: Synthetic probe
tgagctgcacgagggtggaccacccgccctcgtcgtttggaacatcaaacacttgctcca

SEQ ID NO: 523 - DNA, 60 bp, Artificial Sequence
  Description of Artificial Sequence: Synthetic probe
cgcctgagaaccttactcttgaggcgatcagacacctggaagggattactggccttgagc

SEQ ID NO: 524 - DNA, 60 bp, Artificial Sequence
  Description of Artificial Sequence: Synthetic probe
acttgacgccatggaaccagacaccgcacctggccttccttgggctctccaggggaaacg

SEQ ID NO: 525 - DNA, 60 bp, Artificial Sequence
  Description of Artificial Sequence: Synthetic probe
tgtggaggagccgttctcgcgaaggacggggccgagacattcatcgtcggcactcactct

SEQ ID NO: 526 - DNA, 60 bp, Artificial Sequence
  Description of Artificial Sequence: Synthetic probe
ttggctttagagagagaactcctcccgggcagaaggcgtgcgatgacgtgaactccgagc

SEQ ID NO: 527 - DNA, 59 bp, Artificial Sequence
  Description of Artificial Sequence: Synthetic probe
cacgtgggtcccgaacggggctcctgagaccgcgctggacaacaccaccaacccaacag

SEQ ID NO: 528 - DNA, 60 bp, Artificial Sequence
  Description of Artificial Sequence: Synthetic probe
ggtctgcttgttccaaataacacacgggaaagctgacggcgacgccctggttgtgctggc

SEQ ID NO: 529 - DNA, 60 bp, Artificial Sequence
  Description of Artificial Sequence: Synthetic probe
cggcggtttggtgaccacggacccgaagacggctgaccccgcctatgggaaagtgtttaa

SEQ ID NO: 530 - DNA, 60 bp, Artificial Sequence
  Description of Artificial Sequence: Synthetic probe
ctgttcgactgggtcaccagcgaccccttcggacggtgtcacctactggaactcccaact

SEQ ID NO: 531 - DNA, 60 bp, Artificial Sequence
  Description of Artificial Sequence: Synthetic probe
ctcaacggagagtggaaaacaaaggttcaaaagcgactcaagggagccgggcaatccagc

SEQ ID NO: 532 - DNA, 60 bp, Artificial Sequence
  Description of Artificial Sequence: Synthetic probe
cactcttgaggcaattaggcagttggaagaggtcactggtcttgagttgcacgagggtgg

SEQ ID NO: 533 - DNA, 60 bp, Artificial Sequence
  Description of Artificial Sequence: Synthetic probe
ccgtgcaactcggaactccacctggtctttccaggtctagaggggtgacgttttgtactg

SEQ ID NO: 534 - DNA, 60 bp, Artificial Sequence
  Description of Artificial Sequence: Synthetic probe
ggtggacgatgcagtgaatgagtacattgagaaggccaacatcaccacagatgacaagac

SEQ ID NO: 535 - DNA, 60 bp, Artificial Sequence
  Description of Artificial Sequence: Synthetic probe
gccagcacgaagcagcaattgacttctttgaagggatggtgcatgactccatcaaggagg

SEQ ID NO: 536 - DNA, 60 bp, Artificial Sequence
  Description of Artificial Sequence: Synthetic probe
caacccaactgcctaccagaaacagcccataacccgcttggcactcccctacaccgcccc

SEQ ID NO: 537 - DNA, 60 bp, Artificial Sequence
  Description of Artificial Sequence: Synthetic probe
ccaacccaactgcctaccagaaacagcccataacccgcttggcactcccctacaccgccc

SEQ ID NO: 538 - DNA, 60 bp, Artificial Sequence
  Description of Artificial Sequence: Synthetic probe
caggtttgtgaaactcactgcacctaagaaagctcagaccctcgaccttatgcagatccc

SEQ ID NO: 539 - DNA, 60 bp, Artificial Sequence
  Description of Artificial Sequence: Synthetic probe
gacccggtcaccactacggttgcgaactacggcggagaaactcaaacggccagacggctc

SEQ ID NO: 540 - DNA, 60 bp, Artificial Sequence
  Description of Artificial Sequence: Synthetic probe
tcggcggacccggtcaccactacggttgcgaactacggcggagaaactcaaacggccaga

SEQ ID NO: 541 - DNA, 60 bp, Artificial Sequence
  Description of Artificial Sequence: Synthetic probe
cctacttggccggcctggcgcagtactatacacagtacagtggtaccatgaatgtccact

SEQ ID NO: 542 - DNA, 60 bp, Artificial Sequence
  Description of Artificial Sequence: Synthetic probe
cggcgttaatgggatgcaaccacaagataaaccttcgtccggaagtaaaacggcaatcac

SEQ ID NO: 543 - DNA, 60 bp, Artificial Sequence
  Description of Artificial Sequence: Synthetic probe
gagagtacaagtttgtatgccagaccttcttgaaggacgagattcgcccgatggagaagg

SEQ ID NO: 544 - DNA, 60 bp, Artificial Sequence
  Description of Artificial Sequence: Synthetic probe
ggaccggtaaagaaacctgtcgctttgaaggtgaaagcaaagaacttgattgtcactgag

SEQ ID NO: 545 - DNA, 60 bp, Artificial Sequence
  Description of Artificial Sequence: Synthetic probe
tttcagagagaaaactctcccggggcacaagacgggtgatgacgtgagctccgagcccac

SEQ ID NO: 546 - DNA, 60 bp, Artificial Sequence
  Description of Artificial Sequence: Synthetic probe
acaccaccaatccaacggcctatcacaaggcgccgctcacccggcttgcactgccttaca

SEQ ID NO: 547 - DNA, 60 bp, Artificial Sequence
  Description of Artificial Sequence: Synthetic probe
gtacaccgcgtctgacgccgcggagaccacaaatgtgcagggttgggtttgcctgtttca

SEQ ID NO: 548 - DNA, 60 bp, Artificial Sequence
  Description of Artificial Sequence: Synthetic probe
gcccaaaacacccgaggcggccgctcactgcattcacgcggagtgggacacagggttgaa

SEQ ID NO: 549 - DNA, 60 bp, Artificial Sequence
  Description of Artificial Sequence: Synthetic probe
cgtgaccacaaagacggactcagacagggtactcgcccagtttgacttgtctctggcagc

SEQ ID NO: 550 - DNA, 60 bp, Artificial Sequence
  Description of Artificial Sequence: Synthetic probe
gaggctccaacgaggggtccacggacaccacctccacccacacaaccaacactcagaata

SEQ ID NO: 551 - DNA, 60 bp, Artificial Sequence
  Description of Artificial Sequence: Synthetic probe
gagaacctcacgctcgatgctatcaaacaattggaaggaattactggtctcgagctccac

SEQ ID NO: 552 - DNA, 60 bp, Artificial Sequence
  Description of Artificial Sequence: Synthetic probe
ccgcttcgtgcgagttgggcgcctggcgtgtttcggctgtcacccgaagtccacctttca

SEQ ID NO: 553 - DNA, 60 bp, Artificial Sequence
  Description of Artificial Sequence: Synthetic probe
gatcatgttggaaggcagagccatgacagacagtgattacagagtgtttgagtttgagat

SEQ ID NO: 554 - DNA, 60 bp, Artificial Sequence
  Description of Artificial Sequence: Synthetic probe
gagggcaaacatcaccacggacgacaagactcttgacgaagcggagaagaaccctctgga

SEQ ID NO: 555 - DNA, 60 bp, Artificial Sequence
  Description of Artificial Sequence: Synthetic probe
gcaacaagatatgtttaagcctcaaccacccctccaaaacgtgtaccaactcgttcagga

SEQ ID NO: 556 - DNA, 60 bp, Artificial Sequence
  Description of Artificial Sequence: Synthetic probe
aagcaagtactccgcgagcggttcgagacgaggcgatctggggtccctcgcgacgcgagt

SEQ ID NO: 557 - DNA, 60 bp, Artificial Sequence
  Description of Artificial Sequence: Synthetic probe
ggaccaactaccccgggcgctttacaaacctattggacgtggccgaagcatgtcccacct

SEQ ID NO: 558 - DNA, 60 bp, Artificial Sequence
  Description of Artificial Sequence: Synthetic probe
catatatgaggaacggctgggatgttgaggtatctgccgtcggcaaccagttcaacggcg

SEQ ID NO: 559 - DNA, 60 bp, Artificial Sequence
  Description of Artificial Sequence: Synthetic probe
tgccagttcggcttttaccggtctgttcggtgcacttctcgccgacaagaagacggaaga

SEQ ID NO: 560 - DNA, 59 bp, Artificial Sequence
  Description of Artificial Sequence: Synthetic probe
tggggccgtttcgcgcgggctgatcatttggcctgctttggctgacgcccgaaacccgc

SEQ ID NO: 561 - DNA, 60 bp, Artificial Sequence
  Description of Artificial Sequence: Synthetic probe
acttacagctggacccacgacaccgcgtgaccactttgctggattgtgcggacgaacacc

SEQ ID NO: 562 - DNA, 60 bp, Artificial Sequence
  Description of Artificial Sequence: Synthetic probe
tcactgcacccaagaacactcagaccctcgacctcatgcagatcccctcacacacgctgg

SEQ ID NO: 563 - DNA, 60 bp, Artificial Sequence
  Description of Artificial Sequence: Synthetic probe
aaactcactgcacccaagagcgctcagaccctcgacctcatgcagatcccctcacacacg

SEQ ID NO: 564 - DNA, 50 bp, Artificial Sequence
  Description of Artificial Sequence: Synthetic probe
agtgaaggctatcaggacaggtctcgatgaagccaaaccctggtacaagc

SEQ ID NO: 565 - DNA, 60 bp, Artificial Sequence
  Description of Artificial Sequence: Synthetic probe
ggtgaccggaggccggcacctttccttttataaccactgaacacatgaatacaactgact

SEQ ID NO: 566 - DNA, 60 bp, Artificial Sequence
  Description of Artificial Sequence: Synthetic probe
ggtgaccggaggccggcacctttccttttataaccactgagcacatgaatacaactgact

SEQ ID NO: 567 - DNA, 57 bp, Artificial Sequence
  Description of Artificial Sequence: Synthetic probe
aataggtgaccggaggccggcacctttccttttataaccactgaatacatggatata

SEQ ID NO: 568 - DNA, 54 bp, Artificial Sequence
  Description of Artificial Sequence: Synthetic probe
gtggccatcatgctggccgacaccggccttcagattctggacagcacctttgtc

SEQ ID NO: 569 - DNA, 60 bp, Artificial Sequence
  Description of Artificial Sequence: Synthetic probe
cggaggggctgttcttgccaaagacggtgctgaaacattcatcgttggcacacactccgc

SEQ ID NO: 570 - DNA, 60 bp, Artificial Sequence
  Description of Artificial Sequence: Synthetic probe
cgctttcaaacgcctgaaggagaactttgagatcgttgccctatgtttgactcttctagc

SEQ ID NO: 571 - DNA, 60 bp, Artificial Sequence
  Description of Artificial Sequence: Synthetic probe
cctgggcccttcttcttctccgacgtcaggacaaacttctccaaactggtagagaccatc

SEQ ID NO: 572 - DNA, 60 bp, Artificial Sequence
  Description of Artificial Sequence: Synthetic probe
gggcaaccccaccgcatacaacaaagcaccattcacgaggctagcactcccctacactgc

SEQ ID NO: 573 - DNA, 60 bp, Artificial Sequence
  Description of Artificial Sequence: Synthetic probe
aaacaccgccggatacgcctgagagagctgcacactgcatccacgctgagtgggacacag

SEQ ID NO: 574 - DNA, 60 bp, Artificial Sequence
  Description of Artificial Sequence: Synthetic probe
gtctacgccaatatcgccccaacccacgttcacgtagccggtgaactcccgtcgaaagag

SEQ ID NO: 575 - DNA, 60 bp, Artificial Sequence
  Description of Artificial Sequence: Synthetic probe
gtgcttcgactgtcacccggagcccacctttcacccaagttttaccgtcgttcccgacgt

SEQ ID NO: 576 - DNA, 60 bp, Artificial Sequence
  Description of Artificial Sequence: Synthetic probe
ccaccctcttggaagaccgcatcctcactacccgcaacggacataccacctcaacaaccc

SEQ ID NO: 577 - DNA, 60 bp, Artificial Sequence
  Description of Artificial Sequence: Synthetic probe
tggaccgcccgccctcgtcatctggaacatcaaacaccttctccacaccggaatcggtac

SEQ ID NO: 578 - DNA, 60 bp, Artificial Sequence
  Description of Artificial Sequence: Synthetic probe
ccggcgttatagggctgtaaccacatgctcgtaccgcctttcccggcgttaacgggacat

SEQ ID NO: 579 - DNA, 60 bp, Artificial Sequence
  Description of Artificial Sequence: Synthetic probe
gcgcacctcgcgtgaccggttgatactcttaccacttaccgcctacttggtcgttagcgc

SEQ ID NO: 580 - DNA, 56 bp, Artificial Sequence
  Description of Artificial Sequence: Synthetic probe
aaaatctgtgttgtacttcctcattaagaaagggcagcacgaggcagcaattgaat

SEQ ID NO: 581 - DNA, 54 bp, Artificial Sequence
  Description of Artificial Sequence: Synthetic probe
ctggcatccttgaaaagcagcatgacctcaacgacccaagcaagtacaaggagg

SEQ ID NO: 582 - DNA, 60 bp, Artificial Sequence
  Description of Artificial Sequence: Synthetic probe
gaggggattttcccagtcgcatgttcggacggttacggaggattggtgacaacggacccg

SEQ ID NO: 583 - DNA, 54 bp, Artificial Sequence
  Description of Artificial Sequence: Synthetic probe
ataggtgaccggaggccggcaccttttctttaactactttgactctatgcatac

SEQ ID NO: 584 - DNA, 60 bp, Artificial Sequence
  Description of Artificial Sequence: Synthetic probe
gaccccttcaggtaccccgaggtaaaggggaagtaaccacaagcttgacgccgtctgtcc

SEQ ID NO: 585 - DNA, 60 bp, Artificial Sequence
  Description of Artificial Sequence: Synthetic probe
gctcagcggtcggatgcaaccctgatgttgactggcaaagatttggtacacacttcgccc

SEQ ID NO: 586 - DNA, 60 bp, Artificial Sequence
  Description of Artificial Sequence: Synthetic probe
cgcatcgcgcctacacagcgtgctgggcacagcaaacactccattgagcatttacgaggc

SEQ ID NO: 587 - DNA, 60 bp, Artificial Sequence
  Description of Artificial Sequence: Synthetic probe
actcttccaggtcaaaaggcgcgcgacgacgtgaactctgagcccgccaaacctgttgag

SEQ ID NO: 588 - DNA, 60 bp, Artificial Sequence
  Description of Artificial Sequence: Synthetic probe
ccagatacaggaggacatgtccacaaaacacgggcccgactttaaccggttggtgtccgc

SEQ ID NO: 589 - DNA, 60 bp, Artificial Sequence
  Description of Artificial Sequence: Synthetic probe
cgtgcaaccgacgcatgtcattgaccttatgcagactcaccaatacggcctggtgggtgc

SEQ ID NO: 590 - DNA, 60 bp, Artificial Sequence
  Description of Artificial Sequence: Synthetic probe
aggtttacgccaacattgctccgacctacgtacacgtggctggtgagctcccctcgaaag

SEQ ID NO: 591 - DNA, 60 bp, Artificial Sequence
  Description of Artificial Sequence: Synthetic probe
caacggacagggcttttggacacctggagaaactcgaacttccaacagaccaccacggtg

SEQ ID NO: 592 - DNA, 60 bp, Artificial Sequence
  Description of Artificial Sequence: Synthetic probe
ccgagaacctgacgctgtctgccgtcaggcagctggaagaaatcacgggacttgagttgc

SEQ ID NO: 593 - DNA, 60 bp, Artificial Sequence
  Description of Artificial Sequence: Synthetic probe
gggtctccctgtgcggcaactacggtaatggggccgtttcgcgcgggcttatcggctggt

SEQ ID NO: 594 - DNA, 60 bp, Artificial Sequence
  Description of Artificial Sequence: Synthetic probe
agggtttcacccctagcacgccaccggtagtccctgcgtcgcactccacacttacgttgt

SEQ ID NO: 595 - DNA, 60 bp, Artificial Sequence
  Description of Artificial Sequence: Synthetic probe
gctcggcggtcggctgtaatccagatgttgattggcagagatttggaacacacttcgccc

SEQ ID NO: 596 - DNA, 60 bp, Artificial Sequence
  Description of Artificial Sequence: Synthetic probe
cctcaaccacccctccagaacgtgtatcagctcgtccaggaggtgattgaacgggtcgag

SEQ ID NO: 597 - DNA, 60 bp, Artificial Sequence
  Description of Artificial Sequence: Synthetic probe
taaagtggtcaccccggcaccaagcaagtcgaggcccgaacctgtggtcgtttgtctccg

SEQ ID NO: 598 - DNA, 60 bp, Artificial Sequence
  Description of Artificial Sequence: Synthetic probe
acaagcaaatacaccgtgagtggttcaggcaggcgtggtgacatggggtctctcgcggca

SEQ ID NO: 599 - DNA, 60 bp, Artificial Sequence
  Description of Artificial Sequence: Synthetic probe
gctttgacgacggaaaaccgtatgtcaccacgcggacggaccaaacccgacttctggcca

SEQ ID NO: 600 - DNA, 60 bp, Artificial Sequence
  Description of Artificial Sequence: Synthetic probe
cgctaacggtcaacactgctggcgcgtcgcagatcaaggtctacgccaacattgctccga

SEQ ID NO: 601 - DNA, 60 bp, Artificial Sequence
  Description of Artificial Sequence: Synthetic probe
gacaacggacaggccttttggacacctggagaagctcgaacttccaaccgaccaccacgg

SEQ ID NO: 602 - DNA, 60 bp, Artificial Sequence
  Description of Artificial Sequence: Synthetic probe
aaacaacgcttcttgaggaccggatcttgaccacccgcaacgggcacaccacctcgacga

SEQ ID NO: 603 - DNA, 60 bp, Artificial Sequence
  Description of Artificial Sequence: Synthetic probe
ggaaccactcaatggagaatggaaagccaacgttcaacggaagctcaagggtgccgggca

SEQ ID NO: 604 - DNA, 60 bp, Artificial Sequence
  Description of Artificial Sequence: Synthetic probe
atggggccgtttcgcgcgggctgatcggctggtctgctacggctgctgcccgaagcccgc

SEQ ID NO: 605 - DNA, 60 bp, Artificial Sequence
  Description of Artificial Sequence: Synthetic probe
gtggccatctgttgcgccaccggagtgtttggtactgcttaccttgtccctcgtcatctt

SEQ ID NO: 606 - DNA, 60 bp, Artificial Sequence
  Description of Artificial Sequence: Synthetic probe
ccgggtcgagctccacgagaaggtgtcgaaccacccgattttcaagcagatctcaatacc

SEQ ID NO: 607 - DNA, 60 bp, Artificial Sequence
  Description of Artificial Sequence: Synthetic probe
aaagtagttgccccagcacccagcaggtcgaggcctgaacccgtggtcgtttgcctccgt

SEQ ID NO: 608 - DNA, 60 bp, Artificial Sequence
  Description of Artificial Sequence: Synthetic probe
aaagattgtggcgcctgtgaaacagcttctgaactttgacctgctcaagttggcaggaga

SEQ ID NO: 609 - DNA, 54 bp, Artificial Sequence
  Description of Artificial Sequence: Synthetic probe
tgagcggaccaaacacatctgggctcgagaccagggttgtgcaggcagagcggt

SEQ ID NO: 610 - DNA, 52 bp, Artificial Sequence
  Description of Artificial Sequence: Synthetic probe
gtctactactcacctgagaacctcacgcttgatgctatcaaacaattggaag

SEQ ID NO: 611 - DNA, 50 bp, Artificial Sequence
  Description of Artificial Sequence: Synthetic probe
actttccgcctacttggtcgttagcgctgctttgggcactcccgttgggg

SEQ ID NO: 612 - DNA, 60 bp, Artificial Sequence
  Description of Artificial Sequence: Synthetic probe
cctgcttccttcaactacggtgcaatcagggctgacgccatcaacgagcttctcgtgcgc

SEQ ID NO: 613 - DNA, 60 bp, Artificial Sequence
  Description of Artificial Sequence: Synthetic probe
ccgacttggagattgttgtgcggcatgacggtaatttgacttgggtgcccaacggtgcgc

SEQ ID NO: 614 - DNA, 60 bp, Artificial Sequence
  Description of Artificial Sequence: Synthetic probe
catgtttacaggttcaacagattcaaaggcccgttacatggtggcctacatcccgcccgg

SEQ ID NO: 615 - DNA, 60 bp, Artificial Sequence
  Description of Artificial Sequence: Synthetic probe
ccagaacaaacatgactgcccacattactgtcccataccttggagtgaacaggtacgacc

SEQ ID NO: 616 - DNA, 60 bp, Artificial Sequence
  Description of Artificial Sequence: Synthetic probe
cagcctttaccggtctgttcggcgccttgcttgccgacaagaagacggaagagactacgc

SEQ ID NO: 617 - DNA, 60 bp, Artificial Sequence
  Description of Artificial Sequence: Synthetic probe
actcaacggggactggaaagcgatggtccagaggaagcttaagggcgccgggcaatccag

SEQ ID NO: 618 - DNA, 60 bp, Artificial Sequence
  Description of Artificial Sequence: Synthetic probe
atcgagcaattggaggaactcacaggacttgagctgcacgaaggtgggccgcccgccctc

SEQ ID NO: 619 - DNA, 60 bp, Artificial Sequence
  Description of Artificial Sequence: Synthetic probe
caactgactgttttatcgctttggtgcacgcaatcagagagatcagagcacttttcctac

SEQ ID NO: 620 - DNA, 60 bp, Artificial Sequence
  Description of Artificial Sequence: Synthetic probe
gtaatcacaagaaacgccttcgcccggaagtaaaacggtccacgcacacagttttgcccg

SEQ ID NO: 621 - DNA, 60 bp, Artificial Sequence
  Description of Artificial Sequence: Synthetic probe
ggtggggttgctccgtgcgggctgaccgcctggtccgttttggctgtcacccgaaatccg

SEQ ID NO: 622 - DNA, 58 bp, Artificial Sequence
  Description of Artificial Sequence: Synthetic probe
ggggagccgttctcgccaaggacggagccgacacattcatcgttggcactcactccgc

SEQ ID NO: 623 - DNA, 60 bp, Artificial Sequence
  Description of Artificial Sequence: Synthetic probe
cccgatggatagacagaaaccgttgaaagtgagagcaagagccccggtcgtgaaggaggg

SEQ ID NO: 624 - DNA, 60 bp, Artificial Sequence
  Description of Artificial Sequence: Synthetic probe
gtttgtcaccatgacggacttggtgcctggtatccttgaaaagcagcgggatctcaacga

SEQ ID NO: 625 - DNA, 60 bp, Artificial Sequence
  Description of Artificial Sequence: Synthetic probe
aacagcttaccacaaggcaccactcacccgacttgcactgccttacacggcgccacaccg

SEQ ID NO: 626 - DNA, 60 bp, Artificial Sequence
  Description of Artificial Sequence: Synthetic probe
ttttggctagcgccggaaaggactttgagctgcgcctgccggtggatgctcgcacacaga

SEQ ID NO: 627 - DNA, 60 bp, Artificial Sequence
  Description of Artificial Sequence: Synthetic probe
tttcttgacgtggctgaggcgtgccccacgtttctccacttcgagggtgacgtgccatac

SEQ ID NO: 628 - DNA, 60 bp, Artificial Sequence
  Description of Artificial Sequence: Synthetic probe
acaacgctacaagcggaggctcaaacgaggggtccacggacacaacctccacccacacaa

SEQ ID NO: 629 - DNA, 60 bp, Artificial Sequence
  Description of Artificial Sequence: Synthetic probe
ggaacatcaaacacttgcttcacaccggaatcggcactgcctcacgccctagcgaggtgt

SEQ ID NO: 630 - DNA, 60 bp, Artificial Sequence
  Description of Artificial Sequence: Synthetic probe
ggggccaaaagccacgtcctaccggacccatcatgtgtgcaaacccagcacggcaacttt

SEQ ID NO: 631 - DNA, 60 bp, Artificial Sequence
  Description of Artificial Sequence: Synthetic probe
ccacctacagttggattcacggcaccgcgtggccattttagctgggttgtgcggacgaac

SEQ ID NO: 632 - DNA, 60 bp, Artificial Sequence
  Description of Artificial Sequence: Synthetic probe
aattaaaggcgttgatggactcgacgcaatggaaccagacaccgcacccggcctcccctg

SEQ ID NO: 633 - DNA, 58 bp, Artificial Sequence
  Description of Artificial Sequence: Synthetic probe
taaggacggggctgacacgttcatcgttggcacccactccgctggaggcaatggcgtt

SEQ ID NO: 634 - DNA, 57 bp, Artificial Sequence
  Description of Artificial Sequence: Synthetic probe
caccgtcggcttcagagagagacctctcccaggccaaaaggcgcgtaatgacgagaa

SEQ ID NO: 635 - DNA, 60 bp, Artificial Sequence
  Description of Artificial Sequence: Synthetic probe
gtacttcgcccaaatggtttcaacaacggggttcatcccgcccatggcatcgcttgagga

SEQ ID NO: 636 - DNA, 60 bp, Artificial Sequence
  Description of Artificial Sequence: Synthetic probe
gccgcaccgtgtgctggcaacagtgtacaacgggacgagtaagtatgctgtgggtggttc

SEQ ID NO: 637 - DNA, 60 bp, Artificial Sequence
  Description of Artificial Sequence: Synthetic probe
gtcaccacgcggacggatgacacccgacttttggccaagtttgacctttcccttgccgca

SEQ ID NO: 638 - DNA, 60 bp, Artificial Sequence
  Description of Artificial Sequence: Synthetic probe
cggcgggtgcctcctggtggccatggtacctgaatggaaggaatttgacacacgggagaa

SEQ ID NO: 639 - DNA, 60 bp, Artificial Sequence
  Description of Artificial Sequence: Synthetic probe
cccatggacgccggacccgtccgacgttttggtgtttgttccgtacgatcaagagccact

SEQ ID NO: 640 - DNA, 60 bp, Artificial Sequence
  Description of Artificial Sequence: Synthetic probe
cggggccaaaagccacgtccgaatggacccgtcatgtgtgcaaacccagcacagtagctt

SEQ ID NO: 641 - DNA, 60 bp, Artificial Sequence
  Description of Artificial Sequence: Synthetic probe
cgtgaccggttagtactctcaccaccttccgcccacttggttgttagcgctgtcttgggc

SEQ ID NO: 642 - DNA, 60 bp, Artificial Sequence
  Description of Artificial Sequence: Synthetic probe
aaagtctactggccaagttcgacgtgtcgctggcaagacgcaagcaaccgctcgtcgcac

SEQ ID NO: 643 - DNA, 60 bp, Artificial Sequence
  Description of Artificial Sequence: Synthetic probe
aggatattgtagtgtgcatggacggagacaccatgcctggcctctttgcctacaaagccg

SEQ ID NO: 644 - DNA, 60 bp, Artificial Sequence
  Description of Artificial Sequence: Synthetic probe
acaccaagatgtctaaggaggacaaagcgctgttccgtcgttgcgccgccgactacgcgt

SEQ ID NO: 645 - DNA, 60 bp, Artificial Sequence
  Description of Artificial Sequence: Synthetic probe
cctttgccacccctccagaacgtgtaccaactcgtacaggaggtgattgaccgggtcgag

SEQ ID NO: 646 - DNA, 60 bp, Artificial Sequence
  Description of Artificial Sequence: Synthetic probe
accagaccaacccaactgcctatcagaagcaacccatcacccgcctggcactcccctaca

SEQ ID NO: 647 - DNA, 60 bp, Artificial Sequence
  Description of Artificial Sequence: Synthetic probe
actcactgctcccaagaacatccaaaccctcgatctcatgcagatcccctcacacacgct

SEQ ID NO: 648 - DNA, 60 bp, Artificial Sequence
  Description of Artificial Sequence: Synthetic probe
tacagcggcaccatgaacgtccacttcatgttcaccgggcccacggatgctaaagcccga

SEQ ID NO: 649 - DNA, 60 bp, Artificial Sequence
  Description of Artificial Sequence: Synthetic probe
ccagagctgaaggaactcgacacgcgacagaagtaccagctgaccctctttccccaccag

SEQ ID NO: 650 - DNA, 60 bp, Artificial Sequence
  Description of Artificial Sequence: Synthetic probe
cggggaatggaaagcaaaggttcagaaacgacttaagggagccggtcaatccagtccggc

SEQ ID NO: 651 - DNA, 60 bp, Artificial Sequence
  Description of Artificial Sequence: Synthetic probe
cacccttgctgcaattgaacagttggaagaggttaccggtcttgagctgcacgaaggcgg

SEQ ID NO: 652 - DNA, 60 bp, Artificial Sequence
  Description of Artificial Sequence: Synthetic probe
cgcgccgtcgcttgaggaatacctgtacaaacacgactcacgcaggtctccacaactgac

SEQ ID NO: 653 - DNA, 60 bp, Artificial Sequence
  Description of Artificial Sequence: Synthetic probe
cggctggactcacggcaccgcgtggccatgctagctggattgtgcggacgaacgccattt

SEQ ID NO: 654 - DNA, 60 bp, Artificial Sequence
  Description of Artificial Sequence: Synthetic probe
tcatcttctccaaacacaagggtgatgccaaaatgactgaggctgacaagaggctgttcc

SEQ ID NO: 655 - DNA, 60 bp, Artificial Sequence
  Description of Artificial Sequence: Synthetic probe
aaaccacaagctgaaggaccctacgccggccctcttgagcgacagcagccgctgaagctc

SEQ ID NO: 656 - DNA, 60 bp, Artificial Sequence
  Description of Artificial Sequence: Synthetic probe
cgacggctacaaccaacaagctgtcgttgtcatggacgatttgggccaaaaccctgacgg

SEQ ID NO: 657 - DNA, 60 bp, Artificial Sequence
  Description of Artificial Sequence: Synthetic probe
atgaagcgcgctgagctttactgcccacgcccgctccgagtgaggtatacacacaccact

SEQ ID NO: 658 - DNA, 60 bp, Artificial Sequence
  Description of Artificial Sequence: Synthetic probe
aagtcaacgagagcagaaccatttccctgatggacacgaaggaacacacgctggtgggag

SEQ ID NO: 659 - DNA, 60 bp, Artificial Sequence
  Description of Artificial Sequence: Synthetic probe
ctacgcccagtatagtggctccatcaatctgcatttcatgtacaccgggccaacgcaatc

SEQ ID NO: 660 - DNA, 60 bp, Artificial Sequence
  Description of Artificial Sequence: Synthetic probe
tgcaggtctccgcgaccagcacacagttcaatggaggaacactcctggtggcaatggtgc

SEQ ID NO: 661 - DNA, 60 bp, Artificial Sequence
  Description of Artificial Sequence: Synthetic probe
ttctgtcggagtgacctacggttacgcttcggctgaccgtttcctccccgggcccaacac

SEQ ID NO: 662 - DNA, 60 bp, Artificial Sequence
  Description of Artificial Sequence: Synthetic probe
ctccgcggagctggtcagtcgtcgcctgccacagggtcacaaaatcaatctggcaacact

SEQ ID NO: 663 - DNA, 60 bp, Artificial Sequence
  Description of Artificial Sequence: Synthetic probe
gtgcgcacgaaacgcgctgttgctctttgcattcttgtacaaacacgatctcgacgcagg

SEQ ID NO: 664 - DNA, 60 bp, Artificial Sequence
  Description of Artificial Sequence: Synthetic probe
tgccaccactgttggtttcagagagaaagctctcccgggacacaaggcgggtgacgacgt

SEQ ID NO: 665 - DNA, 55 bp, Artificial Sequence
  Description of Artificial Sequence: Synthetic probe
tggggccgcttcgtgcgagttgattggtgtgtttcggctgtcacccaaagcccac

SEQ ID NO: 666 - DNA, 60 bp, Artificial Sequence
  Description of Artificial Sequence: Synthetic probe
ggacctgatgagtaccggagactctttgagcctttcgccgggctctttgagatccccagc

SEQ ID NO: 667 - DNA, 60 bp, Artificial Sequence
  Description of Artificial Sequence: Synthetic probe
ttcacatgccaaaccttcctgaaagatgagattcgtccgatggacaaagttcgcgccggc

SEQ ID NO: 668 - DNA, 60 bp, Artificial Sequence
  Description of Artificial Sequence: Synthetic probe
cgcaagagacaagaaatggtggacgctgccgtgaacgattacatcgagcgcgccggcatc

SEQ ID NO: 669 - DNA, 60 bp, Artificial Sequence
  Description of Artificial Sequence: Synthetic probe
ttgcccagatggtctccacaaccgggttcatcccgcccatggcttctctcgaggacaaag

SEQ ID NO: 670 - DNA, 59 bp, Artificial Sequence
  Description of Artificial Sequence: Synthetic probe
ctgtcttcagttttggagccccgatactgctggcaggtttggtcaaggtcgcctcgagt

SEQ ID NO: 671 - DNA, 60 bp, Artificial Sequence
  Description of Artificial Sequence: Synthetic probe
ggccaaatacatggttgcatacatcccacctggcacacacccactgcccaacacgcccga

SEQ ID NO: 672 - DNA, 60 bp, Artificial Sequence
  Description of Artificial Sequence: Synthetic probe
cggttgggacgtccaggtttcagcaactgccacacagttcaacggaggatgcttgttggt

SEQ ID NO: 673 - DNA, 60 bp, Artificial Sequence
  Description of Artificial Sequence: Synthetic probe
gacctccaacggctggtatgccatcgacgatgaggacttttacccgtggacaccagaccc

SEQ ID NO: 674 - DNA, 60 bp, Artificial Sequence
  Description of Artificial Sequence: Synthetic probe
gtctagagagacgacactttgtactgaacccaactccacgattggtctactggcgggtgc

SEQ ID NO: 675 - DNA, 60 bp, Artificial Sequence
  Description of Artificial Sequence: Synthetic probe
agggtcttgccctagttcgccgtaacgaccgtccctgcgattcacttcacacccagacca

SEQ ID NO: 676 - DNA, 51 bp, Artificial Sequence
  Description of Artificial Sequence: Synthetic probe
attgatgacggggacttctacccatggacgccagacccgtctgatgtcctg

SEQ ID NO: 677 - DNA, 60 bp, Artificial Sequence
  Description of Artificial Sequence: Synthetic probe
cccacgaccgccgtaagcaggagatcatagcacctgagaagcaagtgttgaactttgacc

SEQ ID NO: 678 - DNA, 50 bp, Artificial Sequence
  Description of Artificial Sequence: Synthetic probe
acggagctgttgacccgcatgaagcgagcggacacatactgccccaggcc

SEQ ID NO: 679 - DNA, 60 bp, Artificial Sequence
  Description of Artificial Sequence: Synthetic probe
acacaacccacgcggcgtggtgacctagctgctctggcacagcgggtaagcaacaggttg

SEQ ID NO: 680 - DNA, 51 bp, Artificial Sequence
  Description of Artificial Sequence: Synthetic probe
cagggatgggtgtgtatttatcagattacgcaggttaaagctgaaggcgac

SEQ ID NO: 681 - DNA, 60 bp, Artificial Sequence
  Description of Artificial Sequence: Synthetic probe
gactacgcttacactgcctctgaggtggccgagactacgagtgtgcagggatgggtgtgt

SEQ ID NO: 682 - DNA, 60 bp, Artificial Sequence
  Description of Artificial Sequence: Synthetic probe
cgtgccgttcgtgggtgtaaacaggtacgaccattacaagctccacaagccgtggacgct

SEQ ID NO: 683 - DNA, 56 bp, Artificial Sequence
  Description of Artificial Sequence: Synthetic probe
tactacatgcagcaataccagaattccattgacacacaacttggtgacaacgctat

SEQ ID NO: 684 - DNA, 59 bp, Artificial Sequence
  Description of Artificial Sequence: Synthetic probe
actcaagggagctgggcaatctagcccggcaaccggatcgcagaaccagtcaggcaaca

SEQ ID NO: 685 - DNA, 58 bp, Artificial Sequence
  Description of Artificial Sequence: Synthetic probe
cgatgaaccattcttcgactgggtctatgagtcacctgcgaacctcactcttgaggcg

SEQ ID NO: 686 - DNA, 51 bp, Artificial Sequence
  Description of Artificial Sequence: Synthetic probe
tggattgtgtggacgaacaacgcttgcgcttcttgcgtgaccggttagtac

SEQ ID NO: 687 - DNA, 60 bp, Artificial Sequence
  Description of Artificial Sequence: Synthetic probe
gaagagggccgaaacatactgtccaaggcccttgctggcaatccacccaactgaagccag

SEQ ID NO: 688 - DNA, 60 bp, Artificial Sequence
  Description of Artificial Sequence: Synthetic probe
cacgcctatgagaacaagcgcattacagttgaaggtgggatgccgtccggctgctccgca

SEQ ID NO: 689 - DNA, 60 bp, Artificial Sequence
  Description of Artificial Sequence: Synthetic probe
gttcaaacctgagtacggccccgctgccttgtcaaacaaggacccgcggctgaatgaagg

SEQ ID NO: 690 - DNA, 58 bp, Artificial Sequence
  Description of Artificial Sequence: Synthetic probe
ctccgagcccgcccaccccgaggatgagcaaccacaagctgaagggccctacgccgga

SEQ ID NO: 691 - DNA, 60 bp, Artificial Sequence
  Description of Artificial Sequence: Synthetic probe
acttgtgcaaagtggtcgccccggcgccgagcaagacgagacccgaacccgtggtcgttt

SEQ ID NO: 692 - DNA, 60 bp, Artificial Sequence
  Description of Artificial Sequence: Synthetic probe
cacatttgtcgtgaagaaaatctccgactccctctccagtctctttcacgtgccggcccc

SEQ ID NO: 693 - DNA, 60 bp, Artificial Sequence
  Description of Artificial Sequence: Synthetic probe
ttggacaacaccaccaacccgacggcgtaccacaaagcgccacttacccggcttgcattg

SEQ ID NO: 694 - DNA, 60 bp, Artificial Sequence
  Description of Artificial Sequence: Synthetic probe
tggctgaggcttgccccacgtttctgcacttcgaaggtggcgtaccatacgtgaccacga

SEQ ID NO: 695 - DNA, 60 bp, Artificial Sequence
  Description of Artificial Sequence: Synthetic probe
aacgtacgggtatgcaacggctgaggactttgtgagcgggccaaacacctccggtctcga

SEQ ID NO: 696 - DNA, 60 bp, Artificial Sequence
  Description of Artificial Sequence: Synthetic probe
cgctttgttgcacgccatcagagagataaaagcacgactgttttcaaggacacaggaaga

SEQ ID NO: 697 - DNA, 60 bp, Artificial Sequence
  Description of Artificial Sequence: Synthetic probe
gctttgaaccgcctttcccggcgttaaagggctgtgaccgcaagatagaccttcacccgg

SEQ ID NO: 698 - DNA, 60 bp, Artificial Sequence
  Description of Artificial Sequence: Synthetic probe
cctcctggtggcgctcgtccccgagatggacgacatcagtgacagggaaaagtaccaact

SEQ ID NO: 699 - DNA, 60 bp, Artificial Sequence
  Description of Artificial Sequence: Synthetic probe
ggactttgaggcccttaagccacacttcaaatcccttggtcaaaccatcaccccagctga

SEQ ID NO: 700 - DNA, 60 bp, Artificial Sequence
  Description of Artificial Sequence: Synthetic probe
gttgagcttatcctcgacgggaagacggtagccatttgctgcgctaccggagtgtttggc

SEQ ID NO: 701 - DNA, 60 bp, Artificial Sequence
  Description of Artificial Sequence: Synthetic probe
acaccaacccaaccgcctaccaaaagcaacccattacccgcctggcactcccttacaccg

SEQ ID NO: 702 - DNA, 60 bp, Artificial Sequence
  Description of Artificial Sequence: Synthetic probe
gacacgcggcagaaataccagttgacccttttcccacaccagtttataaacccacgcacc

SEQ ID NO: 703 - DNA, 60 bp, Artificial Sequence
  Description of Artificial Sequence: Synthetic probe
cggcctttactggtctgtttggcgctctcctggctgacaagaaaacggaggaggcaaccc

SEQ ID NO: 704 - DNA, 60 bp, Artificial Sequence
  Description of Artificial Sequence: Synthetic probe
gtggcagactacggtgttggggccgcttcgtgcgagtcgctcgcctggtgtgctttggtt

SEQ ID NO: 705 - DNA, 60 bp, Artificial Sequence
  Description of Artificial Sequence: Synthetic probe
tttgtgaaagtaacaccaaaagaccaaactaacgtgttggacctgatgcagacccctgca

SEQ ID NO: 706 - DNA, 60 bp, Artificial Sequence
  Description of Artificial Sequence: Synthetic probe
aggactttgagttgcgtctgccagttgacgctcgcacacagaccacctccgcaggtgagt

SEQ ID NO: 707 - DNA, 60 bp, Artificial Sequence
  Description of Artificial Sequence: Synthetic probe
ccactggtgacaggctaaggatgccctttaagtaccctgaggtaacacgcgacactcggg

SEQ ID NO: 708 - DNA, 60 bp, Artificial Sequence
  Description of Artificial Sequence: Synthetic probe
agatgataccgcctttcccggcgttaattgggtgcaaccacaagatgaaccttcacccgg

SEQ ID NO: 709 - DNA, 60 bp, Artificial Sequence
  Description of Artificial Sequence: Synthetic probe
gatctcctacggagacgacattgtggtcgcaagtgactatgatctggactttgaggctct

SEQ ID NO: 710 - DNA, 60 bp, Artificial Sequence
  Description of Artificial Sequence: Synthetic probe
ccctgaagctcatggagaaaagagaatacagatttgcctgtcagaccttcctgaaggacg

SEQ ID NO: 711 - DNA, 50 bp, Artificial Sequence
  Description of Artificial Sequence: Synthetic probe
tgtgctgctgactacgcgtcacgcctgcatagcgtgctgggcacggcaaa

SEQ ID NO: 712 - DNA, 58 bp, Artificial Sequence
  Description of Artificial Sequence: Synthetic probe
aattggccactggagtaaaggctatcaggaacggtctcgacgaggccaaaccctggta

SEQ ID NO: 713 - DNA, 60 bp, Artificial Sequence
  Description of Artificial Sequence: Synthetic probe
gggttgggtgtgcatctaccagatcactcacggcaaggctgaaggagacgcactggtcgt

SEQ ID NO: 714 - DNA, 60 bp, Artificial Sequence
  Description of Artificial Sequence: Synthetic probe
agacaaagcgctgttccgccgttgtgctgctgactacgcctcacgcttgcacagcgtact

SEQ ID NO: 715 - DNA, 60 bp, Artificial Sequence
  Description of Artificial Sequence: Synthetic probe
tgttggtgtgatcaacaacgcagacgtcgggaggctgattttctctggtgaggccctcac

SEQ ID NO: 716 - DNA, 60 bp, Artificial Sequence
  Description of Artificial Sequence: Synthetic probe
ggcagaagatggtggatggctcggtgaatgagcacatcgagaaggcaaacaacaccgcag

SEQ ID NO: 717 - DNA, 60 bp, Artificial Sequence
  Description of Artificial Sequence: Synthetic probe
gcacttgaagacactcacaccaacccggtagcaatgtttcagtacgactgtgcccttctc

SEQ ID NO: 718 - DNA, 60 bp, Artificial Sequence
  Description of Artificial Sequence: Synthetic probe
tggatcagaaggcgtcgcgggcgctacccacctccttcaactacggtgccatcaaagcaa

SEQ ID NO: 719 - DNA, 60 bp, Artificial Sequence
  Description of Artificial Sequence: Synthetic probe
aacagcttaccacaaggcaccactcactcggctcgccctgccttacacggcaccacaccg

SEQ ID NO: 720 - DNA, 60 bp, Artificial Sequence
  Description of Artificial Sequence: Synthetic probe
tccttccaaagagggaattttccccgtagcttgcagtgacggctatggtggcctggtgac

SEQ ID NO: 721 - DNA, 60 bp, Artificial Sequence
  Description of Artificial Sequence: Synthetic probe
agcggaggctccaacgagggctccacagacacaacttccaatcacacaaccaacactcag

SEQ ID NO: 722 - DNA, 60 bp, Artificial Sequence
  Description of Artificial Sequence: Synthetic probe
ttatgaacacaactaactgttttatcgctttggtgtacgctatcagagagatcagaacgc

SEQ ID NO: 723 - DNA, 60 bp, Artificial Sequence
  Description of Artificial Sequence: Synthetic probe
accactctccgcctacttggtcgctgcgctgtcttgggcactcctattggggtcgttcga

SEQ ID NO: 724 - DNA, 58 bp, Artificial Sequence
  Description of Artificial Sequence: Synthetic probe
aggacaggacatgctttcggatgctgcgctcatggttctccactctggaaaccgtgtg

SEQ ID NO: 725 - DNA, 60 bp, Artificial Sequence
  Description of Artificial Sequence: Synthetic probe
cgagccacccgattttcaagcagatttccatcccctctcaaaagtctgtgctttacttcc

SEQ ID NO: 726 - DNA, 57 bp, Artificial Sequence
  Description of Artificial Sequence: Synthetic probe
tcgcgaggcttgtctcaagaacggaaacgtccacatcgctaacctgtgtaaagtgaa

SEQ ID NO: 727 - DNA, 60 bp, Artificial Sequence
  Description of Artificial Sequence: Synthetic probe
tgtgtaacttcgacctgttaaagttggctggagatgttgagtccaaccctgggcccttct

SEQ ID NO: 728 - DNA, 60 bp, Artificial Sequence
  Description of Artificial Sequence: Synthetic probe
caatcctgcgctcggctacgtactacttctgtgacctggaggttgctgtcttgggctcgg

SEQ ID NO: 729 - DNA, 60 bp, Artificial Sequence
  Description of Artificial Sequence: Synthetic probe
tgtcaacagacacgaccaggcaaagatgcacaaggcgtggacactcgtggtggcggtgct

SEQ ID NO: 730 - DNA, 60 bp, Artificial Sequence
  Description of Artificial Sequence: Synthetic probe
ccaacaccagtgggctcgagacacgcgtcgaacaagcggagagattcttcaaggagaaac

SEQ ID NO: 731 - DNA, 60 bp, Artificial Sequence
  Description of Artificial Sequence: Synthetic probe
ccatgactctggccgatttccacgccggaattttcatcaagggtactgaacacgccgtgt

SEQ ID NO: 732 - DNA, 60 bp, Artificial Sequence
  Description of Artificial Sequence: Synthetic probe
ggttccgacacacgttcaagacagacaggaagatggaattcacactctacaacggtgaga

SEQ ID NO: 733 - DNA, 60 bp, Artificial Sequence
  Description of Artificial Sequence: Synthetic probe
atgagaaatgggacgtctgcacacgaaacgcgccgttgctctttgcgttcttgtacaaac

SEQ ID NO: 734 - DNA, 60 bp, Artificial Sequence
  Description of Artificial Sequence: Synthetic probe
agatgataccgcctctcccggcgttaattggatgcaaccacaagatgaaccttcacccgg

SEQ ID NO: 735 - DNA, 60 bp, Artificial Sequence
  Description of Artificial Sequence: Synthetic probe
cgaggaggttttccgtgaggaatttggatttcatccgaacgctatttggattctcaaaac

SEQ ID NO: 736 - DNA, 60 bp, Artificial Sequence
  Description of Artificial Sequence: Synthetic probe
tccgcgagactcgcaagcgccagaagatggttgacgacgtccttgatgagtacattgaga

SEQ ID NO: 737 - DNA, 60 bp, Artificial Sequence
  Description of Artificial Sequence: Synthetic probe
ggagaacgctcgcgaggcctgcctcaagaatggaaaccatcacattgccaacctgtgtaa

SEQ ID NO: 738 - DNA, 60 bp, Artificial Sequence
  Description of Artificial Sequence: Synthetic probe
gcttgccacagtctacaatggtgactgcaagtacaaacccactggcaccgcaccccgcga

SEQ ID NO: 739 - DNA, 60 bp, Artificial Sequence
  Description of Artificial Sequence: Synthetic probe
aacaaggccaagtacatggtggcgtacatcccacctggcacacaccctctccccgacaca

SEQ ID NO: 740 - DNA, 60 bp, Artificial Sequence
  Description of Artificial Sequence: Synthetic probe
ttggccgacagggagaagtaccaacttactcttttcccacaccagttcctgaacccacgc

SEQ ID NO: 741 - DNA, 60 bp, Artificial Sequence
  Description of Artificial Sequence: Synthetic probe
gccgataagttcctccctggcccaaacaccaacgggctggagacgagagtggaacaagca

SEQ ID NO: 742 - DNA, 60 bp, Artificial Sequence
  Description of Artificial Sequence: Synthetic probe
ccgcggagcaggtcagtcgtcaccagctacagggacacaaaatcaatctggtaacactgg

SEQ ID NO: 743 - DNA, 60 bp, Artificial Sequence
  Description of Artificial Sequence: Synthetic probe
gggccacccgctctcgtcctctggctgatcaaggattgtcttcaaactggcgttggcact

SEQ ID NO: 744 - DNA, 60 bp, Artificial Sequence
  Description of Artificial Sequence: Synthetic probe
ccacacgacttaccgtcttttccgacgttaacggattgtaaccacacgataataccttct

SEQ ID NO: 745 - DNA, 57 bp, Artificial Sequence
  Description of Artificial Sequence: Synthetic probe
cgcctcagaagagaagtatgtcaccatgacggacctggtgcccggtatccttgaaaa

SEQ ID NO: 746 - DNA, 60 bp, Artificial Sequence
  Description of Artificial Sequence: Synthetic probe
aggccgattcttccgattcagccaacggacgatagacacaagcaaccgctcgtcgcacct

SEQ ID NO: 747 - DNA, 58 bp, Artificial Sequence
  Description of Artificial Sequence: Synthetic probe
gacgccgatgcgctcgtcgtctccgcatcagcggggaaagactttgagctccggctac

SEQ ID NO: 748 - DNA, 60 bp, Artificial Sequence
  Description of Artificial Sequence: Synthetic probe
caacatgtgtacaggggtgggtctgtgtgtaccaaatcactcacggcaaggcagacgccg

SEQ ID NO: 749 - DNA, 59 bp, Artificial Sequence
  Description of Artificial Sequence: Synthetic probe
cttccccgttgcggtttctgccggttacggccacttggtgacaactgacccgaaaacgg

SEQ ID NO: 750 - DNA, 60 bp, Artificial Sequence
  Description of Artificial Sequence: Synthetic probe
cgctcatcgacttcgagaacggtactgtcggacccgaggttgaggctgccttgaagctca

SEQ ID NO: 751 - DNA, 60 bp, Artificial Sequence
  Description of Artificial Sequence: Synthetic probe
gctgaggcgtgccctacgtttctgcactttgagggtggcgtgccgtacgtgaccacaaag

SEQ ID NO: 752 - DNA, 57 bp, Artificial Sequence
  Description of Artificial Sequence: Synthetic probe
cacctcgcaacatgttgccggggcggttcaccaacttccttgacgtggctgaggcgt

SEQ ID NO: 753 - DNA, 60 bp, Artificial Sequence
  Description of Artificial Sequence: Synthetic probe
cagaagattattgcacctgcaaaacagcttttgaactttgacctgctcaagttggctggg

SEQ ID NO: 754 - DNA, 60 bp, Artificial Sequence
  Description of Artificial Sequence: Synthetic probe
gctgccttgtctaacaaggacccgcgactgaacgaaggcgttgtcctcgatgaagtcatc

SEQ ID NO: 755 - DNA, 60 bp, Artificial Sequence
  Description of Artificial Sequence: Synthetic probe
gacggctcccacactgacgttgccttcgttctcgacaggtttgtgaaactcactgcaccc

SEQ ID NO: 756 - DNA, 60 bp, Artificial Sequence
  Description of Artificial Sequence: Synthetic probe
tttgtgcggacgaacgccgctcgcgcacctcgcgtgaccggttagtactcttaccactta

SEQ ID NO: 757 - DNA, 60 bp, Artificial Sequence
  Description of Artificial Sequence: Synthetic probe
ggtcagtactcttaccactctccgcctacttggtcgccagcgctgttttgggcactcctg

SEQ ID NO: 758 - DNA, 60 bp, Artificial Sequence
  Description of Artificial Sequence: Synthetic probe
cgcataacccctcagatgtcacaattggcagaaagactctgaggcgagcgacgccgtagg

SEQ ID NO: 759 - DNA, 60 bp, Artificial Sequence
  Description of Artificial Sequence: Synthetic probe
gggacctcaacgacccaagcaagtacaaggatgccaaggaatggctcgacaacacgcgcc

SEQ ID NO: 760 - DNA, 60 bp, Artificial Sequence
  Description of Artificial Sequence: Synthetic probe
ccccagatatcacaattggcacagtgattttggggcgcgcgacgccgtaggagtgaaaag

SEQ ID NO: 761 - DNA, 60 bp, Artificial Sequence
  Description of Artificial Sequence: Synthetic probe
accgcgtagccattttagctggactgtccggacgaacgccacttgcgcaccccgcgtgac

SEQ ID NO: 762 - DNA, 60 bp, Artificial Sequence
  Description of Artificial Sequence: Synthetic probe
ccatggacacacaacctggtgacaacgctactagcggaggctccaacgaaggctccacag

SEQ ID NO: 763 - DNA, 60 bp, Artificial Sequence
  Description of Artificial Sequence: Synthetic probe
ggtctatgccaacatcgcccctaccaacgtgcacgtcgcgggtgagttcccttctaagga

SEQ ID NO: 764 - DNA, 60 bp, Artificial Sequence
  Description of Artificial Sequence: Synthetic probe
gactacagagtgtttgagtttgagactaaagtgaaaggacaggacatgctctcagacgcc

SEQ ID NO: 765 - DNA, 60 bp, Artificial Sequence
  Description of Artificial Sequence: Synthetic probe
acttgctcaacaccggaatcggcaccgcttcgcgacccaacgaagtgtgcatggtagacg

SEQ ID NO: 766 - DNA, 60 bp, Artificial Sequence
  Description of Artificial Sequence: Synthetic probe
gcttccacccaaatgcagagtggatcctgaaaaccctcgtgaacacggaacacgcctatg

SEQ ID NO: 767 - DNA, 60 bp, Artificial Sequence
  Description of Artificial Sequence: Synthetic probe
ggacggggctgacacattcatcgtcggcacccactctgcaggtggcaacggagttggata

SEQ ID NO: 768 - DNA, 60 bp, Artificial Sequence
  Description of Artificial Sequence: Synthetic probe
acacaaagcgcgcgacgacgtgaaatctgagcccgcccagcctactgaagagcaaccaca

SEQ ID NO: 769 - DNA, 54 bp, Artificial Sequence
  Description of Artificial Sequence: Synthetic probe
tccacacccgaagaccttgagagggcagagaaacagctcaaagcacgtgacatt

SEQ ID NO: 770 - DNA, 60 bp, Artificial Sequence
  Description of Artificial Sequence: Synthetic probe
cgtgcgcatgaaacgagctgagctctactgtcctaggccgctgctggcaatagaggtgtc

SEQ ID NO: 771 - DNA, 60 bp, Artificial Sequence
  Description of Artificial Sequence: Synthetic probe
ggatcttcccagttgcgtgcgcggacggttatggagggctggtgacaacagacccgaaaa

SEQ ID NO: 772 - DNA, 60 bp, Artificial Sequence
  Description of Artificial Sequence: Synthetic probe
ttctggaagaccgcatcctcaccactcgcaacggacacaccacctcgaccacccagtcga

SEQ ID NO: 773 - DNA, 60 bp, Artificial Sequence
  Description of Artificial Sequence: Synthetic probe
gggcaatccagcccagtaacaggctcgcagaaccagtcgggcaacaccggcagcataatt

SEQ ID NO: 774 - DNA, 60 bp, Artificial Sequence
  Description of Artificial Sequence: Synthetic probe
ggacccatcatgtgtgcagccccagcacggcaacttttctgggaaacccactttaaggtg

SEQ ID NO: 775 - DNA, 60 bp, Artificial Sequence
  Description of Artificial Sequence: Synthetic probe
tgatggggccgtttcgcgcgggctgatcccatggcctgctttggctgacgcccgaaaacc

SEQ ID NO: 776 - DNA, 60 bp, Artificial Sequence
  Description of Artificial Sequence: Synthetic probe
gcggaacggttctttaagaagcacttgtttgactggacaccgaacttggcatttgggcat

SEQ ID NO: 777 - DNA, 60 bp, Artificial Sequence
  Description of Artificial Sequence: Synthetic probe
agggagccgggcaatccagcccagcgactgggtcgcagaaccagtcaggtaacactggaa

SEQ ID NO: 778 - DNA, 60 bp, Artificial Sequence
  Description of Artificial Sequence: Synthetic probe
actacgacctacaccgccagtgcacgcggggattcggctcacctaacgacgacgcatgct

SEQ ID NO: 779 - DNA, 60 bp, Artificial Sequence
  Description of Artificial Sequence: Synthetic probe
actcgatgccatggagcctgacacagcacccggtcttccttgggccctccaggggaagcg

SEQ ID NO: 780 - DNA, 60 bp, Artificial Sequence
  Description of Artificial Sequence: Synthetic probe
cggcttccgtgagagaaaactccctggacacaagactgacaatgatgtgaactctgagcc

SEQ ID NO: 781 - DNA, 60 bp, Artificial Sequence
  Description of Artificial Sequence: Synthetic probe
ccacagggttcatcccgcccatggcctcactcgaagataaggggaaaccgttcaacagca

SEQ ID NO: 782 - DNA, 60 bp, Artificial Sequence
  Description of Artificial Sequence: Synthetic probe
tactgcccgcgacctctcctcacgcactatgatcatgccggcaaggatcgctacaagacc

SEQ ID NO: 783 - DNA, 60 bp, Artificial Sequence
  Description of Artificial Sequence: Synthetic probe
agactacgtctgctggtgagggtgcagagcccgtcacgactgacgcttcccaacacggtg

SEQ ID NO: 784 - DNA, 60 bp, Artificial Sequence
  Description of Artificial Sequence: Synthetic probe
ggttacggtggcttccaaaacacagaccccaaaacctcggatcccgtgtacgggcacgtg

SEQ ID NO: 785 - DNA, 60 bp, Artificial Sequence
  Description of Artificial Sequence: Synthetic probe
agccactggacgtagattggcaggatcgagccggtctgttcctccgcggtgcaggacaat

SEQ ID NO: 786 - DNA, 60 bp, Artificial Sequence
  Description of Artificial Sequence: Synthetic probe
gcaggcccaacacccacgggaactgttggctcaactcactcctgcagctctttcgatacg

SEQ ID NO: 787 - DNA, 60 bp, Artificial Sequence
  Description of Artificial Sequence: Synthetic probe
ctgcgcacgaaacgcgccgttgctctttgcattcttgtacaaacacgatcttacgcagga

SEQ ID NO: 788 - DNA, 60 bp, Artificial Sequence
  Description of Artificial Sequence: Synthetic probe
aggaaccacccttctggggcctacgcatggccgcccttttggggcccgcggtcgtcatca

SEQ ID NO: 789 - DNA, 58 bp, Artificial Sequence
  Description of Artificial Sequence: Synthetic probe
cctggcctcttcgcctacaaagctgccaccaaggcaggctactgtggaggagccgttc

SEQ ID NO: 790 - DNA, 60 bp, Artificial Sequence
  Description of Artificial Sequence: Synthetic probe
accacaccaacccgactgcctaccagaagaaacccatcacccgcctggcgctcccctaca

SEQ ID NO: 791 - DNA, 54 bp, Artificial Sequence
  Description of Artificial Sequence: Synthetic probe
aatggaattcacgctacacgacggcgagaaaatggtatttgttccatacgacca

SEQ ID NO: 792 - DNA, 60 bp, Artificial Sequence
  Description of Artificial Sequence: Synthetic probe
ttgccccagcacccagcaggtcgaggcccgaacccgtagtcgtttgcctccgtggcaaat

SEQ ID NO: 793 - DNA, 60 bp, Artificial Sequence
  Description of Artificial Sequence: Synthetic probe
ctggtggccatggtccctgaatggaaagagctcaccccgcgtgagaagtaccagctcact

SEQ ID NO: 794 - DNA, 60 bp, Artificial Sequence
  Description of Artificial Sequence: Synthetic probe
ccgtcgttcccgacgtaaaagggaggtaaccataagcttgacgccgtctgtcccgacgtt

SEQ ID NO: 795 - DNA, 60 bp, Artificial Sequence
  Description of Artificial Sequence: Synthetic probe
ccatgcttctcaaaatgaaggcacacatcgaccctgaaccgcaccacgaggggttggtcg

SEQ ID NO: 796 - DNA, 60 bp, Artificial Sequence
  Description of Artificial Sequence: Synthetic probe
ggagacgacatagtggtggcaagtgattacgacttggattttgaggctcttaagccgcac

SEQ ID NO: 797 - DNA, 60 bp, Artificial Sequence
  Description of Artificial Sequence: Synthetic probe
gtgctcagatgcactcaaacaatggaccgcaaattggctcagcggttggttgtaatccag

SEQ ID NO: 798 - DNA, 57 bp, Artificial Sequence
  Description of Artificial Sequence: Synthetic probe
acctgtcagaccttcctgaaggacgaagttcgcccgatggagaaagtacgtgccggc

SEQ ID NO: 799 - DNA, 60 bp, Artificial Sequence
  Description of Artificial Sequence: Synthetic probe
ccccactgagcatctacgaggcaataaaaggcgttgacggccttgacgccatggaaccag

SEQ ID NO: 800 - DNA, 60 bp, Artificial Sequence
  Description of Artificial Sequence: Synthetic probe
cgagggactggtacacgactccatcaaggaggagcttcgtcccctcatccaacagacttc

SEQ ID NO: 801 - DNA, 60 bp, Artificial Sequence
  Description of Artificial Sequence: Synthetic probe
ggcatggccgttgagatgaagagaatgcagcaagacatgtttaagcctcaaccacccctc

SEQ ID NO: 802 - DNA, 51 bp, Artificial Sequence
  Description of Artificial Sequence: Synthetic probe
caaagtggtcaccccagcacctagcaagtcgagacctgaacctgtggtcgt

SEQ ID NO: 803 - DNA, 60 bp, Artificial Sequence
  Description of Artificial Sequence: Synthetic probe
aagtactccgcaggtggtatgggcagacggggcgacctagagcctctcgcggcgagggtc

SEQ ID NO: 804 - DNA, 60 bp, Artificial Sequence
  Description of Artificial Sequence: Synthetic probe
catgctgtgtttgcctgcgtcacctccgacgggtggtacgcgatcgacgatgaggacttt

SEQ ID NO: 805 - DNA, 60 bp, Artificial Sequence
  Description of Artificial Sequence: Synthetic probe
ccgtcttgtccgacgttaaagggctgtagccacaagcttgcaccgcctttcccggcgtaa

SEQ ID NO: 806 - DNA, 60 bp, Artificial Sequence
  Description of Artificial Sequence: Synthetic probe
aacagcacaggccctggaccctcgtggtcatggttgttgcgccactcaccacaaacacag

SEQ ID NO: 807 - DNA, 60 bp, Artificial Sequence
  Description of Artificial Sequence: Synthetic probe
acacaaccaatcccactgcctaccacaagaggccgctaactcggctggctctcccgtaca

SEQ ID NO: 808 - DNA, 60 bp, Artificial Sequence
  Description of Artificial Sequence: Synthetic probe
tctcccctgggctctccaagggaaacgccgcggcgtcctgatcgacttcgaaaacggcac

SEQ ID NO: 809 - DNA, 60 bp, Artificial Sequence
  Description of Artificial Sequence: Synthetic probe
gctttaaaagtgaaagcaaagaacttgatagtcactgagagtggtgcgccaccgaccgac

SEQ ID NO: 810 - DNA, 60 bp, Artificial Sequence
  Description of Artificial Sequence: Synthetic probe
caagacatgttcaagcctcaaccacccttccagaacatctaccagctcgttcaggaggtg

SEQ ID NO: 811 - DNA, 60 bp, Artificial Sequence
  Description of Artificial Sequence: Synthetic probe
cggcaaatccggcacaaggaaaagcatcctcgcgaacgtgctcgcgcaggcaatttccac

SEQ ID NO: 812 - DNA, 60 bp, Artificial Sequence
  Description of Artificial Sequence: Synthetic probe
cagcaagtcgagacccgaaccagtggtcgtgtgccttcgcggcaaatccggcacaaggaa

SEQ ID NO: 813 - DNA, 60 bp, Artificial Sequence
  Description of Artificial Sequence: Synthetic probe
cagcagtaccagaactcaatggacccacaacttggcgacaacgccattagtggagggtcc

SEQ ID NO: 814 - DNA, 58 bp, Artificial Sequence
  Description of Artificial Sequence: Synthetic probe
aagttttaccgtcgttcccgacgtttgaagggaggaaaccacacgcttgcaccacccc

SEQ ID NO: 815 - DNA, 58 bp, Artificial Sequence
  Description of Artificial Sequence: Synthetic probe
cgccgcggagctctcattgatttcgagaacggcactgtcggacccgagattgaacagg

SEQ ID NO: 816 - DNA, 60 bp, Artificial Sequence
  Description of Artificial Sequence: Synthetic probe
accacaagctgaaggaccctacgcaggaccgctcgagcgacagcagccgctgaagctcaa

SEQ ID NO: 817 - DNA, 60 bp, Artificial Sequence
  Description of Artificial Sequence: Synthetic probe
tcagtttcggagccccgattctgctggcaggcttggtcaaagtcgcctccacgttcttcc

SEQ ID NO: 818 - DNA, 60 bp, Artificial Sequence
  Description of Artificial Sequence: Synthetic probe
caactttggacatgttaccgcagaccaaccagttgacgtgtactacaggatgaagcgtgc

SEQ ID NO: 819 - DNA, 60 bp, Artificial Sequence
  Description of Artificial Sequence: Synthetic probe
gacccctcaacccacggagggcaagtcaaggagaagagacggatgcacacagacgttgca

SEQ ID NO: 820 - DNA, 60 bp, Artificial Sequence
  Description of Artificial Sequence: Synthetic probe
cacaggtcccactcaccacaaagcaaagttcatggtggcgtacatcccgccaggcattga

SEQ ID NO: 821 - DNA, 60 bp, Artificial Sequence
  Description of Artificial Sequence: Synthetic probe
tctccctgtacccgcaccagttcatcaaccctaggaccaacaccacggcacacatccagg

SEQ ID NO: 822 - DNA, 60 bp, Artificial Sequence
  Description of Artificial Sequence: Synthetic probe
ccacgcgacacggtaccaccacgtccacaacacagagctcagttggtatcacctacgggt

SEQ ID NO: 823 - DNA, 60 bp, Artificial Sequence
  Description of Artificial Sequence: Synthetic probe
tacccgtggacacctgaccctgagaacgtactcgcatacgtgccctacgaccaggaacct

SEQ ID NO: 824 - DNA, 60 bp, Artificial Sequence
  Description of Artificial Sequence: Synthetic probe
aggaaccacccttttggggcctacgtattaccgcccttttggggcccgcggtcgtcatca

SEQ ID NO: 825 - DNA, 60 bp, Artificial Sequence
  Description of Artificial Sequence: Synthetic probe
catctggaacatcaagcacctgctccacaccggaatcggcaccgcctcgcgacccagcga

SEQ ID NO: 826 - DNA, 60 bp, Artificial Sequence
  Description of Artificial Sequence: Synthetic probe
ggacctgactttaaccggttagtgtccgcttttgaggaactggccagtggagtgaaagcc

SEQ ID NO: 827 - DNA, 60 bp, Artificial Sequence
  Description of Artificial Sequence: Synthetic probe
ccttgaacaaccacaccaacccgactgcctaccagaagcagcctatcacccgcttggcac

SEQ ID NO: 828 - DNA, 60 bp, Artificial Sequence
  Description of Artificial Sequence: Synthetic probe
gccgaacggttcttcaaaacccacctgttcgactgggtcaccagtgacccgtttggacgg

SEQ ID NO: 829 - DNA, 54 bp, Artificial Sequence
  Description of Artificial Sequence: Synthetic probe
gactgggtcaccagtgactcattcggacgttaccacctcctggaactcccgacc

SEQ ID NO: 830 - DNA, 60 bp, Artificial Sequence
  Description of Artificial Sequence: Synthetic probe
aggccactaccatccacgagcttctcgtgcgtatgaaacgggccgagctctactgtccca

SEQ ID NO: 831 - DNA, 60 bp, Artificial Sequence
  Description of Artificial Sequence: Synthetic probe
aacgggacgaacaagtaccccgtgggcgcttcggggatacgaggtgatttggggcctctt

SEQ ID NO: 832 - DNA, 60 bp, Artificial Sequence
  Description of Artificial Sequence: Synthetic probe
acttctccgacctggagattgttgtgcggcacgaaggcaacctgacctgggtacccaacg

SEQ ID NO: 833 - DNA, 60 bp, Artificial Sequence
  Description of Artificial Sequence: Synthetic probe
tcacagaccactgctaccggggagtcagcagaccctgtcaccaccaccgtagagaactac

SEQ ID NO: 834 - DNA, 60 bp, Artificial Sequence
  Description of Artificial Sequence: Synthetic probe
atgttcacaggctccactgattcaaaagcccgctacatggtggcctacgtcccgcctggg

SEQ ID NO: 835 - DNA, 60 bp, Artificial Sequence
  Description of Artificial Sequence: Synthetic probe
aggactggtgacgacagacccgaagacagctgaccctgcatacggcaaggtgtacaaccc

SEQ ID NO: 836 - DNA, 60 bp, Artificial Sequence
  Description of Artificial Sequence: Synthetic probe
gccctggacattggttgtcatggttgtgtcgccactcacggttagcgccacgagtgcaac

SEQ ID NO: 837 - DNA, 60 bp, Artificial Sequence
  Description of Artificial Sequence: Synthetic probe
ggcgccctgctcgccgataagaaaacggaagagacaacacttctagaggatcgcatcctc

SEQ ID NO: 838 - DNA, 60 bp, Artificial Sequence
  Description of Artificial Sequence: Synthetic probe
ccactcaacggagaatggaaaactaaagttcagcagaagcttaagggagccggacaatcc

SEQ ID NO: 839 - DNA, 60 bp, Artificial Sequence
  Description of Artificial Sequence: Synthetic probe
cggcgttaacgggatgtaacaataagatctaccttcgcccggaagtaaaacggtaaatac

SEQ ID NO: 840 - DNA, 60 bp, Artificial Sequence
  Description of Artificial Sequence: Synthetic probe
gcgctcattgacttcgagaacggcactgtcggacccgaggtagaagctgccttgaagctc

SEQ ID NO: 841 - DNA, 60 bp, Artificial Sequence
  Description of Artificial Sequence: Synthetic probe
gcgctcattgacttcgagaacggcactgtcggacccgaggttgaagctgccttagagctc

SEQ ID NO: 842 - DNA, 60 bp, Artificial Sequence
  Description of Artificial Sequence: Synthetic probe
tggactttgaagcactcaagcctcacttcaaatctgtcggtcagaccatcaccccagctg

SEQ ID NO: 843 - DNA, 60 bp, Artificial Sequence
  Description of Artificial Sequence: Synthetic probe
cctgctgcactgtccaacaatgacaagcgcctgaacgagggagttgtcctcgacgaggtg

SEQ ID NO: 844 - DNA, 60 bp, Artificial Sequence
  Description of Artificial Sequence: Synthetic probe
tgaactccgagcccactaaacctgaggagaaaccaaaggctgaaggaccctacgccgggc

SEQ ID NO: 845 - DNA, 60 bp, Artificial Sequence
  Description of Artificial Sequence: Synthetic probe
cagtggtcgtttgcctccgtggtaaatctggccaaggtaaaagtttccttgcgaacgtgc

SEQ ID NO: 846 - DNA, 60 bp, Artificial Sequence
  Description of Artificial Sequence: Synthetic probe
tccagtgttttccacgtgccagcccctgtcttcagtttcggggctccgatcctgttggca

SEQ ID NO: 847 - DNA, 60 bp, Artificial Sequence
  Description of Artificial Sequence: Synthetic probe
caacttcgggtttgtgaccgccgacgagccagtcgacgtttactaccggatgaagcgtgc

SEQ ID NO: 848 - DNA, 60 bp, Artificial Sequence
  Description of Artificial Sequence: Synthetic probe
tctgaatgggacacaggtctgaactcgagctacacgttcgcggtaccatacctgtcgtcc

SEQ ID NO: 849 - DNA, 60 bp, Artificial Sequence
  Description of Artificial Sequence: Synthetic probe
ctgtacgtgttggagttgcccaaagatcacaagggtatttacggtaaactcaccgactcc

SEQ ID NO: 850 - DNA, 60 bp, Artificial Sequence
  Description of Artificial Sequence: Synthetic probe
gagcatgccgtgttcgccctgttgacttccgacggatggtacgccatagacgatgaggac

SEQ ID NO: 851 - DNA, 60 bp, Artificial Sequence
  Description of Artificial Sequence: Synthetic probe
ttccgttcacccacctctggctggacctgctgcaccgcacctggcccggacagctggact

SEQ ID NO: 852 - DNA, 58 bp, Artificial Sequence
  Description of Artificial Sequence: Synthetic probe
ccccggacgaacatgacggcgcatatcactgtgccctttgttggcgtcaaccgctacg

SEQ ID NO: 853 - DNA, 60 bp, Artificial Sequence
  Description of Artificial Sequence: Synthetic probe
ccgcttcgtgcgagttgattggtgtgttacggctgtcacccaaagcccacctttcacccc

SEQ ID NO: 854 - DNA, 60 bp, Artificial Sequence
  Description of Artificial Sequence: Synthetic probe
cgttgggtgaacgccgtgtgcggcgacgcataatccctcagagatcacaattggacactg

SEQ ID NO: 855 - DNA, 60 bp, Artificial Sequence
  Description of Artificial Sequence: Synthetic probe
ggtacggtcggacccgaagtcgaggctgcccttaagctcatggagaaaagagagtacaag

SEQ ID NO: 856 - DNA, 60 bp, Artificial Sequence
  Description of Artificial Sequence: Synthetic probe
actgtggaggggccgttctcgccaaggacggagctgacacgttcatcgttggcactcact

SEQ ID NO: 857 - DNA, 60 bp, Artificial Sequence
  Description of Artificial Sequence: Synthetic probe
actcttttggcaaacatagtgatcatgattcgtgaaacccgcaagaggcagcagatggtg

SEQ ID NO: 858 - DNA, 60 bp, Artificial Sequence
  Description of Artificial Sequence: Synthetic probe
ccacccacttcactggcaaaaccgattcagtttggtattgcccacctgaccctgaccact

SEQ ID NO: 859 - DNA, 60 bp, Artificial Sequence
  Description of Artificial Sequence: Synthetic probe
cgtgcgcatgaaacgggccgagctttactgccccaggccactactggcaatagaagtgtc

SEQ ID NO: 860 - DNA, 60 bp, Artificial Sequence
  Description of Artificial Sequence: Synthetic probe
tacatcccgcctggagtggaagcgccaccagacacacctgaaagggccgctcactgcata

SEQ ID NO: 861 - DNA, 60 bp, Artificial Sequence
  Description of Artificial Sequence: Synthetic probe
ggtgcctcctggtggccatggtaccggagtggaaagagtttgagcagcgcgagaaatacc

SEQ ID NO: 862 - DNA, 60 bp, Artificial Sequence
  Description of Artificial Sequence: Synthetic probe
cttctggaagaccgcattcttaccacccgcaacgggcacaccatctcgaccacccaatcg

SEQ ID NO: 863 - DNA, 60 bp, Artificial Sequence
  Description of Artificial Sequence: Synthetic probe
ccactcaacggggactggaaggcgatggttcagaggaagcttaagggcgccggtcaatct

SEQ ID NO: 864 - DNA, 60 bp, Artificial Sequence
  Description of Artificial Sequence: Synthetic probe
acggtggtggggccacttcgcgtgggctggtcgcctgtcctgcttcggctgttgcccaaa

SEQ ID NO: 865 - DNA, 60 bp, Artificial Sequence
  Description of Artificial Sequence: Synthetic probe
tgagaacctcacgctctcggccatcgagcagctggaggaaatcaccgggcttgagttgca

SEQ ID NO: 866 - DNA, 60 bp, Artificial Sequence
  Description of Artificial Sequence: Synthetic probe
ctacagatcactttacctgcgttgggtggacgccgtgtgcggtgacgcataatccctcag

SEQ ID NO: 867 - DNA, 60 bp, Artificial Sequence
  Description of Artificial Sequence: Synthetic probe
gaatacaagtttgcttcgcagaccttcctgaaagacgaaattcgtccgatggagaaagtg

SEQ ID NO: 868 - DNA, 60 bp, Artificial Sequence
  Description of Artificial Sequence: Synthetic probe
tctccaaacacaagggagacaccaagatgtcagaggaggacaaagcgctgttccgccgct

SEQ ID NO: 869 - DNA, 60 bp, Artificial Sequence
  Description of Artificial Sequence: Synthetic probe
gtgtgtttgcccctgaatttggccccgctgctttgtccaacaaggacccgcggctgaatg

SEQ ID NO: 870 - DNA, 60 bp, Artificial Sequence
  Description of Artificial Sequence: Synthetic probe
cgtcatcttttcgcagagaagtatgacaggatcatgctggacggtagagccatgacagac

SEQ ID NO: 871 - DNA, 58 bp, Artificial Sequence
  Description of Artificial Sequence: Synthetic probe
tccctgggcgcttcacaaacttccttgacgttgcggaggcatgtccaaccttcctccg

SEQ ID NO: 872 - DNA, 60 bp, Artificial Sequence
  Description of Artificial Sequence: Synthetic probe
agttcccgtttcgtgcgcggacggttatggcaacatggtgacaacggacccgaagactgc

SEQ ID NO: 873 - DNA, 60 bp, Artificial Sequence
  Description of Artificial Sequence: Synthetic probe
cgggctgcaaccacacgcttgtaccgctttcccctgcgttaaaggggtgtaaccacaaga

SEQ ID NO: 874 - DNA, 60 bp, Artificial Sequence
  Description of Artificial Sequence: Synthetic probe
tataactctccgcctacatggtcgtcagcgctgtcctgggcacacccgttggggaccgtt

SEQ ID NO: 875 - DNA, 60 bp, Artificial Sequence
  Description of Artificial Sequence: Synthetic probe
ggggcgctagggtctcactcctagaatgccaacgactgctcctgcgttgtactccaaact

SEQ ID NO: 876 - DNA, 60 bp, Artificial Sequence
  Description of Artificial Sequence: Synthetic probe
tttgagctaaggctgccggtggacgcccgtgtggaaaccacttctgcgggcgagtcagcg

SEQ ID NO: 877 - DNA, 60 bp, Artificial Sequence
  Description of Artificial Sequence: Synthetic probe
ggcggccgcgcactgcattcatgctgaatgggacactgggttgaactcgaagtttacttt

SEQ ID NO: 878 - DNA, 60 bp, Artificial Sequence
  Description of Artificial Sequence: Synthetic probe
gtgcaggcagagcggttctttaaaacccacttgttcgactgggtcaccagtgacccgttc

SEQ ID NO: 879 - DNA, 60 bp, Artificial Sequence
  Description of Artificial Sequence: Synthetic probe
agatgaaggcacacattgaccccgaaccacaccacgaggggttgatcgttgacaccagag

SEQ ID NO: 880 - DNA, 57 bp, Artificial Sequence
  Description of Artificial Sequence: Synthetic probe
gtgatcatggtccgcgagactcgcaagaggcagaagatggtggatgatgcagtgaac

SEQ ID NO: 881 - DNA, 60 bp, Artificial Sequence
  Description of Artificial Sequence: Synthetic probe
ggcagaaaatggtggatgatgcagtgaatgagtacattgagagagcaaacatcaccacag

SEQ ID NO: 882 - DNA, 60 bp, Artificial Sequence
  Description of Artificial Sequence: Synthetic probe
gtttacagggcccactgacgcgaaagcgcgttacatgattgcttatgccccaccgggcat

SEQ ID NO: 883 - DNA, 60 bp, Artificial Sequence
  Description of Artificial Sequence: Synthetic probe
gtttacagggcccactgacgcgaaagcgcgttacatgattgcttatgccccaccaggcat

SEQ ID NO: 884 - DNA, 60 bp, Artificial Sequence
  Description of Artificial Sequence: Synthetic probe
cagtcaagcgttggagtcacatacgggtacgcaacagctgaggatttcgtgagcggaccg

SEQ ID NO: 885 - DNA, 59 bp, Artificial Sequence
  Description of Artificial Sequence: Synthetic probe
cccctcgagcgacagcagccgctgaaactcagggctaagctccctcaggccgagggacc

SEQ ID NO: 886 - DNA, 60 bp, Artificial Sequence
  Description of Artificial Sequence: Synthetic probe
ttcagtttcggagccccgatcctgatggcaggtctggtcaaggtcgcctccacgttcttc

SEQ ID NO: 887 - DNA, 60 bp, Artificial Sequence
  Description of Artificial Sequence: Synthetic probe
cggctctcaccaaacctgccaaacagttgtgtaacttcgacctgttaaagttggccggag

SEQ ID NO: 888 - DNA, 60 bp, Artificial Sequence
  Description of Artificial Sequence: Synthetic probe
caccacccgtttcgcactcccttacacggcgccccacagggtgctcgccacaacctacaa

SEQ ID NO: 889 - DNA, 60 bp, Artificial Sequence
  Description of Artificial Sequence: Synthetic probe
tgtcatcactgtcagcgcaggtcccgacttcgagttcagaatgcccatcagcccatcgcg

SEQ ID NO: 890 - DNA, 60 bp, Artificial Sequence
  Description of Artificial Sequence: Synthetic probe
gcacacacccgctccccgaaacaccggagcaggcgtcacactgttaccatgccgagtggg

SEQ ID NO: 891 - DNA, 60 bp, Artificial Sequence
  Description of Artificial Sequence: Synthetic probe
gaacgctctaccctggcagattcaccaacctgctagacgtggcagaagcgtgcccaacac

SEQ ID NO: 892 - DNA, 60 bp, Artificial Sequence
  Description of Artificial Sequence: Synthetic probe
ctcacatcctggaactccccacagaccacaagggcatctatgggcagttggttgattcgc

SEQ ID NO: 893 - DNA, 60 bp, Artificial Sequence
  Description of Artificial Sequence: Synthetic probe
acgtggattggcaggaccgcgctggtctgttcctccgcggagcgggccagtcatcacctg

SEQ ID NO: 894 - DNA, 60 bp, Artificial Sequence
  Description of Artificial Sequence: Synthetic probe
gacaactgactgctttaacgttttgctcgagatctatcacaggttcagacagacgttcaa

SEQ ID NO: 895 - DNA, 60 bp, Artificial Sequence
  Description of Artificial Sequence: Synthetic probe
ggactccaagtacttcgcccaaatggtttcaactacggggtttatcccgcccatggcctc

SEQ ID NO: 896 - DNA, 60 bp, Artificial Sequence
  Description of Artificial Sequence: Synthetic probe
tgtaatgacgtgaactccgagcctgcccggcccgctgaagagcaaccacaagctgaagga

SEQ ID NO: 897 - DNA, 60 bp, Artificial Sequence
  Description of Artificial Sequence: Synthetic probe
acgggacgaacaagtactccgcgagcggttcgggagtgcgaggcgattcggggtctctcg

SEQ ID NO: 898 - DNA, 60 bp, Artificial Sequence
  Description of Artificial Sequence: Synthetic probe
ccatcaacctgcacttcatgttcacaggctctactgactcaaaagcccgctacatggtgg

SEQ ID NO: 899 - DNA, 60 bp, Artificial Sequence
  Description of Artificial Sequence: Synthetic probe
gtgcaaccccagcacagcaacttttctgcgaaactcacttcaaggtgacactgatactgg

SEQ ID NO: 900 - DNA, 60 bp, Artificial Sequence
  Description of Artificial Sequence: Synthetic probe
acttcaagtactttgcccaaatggtatccaccacggggttcatcccgcctatggcctcgc

SEQ ID NO: 901 - DNA, 59 bp, Artificial Sequence
  Description of Artificial Sequence: Synthetic probe
tggtaccggagctccgttccatcagcaagagagagttgtaccagcttacgcttttcccc

SEQ ID NO: 902 - DNA, 60 bp, Artificial Sequence
  Description of Artificial Sequence: Synthetic probe
ggcgtttgaagggaggaaaccacacgcttgcaacaccactcccggtgtcaacgggatgca

SEQ ID NO: 903 - DNA, 60 bp, Artificial Sequence
  Description of Artificial Sequence: Synthetic probe
acatctacggtgttggggccgccacgtgcgagccgctcgcctggtgtgcttcgactgtca

SEQ ID NO: 904 - DNA, 54 bp, Artificial Sequence
  Description of Artificial Sequence: Synthetic probe
aataggtgaccggaggccggcacctttcctttacaactattgacattatgaata

SEQ ID NO: 905 - DNA, 60 bp, Artificial Sequence
  Description of Artificial Sequence: Synthetic probe
cccctcacggttagcgacactgccgcgacacagattaaggtctacgccaatattgctccg

SEQ ID NO: 906 - DNA, 60 bp, Artificial Sequence
  Description of Artificial Sequence: Synthetic probe
ggtctgtatttaccaaattacacacgggaaggctgaaggtgacaccttggttgtgtcggc

SEQ ID NO: 907 - DNA, 60 bp, Artificial Sequence
  Description of Artificial Sequence: Synthetic probe
ttgtgcggacaaacgccgcttcacgcacctcgcgtgaccggccagtactcttaccacttt

SEQ ID NO: 908 - DNA, 60 bp, Artificial Sequence
  Description of Artificial Sequence: Synthetic probe
ggacgagattcgcccgatggagaaagtaagtgccggcaagactcgcattgtcgacgtcct

SEQ ID NO: 909 - DNA, 60 bp, Artificial Sequence
  Description of Artificial Sequence: Synthetic probe
attctttgaggggatggtgcgtgactccgtcaaggaggagctccggcctctcatccagca

SEQ ID NO: 910 - DNA, 60 bp, Artificial Sequence
  Description of Artificial Sequence: Synthetic probe
cctcaaccgcccctccagaaagtttaccagcttgttcaggaggcgattgaccgggtcgag

SEQ ID NO: 911 - DNA, 60 bp, Artificial Sequence
  Description of Artificial Sequence: Synthetic probe
gccctgatgcactgaaccgaaggttccacgttgacattgacgtgagcgccaaggacgggt

SEQ ID NO: 912 - DNA, 60 bp, Artificial Sequence
  Description of Artificial Sequence: Synthetic probe
cagcagaccgttgtagtaatggatgacttgggccacaaccccgacgggaaggactccaag

SEQ ID NO: 913 - DNA, 60 bp, Artificial Sequence
  Description of Artificial Sequence: Synthetic probe
ccgagacaacgttggacaacaccaccaatccaacggcgtaccacaaggcaccgctcactc

SEQ ID NO: 914 - DNA, 60 bp, Artificial Sequence
  Description of Artificial Sequence: Synthetic probe
cgtgaccacaaagacggactcagacagagtgctcgcccagtttgacctgtctctagcagc

SEQ ID NO: 915 - DNA, 60 bp, Artificial Sequence
  Description of Artificial Sequence: Synthetic probe
cgggtacgcaacagctgaggactttgtgagcggaccaaacacatctgggcttgagaccag

SEQ ID NO: 916 - DNA, 60 bp, Artificial Sequence
  Description of Artificial Sequence: Synthetic probe
gagaacctcacactagatgctatcaaacaattggaagaaatcactggtctcgagctccac

SEQ ID NO: 917 - DNA, 60 bp, Artificial Sequence
  Description of Artificial Sequence: Synthetic probe
ctgtcttgcccgacgataaagggctgtgaccgcaagatcataccgcctttcccggcgtta

SEQ ID NO: 918 - DNA, 60 bp, Artificial Sequence
  Description of Artificial Sequence: Synthetic probe
ggcgagagccccgtgaccaatatgagaggtgacctgcaagtattggcccaaaaggcggca

SEQ ID NO: 919 - DNA, 60 bp, Artificial Sequence
  Description of Artificial Sequence: Synthetic probe
gggtgaacgccgtgtgcggtgacgcgtaatccctcagatatcgcatgacacgagtctgag

SEQ ID NO: 920 - DNA, 60 bp, Artificial Sequence
  Description of Artificial Sequence: Synthetic probe
aggagccgttctggcaaaggatggcgctgagactttcattgtcggcactcactctgcagg

SEQ ID NO: 921 - DNA, 60 bp, Artificial Sequence
  Description of Artificial Sequence: Synthetic probe
agagagagaaccctcccggggcaaaaggcgtgtgatgacgtgaacactgagcctgccaag

SEQ ID NO: 922 - DNA, 60 bp, Artificial Sequence
  Description of Artificial Sequence: Synthetic probe
gcattgccaatttatgcaaggtggtcgctccagcacccagcaagtcgagacccgaacctg

SEQ ID NO: 923 - DNA, 60 bp, Artificial Sequence
  Description of Artificial Sequence: Synthetic probe
gatcccgtccttgtggccatcatgctagcagacaccggtctcgagattctggacagcacg

SEQ ID NO: 924 - DNA, 60 bp, Artificial Sequence
  Description of Artificial Sequence: Synthetic probe
ccgcgcaactccccgcctctttcaactttggtgcaattcgggccacaaccatccatgaac

SEQ ID NO: 925 - DNA, 60 bp, Artificial Sequence
  Description of Artificial Sequence: Synthetic probe
ccttcactggttcaactgactcaaaagcccgctacatggtggcctacgttccgcctggcg

SEQ ID NO: 926 - DNA, 60 bp, Artificial Sequence
  Description of Artificial Sequence: Synthetic probe
cagtcgagtgtgggagtcacgtacggatactccaccaaggaagatcacgtgtccgggcct

SEQ ID NO: 927 - DNA, 60 bp, Artificial Sequence
  Description of Artificial Sequence: Synthetic probe
tcgtcatttggaacatcaagcacctgctccacaccggcattggcactgcctcgcgaccca

SEQ ID NO: 928 - DNA, 60 bp, Artificial Sequence
  Description of Artificial Sequence: Synthetic probe
ctcggcgttaaagggaggtaaccatacgcgtgatgccgtcttgcccgacgttaagggctg

SEQ ID NO: 929 - DNA, 60 bp, Artificial Sequence
  Description of Artificial Sequence: Synthetic probe
aagcctcaaccgtccctccagaacgtctaccagcttgtccaggaggtgattgaccgggtc

SEQ ID NO: 930 - DNA, 60 bp, Artificial Sequence
  Description of Artificial Sequence: Synthetic probe
tgacgtgaattctgagcccgcccagcccgttgaggagcaaccacaagctgaaggacccta

SEQ ID NO: 931 - DNA, 58 bp, Artificial Sequence
  Description of Artificial Sequence: Synthetic probe
ttcgcccggaagtaaaacggcagctttacacagttttgcccgttttcgtgagaaacgg

SEQ ID NO: 932 - DNA, 60 bp, Artificial Sequence
  Description of Artificial Sequence: Synthetic probe
cccctccagaacgtctaccagcttgttcaggaggtgatcgagcgagtggagctgcacgaa

SEQ ID NO: 933 - DNA, 55 bp, Artificial Sequence
  Description of Artificial Sequence: Synthetic probe
gcgagttgatcgcctagtgtgtttcgactgtcacccgaagcccacctttcacccc

SEQ ID NO: 934 - DNA, 60 bp, Artificial Sequence
  Description of Artificial Sequence: Synthetic probe
ggggcgcgcgacgccgtaggagtgaaaagcccgaaagggctttcccggttccttttcttt

SEQ ID NO: 935 - DNA, 60 bp, Artificial Sequence
  Description of Artificial Sequence: Synthetic probe
ctgggttggtcaaggtcgcctcgagtttcctccggtccacacccgaagacctcgagagag

SEQ ID NO: 936 - DNA, 60 bp, Artificial Sequence
  Description of Artificial Sequence: Synthetic probe
ggtctgtatttatcaaattacacacgggaaggctgaagatgacaccttggttgtgtcggc

SEQ ID NO: 937 - DNA, 60 bp, Artificial Sequence
  Description of Artificial Sequence: Synthetic probe
gccgaccctgtctacggtaaggagtacaacccgcccaagaccaactaccctagacgcttc

SEQ ID NO: 938 - DNA, 60 bp, Artificial Sequence
  Description of Artificial Sequence: Synthetic probe
tggctggagaactcccctcgaaggtggggattttcccggttgcgtgttcggacggttatg

SEQ ID NO: 939 - DNA, 60 bp, Artificial Sequence
  Description of Artificial Sequence: Synthetic probe
ctggtggactcatacgcctacatgaggaacggctgggatgttgaggtgtctgccgttggc

SEQ ID NO: 940 - DNA, 53 bp, Artificial Sequence
  Description of Artificial Sequence: Synthetic probe
ttttaagaagtttctgtttgattggacaccggacaaaccttttggacatcgga

SEQ ID NO: 941 - DNA, 60 bp, Artificial Sequence
  Description of Artificial Sequence: Synthetic probe
ccagcccagcaaccggctcgcagaaccagtccggcaacactggcagcataatcaacaact

SEQ ID NO: 942 - DNA, 60 bp, Artificial Sequence
  Description of Artificial Sequence: Synthetic probe
cacacagttttgcccgttttcacgagaaacgggacgtctgcgcacgaaacgcctgtcgct

SEQ ID NO: 943 - DNA, 60 bp, Artificial Sequence
  Description of Artificial Sequence: Synthetic probe
cccctcagatcaaggtgtatgccaacgttgccccaactaacgtgcacgtcgcgggtgagt

SEQ ID NO: 944 - DNA, 60 bp, Artificial Sequence
  Description of Artificial Sequence: Synthetic probe
aaagccgacggcgacgctctggttgtgctggctagcgctggcaaggactttgagctgagg

SEQ ID NO: 945 - DNA, 60 bp, Artificial Sequence
  Description of Artificial Sequence: Synthetic probe
tgaactccgagcccgcccaacctgttgaaggacaaccacaagctgaaggaccctacgccg

SEQ ID NO: 946 - DNA, 60 bp, Artificial Sequence
  Description of Artificial Sequence: Synthetic probe
gagggaatggtgcacgactctatcaaggaagagctccgccctctcatccaacagacctca

SEQ ID NO: 947 - DNA, 60 bp, Artificial Sequence
  Description of Artificial Sequence: Synthetic probe
gaccacggggttcatcccacccatggcctcgctcgaagacaagggtaaacctttcaacag

SEQ ID NO: 948 - DNA, 60 bp, Artificial Sequence
  Description of Artificial Sequence: Synthetic probe
cgcgaccactgcccacctccttcaattacggggccatcaaagcaacccgagtcactgagt

SEQ ID NO: 949 - DNA, 60 bp, Artificial Sequence
  Description of Artificial Sequence: Synthetic probe
gcccgcgcacaaacaacctccacgggtgaatcagcagaccctgtgacctccactgttgaa

SEQ ID NO: 950 - DNA, 60 bp, Artificial Sequence
  Description of Artificial Sequence: Synthetic probe
ccggtctacgggaaagtgttcaaccctccccgcagcttgttgcctgggcgtttcaccaac

SEQ ID NO: 951 - DNA, 60 bp, Artificial Sequence
  Description of Artificial Sequence: Synthetic probe
tcaacccacgcacgaacatgactgcacacctgactgtaccctttgtcggcgtcaaccgct

SEQ ID NO: 952 - DNA, 60 bp, Artificial Sequence
  Description of Artificial Sequence: Synthetic probe
aaaagacggaggagaccaccctccttgaagaccgcatcctcactacccgcaacgggcaca

SEQ ID NO: 953 - DNA, 60 bp, Artificial Sequence
  Description of Artificial Sequence: Synthetic probe
gcaaccacaagatgcaccttcacccggaagtaaaacggcactcacacacagttttgcccg

SEQ ID NO: 954 - DNA, 60 bp, Artificial Sequence
  Description of Artificial Sequence: Synthetic probe
gcgacaactacggtgttggggctacccacgcgggctgatcgcctggtttgcttcggctgt

SEQ ID NO: 955 - DNA, 60 bp, Artificial Sequence
  Description of Artificial Sequence: Synthetic probe
gcacgacttcttctacggacacaagagaaaatggaattcacactctgcaacggtgagaag

SEQ ID NO: 956 - DNA, 60 bp, Artificial Sequence
  Description of Artificial Sequence: Synthetic probe
gcacgacttcttctacggacacaagagaaaatggaattcacactctacaacggtgagaag

SEQ ID NO: 957 - DNA, 52 bp, Artificial Sequence
  Description of Artificial Sequence: Synthetic probe
ggccgctgactacgcgtacaccgcgtccgacaaggctgaaacaacatgtgta

SEQ ID NO: 958 - DNA, 60 bp, Artificial Sequence
  Description of Artificial Sequence: Synthetic probe
gacgctctggtcgtactggctagtgctggcaaagactttgagctaaggctgccggtggac

SEQ ID NO: 959 - DNA, 55 bp, Artificial Sequence
  Description of Artificial Sequence: Synthetic probe
gttaacgggatgcaactgtaagacacaccttcatccggaagtgaaacggctgcgt

SEQ ID NO: 960 - DNA, 55 bp, Artificial Sequence
  Description of Artificial Sequence: Synthetic probe
gttaacgggatgcaaccgcaagacacaccttcatccggaagtgaaacggctgcgt

SEQ ID NO: 961 - DNA, 60 bp, Artificial Sequence
  Description of Artificial Sequence: Synthetic probe
ggacttcaagtacttcgcccagatggtctcaaccacagggttcatcccgcccatggcatc

SEQ ID NO: 962 - DNA, 60 bp, Artificial Sequence
  Description of Artificial Sequence: Synthetic probe
aaccaccaatctctactcgggcttcaccccgaggaccatggtgtgccctgacgcgttgaa

SEQ ID NO: 963 - DNA, 60 bp, Artificial Sequence
  Description of Artificial Sequence: Synthetic probe
aaacgccctcacggcgcggtgacatggcggcccttgcacagagactgagcgagcggctgc

SEQ ID NO: 964 - DNA, 53 bp, Artificial Sequence
  Description of Artificial Sequence: Synthetic probe
tggtttcaactacagggttcatcccgccaatggcatctctcgaggacaaaggt

SEQ ID NO: 965 - DNA, 60 bp, Artificial Sequence
  Description of Artificial Sequence: Synthetic probe
ggtctcgacgaggccaaaccctggtataagcttatcaagctcctaagccgtctgtcgtgc

SEQ ID NO: 966 - DNA, 50 bp, Artificial Sequence
  Description of Artificial Sequence: Synthetic probe
aacggtgagtccaggtacagcagaaatgctgtgcccaatgtgagaggtga

SEQ ID NO: 967 - DNA, 60 bp, Artificial Sequence
  Description of Artificial Sequence: Synthetic probe
actccacactcacgttcttgtgcgcgcgggacccgatgggctttcgttcacccacttaca

SEQ ID NO: 968 - DNA, 54 bp, Artificial Sequence
  Description of Artificial Sequence: Synthetic probe
ccccggcatgacaccgccaactgacccggagcgcgccgcccactgcattcactc

SEQ ID NO: 969 - DNA, 59 bp, Artificial Sequence
  Description of Artificial Sequence: Synthetic probe
ccccggcatgacaccgccaactgacccggagcgcgccgcccattgcattcactctgagt

SEQ ID NO: 970 - DNA, 60 bp, Artificial Sequence
  Description of Artificial Sequence: Synthetic probe
cctgactgactcttatgcttacatgagaaacggttgggatgttgaggtcaccgcagtggg

SEQ ID NO: 971 - DNA, 59 bp, Artificial Sequence
  Description of Artificial Sequence: Synthetic probe
agtgtttggcactgcttacctcgtgcctcgtcaccttttcgcggaaaagtatgacaaaa

SEQ ID NO: 972 - DNA, 60 bp, Artificial Sequence
  Description of Artificial Sequence: Synthetic probe
ggtccatgctgctcaagatgaaggctcacattgatcccgaaccacaccacgagggattgg

SEQ ID NO: 973 - DNA, 60 bp, Artificial Sequence
  Description of Artificial Sequence: Synthetic probe
ggtccatgctgcttaaaatgaaggcacacattgatcccgaaccacaccacgagggattga

SEQ ID NO: 974 - DNA, 50 bp, Artificial Sequence
  Description of Artificial Sequence: Synthetic probe
agtgaaggctatcaggaccggtctcgatgaagccaaaccctggtacaagc

SEQ ID NO: 975 - DNA, 60 bp, Artificial Sequence
  Description of Artificial Sequence: Synthetic probe
gcggtgccaccactgttggtttcagagagaaaactctcccaggacacaaggcgggtgacg

SEQ ID NO: 976 - DNA, 60 bp, Artificial Sequence
  Description of Artificial Sequence: Synthetic probe
gaactccatggacacgcaacttggtgataacgctattagcggaggctccaacgaggggtc

SEQ ID NO: 977 - DNA, 60 bp, Artificial Sequence
  Description of Artificial Sequence: Synthetic probe
aggactcgccgtccactctggacctgacgaataccggcgtctctttgagcctttccaggg

SEQ ID NO: 978 - DNA, 60 bp, Artificial Sequence
  Description of Artificial Sequence: Synthetic probe
gggaggcaaccacaagcttgcaactgtcttgttcgacgataaagggctgtgaccgcaaga

SEQ ID NO: 979 - DNA, 60 bp, Artificial Sequence
  Description of Artificial Sequence: Synthetic probe
gaggctgcccttgagctcatggagaagcgtgaatacaagtttgtttgtcagaccttcctg

SEQ ID NO: 980 - DNA, 60 bp, Artificial Sequence
  Description of Artificial Sequence: Synthetic probe
catggacacgcagcttggtgacaacgccattagcggtggttccaacgagggctccacaga

SEQ ID NO: 981 - DNA, 60 bp, Artificial Sequence
  Description of Artificial Sequence: Synthetic probe
gcccctccagaacgtctaccagcttgttcagaaggtgatcgagcgagtggagctgcacga

SEQ ID NO: 982 - DNA, 60 bp, Artificial Sequence
  Description of Artificial Sequence: Synthetic probe
ccgaaccagtggtcgtttgcctccgcggcaaatccggtcaagggaaaagtttcctcgcga

SEQ ID NO: 983 - DNA, 57 bp, Artificial Sequence
  Description of Artificial Sequence: Synthetic probe
ttttctatcacgcaccacagggaaaatggaactgacactgtacaacggtgagaagaa

SEQ ID NO: 984 - DNA, 60 bp, Artificial Sequence
  Description of Artificial Sequence: Synthetic probe
acgaagaccgggcactgaggcgcgcgacaccgtaggagtgaaaggcccgaaaaggctttt

SEQ ID NO: 985 - DNA, 60 bp, Artificial Sequence
  Description of Artificial Sequence: Synthetic probe
cggaggggccgttcttgctaaagatggagctaacactttcatcgttggcactcactctgc

SEQ ID NO: 986 - DNA, 60 bp, Artificial Sequence
  Description of Artificial Sequence: Synthetic probe
gtgatgacgtgaaccccgagcctgcccaacctgttgaggatcaaccacaagctgaaggac

SEQ ID NO: 987 - DNA, 56 bp, Artificial Sequence
  Description of Artificial Sequence: Synthetic probe
tgaaatgaagagattgcaacaagacatgttcaagcctcagccgcccctccagaacg

SEQ ID NO: 988 - DNA, 60 bp, Artificial Sequence
  Description of Artificial Sequence: Synthetic probe
atctgacttgggtgcctaacggtgcccctgaagcggccctgtcgaacaccagcaacccca

SEQ ID NO: 989 - DNA, 60 bp, Artificial Sequence
  Description of Artificial Sequence: Synthetic probe
tcaaaagcccggtacatggtggcttacatcccgcctggggtggagacgccgccggacaca

SEQ ID NO: 990 - DNA, 60 bp, Artificial Sequence
  Description of Artificial Sequence: Synthetic probe
cggacggttacggaggactggtaacaacagacccgaagacagctgaccccgcttatggca

SEQ ID NO: 991 - DNA, 60 bp, Artificial Sequence
  Description of Artificial Sequence: Synthetic probe
caacggacaagccctttggacacttggtaaagctcgaccttccagccgaccaccacggtg

SEQ ID NO: 992 - DNA, 60 bp, Artificial Sequence
  Description of Artificial Sequence: Synthetic probe
gcacgagggcggaccacctgctcttgtgatctggaacatcaaacacatgctccaaaccgg

SEQ ID NO: 993 - DNA, 60 bp, Artificial Sequence
  Description of Artificial Sequence: Synthetic probe
ccgacgcaaaagggttgtaaccgcaagcttactcccgtctttcccgacgttaaagggacg

SEQ ID NO: 994 - DNA, 51 bp, Artificial Sequence
  Description of Artificial Sequence: Synthetic probe
aacaactacttttaatgagcacaactgactgtttcaccgctttgttgtacg

SEQ ID NO: 995 - DNA, 60 bp, Artificial Sequence
  Description of Artificial Sequence: Synthetic probe
tacggggaaacgccctcacggcgcggtgacatggcagcccttacacagagactgagcgag

SEQ ID NO: 996 - DNA, 60 bp, Artificial Sequence
  Description of Artificial Sequence: Synthetic probe
acagtgtacaacgggaagacgacgtatggggaaacgccctcacggcgcggtgacatggca

SEQ ID NO: 997 - DNA, 60 bp, Artificial Sequence
  Description of Artificial Sequence: Synthetic probe
ttgaaagggggcactagggtctcacccctagtaagccaacgacagtccctgcgttgcact

SEQ ID NO: 998 - DNA, 60 bp, Artificial Sequence
  Description of Artificial Sequence: Synthetic probe
ttgcgtgtgccgacggctatggcaacatggtgacaactgacccgaagacagctgaccctg

SEQ ID NO: 999 - DNA, 60 bp, Artificial Sequence
  Description of Artificial Sequence: Synthetic probe
tgatctcctacggagacgacatcgtggtcgcaagtgattatgatttggactttgaggccc

SEQ ID NO: 1000 - DNA, 60 bp, Artificial Sequence
  Description of Artificial Sequence: Synthetic probe
catgatctcctacggagacgacatcgtggtcgcaagtgattatgatctagactttgaggc

SEQ ID NO: 1001 - DNA, 60 bp, Artificial Sequence
  Description of Artificial Sequence: Synthetic probe
ccagagctttgttctatccaaaagagggaactgtaccagctcacactcttccctcaccag

SEQ ID NO: 1002 - DNA, 60 bp, Artificial Sequence
  Description of Artificial Sequence: Synthetic probe
gcgtggccattttagctggattgtgaggacgaacactgcttgcgcacctcgcgtgaccag

SEQ ID NO: 1003 - DNA, 60 bp, Artificial Sequence
  Description of Artificial Sequence: Synthetic probe
atcacaccaacccgactgcctaccagaagcaacccatcacccgcttggcgctcccttaca

SEQ ID NO: 1004 - DNA, 60 bp, Artificial Sequence
  Description of Artificial Sequence: Synthetic probe
ccccattgtcggcgtgattaacaatgccgatgtcgggaggctgattttctctggcgaagc

SEQ ID NO: 1005 - DNA, 60 bp, Artificial Sequence
  Description of Artificial Sequence: Synthetic probe
cagaaacaaccaacgtacagggctgggtttgcatataccagatcacacacgggaaggccg

SEQ ID NO: 1006 - DNA, 60 bp, Artificial Sequence
  Description of Artificial Sequence: Synthetic probe
cagaaacaaccaacgtacagggctgggtttgcatttaccagatcacacacgggaaggccg

SEQ ID NO: 1007 - DNA, 60 bp, Artificial Sequence
  Description of Artificial Sequence: Synthetic probe
tttgtgaaagtaacaccaaaagaccaaattaatgtgttggacctgatgcagacccctgca

SEQ ID NO: 1008 - DNA, 60 bp, Artificial Sequence
  Description of Artificial Sequence: Synthetic probe
tttgtgaaagtaacaccaaaagaccaaattaatgtgttggacctggtgcaaacccctgca

SEQ ID NO: 1009 - DNA, 60 bp, Artificial Sequence
  Description of Artificial Sequence: Synthetic probe
tttgtgaaagtaacaccaaaagaccaaattaatgcgttggacctgatgcaaacccctgca

SEQ ID NO: 1010 - DNA, 60 bp, Artificial Sequence
  Description of Artificial Sequence: Synthetic probe
atctccgtggcaggactcgcagtccactctgggcctgatgagtaccggcgtctctttgag

SEQ ID NO: 1011 - DNA, 60 bp, Artificial Sequence
  Description of Artificial Sequence: Synthetic probe
ccgcgcctgaacgaaggggttgtcctcgacgaggtcatcttttccaaacacaagggagac

SEQ ID NO: 1012 - DNA, 60 bp, Artificial Sequence
  Description of Artificial Sequence: Synthetic probe
gcaacaagacatgttcaagccccaaccacctctacagaatgtgtaccaactcgttcagga

SEQ ID NO: 1013 - DNA, 60 bp, Artificial Sequence
  Description of Artificial Sequence: Synthetic probe
ggtgccatcaaagccacccgggtgactgaactgctctatcgcatgaagagggctgaaacc

SEQ ID NO: 1014 - DNA, 60 bp, Artificial Sequence
  Description of Artificial Sequence: Synthetic probe
ggcggtgagacacaggtccagaggcgtcagcacacggacgtctcattcatactggacaga

SEQ ID NO: 1015 - DNA, 60 bp, Artificial Sequence
  Description of Artificial Sequence: Synthetic probe
acgcgaaggcgcgttacatgattgcatacgccccgccaggcatggagccgcctaaaacac

SEQ ID NO: 1016 - DNA, 60 bp, Artificial Sequence
  Description of Artificial Sequence: Synthetic probe
ttgtagcgacggttacggcggtttggtgaccacagacccgaagacggctgaccccgccta

SEQ ID NO: 1017 - DNA, 60 bp, Artificial Sequence
  Description of Artificial Sequence: Synthetic probe
cactgcagtggggaatcagttcaacggaggttgcctgttggtggccatggtgcctgagct

SEQ ID NO: 1018 - DNA, 60 bp, Artificial Sequence
  Description of Artificial Sequence: Synthetic probe
tctttgactgggtttacgactcgcctgagaacctcactctcgaggcaattaggcagttgg

SEQ ID NO: 1019 - DNA, 60 bp, Artificial Sequence
  Description of Artificial Sequence: Synthetic probe
cccggcgttaacgggatgtaaccgcaagacgaaccttcacccggaagtaaaacggcaact

SEQ ID NO: 1020 - DNA, 60 bp, Artificial Sequence
  Description of Artificial Sequence: Synthetic probe
gctgactacgcgtcacgcctgcacagtgtgttgggtacggcaaatgctccattgagcgtc

SEQ ID NO: 1021 - DNA, 60 bp, Artificial Sequence
  Description of Artificial Sequence: Synthetic probe
gctctgaaagtgaaagctaagaacctgatcgtcactgagagtggcgccccaccgaccgac

SEQ ID NO: 1022 - DNA, 60 bp, Artificial Sequence
  Description of Artificial Sequence: Synthetic probe
ccagcggtgccagcactgtcggtttcagagagagaactctcccgggacaaaaggtgagtg

SEQ ID NO: 1023 - DNA, 60 bp, Artificial Sequence
  Description of Artificial Sequence: Synthetic probe
tgcgcccaagaacactcagacccttgacctcatgcaaatcccctcacacacgctggttgg

SEQ ID NO: 1024 - DNA, 60 bp, Artificial Sequence
  Description of Artificial Sequence: Synthetic probe
tgcccgtcgacgcgcgccggcaaactaccactaccggcgagtcagcggacccggtaacaa

SEQ ID NO: 1025 - DNA, 60 bp, Artificial Sequence
  Description of Artificial Sequence: Synthetic probe
cttgtgccagagctaaagagccttgacacccggcagaagtaccaactgaccctcttcccc

SEQ ID NO: 1026 - DNA, 60 bp, Artificial Sequence
  Description of Artificial Sequence: Synthetic probe
ccggaggccggcgcctttcttttgaattaccactggattaatgaacacaactgactgttt

SEQ ID NO: 1027 - DNA, 60 bp, Artificial Sequence
  Description of Artificial Sequence: Synthetic probe
cgttaacgggctgtaaccacatgtttacaccacctttcccggcgctaacgggatgcaacc

SEQ ID NO: 1028 - DNA, 60 bp, Artificial Sequence
  Description of Artificial Sequence: Synthetic probe
aacagaaaattgtggcaccggtgaaacagactttgaattttgaccttctcaagttggcag

SEQ ID NO: 1029 - DNA, 60 bp, Artificial Sequence
  Description of Artificial Sequence: Synthetic probe
atttgtcaccatgacagacctggtacctggcatccttgaaaagcagcgggatcttaacga

SEQ ID NO: 1030 - DNA, 51 bp, Artificial Sequence
  Description of Artificial Sequence: Synthetic probe
acgggaaagtgttcaatccacctcgcaacaagttgccggggcggttcacca

SEQ ID NO: 1031 - DNA, 60 bp, Artificial Sequence
  Description of Artificial Sequence: Synthetic probe
ccacctctttcaactacggtgccatcagggcaactcgggtcactgagctgctctaccgga

SEQ ID NO: 1032 - DNA, 60 bp, Artificial Sequence
  Description of Artificial Sequence: Synthetic probe
aggtgacctccaggtgctgacccaaaaggcggcgcgaacgctgcccacctctttcaacta

SEQ ID NO: 1033 - DNA, 60 bp, Artificial Sequence
  Description of Artificial Sequence: Synthetic probe
actcgccctgccttacacggcaccacaccgtgtgttggcaacagtgtacaacggtgagtg

SEQ ID NO: 1034 - DNA, 60 bp, Artificial Sequence
  Description of Artificial Sequence: Synthetic probe
catgccgagtgggacaccgggttgaattcaaagttcacatttcccattccttacctctca

SEQ ID NO: 1035 - DNA, 60 bp, Artificial Sequence
  Description of Artificial Sequence: Synthetic probe
gggcgtttcaccaatctccttgacgtggctgaggcttgcccgacgtttctgcacttcgag

SEQ ID NO: 1036 - DNA, 60 bp, Artificial Sequence
  Description of Artificial Sequence: Synthetic probe
cttggaccctagtggtcatggttgtggcgcctttgactgtcaataatgaaggtgccccac

SEQ ID NO: 1037 - DNA, 60 bp, Artificial Sequence
  Description of Artificial Sequence: Synthetic probe
ccaggcccaataaccacgacaactgttggttgaacgccatcctccagttgtttaggtacg

SEQ ID NO: 1038 - DNA, 60 bp, Artificial Sequence
  Description of Artificial Sequence: Synthetic probe
tcccgcccatggcgtcactcgaggacaaaggcagacccttcaacagcaaggtcatcatcg

SEQ ID NO: 1039 - DNA, 60 bp, Artificial Sequence
  Description of Artificial Sequence: Synthetic probe
aacaaaacacgggcctgactttaaccggttagtgtccgcctttgaggaattggccactgg

SEQ ID NO: 1040 - DNA, 59 bp, Artificial Sequence
  Description of Artificial Sequence: Synthetic probe
ctgtcccggcgttaaagggaggtaaccgcaagcatactaccgcctaccccggcgttaac

SEQ ID NO: 1041 - DNA, 60 bp, Artificial Sequence
  Description of Artificial Sequence: Synthetic probe
cctgtcccggcgttaaagggaggtaaccgcaagcatactaccgcctaccccggcgttaac

SEQ ID NO: 1042 - DNA, 60 bp, Artificial Sequence
  Description of Artificial Sequence: Synthetic probe
gtcggcactcactctgcaggaggcaatggagtaggatactgttcgtgtgtttccaggtcc

SEQ ID NO: 1043 - DNA, 59 bp, Artificial Sequence
  Description of Artificial Sequence: Synthetic probe
gcgagcgacgccgtaggagtgaaaagtccgaaagggcttttcccgcttcctattcaaaa

SEQ ID NO: 1044 - DNA, 60 bp, Artificial Sequence
  Description of Artificial Sequence: Synthetic probe
ctaaatccatgaatacgaccgactgctttatcgctctgctatacgttctcagagagatca

SEQ ID NO: 1045 - DNA, 60 bp, Artificial Sequence
  Description of Artificial Sequence: Synthetic probe
gtgcctggcagaccaccatgcgggcattttcctgaaaggacaggaacatgctgtgtttgc

SEQ ID NO: 1046 - DNA, 60 bp, Artificial Sequence
  Description of Artificial Sequence: Synthetic probe
caactacttttaatgagcacaactgactgtttcatcgctttgttgtacgcttttagagag

SEQ ID NO: 1047 - DNA, 50 bp, Artificial Sequence
  Description of Artificial Sequence: Synthetic probe
actttccgcctacttggtcgttagcgctgctctgggcactcccgttgggg

SEQ ID NO: 1048 - DNA, 60 bp, Artificial Sequence
  Description of Artificial Sequence: Synthetic probe
gcaggaggcaacggagttggatactgttcatgcgtttccaggtccatgcttctcaaaatg

SEQ ID NO: 1049 - DNA, 60 bp, Artificial Sequence
  Description of Artificial Sequence: Synthetic probe
cagttggcagaaagacgctgaggcgagtgacgccgtaggagtgaaaggtccgaaagggct

SEQ ID NO: 1050 - DNA, 60 bp, Artificial Sequence
  Description of Artificial Sequence: Synthetic probe
gatgtcacagttggcagaaagacgctgaggcgagtgacgccgtaggagtgaaaagtccga

SEQ ID NO: 1051 - DNA, 60 bp, Artificial Sequence
  Description of Artificial Sequence: Synthetic probe
gtaccggcgtctcttcgagcctttccagggccttttcgagattccaagctacagatcact

SEQ ID NO: 1052 - DNA, 60 bp, Artificial Sequence
  Description of Artificial Sequence: Synthetic probe
accaagatgtccgaggaggacaaagcgctggtccgccgctgcgccgctgactacgcgtca

SEQ ID NO: 1053 - DNA, 60 bp, Artificial Sequence
  Description of Artificial Sequence: Synthetic probe
ccagcggtgccagcactgttggctttagagagagaactctcccaggacataaggtgagtg

SEQ ID NO: 1054 - DNA, 60 bp, Artificial Sequence
  Description of Artificial Sequence: Synthetic probe
gcgaacgtgctcgcacaagcaatttccactcacttcaccggcagaaccgattcagtttgg

SEQ ID NO: 1055 - DNA, 60 bp, Artificial Sequence
  Description of Artificial Sequence: Synthetic probe
tttccccaccagttcattaacccacgcaccaacatgacggcccatatcaacgtgccgttc

SEQ ID NO: 1056 - DNA, 60 bp, Artificial Sequence
  Description of Artificial Sequence: Synthetic probe
ggttttcgcgcttggctagctctgctttcagcgggctgtttggtgcgctactggctgaca

SEQ ID NO: 1057 - DNA, 60 bp, Artificial Sequence
  Description of Artificial Sequence: Synthetic probe
gctggtatcttcctgaaagggcaagaacatgctgtgtttgcctgtatcacctccaatggg

SEQ ID NO: 1058 - DNA, 60 bp, Artificial Sequence
  Description of Artificial Sequence: Synthetic probe
ccggaggccggcgcctttcttttgactactactaaactaatgaacacaactgactgtttc

SEQ ID NO: 1059 - DNA, 60 bp, Artificial Sequence
  Description of Artificial Sequence: Synthetic probe
ctgcccgacgttaaagggctgcaaccacaagtttgtaccgcctttcccggcgttaacggg

SEQ ID NO: 1060 - DNA, 60 bp, Artificial Sequence
  Description of Artificial Sequence: Synthetic probe
cttacgtctgtgcatgcgcggggaccgatggactatcgttcactcacctacggctggact

SEQ ID NO: 1061 - DNA, 58 bp, Artificial Sequence
  Description of Artificial Sequence: Synthetic probe
ccaaacatcacatttggcacaatgattttggggcgcgcgatgccgtaggagtgaaaag

SEQ ID NO: 1062 - DNA, 60 bp, Artificial Sequence
  Description of Artificial Sequence: Synthetic probe
actcgacgccatggagccggacaccgcacctggccttccctgggccctccaagggaaacg

SEQ ID NO: 1063 - DNA, 60 bp, Artificial Sequence
  Description of Artificial Sequence: Synthetic probe
cgcctaccttgtacctcgccatcttttcgctgagaagtatgacaagattatgctggacgg

SEQ ID NO: 1064 - DNA, 60 bp, Artificial Sequence
  Description of Artificial Sequence: Synthetic probe
acgtgaactccgagcccgcccaaccaaccgaagagcaaccacaagctgaaggaccctacg

SEQ ID NO: 1065 - DNA, 60 bp, Artificial Sequence
  Description of Artificial Sequence: Synthetic probe
ccgattcttccggttcagccagcgggcgatagacacaagcaaccgctcatcgcaccggaa

SEQ ID NO: 1066 - DNA, 60 bp, Artificial Sequence
  Description of Artificial Sequence: Synthetic probe
taccacaaggggccgttgactcgactggctctcccgtacaccgcgccacaccgtgtgttg

SEQ ID NO: 1067 - DNA, 60 bp, Artificial Sequence
  Description of Artificial Sequence: Synthetic probe
aacacagcaggtgcccagcagatcaaagtgtacgccaacatagccccaaccaacgtgcac

SEQ ID NO: 1068 - DNA, 60 bp, Artificial Sequence
  Description of Artificial Sequence: Synthetic probe
acgggtatgcaactgctgaagacagctcgtctggacccaacacatccggtctggagacgc

SEQ ID NO: 1069 - DNA, 60 bp, Artificial Sequence
  Description of Artificial Sequence: Synthetic probe
cgcccgagaacctcacacttgaagccattaaacagctagaggaactcacggggttagagc

SEQ ID NO: 1070 - DNA, 60 bp, Artificial Sequence
  Description of Artificial Sequence: Synthetic probe
cggcgttaacgggatgcaaccgtaagatacaccttcacccggaagtaaaacggctgcgtc

SEQ ID NO: 1071 - DNA, 57 bp, Artificial Sequence
  Description of Artificial Sequence: Synthetic probe
gacaactgctggctgaacaccatcctccagttgtttaggtacgttgatgaacctttt

SEQ ID NO: 1072 - DNA, 60 bp, Artificial Sequence
  Description of Artificial Sequence: Synthetic probe
gacaactgctggctgaacaccatcctccagttgtttaggtacgttgatgaaccttttttc

SEQ ID NO: 1073 - DNA, 60 bp, Artificial Sequence
  Description of Artificial Sequence: Synthetic probe
cgctgtggtaaacgccatcaaagaggtaagagcacttttcctaccacggactgcaggaaa

SEQ ID NO: 1074 - DNA, 59 bp, Artificial Sequence
  Description of Artificial Sequence: Synthetic probe
tggggccgcttcgtgcgagttgatcacctggtgtgtttcggctgtcacccaaagcccac

SEQ ID NO: 1075 - DNA, 60 bp, Artificial Sequence
  Description of Artificial Sequence: Synthetic probe
gccgaggtgcactcattgacttcgagaacggcactgtcggacctgaagtcgcagaagcct

SEQ ID NO: 1076 - DNA, 59 bp, Artificial Sequence
  Description of Artificial Sequence: Synthetic probe
agtgtttggcactgcttacctcgtgccccgtcatcttttcgctgagaagtatgacaaga

SEQ ID NO: 1077 - DNA, 60 bp, Artificial Sequence
  Description of Artificial Sequence: Synthetic probe
tccacattgccaacctgtgcaaggtggtcaccccggcacccagcaagtcgagacccgaac

SEQ ID NO: 1078 - DNA, 60 bp, Artificial Sequence
  Description of Artificial Sequence: Synthetic probe
gtgcccaacggtgctcctgaggcagctctatcaaacaccagcaaccccactgcctacaac

SEQ ID NO: 1079 - DNA, 60 bp, Artificial Sequence
  Description of Artificial Sequence: Synthetic probe
cgggctgcccactgcattcacgctgagtgggacacaggactaaattccaagttcactttt

SEQ ID NO: 1080 - DNA, 60 bp, Artificial Sequence
  Description of Artificial Sequence: Synthetic probe
ccggagtggaaagagtttgaacaacgcgagaagtaccaactcaccctcttcccacaccag

SEQ ID NO: 1081 - DNA, 60 bp, Artificial Sequence
  Description of Artificial Sequence: Synthetic probe
acaaccaacacccagaacaacgattggttttcaaagctcgccagctcagccttcaccggc

SEQ ID NO: 1082 - DNA, 60 bp, Artificial Sequence
  Description of Artificial Sequence: Synthetic probe
gagcacttttcctaccgcgaatcacaggaaagatggaattcaccctgcacaacggcgaga

SEQ ID NO: 1083 - DNA, 60 bp, Artificial Sequence
  Description of Artificial Sequence: Synthetic probe
tgacccactggcgagtgtcagtaacaacactgctgcttcgtagcggagcatgacggccgt

SEQ ID NO: 1084 - DNA, 60 bp, Artificial Sequence
  Description of Artificial Sequence: Synthetic probe
ggggcgctagggtttcacccctagcagaccaacgacatcccctgcgttgtactacacact

SEQ ID NO: 1085 - DNA, 56 bp, Artificial Sequence
  Description of Artificial Sequence: Synthetic probe
cccaccgtggcacacggtgtgtttaaccccgaatttgggcctgccgccttgtccga

SEQ ID NO: 1086 - DNA, 56 bp, Artificial Sequence
  Description of Artificial Sequence: Synthetic probe
cccaccgtggcacacggtgtgtttaaccccgaatttgggcctgccgccctgtccaa

SEQ ID NO: 1087 - DNA, 60 bp, Artificial Sequence
  Description of Artificial Sequence: Synthetic probe
agcagtaaaacacgagggagacctcacttgggttccaaatggagcgcctgaaaaggcgtt

SEQ ID NO: 1088 - DNA, 60 bp, Artificial Sequence
  Description of Artificial Sequence: Synthetic probe
acgactgactgttttatcgctctgctatacgctctcagagagatcaaagcactgtttctg

SEQ ID NO: 1089 - DNA, 60 bp, Artificial Sequence
  Description of Artificial Sequence: Synthetic probe
ggttccactttgaccttgatgtgagtgctagggacgggtacaaaattaacaacaaattgg

SEQ ID NO: 1090 - DNA, 60 bp, Artificial Sequence
  Description of Artificial Sequence: Synthetic probe
tgagctgcacgagggtggaccacccgccttcgtcgtttggaacatcaaacacctgctcca

SEQ ID NO: 1091 - DNA, 60 bp, Artificial Sequence
  Description of Artificial Sequence: Synthetic probe
cgcctgagaaccttactcttgagacaatcaggcacctggaagggattactggccttgagc

SEQ ID NO: 1092 - DNA, 60 bp, Artificial Sequence
  Description of Artificial Sequence: Synthetic probe
cggaggccggcgcctttcatgaacacaactgattgttttatcgctctgttacacgctctc

SEQ ID NO: 1093 - DNA, 60 bp, Artificial Sequence
  Description of Artificial Sequence: Synthetic probe
atcggtggatgacccactggacggcgacgtaactcttggcgacgcggaaaagaaccctca

SEQ ID NO: 1094 - DNA, 60 bp, Artificial Sequence
  Description of Artificial Sequence: Synthetic probe
atcggtggatgacccactggacggcgacgtaactcttggcgacgcggaaaagaaccctct

SEQ ID NO: 1095 - DNA, 60 bp, Artificial Sequence
  Description of Artificial Sequence: Synthetic probe
acgtcgcgggtgagctcccttctaaagaggggattttccccgtggcatgcagcgatggtt

SEQ ID NO: 1096 - DNA, 60 bp, Artificial Sequence
  Description of Artificial Sequence: Synthetic probe
ccgacgaccgggtcacaaaaccaatctggcaacactggcagcattattaacaattactac

SEQ ID NO: 1097 - DNA, 59 bp, Artificial Sequence
  Description of Artificial Sequence: Synthetic probe
gggcgcgcgacgccgtgggagtgaaaagcccgaaagggctttcccggcttccttaatcc

SEQ ID NO: 1098 - DNA, 51 bp, Artificial Sequence
  Description of Artificial Sequence: Synthetic probe
ccctcatccaacaaacttcatttgtgaaacgtgctttcaagcgcctgaagg

SEQ ID NO: 1099 - DNA, 60 bp, Artificial Sequence
  Description of Artificial Sequence: Synthetic probe
caccattggcaacaaggcctttgaggcgcgcgacgccgtaggagtggaaaaccgtaaagg

SEQ ID NO: 1100 - DNA, 60 bp, Artificial Sequence
  Description of Artificial Sequence: Synthetic probe
agacgcgaacgctgagcctgtcgtactcgggagggaacaaccgcgagctgaaggacccta

SEQ ID NO: 1101 - DNA, 60 bp, Artificial Sequence
  Description of Artificial Sequence: Synthetic probe
acagaatgaagagagccgagacgtactgccccaggccccttctcgccatccaaccgagta

SEQ ID NO: 1102 - DNA, 60 bp, Artificial Sequence
  Description of Artificial Sequence: Synthetic probe
gaaggcgcgctacatggccgcgtacgcccctcctggtatggaaccaccgaaaacgcctga

SEQ ID NO: 1103 - DNA, 60 bp, Artificial Sequence
  Description of Artificial Sequence: Synthetic probe
ccagcgaggtgtgcatgatcgacggtacagacgtgtgcttggctgacttccacgccggta

SEQ ID NO: 1104 - DNA, 59 bp, Artificial Sequence
  Description of Artificial Sequence: Synthetic probe
ggggctgttcgatgctccgcggtctcctctgtactgagactacggtgttggggccgcca

SEQ ID NO: 1105 - DNA, 60 bp, Artificial Sequence
  Description of Artificial Sequence: Synthetic probe
gactgcttcggctgtcacccgacgcccgcctttcataggttttaccgtcattcccgacgt

SEQ ID NO: 1106 - DNA, 60 bp, Artificial Sequence
  Description of Artificial Sequence: Synthetic probe
caacacggaacacgcctacgaaaacaagcgcatcaatgttgaaggtggaatgccctcggg

SEQ ID NO: 1107 - DNA, 60 bp, Artificial Sequence
  Description of Artificial Sequence: Synthetic probe
caaaccttcctgaaggacgagatccgccctctggagaaagtcaaggccggtaagactcgc

SEQ ID NO: 1108 - DNA, 60 bp, Artificial Sequence
  Description of Artificial Sequence: Synthetic probe
tgcggagctgccgttcttgcaaaagacggcgccaagacagtgatcgttggcacccactct

SEQ ID NO: 1109 - DNA, 60 bp, Artificial Sequence
  Description of Artificial Sequence: Synthetic probe
cgggcagagggaccttacgcggggccactagagaagcaacaaccgctgaaactgaaagca

SEQ ID NO: 1110 - DNA, 60 bp, Artificial Sequence
  Description of Artificial Sequence: Synthetic probe
ccctcgacccgttctcacgcactacgaccataacggcagggatcgttacaagacgaccct

SEQ ID NO: 1111 - DNA, 60 bp, Artificial Sequence
  Description of Artificial Sequence: Synthetic probe
agtcaccacagacgcatccgcacacggaggtgacaccagaaccacccgtcgggcccacac

SEQ ID NO: 1112 - DNA, 60 bp, Artificial Sequence
  Description of Artificial Sequence: Synthetic probe
gcagaagcttgccccacgctgctcgatttcaacggggtaccgtatgtccaaacccagagc

SEQ ID NO: 1113 - DNA, 60 bp, Artificial Sequence
  Description of Artificial Sequence: Synthetic probe
gcctgctggtggccatggtacccgagctgtgcaaattggacgacagggagaaataccagc

SEQ ID NO: 1114 - DNA, 60 bp, Artificial Sequence
  Description of Artificial Sequence: Synthetic probe
gacccaacaaacacgggaactgctggctcaactcactgctgcagctctttcgatacgtcg

SEQ ID NO: 1115 - DNA, 60 bp, Artificial Sequence
  Description of Artificial Sequence: Synthetic probe
aggaaccacccttttggggcctacgttactgtgcccttttggggcccgcggtcgtcaacc

SEQ ID NO: 1116 - DNA, 60 bp, Artificial Sequence
  Description of Artificial Sequence: Synthetic probe
ggtctgcttcggctgtcacccgaaacccgcctttcataagttttaccgtcgttcccgacg

SEQ ID NO: 1117 - DNA, 60 bp, Artificial Sequence
  Description of Artificial Sequence: Synthetic probe
gtttccacccaaatgctgagtggatccttaagactctcgtgaacacggagcacgcctatg

SEQ ID NO: 1118 - DNA, 52 bp, Artificial Sequence
  Description of Artificial Sequence: Synthetic probe
tgagagctaagctcccacagcaggaaggaccctacgctggcccattggagag

SEQ ID NO: 1119 - DNA, 60 bp, Artificial Sequence
  Description of Artificial Sequence: Synthetic probe
atcctcccggttcagtcaacgggtgacagacacaagcaaccgctcattgcgcccgcgaaa

SEQ ID NO: 1120 - DNA, 60 bp, Artificial Sequence
  Description of Artificial Sequence: Synthetic probe
tacgcgtggaggggatctgactcacctggcagcggcgcacgctcggcgcctgccgacgtc

SEQ ID NO: 1121 - DNA, 60 bp, Artificial Sequence
  Description of Artificial Sequence: Synthetic probe
cggttcgtgaaggtccaagtgtcggacaaccaacacacactggacatgatgcaggtgcac

SEQ ID NO: 1122 - DNA, 60 bp, Artificial Sequence
  Description of Artificial Sequence: Synthetic probe
gaaaacccagaagaggctgcccactgcatacacgctgagtgggacactggtttgaactcc

SEQ ID NO: 1123 - DNA, 60 bp, Artificial Sequence
  Description of Artificial Sequence: Synthetic probe
accctcccagaactgctctgccggggcggtttacaaactacctggatgttgccgaggcct

SEQ ID NO: 1124 - DNA, 60 bp, Artificial Sequence
  Description of Artificial Sequence: Synthetic probe
ccaatctagtgtgggagtcacctacgggtacgcaactggtgaagacagctcgtcgggacc

SEQ ID NO: 1125 - DNA, 60 bp, Artificial Sequence
  Description of Artificial Sequence: Synthetic probe
cggggccgaaagccacgtccaactggacctatcatgtgtgcaaccccagcacagcaactt

SEQ ID NO: 1126 - DNA, 60 bp, Artificial Sequence
  Description of Artificial Sequence: Synthetic probe
actcacggcaccgcgtggccattcttggtcgttagcgctgtcttgggcactcctgttggg

SEQ ID NO: 1127 - DNA, 59 bp, Artificial Sequence
  Description of Artificial Sequence: Synthetic probe
gggctggacaatccagtccagcgaccggctctcagaaccaatctggcaatactggcagc

SEQ ID NO: 1128 - DNA, 59 bp, Artificial Sequence
  Description of Artificial Sequence: Synthetic probe
agtgtttggcactgcttacctcgtgcctcgccacctcttcgcagagaagtatgacaaga

SEQ ID NO: 1129 - DNA, 60 bp, Artificial Sequence
  Description of Artificial Sequence: Synthetic probe
gctcagcggtcggttgtaatccagatgttgattggcaaagatttggaacacacttcgccc

SEQ ID NO: 1130 - DNA, 60 bp, Artificial Sequence
  Description of Artificial Sequence: Synthetic probe
gagccacaccacgaggggttggtcattgacaccagggatgttgaggagcgtgtgcatgtc

SEQ ID NO: 1131 - DNA, 60 bp, Artificial Sequence
  Description of Artificial Sequence: Synthetic probe
tgagcaatgacgtggaatccgagcccaccgtacccgtggagggacaaccacaagctgaag

SEQ ID NO: 1132 - DNA, 60 bp, Artificial Sequence
  Description of Artificial Sequence: Synthetic probe
gttcgtcaccatgacagacttggtgcccggcatccttgaaaagcaacgggatctcaacga

SEQ ID NO: 1133 - DNA, 60 bp, Artificial Sequence
  Description of Artificial Sequence: Synthetic probe
aagcaaccccaccgcctaccacaagcagccatttacgagacttgcgctcccttacaccgc

SEQ ID NO: 1134 - DNA, 60 bp, Artificial Sequence
  Description of Artificial Sequence: Synthetic probe
aatcagccccgggagccccacgcacgtcattgacctcatgcaaacacaccaacacgcgtt

SEQ ID NO: 1135 - DNA, 60 bp, Artificial Sequence
  Description of Artificial Sequence: Synthetic probe
cgtacaggggtgggtctgcatataccaaatcactcacgggaaggctgagcaggacactct

SEQ ID NO: 1136 - DNA, 60 bp, Artificial Sequence
  Description of Artificial Sequence: Synthetic probe
cgttgtgacaaggacggacgaccaacgcctcctggccaagttcgacgtttctcttgctgc

SEQ ID NO: 1137 - DNA, 60 bp, Artificial Sequence
  Description of Artificial Sequence: Synthetic probe
ctggaactccccaccgaacacaagggtgtctacgggcacttggtggactctttcgcatac

SEQ ID NO: 1138 - DNA, 60 bp, Artificial Sequence
  Description of Artificial Sequence: Synthetic probe
gatcggcactgcttcacggcccagtgaggtgtgcatggtcgacgggacagacatgtgttt

SEQ ID NO: 1139 - DNA, 60 bp, Artificial Sequence
  Description of Artificial Sequence: Synthetic probe
gaccggtctcgatgaagccaaaccctggtacaagctcatcaagctcttaagccgcctgtc

SEQ ID NO: 1140 - DNA, 60 bp, Artificial Sequence
  Description of Artificial Sequence: Synthetic probe
cggggatgacatcgtggtggcaagtgattatgacttggactttgaagctctcaagcctca

SEQ ID NO: 1141 - DNA, 60 bp, Artificial Sequence
  Description of Artificial Sequence: Synthetic probe
tgagcatctacgaggctatcaagggcgttgacgggctcgacgccatggaaccagacaccg

SEQ ID NO: 1142 - DNA, 60 bp, Artificial Sequence
  Description of Artificial Sequence: Synthetic probe
gtgatgacgtgaactccgagcccgctaagaccatggaggagcaaccacaagctgaaggac

SEQ ID NO: 1143 - DNA, 60 bp, Artificial Sequence
  Description of Artificial Sequence: Synthetic probe
accaacctgtactcggggttcactccgaggaccatgatgtgccctgatgcactgaaccgc

SEQ ID NO: 1144 - DNA, 60 bp, Artificial Sequence
  Description of Artificial Sequence: Synthetic probe
taaagcgtgcggaaacatactgccccaggcccctgctggctcttgacaccactcaagacc

SEQ ID NO: 1145 - DNA, 60 bp, Artificial Sequence
  Description of Artificial Sequence: Synthetic probe
gtgcccaatggtgcgcccaagactgcgctggacaatcagaccaacccaactgcttaccac

SEQ ID NO: 1146 - DNA, 60 bp, Artificial Sequence
  Description of Artificial Sequence: Synthetic probe
aaagccgagggcgacgcgttagttgtctccgccagtgccggcaaggattttgagtttcgc

SEQ ID NO: 1147 - DNA, 60 bp, Artificial Sequence
  Description of Artificial Sequence: Synthetic probe
ctccgcttcggagaagttccatttgtgaagacggtgaactccggtgaccgcttgctcgcc

SEQ ID NO: 1148 - DNA, 60 bp, Artificial Sequence
  Description of Artificial Sequence: Synthetic probe
acggttacgccgtgactgaggacgcggtatcaggacccaacacttcaggcttggaaaccc

SEQ ID NO: 1149 - DNA, 60 bp, Artificial Sequence
  Description of Artificial Sequence: Synthetic probe
ctgttttcatgaacacaactgactgttttatcgctttgctgtacgctctcagagagatta

SEQ ID NO: 1150 - DNA, 60 bp, Artificial Sequence
  Description of Artificial Sequence: Synthetic probe
tgatggggccgtttcgcgcgggttggtcggctggtctgcttcggctgtcacccgaaaccc

SEQ ID NO: 1151 - DNA, 60 bp, Artificial Sequence
  Description of Artificial Sequence: Synthetic probe
ccttcgttcttgaccggtttgtggaggtcacagtgtcggaaaaccaacacacactcgacg

SEQ ID NO: 1152 - DNA, 53 bp, Artificial Sequence
  Description of Artificial Sequence: Synthetic probe
actgggtcaccagcgacccgtttggacggtgctatctgctggaactcccaact

SEQ ID NO: 1153 - DNA, 60 bp, Artificial Sequence
  Description of Artificial Sequence: Synthetic probe
acggtgatgtggccactccgcgcggactgatcgcctggtttgcttcggctgtcacccgaa

SEQ ID NO: 1154 - DNA, 60 bp, Artificial Sequence
  Description of Artificial Sequence: Synthetic probe
tgaacgccgtgtgcggtgacgcataatccccagagatcgcaattggcacgtgactctggg

SEQ ID NO: 1155 - DNA, 60 bp, Artificial Sequence
  Description of Artificial Sequence: Synthetic probe
gcccgatggagaaagtgcgtgccggcaagacccgcattgtcgacgttttgcctgttgaac

SEQ ID NO: 1156 - DNA, 60 bp, Artificial Sequence
  Description of Artificial Sequence: Synthetic probe
agagagaggactcccgcagggcggggtgcgtgtgacgacgtgaactccgagcccgcacag

SEQ ID NO: 1157 - DNA, 59 bp, Artificial Sequence
  Description of Artificial Sequence: Synthetic probe
tcacattgctaacctgtgcagagtgattgccccagcacccagcaagtcgcgacctgagc

SEQ ID NO: 1158 - DNA, 60 bp, Artificial Sequence
  Description of Artificial Sequence: Synthetic probe
acggtgtacaacgggacgagcaagtactccacaagtgtctcaagcaggcgcggtgagctg

SEQ ID NO: 1159 - DNA, 60 bp, Artificial Sequence
  Description of Artificial Sequence: Synthetic probe
catgttcactggctctgctgactcaaaagcccgctacatggtggcctatgttccacccgg

SEQ ID NO: 1160 - DNA, 60 bp, Artificial Sequence
  Description of Artificial Sequence: Synthetic probe
gtagtgatggtagtgtcgccgctcacagtcagcacgacgtctgcggctcagatcaaggtc

SEQ ID NO: 1161 - DNA, 60 bp, Artificial Sequence
  Description of Artificial Sequence: Synthetic probe
tacgatcaagagccacttaacggagactggaaagcaaaggttcagaggaaactcaagggg

SEQ ID NO: 1162 - DNA, 60 bp, Artificial Sequence
  Description of Artificial Sequence: Synthetic probe
ggtgacactttgtactgcgcatgactccacgttcggcctactggcgggtgctagtaacgg

SEQ ID NO: 1163 - DNA, 60 bp, Artificial Sequence
  Description of Artificial Sequence: Synthetic probe
cactcttaccactttccgcctacttagtcgttagcgctggtttgggcactcccgttgggg

SEQ ID NO: 1164 - DNA, 60 bp, Artificial Sequence
  Description of Artificial Sequence: Synthetic probe
gtggccatcatgctggctgataccggccttgagattctggacagcacgtttgtcgtgaag

SEQ ID NO: 1165 - DNA, 60 bp, Artificial Sequence
  Description of Artificial Sequence: Synthetic probe
gttgttctgcgacaagcatcatcaacacaatcctgaacaacatctacgtgctctacgccc

SEQ ID NO: 1166 - DNA, 60 bp, Artificial Sequence
  Description of Artificial Sequence: Synthetic probe
cgactccatcaaggaggagctccggcctctcatccaacgaacttcatttgtacaacgcgc

SEQ ID NO: 1167 - DNA, 60 bp, Artificial Sequence
  Description of Artificial Sequence: Synthetic probe
cgagtggctggtcaaattgatccttgccatccgcgactggatcaaagcatggatcgccgc

SEQ ID NO: 1168 - DNA, 60 bp, Artificial Sequence
  Description of Artificial Sequence: Synthetic probe
aaccccactgcctacaacaaggaaccattcacgagactcgctctcccgtacactgcgccg

SEQ ID NO: 1169 - DNA, 60 bp, Artificial Sequence
  Description of Artificial Sequence: Synthetic probe
ccaaattcacattctcaatcccgtacgtatccgccgcagattacgcttacacagcgtctg

SEQ ID NO: 1170 - DNA, 60 bp, Artificial Sequence
  Description of Artificial Sequence: Synthetic probe
cgcagataggtgagacccgacttttggccaagtttgacctttcccttgctgcaagacata

SEQ ID NO: 1171 - DNA, 60 bp, Artificial Sequence
  Description of Artificial Sequence: Synthetic probe
acctggtgaagctggagctcccggccgatcaccacggtgtctttggacacttggtggatt

SEQ ID NO: 1172 - DNA, 60 bp, Artificial Sequence
  Description of Artificial Sequence: Synthetic probe
ggagaatggaaagctaacgttcaacggaagctcaagggcgccggacaatccagcccgtcg

SEQ ID NO: 1173 - DNA, 60 bp, Artificial Sequence
  Description of Artificial Sequence: Synthetic probe
ttacgctggcagcaatcagacagctagaggacctcacagggcttgagttgcacgagggcg

SEQ ID NO: 1174 - DNA, 60 bp, Artificial Sequence
  Description of Artificial Sequence: Synthetic probe
tgtgaaactcactttaagatgacgttgatactggtacccaagcactggtgacaggctaag

SEQ ID NO: 1175 - DNA, 50 bp, Artificial Sequence
  Description of Artificial Sequence: Synthetic probe
ccccacagatcaaggtctacgccaacatcgcccctaccaacgtgcacgtt

SEQ ID NO: 1176 - DNA, 60 bp, Artificial Sequence
  Description of Artificial Sequence: Synthetic probe
tctggaaatcgttgtgcggcatgacggtaacctaacttgggtgcccaatggtgctcccgt

SEQ ID NO: 1177 - DNA, 60 bp, Artificial Sequence
  Description of Artificial Sequence: Synthetic probe
ggcgttaacgggacgtaaccacaagacttacctccacccgggagtaaaatggaacaacac

SEQ ID NO: 1178 - DNA, 60 bp, Artificial Sequence
  Description of Artificial Sequence: Synthetic probe
gcgttgattgacttcgagaacggcacagttggacccgaggtcgaggccgccttaaagctc

SEQ ID NO: 1179 - DNA, 60 bp, Artificial Sequence
  Description of Artificial Sequence: Synthetic probe
tgtggaggagccgttctcgcaaaggacggggccgagacattcattgtcggcactcactct

SEQ ID NO: 1180 - DNA, 60 bp, Artificial Sequence
  Description of Artificial Sequence: Synthetic probe
acaaggcgtgcgatgacgtgaactccgagcccgccaagcccagggaggaacaaccacaag

SEQ ID NO: 1181 - DNA, 60 bp, Artificial Sequence
  Description of Artificial Sequence: Synthetic probe
gtctgaagagcgggaacacttgcatcgccaacctgtgcaaagtggtcactccagcgccca

SEQ ID NO: 1182 - DNA, 60 bp, Artificial Sequence
  Description of Artificial Sequence: Synthetic probe
tcggccccttttggccattcacccgagcgaggccagacacaaacagaagattgtggcacc

SEQ ID NO: 1183 - DNA, 60 bp, Artificial Sequence
  Description of Artificial Sequence: Synthetic probe
cggcggcgagacacaggtccagaggcgccagcacacggacgtctcatttatattagacag

SEQ ID NO: 1184 - DNA, 60 bp, Artificial Sequence
  Description of Artificial Sequence: Synthetic probe
ccagttcatcaacccacggacgaacatgacagctcacatcactgtgccctttgttggcgt

SEQ ID NO: 1185 - DNA, 60 bp, Artificial Sequence
  Description of Artificial Sequence: Synthetic probe
cgaagggtccacggacacaacttctacccacacaaccaacacccagaacaatgattggtt

SEQ ID NO: 1186 - DNA, 60 bp, Artificial Sequence
  Description of Artificial Sequence: Synthetic probe
tgctccacaccggaatcggcactgcctcgcgtcctagtgaggtgtgtatggtggacggaa

SEQ ID NO: 1187 - DNA, 60 bp, Artificial Sequence
  Description of Artificial Sequence: Synthetic probe
acacccgttggtcgttgtccgacgctccgcggtctcccctgtgtggcagactacggtgac

SEQ ID NO: 1188 - DNA, 60 bp, Artificial Sequence
  Description of Artificial Sequence: Synthetic probe
tggccattttagctggtttgtgcggacgaacaccgcttgcgcacctcgcgtgaccggttg

SEQ ID NO: 1189 - DNA, 60 bp, Artificial Sequence
  Description of Artificial Sequence: Synthetic probe
cttctgacacggcggagaccacaagtgtgcaaggatgggtgtgcatctaccagatcaccc

SEQ ID NO: 1190 - DNA, 60 bp, Artificial Sequence
  Description of Artificial Sequence: Synthetic probe
agccgttcttgctaaggacggagctgagacgttcatcgttggcacacactccgcaggtgg

SEQ ID NO: 1191 - DNA, 60 bp, Artificial Sequence
  Description of Artificial Sequence: Synthetic probe
ctacgctggcccgatggagagacagaagccactaaaagtaaaagcaaaagccccggccgt

SEQ ID NO: 1192 - DNA, 60 bp, Artificial Sequence
  Description of Artificial Sequence: Synthetic probe
cggggtttatcccgcccatggcctcgctcgaagacaaaggcaagcccttcaacagcaaag

SEQ ID NO: 1193 - DNA, 60 bp, Artificial Sequence
  Description of Artificial Sequence: Synthetic probe
aaactaacccaactgcttaccagaagcagcccatcacccgcctagcgctcccctacaccg

SEQ ID NO: 1194 - DNA, 60 bp, Artificial Sequence
  Description of Artificial Sequence: Synthetic probe
aggccacaagcgtgcaggggtgggtgtgcatctaccaaatcactcacggcaaggctgaag

SEQ ID NO: 1195 - DNA, 60 bp, Artificial Sequence
  Description of Artificial Sequence: Synthetic probe
tgtgaagacggtgaactctggtgaccgcctactggccaagttcgatgtctcgcttgccgc

SEQ ID NO: 1196 - DNA, 60 bp, Artificial Sequence
  Description of Artificial Sequence: Synthetic probe
gcttggctagttctgctttcagtggactgtttggcgcgcttctggctgacaagaaaacgg

SEQ ID NO: 1197 - DNA, 60 bp, Artificial Sequence
  Description of Artificial Sequence: Synthetic probe
ctcgctttgttgaacgcttttagagagatcaagtcactgttttcgtcaagagtacaaggg

SEQ ID NO: 1198 - DNA, 60 bp, Artificial Sequence
  Description of Artificial Sequence: Synthetic probe
cgctccgtgcgagttgatcgcctggtgtgcttcgactgtcacccggcgcccgcctttcat

SEQ ID NO: 1199 - DNA, 60 bp, Artificial Sequence
  Description of Artificial Sequence: Synthetic probe
agggtctcacccctaacatgccaacgacggctcctgcgctgcactccaaacttacgtctg

SEQ ID NO: 1200 - DNA, 60 bp, Artificial Sequence
  Description of Artificial Sequence: Synthetic probe
ggagatgacatagtggtggcaagtgatcacgatttggattttgaggctctcaagccgcac

SEQ ID NO: 1201 - DNA, 60 bp, Artificial Sequence
  Description of Artificial Sequence: Synthetic probe
cggcaaatgccccactgagcatctatgaggcgataaaaggcgttgacggcctcgacgcca

SEQ ID NO: 1202 - DNA, 50 bp, Artificial Sequence
  Description of Artificial Sequence: Synthetic probe
aaaacaacgggaccttaacgaccccagcaagtataaggaggccaaggagt

SEQ ID NO: 1203 - DNA, 60 bp, Artificial Sequence
  Description of Artificial Sequence: Synthetic probe
aaccccaccgcctacctcaaggcaccattcacgagactcgcacttccctacaccgcgcca

SEQ ID NO: 1204 - DNA, 60 bp, Artificial Sequence
  Description of Artificial Sequence: Synthetic probe
gacacgcctgaggaagctgcacattgcatccatgctgagtgggacacggggttgaactcc

SEQ ID NO: 1205 - DNA, 60 bp, Artificial Sequence
  Description of Artificial Sequence: Synthetic probe
aatcaaggtttatgtcaacattgccccgacccacgttcacgtggccggcgagctcccctc

SEQ ID NO: 1206 - DNA, 60 bp, Artificial Sequence
  Description of Artificial Sequence: Synthetic probe
cctggtggccatggtccccgaatggaaagagttcacctcgcgtgagaagtaccagctcac

SEQ ID NO: 1207 - DNA, 60 bp, Artificial Sequence
  Description of Artificial Sequence: Synthetic probe
cgagggatccacggacacaacttccacccacacaaccaacactcagaataacgactggtt

SEQ ID NO: 1208 - DNA, 60 bp, Artificial Sequence
  Description of Artificial Sequence: Synthetic probe
cgccggacccgtccgatgttttagtgtttgtcccgtacgatcaggaaccgctcaatgggg

SEQ ID NO: 1209 - DNA, 60 bp, Artificial Sequence
  Description of Artificial Sequence: Synthetic probe
tcgcttgaggagaacttgtacaaacgcgatctacgcaggttcccgcaactgacacgaacc

SEQ ID NO: 1210 - DNA, 60 bp, Artificial Sequence
  Description of Artificial Sequence: Synthetic probe
gagcatctacgaggccattaaaggcgttgacggactcgacgccatggaaccagacacagc

SEQ ID NO: 1211 - DNA, 60 bp, Artificial Sequence
  Description of Artificial Sequence: Synthetic probe
cccatggcatcacttgaggacaaaggtaaacctttcaacagtaaggtcatcattgcgacc

SEQ ID NO: 1212 - DNA, 60 bp, Artificial Sequence
  Description of Artificial Sequence: Synthetic probe
gctccaacgaaggctccacggacacaacttctacacacacaaccaacacccaaaacaacg

SEQ ID NO: 1213 - DNA, 60 bp, Artificial Sequence
  Description of Artificial Sequence: Synthetic probe
agcctgacacagcacccggtctcccctgggcactccaagggaaacgacgtggagctctca

SEQ ID NO: 1214 - DNA, 60 bp, Artificial Sequence
  Description of Artificial Sequence: Synthetic probe
tacgtcgggccactagagagacaacaaccactgaaattgagagcaagactgcctgtggcc

SEQ ID NO: 1215 - DNA, 60 bp, Artificial Sequence
  Description of Artificial Sequence: Synthetic probe
acttcctcatcgagaaaggacagcacgaagcggcaattgaattctacgaagggatggtac

SEQ ID NO: 1216 - DNA, 60 bp, Artificial Sequence
  Description of Artificial Sequence: Synthetic probe
ggtttgcccggacgctttgaaccgacggtttcacttcgacatcgacgtgagtgccaaggg

SEQ ID NO: 1217 - DNA, 60 bp, Artificial Sequence
  Description of Artificial Sequence: Synthetic probe
tccggtccacgcccgaagacttggagagagcagagaaacaactcaaggcacgtgacatca

SEQ ID NO: 1218 - DNA, 60 bp, Artificial Sequence
  Description of Artificial Sequence: Synthetic probe
gtccccgacccgttctcacgcactacgaccacaatggcaaagatcgttacaagacgagca

SEQ ID NO: 1219 - DNA, 60 bp, Artificial Sequence
  Description of Artificial Sequence: Synthetic probe
tgagcacggaggcgtctccagaaccgcacgccgggcacacaccgacgtcgctttccttct

SEQ ID NO: 1220 - DNA, 60 bp, Artificial Sequence
  Description of Artificial Sequence: Synthetic probe
ccaattcttgaacccacgcaccaacaccaccgcacacattcaggtaccatacctgggtgt

SEQ ID NO: 1221 - DNA, 60 bp, Artificial Sequence
  Description of Artificial Sequence: Synthetic probe
ggacacctgaccctgagaacgtgctcgtgtatgtgccctacgaccaagaaccactggacg

SEQ ID NO: 1222 - DNA, 60 bp, Artificial Sequence
  Description of Artificial Sequence: Synthetic probe
tggcgttcttcccgcggccggatcgcctgcgcgaacgctggctcttcacccgaaggccta

SEQ ID NO: 1223 - DNA, 50 bp, Artificial Sequence
  Description of Artificial Sequence: Synthetic probe
accggaggcggctgcccactgcattcatgctgagtgggacactgggttga

SEQ ID NO: 1224 - DNA, 60 bp, Artificial Sequence
  Description of Artificial Sequence: Synthetic probe
gtgcaggtacagcagaaatgctgtgcccaacaggagaggtgaccttcagttgttggctca

SEQ ID NO: 1225 - DNA, 52 bp, Artificial Sequence
  Description of Artificial Sequence: Synthetic probe
tggccgatttccatgcaggcattttccttaaggggcacgaacacgctgtgtt

SEQ ID NO: 1226 - DNA, 60 bp, Artificial Sequence
  Description of Artificial Sequence: Synthetic probe
ccagcgaggtgtgcatggtggatggtacggacatgtgcttggccgatttccatgcaggca

SEQ ID NO: 1227 - DNA, 60 bp, Artificial Sequence
  Description of Artificial Sequence: Synthetic probe
ctttgagattccaagctacagatcactttacttgcgttgggtgaacgccgtgtgtggcga

SEQ ID NO: 1228 - DNA, 60 bp, Artificial Sequence
  Description of Artificial Sequence: Synthetic probe
ggcacggtcggacctgaagtcgaggctgccttgaaacttatggagaaaagagaatacaag

SEQ ID NO: 1229 - DNA, 60 bp, Artificial Sequence
  Description of Artificial Sequence: Synthetic probe
acgtgaacactgaacccgcccagcctgccggagaggaaccaaaagctgaaggaccctaca

SEQ ID NO: 1230 - DNA, 60 bp, Artificial Sequence
  Description of Artificial Sequence: Synthetic probe
aaggtcatcattgcaaccaccaacctgtacgcgggctttaccccgaggactatggtctgc

SEQ ID NO: 1231 - DNA, 60 bp, Artificial Sequence
  Description of Artificial Sequence: Synthetic probe
agcaaccccaccgcctacaagaaggcaccgttcacgagacttgctctaccttacaccgcg

SEQ ID NO: 1232 - DNA, 60 bp, Artificial Sequence
  Description of Artificial Sequence: Synthetic probe
tacgtcgttacgaggacagacggcacgcgcctcttggccaagttcgacctttcccttgct

SEQ ID NO: 1233 - DNA, 60 bp, Artificial Sequence
  Description of Artificial Sequence: Synthetic probe
caccacctcgactacccagtccagcgtaggcgtcacgtacgggtactccacggcggaaga

SEQ ID NO: 1234 - DNA, 60 bp, Artificial Sequence
  Description of Artificial Sequence: Synthetic probe
ccacgtctctgacccgtcgtgtgtgcaaacccagcacagcagctttactgcgaaaaccac

SEQ ID NO: 1235 - DNA, 60 bp, Artificial Sequence
  Description of Artificial Sequence: Synthetic probe
ccggcgttaaagggatgtaaccacaagacgcaccttcacccggaagtaaaacggcacttc

SEQ ID NO: 1236 - DNA, 60 bp, Artificial Sequence
  Description of Artificial Sequence: Synthetic probe
acttacgttgcacacgcggggcccgttggacttccgttcactcacttacagctggaccca

SEQ ID NO: 1237 - DNA, 57 bp, Artificial Sequence
  Description of Artificial Sequence: Synthetic probe
gactttgagaacggcactgtcggacccgaagtcgcagctgctctagagctcatggag

SEQ ID NO: 1238 - DNA, 60 bp, Artificial Sequence
  Description of Artificial Sequence: Synthetic probe
ctggcccgatggagagacagaaaccactgaaagtgaaggcaaaggccccggtcgttaagg

SEQ ID NO: 1239 - DNA, 51 bp, Artificial Sequence
  Description of Artificial Sequence: Synthetic probe
caggaccggcctcgacgaagctaagccctggtacaagctcatcaagctcct

SEQ ID NO: 1240 - DNA, 53 bp, Artificial Sequence
  Description of Artificial Sequence: Synthetic probe
tcttcttctccgacgttaggtcgaacttctctaagctggtagacaccatcaac

SEQ ID NO: 1241 - DNA, 60 bp, Artificial Sequence
  Description of Artificial Sequence: Synthetic probe
ccgcgttaacggggtgtaaccacaagatgtgccttcgcccggaagtaaaacggcaatcac

SEQ ID NO: 1242 - DNA, 60 bp, Artificial Sequence
  Description of Artificial Sequence: Synthetic probe
cgacaacgcacgccaagcgtgcttgaagagcgggaacgtccacattgccaacctgtgcaa

SEQ ID NO: 1243 - DNA, 60 bp, Artificial Sequence
  Description of Artificial Sequence: Synthetic probe
gtggccatctgctgcgctaccggagtgtgtggtactgcctaccttgttcctcgtcatctc

SEQ ID NO: 1244 - DNA, 57 bp, Artificial Sequence
  Description of Artificial Sequence: Synthetic probe
tcaggaggtgattgaccgggtcgagctccatgagaaggtgtcgagccacccgatttt

SEQ ID NO: 1245 - DNA, 58 bp, Artificial Sequence
  Description of Artificial Sequence: Synthetic probe
cattgccaacttgtgcaaagtggttgccccagcacccagtaggtcgaggcccgaacct

SEQ ID NO: 1246 - DNA, 60 bp, Artificial Sequence
  Description of Artificial Sequence: Synthetic probe
agaacggcgagtggctggtcaaactgattctggccatccgcgactggatccaggcttgga

SEQ ID NO: 1247 - DNA, 60 bp, Artificial Sequence
  Description of Artificial Sequence: Synthetic probe
accagaccaacccaactgcttaccagaagcaacctgtcacccgcctggcgctcccctaca

SEQ ID NO: 1248 - DNA, 60 bp, Artificial Sequence
  Description of Artificial Sequence: Synthetic probe
ggaggagaaactcagacagccaggcggcttcacaccgacgttgcctttgttcttgacagg

SEQ ID NO: 1249 - DNA, 60 bp, Artificial Sequence
  Description of Artificial Sequence: Synthetic probe
cggtgaactctggtgaccgtttgctagccaagtttgatgtgtcgctcgctgcgggccaca

SEQ ID NO: 1250 - DNA, 60 bp, Artificial Sequence
  Description of Artificial Sequence: Synthetic probe
gacaggaacacgctgtgtttgcctgcgtcacctccaatgggtggtacgcgattgacgacg

SEQ ID NO: 1251 - DNA, 60 bp, Artificial Sequence
  Description of Artificial Sequence: Synthetic probe
ggtactcaaccactggtgacaggctaatgatgcccctcaggtaccccgaagtaacacgcg

SEQ ID NO: 1252 - DNA, 60 bp, Artificial Sequence
  Description of Artificial Sequence: Synthetic probe
tgctccacggttcccacacacgacatactacggtatggggccgcttcgtgcgagttgatc

SEQ ID NO: 1253 - DNA, 60 bp, Artificial Sequence
  Description of Artificial Sequence: Synthetic probe
cggcacggtcgggcccgaagtcgagaccgccttggagctcatggagaaaagagaatacaa

SEQ ID NO: 1254 - DNA, 60 bp, Artificial Sequence
  Description of Artificial Sequence: Synthetic probe
tttgcctacaaagccgccaccaaggctgggtactgtggaggagccgttctcgctaaggac

SEQ ID NO: 1255 - DNA, 60 bp, Artificial Sequence
  Description of Artificial Sequence: Synthetic probe
caaggaggaactccgacccctcatccagcacacctcatttgtgaaacgcgcgttcaagcg

SEQ ID NO: 1256 - DNA, 60 bp, Artificial Sequence
  Description of Artificial Sequence: Synthetic probe
ccatgacggacttggtacctggaatccttgaaaagcagcgagaccttaacgacccaagca

SEQ ID NO: 1257 - DNA, 60 bp, Artificial Sequence
  Description of Artificial Sequence: Synthetic probe
accaacccaacagcttaccacaaggcgccactcacccggcttgccctgccctacacggca

SEQ ID NO: 1258 - DNA, 60 bp, Artificial Sequence
  Description of Artificial Sequence: Synthetic probe
cccctacctttcggccgctgactacgcatacaccgcgtcggatgtggctgaaaccacaaa

SEQ ID NO: 1259 - DNA, 60 bp, Artificial Sequence
  Description of Artificial Sequence: Synthetic probe
ggtgcacaaaccctggaccctcgtggttatggtcgtagctcctctgactgtcaacaccga

SEQ ID NO: 1260 - DNA, 60 bp, Artificial Sequence
  Description of Artificial Sequence: Synthetic probe
cggcacggacatgtgtctggctgatttccacgcgggcattttcttgaaaggacaggagca

SEQ ID NO: 1261 - DNA, 60 bp, Artificial Sequence
  Description of Artificial Sequence: Synthetic probe
cccacgcaggtctcccaactgacacaaaccgtgcagtttgaaactccgcctggtctttcc

SEQ ID NO: 1262 - DNA, 60 bp, Artificial Sequence
  Description of Artificial Sequence: Synthetic probe
acccacctacagctgaactcacggcaccgcgtggccatttagctggactgtgcggacgaa

SEQ ID NO: 1263 - DNA, 60 bp, Artificial Sequence
  Description of Artificial Sequence: Synthetic probe
gccgtgtgcggtgacgcgtaatccctcagatatcacaacggaaagattttgaggcgtgcg

SEQ ID NO: 1264 - DNA, 57 bp, Artificial Sequence
  Description of Artificial Sequence: Synthetic probe
gaagctgttccgtcgctgtgctgctgactacgcgtcacgcctgcacaatgaactggg

SEQ ID NO: 1265 - DNA, 60 bp, Artificial Sequence
  Description of Artificial Sequence: Synthetic probe
tatgccgggcccgtggagcgtcagaaacccctgagagtgagagccaagctaccacaacag

SEQ ID NO: 1266 - DNA, 60 bp, Artificial Sequence
  Description of Artificial Sequence: Synthetic probe
ccaacccagtggcaatgtttcaatacgactgcgcccttctcaacggcatggcggtcgaga

SEQ ID NO: 1267 - DNA, 60 bp, Artificial Sequence
  Description of Artificial Sequence: Synthetic probe
cgaggccaagccatggtacaagcttatcaaactcctaagccgcctgtcgtgcatggccgc

SEQ ID NO: 1268 - DNA, 60 bp, Artificial Sequence
  Description of Artificial Sequence: Synthetic probe
tcactcgacttgccttgccctacacggcgccgcaccgcgtgttggcgactgcgtacaacg

SEQ ID NO: 1269 - DNA, 60 bp, Artificial Sequence
  Description of Artificial Sequence: Synthetic probe
accaactttcttgatgtggccgaggcgtgccctacctttctgcacttcgagggcgacgtg

SEQ ID NO: 1270 - DNA, 60 bp, Artificial Sequence
  Description of Artificial Sequence: Synthetic probe
acgctgtcacttgctggaactcccaacagaccacaagggtgtctacggcggactgaccga

SEQ ID NO: 1271 - DNA, 60 bp, Artificial Sequence
  Description of Artificial Sequence: Synthetic probe
ttcttcgactgggtctacaactcgccagagaacctcacgctcgccgccatcgcgcagctt

SEQ ID NO: 1272 - DNA, 60 bp, Artificial Sequence
  Description of Artificial Sequence: Synthetic probe
tgagctacggtgatggggccacttcgcgcggccgagtcgcctggtgtgctccggctgacg

SEQ ID NO: 1273 - DNA, 58 bp, Artificial Sequence
  Description of Artificial Sequence: Synthetic probe
ggggtctcgtcaagtcatacgcgtacatgcgtaatggctgggacgtcgaggtgaccgc

SEQ ID NO: 1274 - DNA, 60 bp, Artificial Sequence
  Description of Artificial Sequence: Synthetic probe
cacgagcttctcgtgcgcatgaaacggacagagctctactgccccaggccactattggca

SEQ ID NO: 1275 - DNA, 51 bp, Artificial Sequence
  Description of Artificial Sequence: Synthetic probe
accaccgtggagaactacggtggtgagacacaaacccagagacggcaccac

SEQ ID NO: 1276 - DNA, 60 bp, Artificial Sequence
  Description of Artificial Sequence: Synthetic probe
gttctgccggttacggcaacatggtgacaactgacccgaaaacggctgaccctgcctacg

SEQ ID NO: 1277 - DNA, 60 bp, Artificial Sequence
  Description of Artificial Sequence: Synthetic probe
tgttctgccggttacggccacatggtgacaactgacccgaaaacggctgaccctgcctac

SEQ ID NO: 1278 - DNA, 60 bp, Artificial Sequence
  Description of Artificial Sequence: Synthetic probe
gagtacattgagaaggcgaatatcaccactgacgacaaaacgcttgacgaggcggaaaag

SEQ ID NO: 1279 - DNA, 60 bp, Artificial Sequence
  Description of Artificial Sequence: Synthetic probe
cgaccactggtgaatctgctgaccccgtcatcactaccgttgagaactacggaggagaga

SEQ ID NO: 1280 - DNA, 60 bp, Artificial Sequence
  Description of Artificial Sequence: Synthetic probe
cggagtcacattcgggtatgcaaccgctgaagatagcacgtctggacccaatgacactgg

SEQ ID NO: 1281 - DNA, 60 bp, Artificial Sequence
  Description of Artificial Sequence: Synthetic probe
ccacgcacgaacatgactgcgcacatcacagtgccctttgttggcgtcaaccgctacgac

SEQ ID NO: 1282 - DNA, 60 bp, Artificial Sequence
  Description of Artificial Sequence: Synthetic probe
agatgataccgcctttcccggcgttaattgaatgcaaccacaagatgaaccttcacccgg

SEQ ID NO: 1283 - DNA, 60 bp, Artificial Sequence
  Description of Artificial Sequence: Synthetic probe
gtccacaaagcacggacccgactttaaccggttggtgtctgcgtttgaggaattggccac

SEQ ID NO: 1284 - DNA, 60 bp, Artificial Sequence
  Description of Artificial Sequence: Synthetic probe
tgaactccaagttcacgttttcaatcccgtgcatctcggccgctgactacgcgtacaccg

SEQ ID NO: 1285 - DNA, 56 bp, Artificial Sequence
  Description of Artificial Sequence: Synthetic probe
gcagattacgcgtacactgcgtctgatgtggcagaaacaacaaacgtacagggatg

SEQ ID NO: 1286 - DNA, 50 bp, Artificial Sequence
  Description of Artificial Sequence: Synthetic probe
cggtcgcttgttcggacgggtacggtggcttggtgacaacagacccaaaa

SEQ ID NO: 1287 - DNA, 60 bp, Artificial Sequence
  Description of Artificial Sequence: Synthetic probe
cctggtggccatggtccctgaatggaaagagttcaccccgcgtgagaagtaccagctcac

SEQ ID NO: 1288 - DNA, 60 bp, Artificial Sequence
  Description of Artificial Sequence: Synthetic probe
gcgtttcttctttcacggacacaaggaaagatggaactcacactttacaacggtgaaaag

SEQ ID NO: 1289 - DNA, 60 bp, Artificial Sequence
  Description of Artificial Sequence: Synthetic probe
cgggcctgccgccttgtctaataaggacccacgtctgaacgaaggtgttgtcctcgatga

SEQ ID NO: 1290 - DNA, 60 bp, Artificial Sequence
  Description of Artificial Sequence: Synthetic probe
cgctgagaagtatgacaagatcatgttggacggcagggctttgacagacagtgactacag

SEQ ID NO: 1291 - DNA, 60 bp, Artificial Sequence
  Description of Artificial Sequence: Synthetic probe
cgggcttcaccccgaagaccatggtgtgccctgatgctctgaaccggaggtttcactttg

SEQ ID NO: 1292 - DNA, 60 bp, Artificial Sequence
  Description of Artificial Sequence: Synthetic probe
actacgacctacaccgccagtacacgcggggattcggctcacctaacggcgacgcatgct

SEQ ID NO: 1293 - DNA, 60 bp, Artificial Sequence
  Description of Artificial Sequence: Synthetic probe
acactggcactacgacctacaccgccagtacacgcggggattcggctcacctaacggcga

SEQ ID NO: 1294 - DNA, 60 bp, Artificial Sequence
  Description of Artificial Sequence: Synthetic probe
acgcagaatgggacactggtctgaactctaagttcacattttcaatcccgtacatctcgg

SEQ ID NO: 1295 - DNA, 60 bp, Artificial Sequence
  Description of Artificial Sequence: Synthetic probe
aaaattttggacacatgcacaaggttgttctgccccatgaaccaaaaggtgtttacgggg

SEQ ID NO: 1296 - DNA, 51 bp, Artificial Sequence
  Description of Artificial Sequence: Synthetic probe
aacgccatcagagagataagagcacttttcctaccacggactacaggaaaa

SEQ ID NO: 1297 - DNA, 51 bp, Artificial Sequence
  Description of Artificial Sequence: Synthetic probe
aacgccattagagagataagagcacttttcctaccacggactacaggaaaa

SEQ ID NO: 1298 - DNA, 60 bp, Artificial Sequence
  Description of Artificial Sequence: Synthetic probe
gtcccgacgttaaagggaggtaaccataagcatactaccgcctttcccggcgttaacggg

SEQ ID NO: 1299 - DNA, 60 bp, Artificial Sequence
  Description of Artificial Sequence: Synthetic probe
ctggggcgcgcgacgccgtaggagtgaaaagcctgagagggctttccccgctttcttaat

SEQ ID NO: 1300 - DNA, 60 bp, Artificial Sequence
  Description of Artificial Sequence: Synthetic probe
tggaagaggttactggtcttgaactgcacgagggtgggccacctgctctcgtcatctgga

SEQ ID NO: 1301 - DNA, 60 bp, Artificial Sequence
  Description of Artificial Sequence: Synthetic probe
gccaccactgttggcttcagagagaaaactctcccgggacacaaggcgggtgatgacgtg

SEQ ID NO: 1302 - DNA, 60 bp, Artificial Sequence
  Description of Artificial Sequence: Synthetic probe
gcgcgagtcgcgacacagcttcctgcttcttttaactacggtgcaatcagggcccagacc

SEQ ID NO: 1303 - DNA, 60 bp, Artificial Sequence
  Description of Artificial Sequence: Synthetic probe
aagcaagtactccgcgagcggtttgggacgaggcgatctggggccccacgcggcgcgagt

SEQ ID NO: 1304 - DNA, 56 bp, Artificial Sequence
  Description of Artificial Sequence: Synthetic probe
ccaccaacacgggctggtgggtgcgttactgcgtgcagccacgtactacttctccg

SEQ ID NO: 1305 - DNA, 60 bp, Artificial Sequence
  Description of Artificial Sequence: Synthetic probe
agatgtctgaggaggacaaagcgctgttccgtcgatgtgctgctgactacgcgtcacgcc

SEQ ID NO: 1306 - DNA, 50 bp, Artificial Sequence
  Description of Artificial Sequence: Synthetic probe
acgccgtggtgcgctcattgatttcgagaacggcactgtcggacccgagg

SEQ ID NO: 1307 - DNA, 60 bp, Artificial Sequence
  Description of Artificial Sequence: Synthetic probe
ccctatgaatacaactgactgttttatcgctttggtaaacgccatcaaagaggtaagagc

SEQ ID NO: 1308 - DNA, 60 bp, Artificial Sequence
  Description of Artificial Sequence: Synthetic probe
ccctatgaatacaactgactgttttatcgctttggtaaacgccatcaaagaggtaatagc

SEQ ID NO: 1309 - DNA, 60 bp, Artificial Sequence
  Description of Artificial Sequence: Synthetic probe
ctgcgttgggtgaacgccgtgtgcggtgacgtataatccctcagagatcatgattggcac

SEQ ID NO: 1310 - DNA, 60 bp, Artificial Sequence
  Description of Artificial Sequence: Synthetic probe
tgttcaaccctgagttcgggcccgctgtcttgtccaacaaggacccgcggctgaacgaag

SEQ ID NO: 1311 - DNA, 60 bp, Artificial Sequence
  Description of Artificial Sequence: Synthetic probe
cgcgatgacgtgaactccgagcccgcctgccctgacacagagcaaccacaagctgaagga

SEQ ID NO: 1312 - DNA, 60 bp, Artificial Sequence
  Description of Artificial Sequence: Synthetic probe
tcgccccggcgcccagcaagtcgagacctgagcccgtggtcgtttgcctccgtggtaaat

SEQ ID NO: 1313 - DNA, 60 bp, Artificial Sequence
  Description of Artificial Sequence: Synthetic probe
tcccgtacaccgcaccacaccgcgtgttggccacaacgtacaccggtacaacggcctaca

SEQ ID NO: 1314 - DNA, 60 bp, Artificial Sequence
  Description of Artificial Sequence: Synthetic probe
gacgttgctgaggcttgccccaccctcctgatgttcgagaacgtgccctacgtctcaaca

SEQ ID NO: 1315 - DNA, 60 bp, Artificial Sequence
  Description of Artificial Sequence: Synthetic probe
caacacagtcgagcgttggagtcacgtacgggtacgcaacagttgaggacaacacgtcag

SEQ ID NO: 1316 - DNA, 60 bp, Artificial Sequence
  Description of Artificial Sequence: Synthetic probe
gagaacctcacgctgtcggccatcaagcagctagaggaactcaccgggcttgagttacgc

SEQ ID NO: 1317 - DNA, 60 bp, Artificial Sequence
  Description of Artificial Sequence: Synthetic probe
gtaaccgcaagatctaccttcgcccggaagtaaaacggaaactcatcacagttttgcccg

SEQ ID NO: 1318 - DNA, 60 bp, Artificial Sequence
  Description of Artificial Sequence: Synthetic probe
agggtctcacccctagcaggccaacgactgtccctgcgttgcgctccacacttacgttgt

SEQ ID NO: 1319 - DNA, 60 bp, Artificial Sequence
  Description of Artificial Sequence: Synthetic probe
ccgactacgcgtcgcgcttacacaatgtgctgggtacggcaaacgccccattgagcgttt

SEQ ID NO: 1320 - DNA, 57 bp, Artificial Sequence
  Description of Artificial Sequence: Synthetic probe
ggcactagaggtgatctcacaagacagacacaaacagaagatcattgcacccgaaaa

SEQ ID NO: 1321 - DNA, 60 bp, Artificial Sequence
  Description of Artificial Sequence: Synthetic probe
cccggactaactaccccgggcgtttcaccaacttgttggacgtggctgaggcatgtccca

SEQ ID NO: 1322 - DNA, 57 bp, Artificial Sequence
  Description of Artificial Sequence: Synthetic probe
cattttcctgaaaggtcgggagcacgctgtgtttgcatgtgtcacctctgacgggtg

SEQ ID NO: 1323 - DNA, 60 bp, Artificial Sequence
  Description of Artificial Sequence: Synthetic probe
ctccacccacttcaccggcagaactgattcagtttggtactgcccacctgaccctgacca

SEQ ID NO: 1324 - DNA, 60 bp, Artificial Sequence
  Description of Artificial Sequence: Synthetic probe
ctcactccgcaggcggcaacggagttggatactgctcatgcctttccaggtccatgcttc

SEQ ID NO: 1325 - DNA, 53 bp, Artificial Sequence
  Description of Artificial Sequence: Synthetic probe
actgggtcaccagtgacccgttcggacggtactacctgctggaactcccaact

SEQ ID NO: 1326 - DNA, 51 bp, Artificial Sequence
  Description of Artificial Sequence: Synthetic probe
ctttgaaagtgaacgcaaagaacttgatcgtcactgagagtggtgctcccc

SEQ ID NO: 1327 - DNA, 60 bp, Artificial Sequence
  Description of Artificial Sequence: Synthetic probe
gagaacctcacacttgatgctatcaaacgattggaagaaattactggtctcgagctccac

SEQ ID NO: 1328 - DNA, 60 bp, Artificial Sequence
  Description of Artificial Sequence: Synthetic probe
cgagcacaaggaaagatggagttcacactttacaacggtgagaagaaaacattctactcc

SEQ ID NO: 1329 - DNA, 60 bp, Artificial Sequence
  Description of Artificial Sequence: Synthetic probe
ctccaagttttggatcagaaggcggcgagaccgctgcctacctccttcaactatggtgcc

SEQ ID NO: 1330 - DNA, 57 bp, Artificial Sequence
  Description of Artificial Sequence: Synthetic probe
gcctactacaaagcaccgcttactcggctggccctgccatacacggccccacaccgc

SEQ ID NO: 1331 - DNA, 60 bp, Artificial Sequence
  Description of Artificial Sequence: Synthetic probe
ttcggctgctgactacgcgtacaccgcgtctgacactgcagagaccataaacgtgcaggg

SEQ ID NO: 1332 - DNA, 60 bp, Artificial Sequence
  Description of Artificial Sequence: Synthetic probe
ggcattttcctgaaaggaacagaacacgctgtgttcgcttgtgtcacctccaacgggtgg

SEQ ID NO: 1333 - DNA, 60 bp, Artificial Sequence
  Description of Artificial Sequence: Synthetic probe
ggctggtcaaactaatccttgccatccgcgactggatcaaggcttggattgcctcagaag

SEQ ID NO: 1334 - DNA, 53 bp, Artificial Sequence
  Description of Artificial Sequence: Synthetic probe
acgggacaagcaagtactccgtgagcggttcgagacgaggcgacttggggacc

SEQ ID NO: 1335 - DNA, 60 bp, Artificial Sequence
  Description of Artificial Sequence: Synthetic probe
gccgaagcatgtcccacttttctctgttttgacgatgggaaaccgtacgtcgttacgcgg

SEQ ID NO: 1336 - DNA, 60 bp, Artificial Sequence
  Description of Artificial Sequence: Synthetic probe
caaggtctacgctaacattgccccaacctatgttcacgtggctggggagcttccctcgaa

SEQ ID NO: 1337 - DNA, 60 bp, Artificial Sequence
  Description of Artificial Sequence: Synthetic probe
gggacgttgaggtgtctgccgttggcaatcagtttaacggtgggtgccttctggtggcca

SEQ ID NO: 1338 - DNA, 60 bp, Artificial Sequence
  Description of Artificial Sequence: Synthetic probe
acacaaccagcacccaaaacaacgattggttttcgaaacttgccagctcagctttcaccg

SEQ ID NO: 1339 - DNA, 60 bp, Artificial Sequence
  Description of Artificial Sequence: Synthetic probe
ggtacgcgattgatgacgaggacttttacccgtggacgcctgacccatcggacgtcttgg

SEQ ID NO: 1340 - DNA, 60 bp, Artificial Sequence
  Description of Artificial Sequence: Synthetic probe
ccactgattttcatgaatacaactaactgttttatcgctttggtgtacgccatcagagag

SEQ ID NO: 1341 - DNA, 57 bp, Artificial Sequence
  Description of Artificial Sequence: Synthetic probe
gggccgtttcgcgcgggctgatcgcatggcctgctttggttgacgcccgaaacccgc

SEQ ID NO: 1342 - DNA, 60 bp, Artificial Sequence
  Description of Artificial Sequence: Synthetic probe
agggtttcacccctagcatgccaccgacagcccctgcgatgcactccacacttacgttct

SEQ ID NO: 1343 - DNA, 60 bp, Artificial Sequence
  Description of Artificial Sequence: Synthetic probe
ggtgaacgccgtgtgcggtgacgcatgatccctcagatgttacaattggcagaaagacgc

SEQ ID NO: 1344 - DNA, 60 bp, Artificial Sequence
  Description of Artificial Sequence: Synthetic probe
cgtggttggcgtgatcaacaacgctgacgtcgggagactgattttctctggcgaggccct

SEQ ID NO: 1345 - DNA, 60 bp, Artificial Sequence
  Description of Artificial Sequence: Synthetic probe
caccacggatgacaagactcttgacgaggcagaaaagaaccctctggagaccagtggtgc

SEQ ID NO: 1346 - DNA, 60 bp, Artificial Sequence
  Description of Artificial Sequence: Synthetic probe
gattgaacgggtcgagctccacgagaaagtatcgagccacccaatcttcaagcagatctc

SEQ ID NO: 1347 - DNA, 60 bp, Artificial Sequence
  Description of Artificial Sequence: Synthetic probe
acggcgagtggctggtcaagctgattcttgctatccgcgactggattaaagcatggatcg

SEQ ID NO: 1348 - DNA, 60 bp, Artificial Sequence
  Description of Artificial Sequence: Synthetic probe
gggtgcccaatggctcacccaaagatgctctggacaaccagaccaacccaactgcctacc

SEQ ID NO: 1349 - DNA, 58 bp, Artificial Sequence
  Description of Artificial Sequence: Synthetic probe
atgccaaagctcggtacatggtagcctacatccctcccggcatgacaccggccacgga

SEQ ID NO: 1350 - DNA, 60 bp, Artificial Sequence
  Description of Artificial Sequence: Synthetic probe
ctcaacggaggatggaaggcaagggttcagaaacggctcaaaggagccgggcaatccagc

SEQ ID NO: 1351 - DNA, 60 bp, Artificial Sequence
  Description of Artificial Sequence: Synthetic probe
gctctactacacgcccttagagagatcaagacattctttcgttcacggacacaaggaaag

SEQ ID NO: 1352 - DNA, 60 bp, Artificial Sequence
  Description of Artificial Sequence: Synthetic probe
cgacgttaaaggggcgtaaccacaagcctggaaccgtcttgcccgacgttaacgggctgt

SEQ ID NO: 1353 - DNA, 60 bp, Artificial Sequence
  Description of Artificial Sequence: Synthetic probe
agaaagacgctgaggcgagcgacgccgtaggagtgaaaagtccgaaaaggcttttcccgc

SEQ ID NO: 1354 - DNA, 60 bp, Artificial Sequence
  Description of Artificial Sequence: Synthetic probe
ggggcgctagggtctcacccctaaaatgccaacgacagtccctgcattgcactccatact

SEQ ID NO: 1355 - DNA, 60 bp, Artificial Sequence
  Description of Artificial Sequence: Synthetic probe
acctggacttcgaggctctcaagccccacttcaagtccctcggtcagaccatcactccag

SEQ ID NO: 1356 - DNA, 60 bp, Artificial Sequence
  Description of Artificial Sequence: Synthetic probe
cgtgctagggacggcaaacgccccactgagtgtatacgaagccatcaaaggcgtcgatgg

SEQ ID NO: 1357 - DNA, 60 bp, Artificial Sequence
  Description of Artificial Sequence: Synthetic probe
taaagtgaaagccaggctgccacaacaggagggaccctacgccggcccaatggagagaca

SEQ ID NO: 1358 - DNA, 60 bp, Artificial Sequence
  Description of Artificial Sequence: Synthetic probe
aagcctcaaccgcccgtccagaacgtctaccaactcgttcaggaggtgattgagcgggtg

SEQ ID NO: 1359 - DNA, 60 bp, Artificial Sequence
  Description of Artificial Sequence: Synthetic probe
tcgaggcccgaaccagtggtcgtgtgtcttcgcggcaaatccggccaagggaagagtttc

SEQ ID NO: 1360 - DNA, 60 bp, Artificial Sequence
  Description of Artificial Sequence: Synthetic probe
gctctgcccacctccttcaactacggtgccatcaaggcaactcgtgtgactgaactactc

SEQ ID NO: 1361 - DNA, 60 bp, Artificial Sequence
  Description of Artificial Sequence: Synthetic probe
acgttttcgatcccatacctttcggcggcagactacgcatacaccgcgtccgacgttgcc

SEQ ID NO: 1362 - DNA, 60 bp, Artificial Sequence
  Description of Artificial Sequence: Synthetic probe
ccggagctctgccccatcaccaagagagagctgtaccaactcacacttttccctcaccag

SEQ ID NO: 1363 - DNA, 60 bp, Artificial Sequence
  Description of Artificial Sequence: Synthetic probe
ccagcgaggtgtgcatgatcgacggcacagacatgtgcttggccgacttccacgccggta

SEQ ID NO: 1364 - DNA, 60 bp, Artificial Sequence
  Description of Artificial Sequence: Synthetic probe
aagtaacaccgtcgctcccgacgttcaaagggaggaaaccacaagcttgcaccaccactc

SEQ ID NO: 1365 - DNA, 60 bp, Artificial Sequence
  Description of Artificial Sequence: Synthetic probe
gcaggaggcaacggagttggatactgttcatgcgtttccaggtccatgcttcttaaaatg

SEQ ID NO: 1366 - DNA, 51 bp, Artificial Sequence
  Description of Artificial Sequence: Synthetic probe
aacaactacttttaatgagcacaactgactgtttcatcgctttgttgcacg

SEQ ID NO: 1367 - DNA, 60 bp, Artificial Sequence
  Description of Artificial Sequence: Synthetic probe
cttcgcccaaatggtttcaaccacggggtttatcccgcccatggcatcacttgaggacaa

SEQ ID NO: 1368 - DNA, 60 bp, Artificial Sequence
  Description of Artificial Sequence: Synthetic probe
ctgagttcgggcctgccgccctgtctaacaaggacccacgtctgaacgagggtgttgtcc

SEQ ID NO: 1369 - DNA, 60 bp, Artificial Sequence
  Description of Artificial Sequence: Synthetic probe
gtgcgaccccagcacggcgactttactgcgaaacccactttaaagtgacatcgaaactgg

SEQ ID NO: 1370 - DNA, 60 bp, Artificial Sequence
  Description of Artificial Sequence: Synthetic probe
aacaaggacccacggggccaaaagccacgcccacacgggcccgtcatgtgtgcgacccca

SEQ ID NO: 1371 - DNA, 60 bp, Artificial Sequence
  Description of Artificial Sequence: Synthetic probe
gcaaccgtaagacacaccttcatccggaagtaaaacggctgcgtcacgtagttttgccct

SEQ ID NO: 1372 - DNA, 60 bp, Artificial Sequence
  Description of Artificial Sequence: Synthetic probe
gcatggccgttgaaatgaagagaatgcgacaagatatgtttaagcctcaaccgcccctcc

SEQ ID NO: 1373 - DNA, 60 bp, Artificial Sequence
  Description of Artificial Sequence: Synthetic probe
cgtcggagtcacttacgggtacgcaacagttgaggactttgtgagcggaccaaacacatc

SEQ ID NO: 1374 - DNA, 55 bp, Artificial Sequence
  Description of Artificial Sequence: Synthetic probe
gactgggtcacagaaccagtcgggcaacactggaagcattattaacaattactac

SEQ ID NO: 1375 - DNA, 60 bp, Artificial Sequence
  Description of Artificial Sequence: Synthetic probe
attgacttcgagaacggcacggttggacccgaggtcgcggctgccctgaagctcatggag

SEQ ID NO: 1376 - DNA, 60 bp, Artificial Sequence
  Description of Artificial Sequence: Synthetic probe
gtgttcaaccctgagttcggccccgctgccctgtccaacaaggacccgcgactgaacgaa

SEQ ID NO: 1377 - DNA, 60 bp, Artificial Sequence
  Description of Artificial Sequence: Synthetic probe
aagccaagaatttgattgtcactgagagtggcgccccaccgactgacttgcaaaagatgg

SEQ ID NO: 1378 - DNA, 60 bp, Artificial Sequence
  Description of Artificial Sequence: Synthetic probe
caaggacttcaagtacttcgcccaaatggtgtcgaccacggggttcatcccacccatggc

SEQ ID NO: 1379 - DNA, 60 bp, Artificial Sequence
  Description of Artificial Sequence: Synthetic probe
cggagcacttcgggccaccaacatccatgaaatccttgtgcgcatgaagcgagctgaact

SEQ ID NO: 1380 - DNA, 60 bp, Artificial Sequence
  Description of Artificial Sequence: Synthetic probe
aaagctcccagccccacgcacgtcattgacctcatgcaaacccaccagcacgggcttgtg

SEQ ID NO: 1381 - DNA, 60 bp, Artificial Sequence
  Description of Artificial Sequence: Synthetic probe
tttctgccgctgactacgcctacaccgcgtccgacgaggcagagacgaccaatgtgcaag

SEQ ID NO: 1382 - DNA, 60 bp, Artificial Sequence
  Description of Artificial Sequence: Synthetic probe
aaaccgaggagaccactcttttggaggaccgcatccttaccacccgcaacggccacacca

SEQ ID NO: 1383 - DNA, 60 bp, Artificial Sequence
  Description of Artificial Sequence: Synthetic probe
gctctgttacacgcccttagagagatcaaaacactctttctttcacggacacaaggaaag

SEQ ID NO: 1384 - DNA, 60 bp, Artificial Sequence
  Description of Artificial Sequence: Synthetic probe
actccacacttacgtttgtgtgcgcgcggagaccggtggactttcgttcacccacctgca

SEQ ID NO: 1385 - DNA, 60 bp, Artificial Sequence
  Description of Artificial Sequence: Synthetic probe
atttggaacattaaacacttgctcaacactggaatcggcaccgcctcgcgacccagcgaa

SEQ ID NO: 1386 - DNA, 59 bp, Artificial Sequence
  Description of Artificial Sequence: Synthetic probe
cttccccgttgcgtgttctgccggttacggccacttggtgacaactgacccgaaaacgg

SEQ ID NO: 1387 - DNA, 60 bp, Artificial Sequence
  Description of Artificial Sequence: Synthetic probe
ccgcggctgaatgaaggtgttgtcctcgatgaagccattttctccaaacacaaaggagac

SEQ ID NO: 1388 - DNA, 60 bp, Artificial Sequence
  Description of Artificial Sequence: Synthetic probe
tcatcaagatcctgagccgcttgtcatgcatggccgccgtagcagcacggtcaaaggacc

SEQ ID NO: 1389 - DNA, 60 bp, Artificial Sequence
  Description of Artificial Sequence: Synthetic probe
gggaaaccgtacgttgtgacaagaacggatgagcagcgtcttctggccaagttcgacgtc

SEQ ID NO: 1390 - DNA, 60 bp, Artificial Sequence
  Description of Artificial Sequence: Synthetic probe
ccggcgtaaatgggatgtaaccacaagacacaccttcagccggaagtaaacgacaacacc

SEQ ID NO: 1391 - DNA, 53 bp, Artificial Sequence
  Description of Artificial Sequence: Synthetic probe
actgggtcaccagtgacccgtttggacggtgttatctgctggaactcccaact

SEQ ID NO: 1392 - DNA, 54 bp, Artificial Sequence
  Description of Artificial Sequence: Synthetic probe
ttgaaagggggcgttagggtctcttccctaacatgccaacgacagctcctgcgc

SEQ ID NO: 1393 - DNA, 60 bp, Artificial Sequence
  Description of Artificial Sequence: Synthetic probe
ggaacacgcctatgagaacaaacgcatcgctgttgaaggcgggatgccatctggttgttc

SEQ ID NO: 1394 - DNA, 60 bp, Artificial Sequence
  Description of Artificial Sequence: Synthetic probe
actcgacgccatggaaccagacaccgcgcccggccttccctgggctctccaggggaaacg

SEQ ID NO: 1395 - DNA, 60 bp, Artificial Sequence
  Description of Artificial Sequence: Synthetic probe
gcgagactcgcaagagacaacagaacaagactctcgacgaggcggaaaagaaccctctgg

SEQ ID NO: 1396 - DNA, 60 bp, Artificial Sequence
  Description of Artificial Sequence: Synthetic probe
cccagactcttgatctcatgcagatcccctcgcacacactggttggggcgttactccggt

SEQ ID NO: 1397 - DNA, 60 bp, Artificial Sequence
  Description of Artificial Sequence: Synthetic probe
gggatgggtgtgcatttaccagatcacgcacggtaaagctgaaggtgacgcactggtcgt

SEQ ID NO: 1398 - DNA, 60 bp, Artificial Sequence
  Description of Artificial Sequence: Synthetic probe
gggagctgccctcgaaggagggaatagttcctgtagcgtgtgtggacggttacggcaaca

SEQ ID NO: 1399 - DNA, 60 bp, Artificial Sequence
  Description of Artificial Sequence: Synthetic probe
cggaagagacaaccttgcttgaagaccgcatcctcaccaccagaaatggccacacgacgt

SEQ ID NO: 1400 - DNA, 60 bp, Artificial Sequence
  Description of Artificial Sequence: Synthetic probe
cccttggacgccggacccgtccgatgtcctggtatttgtgccgtacgatcaagaaccact

SEQ ID NO: 1401 - DNA, 60 bp, Artificial Sequence
  Description of Artificial Sequence: Synthetic probe
gctttgttgcacgccattagaaagatcaaggcacgacttcttctacggacacaagagaag

SEQ ID NO: 1402 - DNA, 60 bp, Artificial Sequence
  Description of Artificial Sequence: Synthetic probe
caggtctagaggggtgtcatactgtactgtgcttgactccacactcggtccactagcgag

SEQ ID NO: 1403 - DNA, 60 bp, Artificial Sequence
  Description of Artificial Sequence: Synthetic probe
ccgacgttaaagggaagcagccacaagcttgacaccgtcttgcccagcgttaaggggctg

SEQ ID NO: 1404 - DNA, 60 bp, Artificial Sequence
  Description of Artificial Sequence: Synthetic probe
ccgactacgcgtcgcgcttacacaatgtgttgggcacggcaaacgccccattgagcgttt

SEQ ID NO: 1405 - DNA, 60 bp, Artificial Sequence
  Description of Artificial Sequence: Synthetic probe
ccgttgttggcgttattaacaatgctgacgtcgggagactgatcttctctggtgaggccc

SEQ ID NO: 1406 - DNA, 60 bp, Artificial Sequence
  Description of Artificial Sequence: Synthetic probe
cccttgccgcgaagcacatgtctaacacatacttggcaggaattgcccagtactacacac

SEQ ID NO: 1407 - DNA, 60 bp, Artificial Sequence
  Description of Artificial Sequence: Synthetic probe
cccggactaactaccccgggcgtttcactaacttgttggacgtggctgaggcatgtccca

SEQ ID NO: 1408 - DNA, 60 bp, Artificial Sequence
  Description of Artificial Sequence: Synthetic probe
ggcgttaacgggacgtaaccacaagatttacctccacccgggagtaaaacggaacatcac

SEQ ID NO: 1409 - DNA, 60 bp, Artificial Sequence
  Description of Artificial Sequence: Synthetic probe
cacccacccacagttggactaacggcactgcgtggccattttagctggatagtgcggacg

SEQ ID NO: 1410 - DNA, 60 bp, Artificial Sequence
  Description of Artificial Sequence: Synthetic probe
ccttcctggcaggtctcgcccagtactacacacagtatagcggcaccatcaacctgcact

SEQ ID NO: 1411 - DNA, 60 bp, Artificial Sequence
  Description of Artificial Sequence: Synthetic probe
ccttcctggcaggtctcgcccagtactacacacagtacaccggcaccatcaacctgcact

SEQ ID NO: 1412 - DNA, 60 bp, Artificial Sequence
  Description of Artificial Sequence: Synthetic probe
ggtggatgatgcagtgaatgagtatattgagaaagccaacatcaccacagatgacaagac

SEQ ID NO: 1413 - DNA, 55 bp, Artificial Sequence
  Description of Artificial Sequence: Synthetic probe
aataagcgaccggaggccggcgcttttctgctaaaccactattaactcaatgaac

SEQ ID NO: 1414 - DNA, 60 bp, Artificial Sequence
  Description of Artificial Sequence: Synthetic probe
cggcaccgcgtagtcattttagctggattgtgaggacgaacaccgtttgcgcatctcgcg

SEQ ID NO: 1415 - DNA, 51 bp, Artificial Sequence
  Description of Artificial Sequence: Synthetic probe
tggactattcggccttcgatgctaaccactgtagtgacgcgatgaacatca

SEQ ID NO: 1416 - DNA, 60 bp, Artificial Sequence
  Description of Artificial Sequence: Synthetic probe
cgcccaccgttgcacacggtgtgttcaatcctgagtttgggcctgccgccttgtcaaaca

SEQ ID NO: 1417 - DNA, 60 bp, Artificial Sequence
  Description of Artificial Sequence: Synthetic probe
gggttcatcccgcccatggcatctctcgaggacaaaggcaagcctttcaacagcaaggtc

SEQ ID NO: 1418 - DNA, 60 bp, Artificial Sequence
  Description of Artificial Sequence: Synthetic probe
cggacgtctcgttcatcatggacagattcgtgaaagtcacaccaacagaccaaaccaatg

SEQ ID NO: 1419 - DNA, 60 bp, Artificial Sequence
  Description of Artificial Sequence: Synthetic probe
gctgcacactgcattcatgctgagtgggacactgggttgaattcaaagttcacatttccc

SEQ ID NO: 1420 - DNA, 60 bp, Artificial Sequence
  Description of Artificial Sequence: Synthetic probe
gccacctcctggaactcccgactgatcacaaaggtgtctacggcagcttgaccgactcgt

SEQ ID NO: 1421 - DNA, 60 bp, Artificial Sequence
  Description of Artificial Sequence: Synthetic probe
atgctatcaagcagttggaagaattcaccgggctcgagttacacgagggcggcccgcctg

SEQ ID NO: 1422 - DNA, 56 bp, Artificial Sequence
  Description of Artificial Sequence: Synthetic probe
gacactcgggatctgagaaggggactgaggtttctttaaaagcgctcggtttaaaa

SEQ ID NO: 1423 - DNA, 60 bp, Artificial Sequence
  Description of Artificial Sequence: Synthetic probe
ccgacgtaaaaggaagtaaccacaagcttggcactgcctgtcccggcattaaagggaggt

SEQ ID NO: 1424 - DNA, 60 bp, Artificial Sequence
  Description of Artificial Sequence: Synthetic probe
cttacgttcctgtgtgcgcgggacccgatggactctcgttcacccacttacagctggact

SEQ ID NO: 1425 - DNA, 60 bp, Artificial Sequence
  Description of Artificial Sequence: Synthetic probe
cgattggcagaaagactctgaggcgagcgacaccgtaggagtgaaaagcccgagaggcgt

SEQ ID NO: 1426 - DNA, 60 bp, Artificial Sequence
  Description of Artificial Sequence: Synthetic probe
tgagcctgtcaaacccgagagggaacaaccgcaagctgaaggaccctacgccgggccgct

SEQ ID NO: 1427 - DNA, 60 bp, Artificial Sequence
  Description of Artificial Sequence: Synthetic probe
accctcccgggacagaagacacgcgatgaagtgaacactgagcctgtcaaacccgagagg

SEQ ID NO: 1428 - DNA, 60 bp, Artificial Sequence
  Description of Artificial Sequence: Synthetic probe
tctctgacttggagttggctgtgaaacatgaaggcgacctcacctgggtcccgaacgggg

SEQ ID NO: 1429 - DNA, 56 bp, Artificial Sequence
  Description of Artificial Sequence: Synthetic probe
gtggttccaacgagggctccacagacacaacttccacacacacaaccaacacccag

SEQ ID NO: 1430 - DNA, 60 bp, Artificial Sequence
  Description of Artificial Sequence: Synthetic probe
tcaagagccactcaatggcgactggaagacaaaggttcagaagaagctcaagggagccgg

SEQ ID NO: 1431 - DNA, 60 bp, Artificial Sequence
  Description of Artificial Sequence: Synthetic probe
gactgggtctatgactcgcctgagaacctcaccctcgacgcgatcagacagctggaagag

SEQ ID NO: 1432 - DNA, 57 bp, Artificial Sequence
  Description of Artificial Sequence: Synthetic probe
caatgaatacaactgactgttttatcgctttgactcacgctgccagagagattaaag

SEQ ID NO: 1433 - DNA, 60 bp, Artificial Sequence
  Description of Artificial Sequence: Synthetic probe
gtgagcgcacgaaacgcgccgtcgcttgtggaagacttgtacaaacacgatctacgcagg

SEQ ID NO: 1434 - DNA, 60 bp, Artificial Sequence
  Description of Artificial Sequence: Synthetic probe
agcacgggctggtaggtgcgctgttgcgtgcagccacgtactacttctctgacttggaga

SEQ ID NO: 1435 - DNA, 60 bp, Artificial Sequence
  Description of Artificial Sequence: Synthetic probe
caacacgggctggtaggtgcgctgttgcgtgcagccacgtactacttctctgacttggag

SEQ ID NO: 1436 - DNA, 60 bp, Artificial Sequence
  Description of Artificial Sequence: Synthetic probe
aagggaggcaaccgcaagcttttaccgcctttcccggcggtaacgggatgcaaccacaag

SEQ ID NO: 1437 - DNA, 60 bp, Artificial Sequence
  Description of Artificial Sequence: Synthetic probe
agcttgacgccgtctgtcccgacgtcaaagggaggcaaccgcaagcttttaccgcctttc

SEQ ID NO: 1438 - DNA, 60 bp, Artificial Sequence
  Description of Artificial Sequence: Synthetic probe
cgacgtgaaggggaagtaaccacaagcttgacgccgtctgtcccgacgttaaagggaggc

SEQ ID NO: 1439 - DNA, 60 bp, Artificial Sequence
  Description of Artificial Sequence: Synthetic probe
aagtactccgcaggtggtacgggcagacggggcgacctagggcctctcgcggcgagggtc

SEQ ID NO: 1440 - DNA, 60 bp, Artificial Sequence
  Description of Artificial Sequence: Synthetic probe
ttttcaagaagcacctgtttgattggacaccggacaaagcttttgggcacttagagaagt

SEQ ID NO: 1441 - DNA, 60 bp, Artificial Sequence
  Description of Artificial Sequence: Synthetic probe
caccgtcttgtccgacgttaaagggctgtaaccacaagcttgcaccgtctttcccggcgt

SEQ ID NO: 1442 - DNA, 55 bp, Artificial Sequence
  Description of Artificial Sequence: Synthetic probe
cgctcacgcatattcgcgtgaccggccagtactcttaccactttccgcctacttg

SEQ ID NO: 1443 - DNA, 60 bp, Artificial Sequence
  Description of Artificial Sequence: Synthetic probe
tggtgttgtcctcgacgaaaccatcttctccaaacacaaaggagatacaaagatgtctga

SEQ ID NO: 1444 - DNA, 60 bp, Artificial Sequence
  Description of Artificial Sequence: Synthetic probe
tcagtttcggagccccgattctgttagccgggctggtcaaggtcgcctcgagtttcttcc

SEQ ID NO: 1445 - DNA, 60 bp, Artificial Sequence
  Description of Artificial Sequence: Synthetic probe
aacgggacggacaagtaccccgtgagcgcttcgggaggacgaggtgatttggggcctctt

SEQ ID NO: 1446 - DNA, 60 bp, Artificial Sequence
  Description of Artificial Sequence: Synthetic probe
accacttctaccggggagtcagcagaccctgttaccaccaccgtagagaactacggcggt

SEQ ID NO: 1447 - DNA, 60 bp, Artificial Sequence
  Description of Artificial Sequence: Synthetic probe
gtttcccttgccgcaaagcatatgtctaacacatacttgtcagggctcgcacagtacttc

SEQ ID NO: 1448 - DNA, 60 bp, Artificial Sequence
  Description of Artificial Sequence: Synthetic probe
acaaacctattggacgtggccgaggcgtgtcccaccttcctctgcttcgacggcgggaga

SEQ ID NO: 1449 - DNA, 60 bp, Artificial Sequence
  Description of Artificial Sequence: Synthetic probe
ttacggaggactggtgacgacagatccgaagacagctgaccccgcgtacggcaaggtgta

SEQ ID NO: 1450 - DNA, 60 bp, Artificial Sequence
  Description of Artificial Sequence: Synthetic probe
gccctggacactggttgtcatggttgtgtcgccacttacggttaacgccacgagtgcaac

SEQ ID NO: 1451 - DNA, 54 bp, Artificial Sequence
  Description of Artificial Sequence: Synthetic probe
aaaactggagcttcccactgtccaccacggcgttttcggacacctggtagactc

SEQ ID NO: 1452 - DNA, 51 bp, Artificial Sequence
  Description of Artificial Sequence: Synthetic probe
ggggaataaccacaagcttaacaacgtctgtcccgacgttaaagggaggtg

SEQ ID NO: 1453 - DNA, 60 bp, Artificial Sequence
  Description of Artificial Sequence: Synthetic probe
caccttttcgattgggtcaccagcgactcattcggacgttgccacctcctggaactcccg

SEQ ID NO: 1454 - DNA, 60 bp, Artificial Sequence
  Description of Artificial Sequence: Synthetic probe
ctacaccagaatgatgattggcaggttctgtgcacaaatgcactccagcaacggaccgca

SEQ ID NO: 1455 - DNA, 60 bp, Artificial Sequence
  Description of Artificial Sequence: Synthetic probe
ttccgtctgtgcgctgccgactatgcctcgcatctgcacaacgtacttgggacagccaac

SEQ ID NO: 1456 - DNA, 60 bp, Artificial Sequence
  Description of Artificial Sequence: Synthetic probe
actgctcctgtgtctcacgatccatgctcctacagatgaaggcccacatcgaccctcccc

SEQ ID NO: 1457 - DNA, 60 bp, Artificial Sequence
  Description of Artificial Sequence: Synthetic probe
gacagcaaccgctgaaactcaaggctaagctccctcaggccgagggaccttacgctgggc

SEQ ID NO: 1458 - DNA, 60 bp, Artificial Sequence
  Description of Artificial Sequence: Synthetic probe
tgtcgggactaacaaatgggtgggctgggctcccaacggcagcccggtgctgagtgaagt

SEQ ID NO: 1459 - DNA, 60 bp, Artificial Sequence
  Description of Artificial Sequence: Synthetic probe
ccgtcagtgcaggccccgactttgagttcagaatgcccatcagtccatcgcgccaaacaa

SEQ ID NO: 1460 - DNA, 60 bp, Artificial Sequence
  Description of Artificial Sequence: Synthetic probe
gcagaagcctgccccacactgctcgatttcaacggggttccatacgtccaaacccagaac

SEQ ID NO: 1461 - DNA, 60 bp, Artificial Sequence
  Description of Artificial Sequence: Synthetic probe
actcacacttttcccgcatcagttcttgaacccacgtaccaacaccacagcacacatcca

SEQ ID NO: 1462 - DNA, 60 bp, Artificial Sequence
  Description of Artificial Sequence: Synthetic probe
ccctggctgacttccacgctggcattttcatcaagggtaccgagcacgctgtgttcgctc

SEQ ID NO: 1463 - DNA, 60 bp, Artificial Sequence
  Description of Artificial Sequence: Synthetic probe
caactctattaaggaggaactccaacccctcctccaacaaacttcatttgtgaaacgcgc

SEQ ID NO: 1464 - DNA, 60 bp, Artificial Sequence
  Description of Artificial Sequence: Synthetic probe
cgactctattaaagaggaactccaacccctcctccaacaaacttcatttgtgaaacgcgc

SEQ ID NO: 1465 - DNA, 60 bp, Artificial Sequence
  Description of Artificial Sequence: Synthetic probe
cgactctattaaggaggaactccaacccctcctccaacaaacttcatttgtgaaacgcgc

SEQ ID NO: 1466 - DNA, 60 bp, Artificial Sequence
  Description of Artificial Sequence: Synthetic probe
caggctaaggatgccctccaggtaccccgaggtaacatgagacactcgggatctgaggag

SEQ ID NO: 1467 - DNA, 60 bp, Artificial Sequence
  Description of Artificial Sequence: Synthetic probe
gactttgaggctcttaagccgcacttcaaatctcttggccaaaccatcactccagctgac

SEQ ID NO: 1468 - DNA, 60 bp, Artificial Sequence
  Description of Artificial Sequence: Synthetic probe
atgaaatccgtccgatcgagaaggtacgcagcggcaagacccgcattgtcgacgtcttgc

SEQ ID NO: 1469 - DNA, 60 bp, Artificial Sequence
  Description of Artificial Sequence: Synthetic probe
gctggctactgcggaggagccgttcttgcaaaagacggagccgacacattcatcgttggc

SEQ ID NO: 1470 - DNA, 60 bp, Artificial Sequence
  Description of Artificial Sequence: Synthetic probe
ctggtgaggcccttacctacaaagatattgtagtgtgcatggatggcgacaccatgcctg

SEQ ID NO: 1471 - DNA, 60 bp, Artificial Sequence
  Description of Artificial Sequence: Synthetic probe
tacgccgggccacttgagcgtcagaagcccctgaaagtgagagccaagctcccacagcaa

SEQ ID NO: 1472 - DNA, 55 bp, Artificial Sequence
  Description of Artificial Sequence: Synthetic probe
cttcttcttctccgacgtcaggtcgaacttttctaagctggtagatactatcaac

SEQ ID NO: 1473 - DNA, 60 bp, Artificial Sequence
  Description of Artificial Sequence: Synthetic probe
ggtgaccaccacggttgagaactacggaggtgaaactcaaacggccagacggctccacac

SEQ ID NO: 1474 - DNA, 60 bp, Artificial Sequence
  Description of Artificial Sequence: Synthetic probe
tggactttgaagcactcaagcctcacttcaagtctgtcggtcagaccatcaccccagctg

SEQ ID NO: 1475 - DNA, 60 bp, Artificial Sequence
  Description of Artificial Sequence: Synthetic probe
gtcggcgtcgtcaacaacgctgaccgttggagactcatcttctctggagaggcactcacc

SEQ ID NO: 1476 - DNA, 60 bp, Artificial Sequence
  Description of Artificial Sequence: Synthetic probe
ctgccacagcaagaggggccttacgccggtccgatggaaagacaacaaccgctgaaggtt

SEQ ID NO: 1477 - DNA, 60 bp, Artificial Sequence
  Description of Artificial Sequence: Synthetic probe
cgacgtgagcgccaaggacggatacaaggttaataacaaattggacatcatcaaagcact

SEQ ID NO: 1478 - DNA, 60 bp, Artificial Sequence
  Description of Artificial Sequence: Synthetic probe
cgatccgtccaagtaccatgaagcgaaggggtggctcgagaatgcccgccaggcatgtct

SEQ ID NO: 1479 - DNA, 60 bp, Artificial Sequence
  Description of Artificial Sequence: Synthetic probe
tgttttccacgtgccggcccctgtcttcagtttcggggctccggtcctgttggcaggttt

SEQ ID NO: 1480 - DNA, 60 bp, Artificial Sequence
  Description of Artificial Sequence: Synthetic probe
gtgttggcgcagaaatactcttccgccaagcactctctaccatccaccttcaacttcggg

SEQ ID NO: 1481 - DNA, 60 bp, Artificial Sequence
  Description of Artificial Sequence: Synthetic probe
ccgcagatccaatctacggacatgtgtacaacccctcaaggaacgactgtcacggtaggt

SEQ ID NO: 1482 - DNA, 60 bp, Artificial Sequence
  Description of Artificial Sequence: Synthetic probe
cctgccaccgggtcacaaaaccagtccggtaacacgggtagcataatcaacaactactac

SEQ ID NO: 1483 - DNA, 60 bp, Artificial Sequence
  Description of Artificial Sequence: Synthetic probe
cccacaagctaaacagttttgcccgttttcatgagaaatgggacgtcagcgcacgaaacg

SEQ ID NO: 1484 - DNA, 60 bp, Artificial Sequence
  Description of Artificial Sequence: Synthetic probe
gtgtcgaaccacccgatcttcaaacaaatctcaatcccttcccaaaagtccgtgttgtac

SEQ ID NO: 1485 - DNA, 60 bp, Artificial Sequence
  Description of Artificial Sequence: Synthetic probe
ctgggtctatgaatcacccgagaaccttacccttgaggcgatcaatcaattggaagaggt

SEQ ID NO: 1486 - DNA, 60 bp, Artificial Sequence
  Description of Artificial Sequence: Synthetic probe
ggttgaacactatccttcagttgtttagatacgtcgatgatcctttcttcgactgggtct

SEQ ID NO: 1487 - DNA, 60 bp, Artificial Sequence
  Description of Artificial Sequence: Synthetic probe
gcacgacttcttctacggacaacggagaagatggagttcacactctacaacggtgagaag

SEQ ID NO: 1488 - DNA, 60 bp, Artificial Sequence
  Description of Artificial Sequence: Synthetic probe
cacaaccgactgttttatcgctctgttgtacgccatcagggagatcaaggcacgacttct

SEQ ID NO: 1489 - DNA, 60 bp, Artificial Sequence
  Description of Artificial Sequence: Synthetic probe
ggtctagaggggtaacattttgtactgcgtttgactccacgctcgatccactagcgagtg

SEQ ID NO: 1490 - DNA, 60 bp, Artificial Sequence
  Description of Artificial Sequence: Synthetic probe
ggtctagaggggtaacactttgtactgagtttgactccacgctcgatccactagcgagtg

SEQ ID NO: 1491 - DNA, 60 bp, Artificial Sequence
  Description of Artificial Sequence: Synthetic probe
aatgactggttttcaaagctggccagttccgcttttagcggtcttttcggcgctctcctc

SEQ ID NO: 1492 - DNA, 57 bp, Artificial Sequence
  Description of Artificial Sequence: Synthetic probe
ggcactagaggtgatctcacaagacaggcgcaaacagaagatcattgcacccgaaaa

SEQ ID NO: 1493 - DNA, 60 bp, Artificial Sequence
  Description of Artificial Sequence: Synthetic probe
cgcctgagaacctcacgctctcggccatcgaacagctggaggaaattaccgggcttgagt

SEQ ID NO: 1494 - DNA, 60 bp, Artificial Sequence
  Description of Artificial Sequence: Synthetic probe
cacaattggcagaaagtacctgaggcgagcgacgccgtatgagtgaaaaggccgaagggc

SEQ ID NO: 1495 - DNA, 60 bp, Artificial Sequence
  Description of Artificial Sequence: Synthetic probe
gcaagactcgcattgtcgatgtcctgcctgttgaacacatcatctacaccagaatgatga

SEQ ID NO: 1496 - DNA, 60 bp, Artificial Sequence
  Description of Artificial Sequence: Synthetic probe
gtgtgcgcgatctcacgggacactttcgcgacaccatgaaactgtcgaaaggcagcccca

SEQ ID NO: 1497 - DNA, 60 bp, Artificial Sequence
  Description of Artificial Sequence: Synthetic probe
ggcttccgcgagagagaactccccgggcagaagactggcaatgaagtgaactctgagcca

SEQ ID NO: 1498 - DNA, 60 bp, Artificial Sequence
  Description of Artificial Sequence: Synthetic probe
tcagtttcggagccccggtcctgttggcaggtttggtcaaagtcgcctccacgttcttcc

SEQ ID NO: 1499 - DNA, 60 bp, Artificial Sequence
  Description of Artificial Sequence: Synthetic probe
tccagtcgttcactcaaaaggttcggttgtccgctttgcgctgccctacaccgcgccaca

SEQ ID NO: 1500 - DNA, 60 bp, Artificial Sequence
  Description of Artificial Sequence: Synthetic probe
gctggcgctgactttgagctcaggttgccaataaaccccaccgcccagacaactagtgcg

SEQ ID NO: 1501 - DNA, 60 bp, Artificial Sequence
  Description of Artificial Sequence: Synthetic probe
gctccatcaacctgcacttcatgtacaccgggccaacgcagtcaaaagctcgcttcatgg

SEQ ID NO: 1502 - DNA, 60 bp, Artificial Sequence
  Description of Artificial Sequence: Synthetic probe
tcatgtccacctgttggagctgcccaccgaccacaaaggcatctacggcgccatggttga

SEQ ID NO: 1503 - DNA, 60 bp, Artificial Sequence
  Description of Artificial Sequence: Synthetic probe
ggcccaacacacacgggaactgctggctcaactctctgctgcagctctttcgatacgtcg

SEQ ID NO: 1504 - DNA, 60 bp, Artificial Sequence
  Description of Artificial Sequence: Synthetic probe
ccagtggtgccagtaccgttggtttcagagagaaaactctgtcaggccacaaagcgcgcg

SEQ ID NO: 1505 - DNA, 60 bp, Artificial Sequence
  Description of Artificial Sequence: Synthetic probe
ttgcccaaatggtttcaactacagggttcatcccgcccatggcgtcgcttgaggacaaag

SEQ ID NO: 1506 - DNA, 60 bp, Artificial Sequence
  Description of Artificial Sequence: Synthetic probe
aagatcattgcacccgcaaaacagctgttgaactttgacctacttcagttggcgggtgac

SEQ ID NO: 1507 - DNA, 60 bp, Artificial Sequence
  Description of Artificial Sequence: Synthetic probe
cctgcttctttcaactacggtgcaatcagggcccagaccatccacgagcttctcgtgcgc

SEQ ID NO: 1508 - DNA, 53 bp, Artificial Sequence
  Description of Artificial Sequence: Synthetic probe
acgggacaagcaagtactccgcgagcggtttgggacgaggcgatctggggtcc

SEQ ID NO: 1509 - DNA, 59 bp, Artificial Sequence
  Description of Artificial Sequence: Synthetic probe
gttgtcatggtagtatcacccctcacggtcagcaacgctgccgcagcacaaatcaaggt

SEQ ID NO: 1510 - DNA, 60 bp, Artificial Sequence
  Description of Artificial Sequence: Synthetic probe
ggtacgatcagtacaagaaacacaagccctggacactggttgtcatggtagtatcacccc

SEQ ID NO: 1511 - DNA, 60 bp, Artificial Sequence
  Description of Artificial Sequence: Synthetic probe
tggacacttgacaaaactggagcttcccaccgaccaccgcggtgtcttcggacacctggt

SEQ ID NO: 1512 - DNA, 60 bp, Artificial Sequence
  Description of Artificial Sequence: Synthetic probe
ccggacccgtccgatgtcctggtgtttgtaccgtacgatcaagagccactcaacggagga

SEQ ID NO: 1513 - DNA, 60 bp, Artificial Sequence
  Description of Artificial Sequence: Synthetic probe
ccaccgattttatgaatacaactaactgttttatcgctttggtatacgctatcagagaga

SEQ ID NO: 1514 - DNA, 60 bp, Artificial Sequence
  Description of Artificial Sequence: Synthetic probe
gcacacgctcggcacttgccgacgtcgttcaactttggtgcagttaaagcagaaacagtc

SEQ ID NO: 1515 - DNA, 60 bp, Artificial Sequence
  Description of Artificial Sequence: Synthetic probe
ataccacaagggaccgctgactcgactggccctcccgtacaccgcgccacaccgcgtgtt

SEQ ID NO: 1516 - DNA, 60 bp, Artificial Sequence
  Description of Artificial Sequence: Synthetic probe
tttgagctccggctgcctgtggacgctaggcgacaaactacgaccactggtgaatctgcc

SEQ ID NO: 1517 - DNA, 52 bp, Artificial Sequence
  Description of Artificial Sequence: Synthetic probe
ccccggcatggaggcaccagaaaacccagaagaggctgcacactgcatacac

SEQ ID NO: 1518 - DNA, 60 bp, Artificial Sequence
  Description of Artificial Sequence: Synthetic probe
ttaaggtgtatgccaatatagccccaaccaacgtccacgttgcaggtgagctcccctcca

SEQ ID NO: 1519 - DNA, 60 bp, Artificial Sequence
  Description of Artificial Sequence: Synthetic probe
cttaacggagaatggaagactaaggttcagcaaaagcttaagggagccgggcaatccagc

SEQ ID NO: 1520 - DNA, 60 bp, Artificial Sequence
  Description of Artificial Sequence: Synthetic probe
acaactcgcccgagaacctgacgctcgaagccattaagcagctggaagaactcacagggc

SEQ ID NO: 1521 - DNA, 60 bp, Artificial Sequence
  Description of Artificial Sequence: Synthetic probe
ctttatcgctttggtgcacgctatcagagagattagagcaattttcttcccacggacgac

SEQ ID NO: 1522 - DNA, 60 bp, Artificial Sequence
  Description of Artificial Sequence: Synthetic probe
ccgtcgttcccggcgtaaaagggatataaccacaagcttaacaccgtctctcccgacgtt

SEQ ID NO: 1523 - DNA, 54 bp, Artificial Sequence
  Description of Artificial Sequence: Synthetic probe
gcgttgcactccacacttacgttgtgtgcgcgcgggacccgacggactatcgtt

SEQ ID NO: 1524 - DNA, 60 bp, Artificial Sequence
  Description of Artificial Sequence: Synthetic probe
gatgtcacaattggcagaaagactttgaggcgagcgacgcggtaggagtgaaaggaccga

SEQ ID NO: 1525 - DNA, 60 bp, Artificial Sequence
  Description of Artificial Sequence: Synthetic probe
cgaggaggtgttccgcacagacttcggcttccacccaaacgcggagtggattctgaagac

SEQ ID NO: 1526 - DNA, 54 bp, Artificial Sequence
  Description of Artificial Sequence: Synthetic probe
ggactcgacgccatggaaccagacactgcacctggccttccctgggctctccag

SEQ ID NO: 1527 - DNA, 60 bp, Artificial Sequence
  Description of Artificial Sequence: Synthetic probe
ttctacccactttactggcaaaaccgactcagtttggtactgcccgcctgatcctgacca

SEQ ID NO: 1528 - DNA, 60 bp, Artificial Sequence
  Description of Artificial Sequence: Synthetic probe
cagatcccaccgcacacactggttggggcgttgctccggtccgcgacatactacttctca

SEQ ID NO: 1529 - DNA, 60 bp, Artificial Sequence
  Description of Artificial Sequence: Synthetic probe
cttacactgcttctgacgtggccgagaccacaagtgtgcaaggatgggtgtgcatttacc

SEQ ID NO: 1530 - DNA, 60 bp, Artificial Sequence
  Description of Artificial Sequence: Synthetic probe
cggagctgaaaagccttgacacgcggcagaagtaccagttgacccttttcccacaccagt

SEQ ID NO: 1531 - DNA, 60 bp, Artificial Sequence
  Description of Artificial Sequence: Synthetic probe
tgcttgaagaccgcatcctcaccaccagaaacggccacacgacgtcgacgacacagtcga

SEQ ID NO: 1532 - DNA, 60 bp, Artificial Sequence
  Description of Artificial Sequence: Synthetic probe
atacaactgactgctttatcgctctgttccacgccatcagagagatcagggcacgacttc

SEQ ID NO: 1533 - DNA, 60 bp, Artificial Sequence
  Description of Artificial Sequence: Synthetic probe
tgttggggttagttcgacgctctgcggtatcctccgcgtgacggactacggtgttggggc

SEQ ID NO: 1534 - DNA, 60 bp, Artificial Sequence
  Description of Artificial Sequence: Synthetic probe
ggaggtgttccgcacagagtttggcttccacccgaacgccgagtggatcctgaagactct

SEQ ID NO: 1535 - DNA, 54 bp, Artificial Sequence
  Description of Artificial Sequence: Synthetic probe
gccccggtcgttaaggaagggccttacgaaggaccagtgaagaaacctgtcgct

SEQ ID NO: 1536 - DNA, 60 bp, Artificial Sequence
  Description of Artificial Sequence: Synthetic probe
gagccaagctcccacagcaagagggaccttatgctggcccgatggagagacagaaaccac

SEQ ID NO: 1537 - DNA, 57 bp, Artificial Sequence
  Description of Artificial Sequence: Synthetic probe
cccttcttcttctctgatgtcaggtcgaacttcaccaagctggtggacaccattaac

SEQ ID NO: 1538 - DNA, 60 bp, Artificial Sequence
  Description of Artificial Sequence: Synthetic probe
atttaccagatcacccacggtaaagctgaaggtgacgcgctggtcgtgtccgtcagcgct

SEQ ID NO: 1539 - DNA, 60 bp, Artificial Sequence
  Description of Artificial Sequence: Synthetic probe
gcggcactatgaatatccacttcatgttcactggacccacggatgccaaagcccgctaca

SEQ ID NO: 1540 - DNA, 60 bp, Artificial Sequence
  Description of Artificial Sequence: Synthetic probe
gaaaacggaggagacaactctgcttgaagaccgcatactcaccaccagaaatggccacac

SEQ ID NO: 1541 - DNA, 60 bp, Artificial Sequence
  Description of Artificial Sequence: Synthetic probe
ggttctcacgcttggccagttcggcctttagcggactgtttggtgctcttttggctgaca

SEQ ID NO: 1542 - DNA, 60 bp, Artificial Sequence
  Description of Artificial Sequence: Synthetic probe
ccgacgttaacggactggaaccacaagcttataccgcctttcccggcgttaacgggatgt

SEQ ID NO: 1543 - DNA, 60 bp, Artificial Sequence
  Description of Artificial Sequence: Synthetic probe
cgcttcggcgtgaccggttaatactcttaccactctccgcctacttggtcgttagcgctg

SEQ ID NO: 1544 - DNA, 60 bp, Artificial Sequence
  Description of Artificial Sequence: Synthetic probe
gtttggaacattaaacacttgctcaacaccggaatcggcaccgcctcgcgacccagcgaa

SEQ ID NO: 1545 - DNA, 60 bp, Artificial Sequence
  Description of Artificial Sequence: Synthetic probe
gtcgagctgtcgcactacaccatgattgcctacggggatgacattgtagttgcaagtgac

SEQ ID NO: 1546 - DNA, 60 bp, Artificial Sequence
  Description of Artificial Sequence: Synthetic probe
ccattgagtgtgtttgaagccatcaaaggtgtcgacggactcgatgccatggagcctgac

SEQ ID NO: 1547 - DNA, 60 bp, Artificial Sequence
  Description of Artificial Sequence: Synthetic probe
aaggacaggacatgctctcagatgctgcgctcatggttctccactccggaaaccgcgtgc

SEQ ID NO: 1548 - DNA, 60 bp, Artificial Sequence
  Description of Artificial Sequence: Synthetic probe
cagtctggtactgtccacctgaccccgatcacttcgatggctacaaccaacaggtcgttg

SEQ ID NO: 1549 - DNA, 60 bp, Artificial Sequence
  Description of Artificial Sequence: Synthetic probe
tacaggatgaagcgtgcggagctttactgccctagaccactcctcccagcctacgaccac

SEQ ID NO: 1550 - DNA, 60 bp, Artificial Sequence
  Description of Artificial Sequence: Synthetic probe
cacgttcgctgttccatacgtctcggccagtgacttctcatacacccacacggacacgcc

SEQ ID NO: 1551 - DNA, 60 bp, Artificial Sequence
  Description of Artificial Sequence: Synthetic probe
ccctctacccacaccagttcatcaacccaaggactaacacaactgcccacatccaggtgc

SEQ ID NO: 1552 - DNA, 60 bp, Artificial Sequence
  Description of Artificial Sequence: Synthetic probe
gggcaggtctgttccttcgtggggcaggccagtcctctcccgccacagggtcacaaaatc

SEQ ID NO: 1553 - DNA, 60 bp, Artificial Sequence
  Description of Artificial Sequence: Synthetic probe
ccacagacgcagacagacgttcaaagcaaacaagaagatggaattcacactctacaacgg

SEQ ID NO: 1554 - DNA, 60 bp, Artificial Sequence
  Description of Artificial Sequence: Synthetic probe
tactcagacctctggctgtcgtacctctactaggcaggcaggaaccacccttttggggcc

SEQ ID NO: 1555 - DNA, 60 bp, Artificial Sequence
  Description of Artificial Sequence: Synthetic probe
agtgatgacgtgaactccgagcccgcccaaaccctggaggagcaaccacaagctgaggga

SEQ ID NO: 1556 - DNA, 60 bp, Artificial Sequence
  Description of Artificial Sequence: Synthetic probe
gtgtgcatggtagacgggacggatatgtgtttggctgacttccacgctggcatcttcctg

SEQ ID NO: 1557 - DNA, 60 bp, Artificial Sequence
  Description of Artificial Sequence: Synthetic probe
cccaacgaagtgtgcatggtagacgggacggatatgtgtttggctgacttccacgctggc

SEQ ID NO: 1558 - DNA, 60 bp, Artificial Sequence
  Description of Artificial Sequence: Synthetic probe
gcgacccagcgaagtgtgcatggtagacgggacggatatgtgtttggctgacttccacgc

SEQ ID NO: 1559 - DNA, 60 bp, Artificial Sequence
  Description of Artificial Sequence: Synthetic probe
gcctcgcgacccagcgaagtgtgcatggtagacgggacggatatgtgtttggctgacttc

SEQ ID NO: 1560 - DNA, 60 bp, Artificial Sequence
  Description of Artificial Sequence: Synthetic probe
ggcagattttgtgcacagatgcactcaaataacggaccgcaaattggctcagcggtcggt

SEQ ID NO: 1561 - DNA, 60 bp, Artificial Sequence
  Description of Artificial Sequence: Synthetic probe
aaggcgcgttacatggttgcctacgccccaccaggcatggagccgcccaagacacctgag

SEQ ID NO: 1562 - DNA, 57 bp, Artificial Sequence
  Description of Artificial Sequence: Synthetic probe
acggactcggacagggtgcttgctcagtttgacatgtctttggcagcaaaacaaatg

SEQ ID NO: 1563 - DNA, 60 bp, Artificial Sequence
  Description of Artificial Sequence: Synthetic probe
ggtgccttctggtcgcaatggtaccagagctttattctatccaaaagagggaactgtacc

SEQ ID NO: 1564 - DNA, 60 bp, Artificial Sequence
  Description of Artificial Sequence: Synthetic probe
cgggtacgcaacagctgaagattttgtgagcggaccgaacacttccggtctcgaaaccag

SEQ ID NO: 1565 - DNA, 60 bp, Artificial Sequence
  Description of Artificial Sequence: Synthetic probe
agcagttggaggatctcacaggacttgaactgcatgagggtggaccacctgctctcgtga

SEQ ID NO: 1566 - DNA, 60 bp, Artificial Sequence
  Description of Artificial Sequence: Synthetic probe
aacagatttcaatcccttcccagaagtccgtgttgtacttcctcattgagaagggtcagc

SEQ ID NO: 1567 - DNA, 60 bp, Artificial Sequence
  Description of Artificial Sequence: Synthetic probe
ttcaagcagatctcaatcccttcacagaagtccgtgttgtacttcctcattgagaaagga

SEQ ID NO: 1568 - DNA, 60 bp, Artificial Sequence
  Description of Artificial Sequence: Synthetic probe
gtgcaggtacagcagaaatgctgtgcccaactcgagaggtgaccttcaggtgttggctca

SEQ ID NO: 1569 - DNA, 60 bp, Artificial Sequence
  Description of Artificial Sequence: Synthetic probe
ggcggccgcgcactgcatccatgctgaatgggacactgggttgaactcaaagttcacttt

SEQ ID NO: 1570 - DNA, 60 bp, Artificial Sequence
  Description of Artificial Sequence: Synthetic probe
gagggctccaccgacacaacctccacccacacaaccaacacccagaacaacgactggttc

SEQ ID NO: 1571 - DNA, 60 bp, Artificial Sequence
  Description of Artificial Sequence: Synthetic probe
tatagcaaccgcggtgatggggccgtttcgcgcgggttgctcgcctggcctgttacggct

SEQ ID NO: 1572 - DNA, 59 bp, Artificial Sequence
  Description of Artificial Sequence: Synthetic probe
cacccacagctggactcacggcaccgtgcgaccatttggctggattgtgcggacgaaca

SEQ ID NO: 1573 - DNA, 60 bp, Artificial Sequence
  Description of Artificial Sequence: Synthetic probe
acacttacgttgtacgcggggcccgatggactttcgttcacccacccacagctggactca

SEQ ID NO: 1574 - DNA, 60 bp, Artificial Sequence
  Description of Artificial Sequence: Synthetic probe
gctagggtctcacccctagcacgccaacgacaatccctgcgttgcactccacacttacgt

SEQ ID NO: 1575 - DNA, 60 bp, Artificial Sequence
  Description of Artificial Sequence: Synthetic probe
catcacctttgaggaggtgtttcgcacggaattcggtttccacccaaacgctgagtggat

SEQ ID NO: 1576 - DNA, 60 bp, Artificial Sequence
  Description of Artificial Sequence: Synthetic probe
ttcttgccaaggacggggctgacacgttcattgtcggcactcactccgcaggtggcaatg

SEQ ID NO: 1577 - DNA, 60 bp, Artificial Sequence
  Description of Artificial Sequence: Synthetic probe
aaggcgagtgatgacgtgaactccgagcccgctgagcccgtggagagaccacaagctgaa

SEQ ID NO: 1578 - DNA, 60 bp, Artificial Sequence
  Description of Artificial Sequence: Synthetic probe
ataccagaagcagcccatcacacgcctggcgctcccttacaccgctccccaccgtgtgct

SEQ ID NO: 1579 - DNA, 60 bp, Artificial Sequence
  Description of Artificial Sequence: Synthetic probe
cgtttctgttagcgccggtaaggactttgagtttcgcctaccagtggacgcgcgccagca

SEQ ID NO: 1580 - DNA, 60 bp, Artificial Sequence
  Description of Artificial Sequence: Synthetic probe
gtcgcgctcgtaccagagttgaagagtctcgacacacggcaaaagtaccagttgactctc

SEQ ID NO: 1581 - DNA, 60 bp, Artificial Sequence
  Description of Artificial Sequence: Synthetic probe
agaaaacagaggaaacaaccatgcttgaagaccgtatcctcaccaccaggaacggccaca

SEQ ID NO: 1582 - DNA, 60 bp, Artificial Sequence
  Description of Artificial Sequence: Synthetic probe
tgcttcaaaccggaatcggcaccgcctcgcgtcctagtgaggtatgcatggttgacggga

SEQ ID NO: 1583 - DNA, 60 bp, Artificial Sequence
  Description of Artificial Sequence: Synthetic probe
cggcgttaaaggactgcaaccgaaagtctacaccgcccctcccggcgttaacgggatgta

SEQ ID NO: 1584 - DNA, 60 bp, Artificial Sequence
  Description of Artificial Sequence: Synthetic probe
agggtctcacccctagcacgccaacgatagctcctgcgtcgcgctccacatttacgtttg

SEQ ID NO: 1585 - DNA, 60 bp, Artificial Sequence
  Description of Artificial Sequence: Synthetic probe
atccaacctgaagagcaaccacaagctgaaggaccctacgccgggccactcgagcgtcag

SEQ ID NO: 1586 - DNA, 60 bp, Artificial Sequence
  Description of Artificial Sequence: Synthetic probe
agcacttgaagacacgcacactaacccagtggcgatgtttcagtacgattgtgcccttct

SEQ ID NO: 1587 - DNA, 60 bp, Artificial Sequence
  Description of Artificial Sequence: Synthetic probe
agcttctcgtgcgtatgaagcgggccgaactctactgccccagaccactgctggcaatag

SEQ ID NO: 1588 - DNA, 60 bp, Artificial Sequence
  Description of Artificial Sequence: Synthetic probe
gtgaaccctatgcatgtcattgacctcatgcagacccaccaacacgggcttgtaggggcg

SEQ ID NO: 1589 - DNA, 60 bp, Artificial Sequence
  Description of Artificial Sequence: Synthetic probe
tggagacaccgccggacacacctgagaaagccgcacactgcatccacgctgaatgggaca

SEQ ID NO: 1590 - DNA, 60 bp, Artificial Sequence
  Description of Artificial Sequence: Synthetic probe
aacggttgggatgtcgaggtgtctgctgttggcaaccaattcaacggcgggtgcctcctg

SEQ ID NO: 1591 - DNA, 59 bp, Artificial Sequence
  Description of Artificial Sequence: Synthetic probe
ggggtcacctacgggtactccactggggaagaccacaccgcagggcccaacacatcggg

SEQ ID NO: 1592 - DNA, 60 bp, Artificial Sequence
  Description of Artificial Sequence: Synthetic probe
ctcctgacccatcagacgtcctggtattcgtcccgtacgatcaagaaccactcaacgggg

SEQ ID NO: 1593 - DNA, 59 bp, Artificial Sequence
  Description of Artificial Sequence: Synthetic probe
gcacgtaacgcgccgtcgcttgaggatgacttgtacaaacacgatctaagcaggtcccc

SEQ ID NO: 1594 - DNA, 60 bp, Artificial Sequence
  Description of Artificial Sequence: Synthetic probe
tttggtcattagcgctgtcttgggcacgcctgtctgaggctgttcgacgctccacgggct

SEQ ID NO: 1595 - DNA, 60 bp, Artificial Sequence
  Description of Artificial Sequence: Synthetic probe
cgctggtgacaggctaaggatgcccttcaggtaccccgaggtaacacgtgacacttggga

SEQ ID NO: 1596 - DNA, 60 bp, Artificial Sequence
  Description of Artificial Sequence: Synthetic probe
cccagctacagatcactttacctgcgttgggtgaacgccgtgtgcggtgacgcataaccc

SEQ ID NO: 1597 - DNA, 60 bp, Artificial Sequence
  Description of Artificial Sequence: Synthetic probe
ctgaaactggtactcaaccactggtgacaggctaaggatgcccttcaggtaccccgaggt

SEQ ID NO: 1598 - DNA, 55 bp, Artificial Sequence
  Description of Artificial Sequence: Synthetic probe
tcactttacctgcgttgggtgaacgccgtgtgcggtgacgcataatccctcagat

SEQ ID NO: 1599 - DNA, 60 bp, Artificial Sequence
  Description of Artificial Sequence: Synthetic probe
ccgacaaaagcgacaaaggttttgttcttggtcactccatcaccgatgtcactttcctca

SEQ ID NO: 1600 - DNA, 60 bp, Artificial Sequence
  Description of Artificial Sequence: Synthetic probe
gctgacaaaagcgacaaaggttttgttcttggtcactccatcaccgatgtcactttcctc

SEQ ID NO: 1601 - DNA, 60 bp, Artificial Sequence
  Description of Artificial Sequence: Synthetic probe
ggtgacaggctaaggatgcccttcaggtaccccgaggtaacatgcgacactcgggatctg

SEQ ID NO: 1602 - DNA, 60 bp, Artificial Sequence
  Description of Artificial Sequence: Synthetic probe
gacaggctaaggatgcccttcaggtaccccgaggtaacacgcgacactcgggatctgaga

SEQ ID NO: 1603 - DNA, 60 bp, Artificial Sequence
  Description of Artificial Sequence: Synthetic probe
ctggtgacaggctaaggatgcccttcaggtaccccgaggtaacatgcgacactcgggatc

SEQ ID NO: 1604 - DNA, 60 bp, Artificial Sequence
  Description of Artificial Sequence: Synthetic probe
tagctacagatcactttacctgcgttgggtgaacgccgtgtgcggcgacgcataatcccc

SEQ ID NO: 1605 - DNA, 60 bp, Artificial Sequence
  Description of Artificial Sequence: Synthetic probe
aagctacagatcactttacctgcgttgggtgaacgccgtgtgcggcgacgcataatcccc

SEQ ID NO: 1606 - DNA, 60 bp, Artificial Sequence
  Description of Artificial Sequence: Synthetic probe
cctcgaggccatcctctcctttgcacgccgtgggaccatacaggagaagttgatctccgt

SEQ ID NO: 1607 - DNA, 60 bp, Artificial Sequence
  Description of Artificial Sequence: Synthetic probe
cactccagctgacaaaagcgacaaaggttttgttcttggtcactccatcaccgatgtcac

SEQ ID NO: 1608 - DNA, 60 bp, Artificial Sequence
  Description of Artificial Sequence: Synthetic probe
ctaaggatgcccttcaggtaccccgaggtaacacgcgacactcgggatctgagaagggga

SEQ ID NO: 1609 - DNA, 60 bp, Artificial Sequence
  Description of Artificial Sequence: Synthetic probe
ctggtgacaggctaaggatgcccttcaggtaccccgaggtaacacgcgaaactcgggatc

SEQ ID NO: 1610 - DNA, 60 bp, Artificial Sequence
  Description of Artificial Sequence: Synthetic probe
ctggtgacaggctaaggatgcccttcaggtaccccgaggtaacacgggacacttgggatc

SEQ ID NO: 1611 - DNA, 60 bp, Artificial Sequence
  Description of Artificial Sequence: Synthetic probe
aagctacagatcactttacctgcgttgggtgaacgccgtgtgcggtgacgcataatcccc

SEQ ID NO: 1612 - DNA, 60 bp, Artificial Sequence
  Description of Artificial Sequence: Synthetic probe
gctatcctctcctttgcacgccgtgggaccatacaggagaagttgatctccgtggcaggg

SEQ ID NO: 1613 - DNA, 60 bp, Artificial Sequence
  Description of Artificial Sequence: Synthetic probe
gctatcctctcctttgcacgccgtgggaccatacaggagaagttgatctccgtggcggga

SEQ ID NO: 1614 - DNA, 60 bp, Artificial Sequence
  Description of Artificial Sequence: Synthetic probe
ctggtgacagactaaggatgcccttcaggtaccccgaggtaacacgggacactcgggatc

SEQ ID NO: 1615 - DNA, 60 bp, Artificial Sequence
  Description of Artificial Sequence: Synthetic probe
cactggtgacaggctaaggatgcccttcaggtaccccgaggtaacacgtgacactcggga

SEQ ID NO: 1616 - DNA, 52 bp, Artificial Sequence
  Description of Artificial Sequence: Synthetic probe
tcctctcctttgcacgccgtgggaccatacaggagaagttgatctccgtggc

SEQ ID NO: 1617 - DNA, 60 bp, Artificial Sequence
  Description of Artificial Sequence: Synthetic probe
ttccaaggcctctttgagattccaagctacagatcactttacctgcgttgggtgaacgcc

SEQ ID NO: 1618 - DNA, 60 bp, Artificial Sequence
  Description of Artificial Sequence: Synthetic probe
gactacagagtgtttgagtttgagattaaagtaaaaggacaggacatgctctcagatgcc

SEQ ID NO: 1619 - DNA, 60 bp, Artificial Sequence
  Description of Artificial Sequence: Synthetic probe
gctacagatcactttacctgcgttgggtgaacgccgtgtgcggtgacgcataatccctca

SEQ ID NO: 1620 - DNA, 60 bp, Artificial Sequence
  Description of Artificial Sequence: Synthetic probe
gagatcccaagctacagatcactttacctgcgttgggtgaacgccgtgtgcggtgacgca

SEQ ID NO: 1621 - DNA, 60 bp, Artificial Sequence
  Description of Artificial Sequence: Synthetic probe
cgagataccaagctacagatcactttacctgcgttgggtgaacgccgtgtgcggtgacgc

SEQ ID NO: 1622 - DNA, 53 bp, Artificial Sequence
  Description of Artificial Sequence: Synthetic probe
acccttgaggctatcctctcctttgcacgccgtgggaccatacaggagaagtt

SEQ ID NO: 1623 - DNA, 60 bp, Artificial Sequence
  Description of Artificial Sequence: Synthetic probe
tgaggctatcctctcctttgcacgccgtgggaccattcaggagaagttgatctcggtggc

SEQ ID NO: 1624 - DNA, 60 bp, Artificial Sequence
  Description of Artificial Sequence: Synthetic probe
ggccattctctcctttgcacgccgtgggaccatacaggagaagttgatctccgtggcagg

SEQ ID NO: 1625 - DNA, 60 bp, Artificial Sequence
  Description of Artificial Sequence: Synthetic probe
gccatcctctcctttgcacgccgtgggaccatacaggagaagttgatctccgtggcagga

SEQ ID NO: 1626 - DNA, 60 bp, Artificial Sequence
  Description of Artificial Sequence: Synthetic probe
tcagggcctctttgagattccaagctacagatcactttacctgcgttgggtgaacgccgt

SEQ ID NO: 1627 - DNA, 60 bp, Artificial Sequence
  Description of Artificial Sequence: Synthetic probe
ttccagggcctctttgagattccaagctacagatcactttacctgcgttgggtgaacgcc

SEQ ID NO: 1628 - DNA, 60 bp, Artificial Sequence
  Description of Artificial Sequence: Synthetic probe
tgaggctatcctctcctttgcacgccgtgggaccatacaggagaagctgatctccgtggc

SEQ ID NO: 1629 - DNA, 60 bp, Artificial Sequence
  Description of Artificial Sequence: Synthetic probe
aagccatcctctcctttgcacgccgtgggaccatacaggagaagttgatctctgtggcag

SEQ ID NO: 1630 - DNA, 60 bp, Artificial Sequence
  Description of Artificial Sequence: Synthetic probe
cagatcactttacctgcgttgggtgaacgccgtgtgcggtgacgcataatccctcggaga

SEQ ID NO: 1631 - DNA, 60 bp, Artificial Sequence
  Description of Artificial Sequence: Synthetic probe
agctacagatcactttacctgcgttgggtgaacgccgtgtgcggtgacgcataatccctc

SEQ ID NO: 1632 - DNA, 60 bp, Artificial Sequence
  Description of Artificial Sequence: Synthetic probe
tcttcgagattccaagctacagatcactttacctgcgttgggtgaacgccgtgtgcggtg

SEQ ID NO: 1633 - DNA, 60 bp, Artificial Sequence
  Description of Artificial Sequence: Synthetic probe
tctttgagattccaagctacagatcactttacctgcgttgggtgaacgccgtgtgcggtg

SEQ ID NO: 1634 - DNA, 60 bp, Artificial Sequence
  Description of Artificial Sequence: Synthetic probe
tcttcgagattccaagctacagatcactttacctgcgttgggtgaacgccgtgtgcggcg

SEQ ID NO: 1635 - DNA, 60 bp, Artificial Sequence
  Description of Artificial Sequence: Synthetic probe
tttgagattccaagctacagatcactttacctgcgttgggtgaacgccgtgtgcggtgac

SEQ ID NO: 1636 - DNA, 60 bp, Artificial Sequence
  Description of Artificial Sequence: Synthetic probe
ctttgagattccaagctacagatcactttacctgcgttgggtgaacgccgtgtgcggtga

SEQ ID NO: 1637 - DNA, 60 bp, Artificial Sequence
  Description of Artificial Sequence: Synthetic probe
cgagattccaagctacagatcactttacctgcgttgggtgaacgccgtgtgcggtgacgc

SEQ ID NO: 1638 - DNA, 60 bp, Artificial Sequence
  Description of Artificial Sequence: Synthetic probe
ggagacaggctaaggatgcccttcaggtaccccgaggtaacatgagacactcgggatctg

SEQ ID NO: 1639 - DNA, 60 bp, Artificial Sequence
  Description of Artificial Sequence: Synthetic probe
cactttacctgcgttgggtgaacgccgtgtgcggtgacgcataacccctcagatgtcaca

SEQ ID NO: 1640 - DNA, 60 bp, Artificial Sequence
  Description of Artificial Sequence: Synthetic probe
ctacagatcgctctacctgcgttgggtgaacgccgtgtgcggtgacgcataatccctcag

SEQ ID NO: 1641 - DNA, 60 bp, Artificial Sequence
  Description of Artificial Sequence: Synthetic probe
ggctatcctctcctttgcacgccgtgggaccatacaggagaagttgatctccgtggcagg

SEQ ID NO: 1642 - DNA, 60 bp, Artificial Sequence
  Description of Artificial Sequence: Synthetic probe
actacagagtgtttgagtttgagattaaagtaaaaggacaggacatgctctcagacgctg

SEQ ID NO: 1643 - DNA, 60 bp, Artificial Sequence
  Description of Artificial Sequence: Synthetic probe
gattacagagtgtttgagtttgagattaaagtaaaaggacaggacatgctctcagacgcg

SEQ ID NO: 1644 - DNA, 60 bp, Artificial Sequence
  Description of Artificial Sequence: Synthetic probe
gactacagagtgtttgagtttgagattaaagtaaaaggacaggacatgctctcagacgcc

SEQ ID NO: 1645 - DNA, 60 bp, Artificial Sequence
  Description of Artificial Sequence: Synthetic probe
cgactacagagtgtttgagtttgagattaaagtaaaaggacaggacatgctctcagacgc

SEQ ID NO: 1646 - DNA, 60 bp, Artificial Sequence
  Description of Artificial Sequence: Synthetic probe
gactacagagtgtttgagtttgagattaaagtaaaaggacaggacatgctctcagacgcg

SEQ ID NO: 1647 - DNA, 60 bp, Artificial Sequence
  Description of Artificial Sequence: Synthetic probe
tgattacagagtgtttgagtttgagattaaagtaaaaggacaggacatgctctcagacgc

SEQ ID NO: 1648 - DNA, 60 bp, Artificial Sequence
  Description of Artificial Sequence: Synthetic probe
tgaggctatcctctcctttgcacgccgtgggaccatacaggagaagttgatctccgtggc

SEQ ID NO: 1649 - DNA, 60 bp, Artificial Sequence
  Description of Artificial Sequence: Synthetic probe
cgaagctatcctctcctttgcacgccgtgggaccatacaggagaagttgatctccgtggc

SEQ ID NO: 1650 - DNA, 60 bp, Artificial Sequence
  Description of Artificial Sequence: Synthetic probe
tgtttgagtttgagattaaagtaaaaggacaggacatgctctcagatgccgcgctcatgg

SEQ ID NO: 1651 - DNA, 60 bp, Artificial Sequence
  Description of Artificial Sequence: Synthetic probe
ggctatcctctcctttgcacgccgtgggaccatacaggagaagttgatttcagtggcagg

SEQ ID NO: 1652 - DNA, 60 bp, Artificial Sequence
  Description of Artificial Sequence: Synthetic probe
ccctcgaggctatcctctcctttgcacgccgtgggaccatacaggagaagttgatctccg

SEQ ID NO: 1653 - DNA, 60 bp, Artificial Sequence
  Description of Artificial Sequence: Synthetic probe
tcgaggctatcctctcctttgcacgccgtgggaccatccaggagaagttgatctccgtgg

SEQ ID NO: 1654 - DNA, 60 bp, Artificial Sequence
  Description of Artificial Sequence: Synthetic probe
ttccagggtctctttgagattccaagctacagatcactttacctgcgttgggtgaacgcc

SEQ ID NO: 1655 - DNA, 60 bp, Artificial Sequence
  Description of Artificial Sequence: Synthetic probe
tttcagggtctctttgagattccaagctacagatcactttacctgcgttgggtgaacgcc

SEQ ID NO: 1656 - DNA, 60 bp, Artificial Sequence
  Description of Artificial Sequence: Synthetic probe
tggtgacaggctaaggatgcccttcaggtaccccgaggtaacacgcgacactcgggatct

SEQ ID NO: 1657 - DNA, 60 bp, Artificial Sequence
  Description of Artificial Sequence: Synthetic probe
tttgagattccaagctacagatcactttacctgcgttgggtgaacgccgtgtgcggcgac

SEQ ID NO: 1658 - DNA, 60 bp, Artificial Sequence
  Description of Artificial Sequence: Synthetic probe
tctctcctttgcacgccgtgggaccatacaggagaagttgatctccgtggcaggactcgc

SEQ ID NO: 1659 - DNA, 60 bp, Artificial Sequence
  Description of Artificial Sequence: Synthetic probe
gaccctcgaggctatcctctcctttgcacgccgtgggaccatacaggagaagttgatctc

SEQ ID NO: 1660 - DNA, 60 bp, Artificial Sequence
  Description of Artificial Sequence: Synthetic probe
cagctgacaaaagcgacaaaggttttgttcttggtcactccatcaccgatgtcactttcc

SEQ ID NO: 1661 - DNA, 60 bp, Artificial Sequence
  Description of Artificial Sequence: Synthetic probe
gtctgcaacgtactacttctcagacctggaggttgcgcttgttcacacgggcccagccac

SEQ ID NO: 1662 - DNA, 60 bp, Artificial Sequence
  Description of Artificial Sequence: Synthetic probe
gtgccagcactgttggcttcagagagaggactctcccgggacaaaaggcgagtgatgacg

SEQ ID NO: 1663 - DNA, 60 bp, Artificial Sequence
  Description of Artificial Sequence: Synthetic probe
gtgccagcactgttggcttcagagagaggactcttccaggacagaaggtgagtgatgacg

SEQ ID NO: 1664 - DNA, 55 bp, Artificial Sequence
  Description of Artificial Sequence: Synthetic probe
gtcaacatcagacagacacaagcaaaagatcattgcacccgcaaaacaactcttg

SEQ ID NO: 1665 - DNA, 60 bp, Artificial Sequence
  Description of Artificial Sequence: Synthetic probe
accagtcgacgtttacttcagaatgaagaggaccgagctctactgtccaaggccactcct

SEQ ID NO: 1666 - DNA, 60 bp, Artificial Sequence
  Description of Artificial Sequence: Synthetic probe
gccagtcgacgtttacttcagaatgaagaggaccgagctctactgttcaaggccactcct

SEQ ID NO: 1667 - DNA, 60 bp, Artificial Sequence
  Description of Artificial Sequence: Synthetic probe
cctgtcaaccaggtacaacggtgaatgcaactacacacaacggtcacccgccattcgcgg

SEQ ID NO: 1668 - DNA, 60 bp, Artificial Sequence
  Description of Artificial Sequence: Synthetic probe
caccgactcctgtcaaccaggtacaacggtgaatgcaactacacacaacggtcacccgcc

SEQ ID NO: 1669 - DNA, 60 bp, Artificial Sequence
  Description of Artificial Sequence: Synthetic probe
ggtgcgccacggacaacccagctccgtgacaacccaatggtgttttcacacaactctgtc

SEQ ID NO: 1670 - DNA, 60 bp, Artificial Sequence
  Description of Artificial Sequence: Synthetic probe
tggcaacccaacggtgcgccacggacaacccagctccgtgacaacccaatggtgttttca

SEQ ID NO: 1671 - DNA, 60 bp, Artificial Sequence
  Description of Artificial Sequence: Synthetic probe
gcgagaacgccctctattaagactcatactctgctcatggctgagacgcccagactggcc

SEQ ID NO: 1672 - DNA, 60 bp, Artificial Sequence
  Description of Artificial Sequence: Synthetic probe
caagtcgcgagaacgccctctattaagactcatactctgctcatggctgagacgcccaga

SEQ ID NO: 1673 - DNA, 60 bp, Artificial Sequence
  Description of Artificial Sequence: Synthetic probe
cagcagaaatgctcccaatgtgagactccaggtgctggaccaagtcgcgagaacgccctc

SEQ ID NO: 1674 - DNA, 60 bp, Artificial Sequence
  Description of Artificial Sequence: Synthetic probe
agtgcaggtacagcagaaatgctcccaatgtgagactccaggtgctggaccaagtcgcga

SEQ ID NO: 1675 - DNA, 60 bp, Artificial Sequence
  Description of Artificial Sequence: Synthetic probe
tgcctacggcaccacgtgtgtcggcaactgtgggtgagtgcaggtacagcagaaatgctc

SEQ ID NO: 1676 - DNA, 60 bp, Artificial Sequence
  Description of Artificial Sequence: Synthetic probe
cacccgactcgccctgcctacggcaccacgtgtgtcggcaactgtgggtgagtgcaggta

SEQ ID NO: 1677 - DNA, 60 bp, Artificial Sequence
  Description of Artificial Sequence: Synthetic probe
atgtcccaaacggggctcctgaatctgcactggagacagctaaggctctcacccgactcg

SEQ ID NO: 1678 - DNA, 60 bp, Artificial Sequence
  Description of Artificial Sequence: Synthetic probe
gatgtcccaaacggggctcctgaatctgcactggagacagctaaggctctcacccgactc

SEQ ID NO: 1679 - DNA, 60 bp, Artificial Sequence
  Description of Artificial Sequence: Synthetic probe
actcccctacaccgccccccaccgtgtgctggcgacagtgtacaacgggaagacaacgta

SEQ ID NO: 1680 - DNA, 60 bp, Artificial Sequence
  Description of Artificial Sequence: Synthetic probe
ggcactcccctacaccgccccccaccgtgtgctggcgacagtgtacaacgggaagacaac

SEQ ID NO: 1681 - DNA, 60 bp, Artificial Sequence
  Description of Artificial Sequence: Synthetic probe
ccggacccgtccgacgtcctggtatttgtcccgtacgatcaagaaccgctcaacggagaa

SEQ ID NO: 1682 - DNA, 60 bp, Artificial Sequence
  Description of Artificial Sequence: Synthetic probe
acatctttcaactacggtgcgcttcgtgctgataccatccacgaaattctcgtgcgcatg

SEQ ID NO: 1683 - DNA, 60 bp, Artificial Sequence
  Description of Artificial Sequence: Synthetic probe
acagtctaccacaaagcaccatttaccagactcgcactcccctacactgcgccacaccgc

SEQ ID NO: 1684 - DNA, 60 bp, Artificial Sequence
  Description of Artificial Sequence: Synthetic probe
acttctctgacctggagattgtggtgaggcacgagggcaacctgacgtgggtgcctaacg

SEQ ID NO: 1685 - DNA, 56 bp, Artificial Sequence
  Description of Artificial Sequence: Synthetic probe
accagcacgggctggtgggcgcgttgctgcgtgcagctacgtactacttctctgac

SEQ ID NO: 1686 - DNA, 60 bp, Artificial Sequence
  Description of Artificial Sequence: Synthetic probe
tcattatggacagatttgtgaaaatagaaagcctcagccccacacatgtcattgacctca

SEQ ID NO: 1687 - DNA, 60 bp, Artificial Sequence
  Description of Artificial Sequence: Synthetic probe
cggtggagagacacaagtccaaaggcgacaccacacggacattgccttcattatggacag

SEQ ID NO: 1688 - DNA, 60 bp, Artificial Sequence
  Description of Artificial Sequence: Synthetic probe
ctacggtggagagacacaagtccaaaggcgacaccacacggacattgccttcattatgga

SEQ ID NO: 1689 - DNA, 60 bp, Artificial Sequence
  Description of Artificial Sequence: Synthetic probe
gggagtctgcagaccctgtcacgaccactgttgagaactacggtggagagacacaagtcc

SEQ ID NO: 1690 - DNA, 60 bp, Artificial Sequence
  Description of Artificial Sequence: Synthetic probe
accactgcaacgggggagtctgcagaccctgtcacgaccactgttgagaactacggtgga

SEQ ID NO: 1691 - DNA, 60 bp, Artificial Sequence
  Description of Artificial Sequence: Synthetic probe
ggcaggatctacacggaggcggaagtcgacgtgtacgtgaggatgaaacgagcggagctt

SEQ ID NO: 1692 - DNA, 60 bp, Artificial Sequence
  Description of Artificial Sequence: Synthetic probe
caactacggcaggatctacacggaggcggaagtcgacgtgtacgtgaggatgaaacgagc

SEQ ID NO: 1693 - DNA, 60 bp, Artificial Sequence
  Description of Artificial Sequence: Synthetic probe
cacgaactcccgtctaccttcaacttcggctacgtgaccgccgacgaaccagtcgacgtt

SEQ ID NO: 1694 - DNA, 60 bp, Artificial Sequence
  Description of Artificial Sequence: Synthetic probe
tagaagtggcagtgaaacacgaggggaacctcacctgggtcccgaatggggcgcccgaga

SEQ ID NO: 1695 - DNA, 60 bp, Artificial Sequence
  Description of Artificial Sequence: Synthetic probe
actacttcgcagacctagaagtggcagtgaaacacgaggggaacctcacctgggtcccga

SEQ ID NO: 1696 - DNA, 60 bp, Artificial Sequence
  Description of Artificial Sequence: Synthetic probe
tccgtactgctacttactacttcgcagacctagaagtggcagtgaaacacgaggggaacc

SEQ ID NO: 1697 - DNA, 60 bp, Artificial Sequence
  Description of Artificial Sequence: Synthetic probe
actttggtgggtgcgctcctccgtactgctacttactacttcgcagacctagaagtggca

SEQ ID NO: 1698 - DNA, 60 bp, Artificial Sequence
  Description of Artificial Sequence: Synthetic probe
acccctgcccacactttggtgggtgcgctcctccgtactgctacttactacttcgcagac

SEQ ID NO: 1699 - DNA, 60 bp, Artificial Sequence
  Description of Artificial Sequence: Synthetic probe
ccgaccctgttaccactaccgttgagaactacggaggagagacgcaagtccaacgtcgtc

SEQ ID NO: 1700 - DNA, 60 bp, Artificial Sequence
  Description of Artificial Sequence: Synthetic probe
caacagtgtacaacgggacaaacaagtactccactactggtatcagaaggggtgcccttg

SEQ ID NO: 1701 - DNA, 59 bp, Artificial Sequence
  Description of Artificial Sequence: Synthetic probe
caacagtgtacaacgggacaaacaagtactccactactggtatcagaaggggtgccctt

SEQ ID NO: 1702 - DNA, 60 bp, Artificial Sequence
  Description of Artificial Sequence: Synthetic probe
ggcaacagtgtacaacgggacaaacaagtactccactactggtaacagaaggggtgacct

SEQ ID NO: 1703 - DNA, 60 bp, Artificial Sequence
  Description of Artificial Sequence: Synthetic probe
ggcaacagtgtacaacgggacaaacaagtactccacgactggtggcagaaggggtgacct

SEQ ID NO: 1704 - DNA, 60 bp, Artificial Sequence
  Description of Artificial Sequence: Synthetic probe
ggcaacagtgtacaacgggacaaacaagtactccacgactggtagcagaaggggtgacct

SEQ ID NO: 1705 - DNA, 60 bp, Artificial Sequence
  Description of Artificial Sequence: Synthetic probe
acccgaggcagccctgtcaaacaccagcaaccccactgcctacaacaaggcaccgttcac

SEQ ID NO: 1706 - DNA, 58 bp, Artificial Sequence
  Description of Artificial Sequence: Synthetic probe
ctcgtgcgcatgagacgtgctgagctttactgccccaggccactgctggcagtggagg

SEQ ID NO: 1707 - DNA, 54 bp, Artificial Sequence
  Description of Artificial Sequence: Synthetic probe
cttgcgcttccctacactgcgccgcaccgcgtgttggcaacagtgtacaacggg

SEQ ID NO: 1708 - DNA, 60 bp, Artificial Sequence
  Description of Artificial Sequence: Synthetic probe
cacacactaccgtccacattcaactttggtcacgttacagctgacaaagctgttgacgtc

SEQ ID NO: 1709 - DNA, 60 bp, Artificial Sequence
  Description of Artificial Sequence: Synthetic probe
gacagcacacgctaccgtccacattcaactttggtcacgttactgccgacaaagcagttg

SEQ ID NO: 1710 - DNA, 56 bp, Artificial Sequence
  Description of Artificial Sequence: Synthetic probe
ctcgtgcgcatgaaacgtgctgaactttactgccccaggccactgctggcagtaga

SEQ ID NO: 1711 - DNA, 58 bp, Artificial Sequence
  Description of Artificial Sequence: Synthetic probe
ctcgtgcgcatgaaacgtgctgaactttactgccccaggccactgctggcagtagagg

SEQ ID NO: 1712 - DNA, 60 bp, Artificial Sequence
  Description of Artificial Sequence: Synthetic probe
gggcagctgcccacctcctttaactacggcgctgtaaaggctgaaaccatcactgagctt

SEQ ID NO: 1713 - DNA, 60 bp, Artificial Sequence
  Description of Artificial Sequence: Synthetic probe
caccgcgtgttggcaaccgtttacaacgggaactgcaagtacggcactggtccagtgacc

SEQ ID NO: 1714 - DNA, 60 bp, Artificial Sequence
  Description of Artificial Sequence: Synthetic probe
acagcaccacaccgcgtgttggcaaccgtttacaacgggaactgcaagtacggcactggt

SEQ ID NO: 1715 - DNA, 60 bp, Artificial Sequence
  Description of Artificial Sequence: Synthetic probe
gcggctacgtactacttctctgacctggagattgtggtacgccatgaaggcaacctgacg

SEQ ID NO: 1716 - DNA, 60 bp, Artificial Sequence
  Description of Artificial Sequence: Synthetic probe
tacaccgcgccacaccgcgtgctggcaacagtgtacaacgggacgagcaagtactctgcg

SEQ ID NO: 1717 - DNA, 60 bp, Artificial Sequence
  Description of Artificial Sequence: Synthetic probe
tcgttcaactttggtgccatcaaagcagagaccatcactgagctgttagtgcggatgaaa

SEQ ID NO: 1718 - DNA, 60 bp, Artificial Sequence
  Description of Artificial Sequence: Synthetic probe
tcgttcaactttggtgccatcaaagcagagaccatcactgagctgttagtgcgcatgaaa

SEQ ID NO: 1719 - DNA, 60 bp, Artificial Sequence
  Description of Artificial Sequence: Synthetic probe
cgttcaactttggtgccatcaaagcagagaccatcactgagctgttagtgcgcatgaaac

SEQ ID NO: 1720 - DNA, 60 bp, Artificial Sequence
  Description of Artificial Sequence: Synthetic probe
cttctcccggcttacgaccacgcaaaccgggacagattcgacagccccattggtgtcgaa

SEQ ID NO: 1721 - DNA, 60 bp, Artificial Sequence
  Description of Artificial Sequence: Synthetic probe
actgccccaggccacttctcccggcttacgaccacgcaaaccgggacagattcgacagcc

SEQ ID NO: 1722 - DNA, 60 bp, Artificial Sequence
  Description of Artificial Sequence: Synthetic probe
cgctgacaagccggtggacgtgtactacaggatgaagcgcgctgaattgtactgccccag

SEQ ID NO: 1723 - DNA, 60 bp, Artificial Sequence
  Description of Artificial Sequence: Synthetic probe
cacgcgcttccttccactttcaactttggccacgttaccgctgacaagccggtggacgtg

SEQ ID NO: 1724 - DNA, 60 bp, Artificial Sequence
  Description of Artificial Sequence: Synthetic probe
gccaacacccgacacgcgcttccttccactttcaactttggccacgttaccgctgacaag

SEQ ID NO: 1725 - DNA, 60 bp, Artificial Sequence
  Description of Artificial Sequence: Synthetic probe
ttcgcggcgaccgtgctgtgctggctgccaaatatgccaacacccgacacgcgcttcctt

SEQ ID NO: 1726 - DNA, 60 bp, Artificial Sequence
  Description of Artificial Sequence: Synthetic probe
agcgcgtcaccgctattcgcggcgaccgtgctgtgctggctgccaaatatgccaacaccc

SEQ ID NO: 1727 - DNA, 60 bp, Artificial Sequence
  Description of Artificial Sequence: Synthetic probe
aacccaatggtcttctcgcacaacgctgtcactcgtttcgccgtgccgtataccgcgcca

SEQ ID NO: 1728 - DNA, 60 bp, Artificial Sequence
  Description of Artificial Sequence: Synthetic probe
cgacaacccaatggtcttctcgcacaacgctgtcactcgtttcgccgtgccgtataccgc

SEQ ID NO: 1729 - DNA, 60 bp, Artificial Sequence
  Description of Artificial Sequence: Synthetic probe
tctggcagccaaacggcgcaccgagaaccagcgagcttggcgacaacccaatggtcttct

SEQ ID NO: 1730 - DNA, 60 bp, Artificial Sequence
  Description of Artificial Sequence: Synthetic probe
acccgtgtcttctggcagccaaacggcgcaccgagaaccagcgagcttggcgacaaccca

SEQ ID NO: 1731 - DNA, 60 bp, Artificial Sequence
  Description of Artificial Sequence: Synthetic probe
tctgtgacctggaaatagcatgtgttggtaaacacacccgtgtcttctggcagccaaacg

SEQ ID NO: 1732 - DNA, 60 bp, Artificial Sequence
  Description of Artificial Sequence: Synthetic probe
cgtcaacctactacttctgtgacctggaaatagcatgtgttggtaaacacacccgtgtct

SEQ ID NO: 1733 - DNA, 60 bp, Artificial Sequence
  Description of Artificial Sequence: Synthetic probe
gacctcatggacaccaaggacaaggccctggtaggtgcccttcttagagcgtcaacctac

SEQ ID NO: 1734 - DNA, 60 bp, Artificial Sequence
  Description of Artificial Sequence: Synthetic probe
ggacctcatggacaccaaggacaaggccctggtaggtgcccttcttagagcgtcaaccta

SEQ ID NO: 1735 - DNA, 60 bp, Artificial Sequence
  Description of Artificial Sequence: Synthetic probe
ggttcacccacgtccacacaaacaagacaagcttcaacgtggacctcatggacaccaagg

SEQ ID NO: 1736 - DNA, 60 bp, Artificial Sequence
  Description of Artificial Sequence: Synthetic probe
gtgctcgacaggttcacccacgtccacacaaacaagacaagcttcaacgtggacctcatg

SEQ ID NO: 1737 - DNA, 51 bp, Artificial Sequence
  Description of Artificial Sequence: Synthetic probe
acacggcggccaggtgtcggagaagagacggatgcacacagacgtgacatt

SEQ ID NO: 1738 - DNA, 60 bp, Artificial Sequence
  Description of Artificial Sequence: Synthetic probe
actaccaccgccggagagggtgcagacgtcgtgacgtctgatccctcgacacacggcggc

SEQ ID NO: 1739 - DNA, 60 bp, Artificial Sequence
  Description of Artificial Sequence: Synthetic probe
gcaaggaccgttacaagacggtcctcgtcaagcctgccaaacagatgtgcaacttcgacc

SEQ ID NO: 1740 - DNA, 60 bp, Artificial Sequence
  Description of Artificial Sequence: Synthetic probe
gaccacgctggcaaggaccgttacaagacggtcctcgtcaagcctgccaaacagatgtgc

SEQ ID NO: 1741 - DNA, 60 bp, Artificial Sequence
  Description of Artificial Sequence: Synthetic probe
taaatacaagcccactggcaccgcgcctcgcgaaaacattcgcggtgacctcgcaaccct

SEQ ID NO: 1742 - DNA, 60 bp, Artificial Sequence
  Description of Artificial Sequence: Synthetic probe
tgactgtaaatacaagcccactggcaccgcgcctcgcgaaaacattcgcggtgacctcgc

SEQ ID NO: 1743 - DNA, 60 bp, Artificial Sequence
  Description of Artificial Sequence: Synthetic probe
gcaccccaccgggtgcttgccacagtctacaatggtgactgtaaatacaagcccactggc

SEQ ID NO: 1744 - DNA, 60 bp, Artificial Sequence
  Description of Artificial Sequence: Synthetic probe
gctctaccctacaccgcaccccaccgggtgcttgccacagtctacaatggtgactgtaaa

SEQ ID NO: 1745 - DNA, 60 bp, Artificial Sequence
  Description of Artificial Sequence: Synthetic probe
cagtcgtcttctcacaccaaggtactacccgttttgctctaccctacaccgcaccccacc

SEQ ID NO: 1746 - DNA, 60 bp, Artificial Sequence
  Description of Artificial Sequence: Synthetic probe
aagtgggcgacaacccagtcgtcttctcacaccaaggtactacccgttttgctctaccct

SEQ ID NO: 1747 - DNA, 60 bp, Artificial Sequence
  Description of Artificial Sequence: Synthetic probe
ggcgactccaagtacaggtcacacaacgaggaaccacgggcccacatccgcggagacctc

SEQ ID NO: 1748 - DNA, 60 bp, Artificial Sequence
  Description of Artificial Sequence: Synthetic probe
acccacgacattcaacttcggtcgattgttgtgtgattcgggtgacgtgtactaccgaat

SEQ ID NO: 1749 - DNA, 60 bp, Artificial Sequence
  Description of Artificial Sequence: Synthetic probe
gttcacgccaaggggaatgttacccgctttgcactgccctacacagccccgcacggagct

SEQ ID NO: 1750 - DNA, 60 bp, Artificial Sequence
  Description of Artificial Sequence: Synthetic probe
gttcacgccaagaggaatgttacccgctttgcactgccctacacagccccgcacggagct

SEQ ID NO: 1751 - DNA, 60 bp, Artificial Sequence
  Description of Artificial Sequence: Synthetic probe
cgttcacgccaaggggaatgttacccgctttgcactgccctacacagccccgcacggagc

SEQ ID NO: 1752 - DNA, 60 bp, Artificial Sequence
  Description of Artificial Sequence: Synthetic probe
cgttcacgccaagaggaatgttacccgctttgcactgccctacacagccccgcacggagc

SEQ ID NO: 1753 - DNA, 60 bp, Artificial Sequence
  Description of Artificial Sequence: Synthetic probe
acaacccagtcgttcacgccaaggggaatgttacccgctttgcactgccctacacagccc

SEQ ID NO: 1754 - DNA, 60 bp, Artificial Sequence
  Description of Artificial Sequence: Synthetic probe
tccactgtttacaacggtgagtgtgcttacagcaaacctgtgagcgcgatccgtggcgac

SEQ ID NO: 1755 - DNA, 60 bp, Artificial Sequence
  Description of Artificial Sequence: Synthetic probe
tgctgtccactgtttacaacggtgagtgtgcttacagcaaacctgtgagcgcgatccgtg

SEQ ID NO: 1756 - DNA, 60 bp, Artificial Sequence
  Description of Artificial Sequence: Synthetic probe
gcttggagacaaccccatggtcttctcccacaacaaggtcacgcgttttgccgtccccta

SEQ ID NO: 1757 - DNA, 60 bp, Artificial Sequence
  Description of Artificial Sequence: Synthetic probe
agcttggagacaaccccatggtcttctcccacaacaaggtcacgcgttttgccgtcccct

SEQ ID NO: 1758 - DNA, 60 bp, Artificial Sequence
  Description of Artificial Sequence: Synthetic probe
gacctgcttgataccaaggagaaggcgcttgtgggagccatcctacgatcggccacttac

SEQ ID NO: 1759 - DNA, 60 bp, Artificial Sequence
  Description of Artificial Sequence: Synthetic probe
ttgacctgcttgataccaaggagaaggcgcttgtgggagccatcctacgatcggccactt

SEQ ID NO: 1760 - DNA, 59 bp, Artificial Sequence
  Description of Artificial Sequence: Synthetic probe
cggcgtgtccacactgatgtggccttccttctcgaccgcagcacacacgtgcacactca

SEQ ID NO: 1761 - DNA, 60 bp, Artificial Sequence
  Description of Artificial Sequence: Synthetic probe
aagtggtaaccactgaccccaccacacacggtggtagtgtgggtacgccacggcgtgtcc

SEQ ID NO: 1762 - DNA, 60 bp, Artificial Sequence
  Description of Artificial Sequence: Synthetic probe
ggcccctgttggccatccacccgagcgaaactagacacaaacaaaagattgtggcacctg

SEQ ID NO: 1763 - DNA, 60 bp, Artificial Sequence
  Description of Artificial Sequence: Synthetic probe
acaaggcgcctctaacccgtcttgccctgccttacacggcaccacaccgtgtattggcta

SEQ ID NO: 1764 - DNA, 60 bp, Artificial Sequence
  Description of Artificial Sequence: Synthetic probe
accaaaagaccaaattaacacactggacctgatgcaaacccctgctcacactctggtggg

SEQ ID NO: 1765 - DNA, 60 bp, Artificial Sequence
  Description of Artificial Sequence: Synthetic probe
ccctacgaccatgaacctctggacgtggactggcaggaccgggctggcctgttcctccgc

SEQ ID NO: 1766 - DNA, 60 bp, Artificial Sequence
  Description of Artificial Sequence: Synthetic probe
gccctacgaccatgaacctctggacgtggactggcaggaccgggctggcctgttcctccg

SEQ ID NO: 1767 - DNA, 60 bp, Artificial Sequence
  Description of Artificial Sequence: Synthetic probe
ctggctgacttccacgccggaattttcatcaaaggcaccgagcacgctgtgttcgccctc

SEQ ID NO: 1768 - DNA, 60 bp, Artificial Sequence
  Description of Artificial Sequence: Synthetic probe
catgactctggctgacttccacgccggaattttcatcaaaggcaccgagcacgctgtgtt

SEQ ID NO: 1769 - DNA, 60 bp, Artificial Sequence
  Description of Artificial Sequence: Synthetic probe
catgatcaaacagctctctgactatactaaattggacttgtcggacggtgggccccccgc

SEQ ID NO: 1770 - DNA, 56 bp, Artificial Sequence
  Description of Artificial Sequence: Synthetic probe
catgatcaaacagctctctgactatactaaattggacttgtcggacggtgggcccc

SEQ ID NO: 1771 - DNA, 60 bp, Artificial Sequence
  Description of Artificial Sequence: Synthetic probe
gcaggcccaacaatcacgggaactgttggctcaactcaatactgcagctctttcgatacg

SEQ ID NO: 1772 - DNA, 60 bp, Artificial Sequence
  Description of Artificial Sequence: Synthetic probe
cttctacagcaggcccaacaatcacgggaactgttggctcaactcaatactgcagctctt

SEQ ID NO: 1773 - DNA, 60 bp, Artificial Sequence
  Description of Artificial Sequence: Synthetic probe
agacaactgactgttttaacgtgtttctcgaaatctttcataggtccagacagacgttca

SEQ ID NO: 1774 - DNA, 60 bp, Artificial Sequence
  Description of Artificial Sequence: Synthetic probe
atgaagacaactgactgttttaacgtgtttctcgaaatctttcataggtccagacagacg

SEQ ID NO: 1775 - DNA, 60 bp, Artificial Sequence
  Description of Artificial Sequence: Synthetic probe
gagacacaagtccagcggcgtcaccacactgatgtcggcttcataatggacagatttgtg

SEQ ID NO: 1776 - DNA, 60 bp, Artificial Sequence
  Description of Artificial Sequence: Synthetic probe
gcggcgatacacaggtccagaggcgccaacacacggacgtctcgttcatcatggacagat

SEQ ID NO: 1777 - DNA, 60 bp, Artificial Sequence
  Description of Artificial Sequence: Synthetic probe
cagacggggtgatctagggtctctcgcgagggtcgccgcaaaacagcttcccgcttcttt

SEQ ID NO: 1778 - DNA, 60 bp, Artificial Sequence
  Description of Artificial Sequence: Synthetic probe
cacaggtaatgcaggcagacggggtgatctagggtctctcgcgagggtcgccgcaaaaca

SEQ ID NO: 1779 - DNA, 60 bp, Artificial Sequence
  Description of Artificial Sequence: Synthetic probe
ccgttgatggttaggtacactcacaccacagacagatacaaggtcacacttgtgtcgcca

SEQ ID NO: 1780 - DNA, 60 bp, Artificial Sequence
  Description of Artificial Sequence: Synthetic probe
ccacgtccgctgatggttaggtacactcacaccacagacagatacaaggtcgcacttgtg

SEQ ID NO: 1781 - DNA, 60 bp, Artificial Sequence
  Description of Artificial Sequence: Synthetic probe
ctgcttcggtctgcgacgtactacttctcagacctagaggttgcgcttgttcacacaggc

SEQ ID NO: 1782 - DNA, 60 bp, Artificial Sequence
  Description of Artificial Sequence: Synthetic probe
ttctactgtccacgtccgctgatggttaggtacactcacaccacagacagatacaaggtc

SEQ ID NO: 1783 - DNA, 60 bp, Artificial Sequence
  Description of Artificial Sequence: Synthetic probe
cgctcccctacactgcaccacaccgcgtgttggcaacagtgtacaacggagtgaacaagt

SEQ ID NO: 1784 - DNA, 60 bp, Artificial Sequence
  Description of Artificial Sequence: Synthetic probe
atccaacaactcctcgtgcgcatgaagcgtgccgagctctactgccccaggccactgctg

SEQ ID NO: 1785 - DNA, 60 bp, Artificial Sequence
  Description of Artificial Sequence: Synthetic probe
gcaacaggctgcccacctccttcaactacggtgctgtgaaggctgacaccatcacggagc

SEQ ID NO: 1786 - DNA, 60 bp, Artificial Sequence
  Description of Artificial Sequence: Synthetic probe
agcaacaggctgcccacctccttcaactacggtgctgtgaaggctgacaccatcacggag

SEQ ID NO: 1787 - DNA, 60 bp, Artificial Sequence
  Description of Artificial Sequence: Synthetic probe
gtgaaacagctcctgaacttcgacctgcttaagttggcgggagacgttgagtccaaccct

SEQ ID NO: 1788 - DNA, 60 bp, Artificial Sequence
  Description of Artificial Sequence: Synthetic probe
ccggagtgtttggcactgcttacctcgtgcctcgtcatcttttcgcagagaagtatgaca

SEQ ID NO: 1789 - DNA, 60 bp, Artificial Sequence
  Description of Artificial Sequence: Synthetic probe
cgaccacgcaaaccgggacaggttcgatgccccaatcggcgtcgagaaacaactgtgcaa

SEQ ID NO: 1790 - DNA, 60 bp, Artificial Sequence
  Description of Artificial Sequence: Synthetic probe
cctacgaccacgcaaaccgggacaggttcgatgccccaatcggcgtcgagaaacaactgt

SEQ ID NO: 1791 - DNA, 60 bp, Artificial Sequence
  Description of Artificial Sequence: Synthetic probe
aaatacgcaaacacgcgccacgcgctcccctccacgttcaactttggacacgttaccgcg

SEQ ID NO: 1792 - DNA, 60 bp, Artificial Sequence
  Description of Artificial Sequence: Synthetic probe
caaatacgcaaacacgcgccacgcgctcccctccacgttcaactttggacacgttaccgc

SEQ ID NO: 1793 - DNA, 60 bp, Artificial Sequence
  Description of Artificial Sequence: Synthetic probe
aacacatgtcaccgccatccgcggtgaccgcgctgtgttagcggccaaatacgcaaacac

SEQ ID NO: 1794 - DNA, 60 bp, Artificial Sequence
  Description of Artificial Sequence: Synthetic probe
gtttgttgtcaactgtctacaacggtgagtgcgggtacagaacacatgtcaccgccatcc

SEQ ID NO: 1795 - DNA, 60 bp, Artificial Sequence
  Description of Artificial Sequence: Synthetic probe
gttttctcaaagaacggtgtcacccggttcgccgtgccgtacactgcgccacaccgtttg

SEQ ID NO: 1796 - DNA, 60 bp, Artificial Sequence
  Description of Artificial Sequence: Synthetic probe
caaccccatggttttctcaaagaacggtgtcacccggttcgccgtgccgtacactgcgcc

SEQ ID NO: 1797 - DNA, 60 bp, Artificial Sequence
  Description of Artificial Sequence: Synthetic probe
ggcaacccaacggcgcacccagaaccaccgaacttggggacaaccccatggttttctcaa

SEQ ID NO: 1798 - DNA, 59 bp, Artificial Sequence
  Description of Artificial Sequence: Synthetic probe
acaacggtgactgtaagtacaaacccactggcacagccccgcgcgaaaacattcgcggg

SEQ ID NO: 1799 - DNA, 57 bp, Artificial Sequence
  Description of Artificial Sequence: Synthetic probe
atggtgcccctgaagcagctttgtcaaacaccagcaaccccactgcctacaacaagg

SEQ ID NO: 1800 - DNA, 60 bp, Artificial Sequence
  Description of Artificial Sequence: Synthetic probe
ccactggtgaatctgctgaccctgttaccactaccgtcgagaactacggaggagagacgc

SEQ ID NO: 1801 - DNA, 60 bp, Artificial Sequence
  Description of Artificial Sequence: Synthetic probe
actacggccactggtgaatctgctgaccctgttaccactaccgtcgagaactacggagga

SEQ ID NO: 1802 - DNA, 60 bp, Artificial Sequence
  Description of Artificial Sequence: Synthetic probe
gtgcccaatggtgcccctgaagcagctttgtcaaacaccagcaaccccaccgcctacaac

SEQ ID NO: 1803 - DNA, 60 bp, Artificial Sequence
  Description of Artificial Sequence: Synthetic probe
gggtgcccaatggtgcccctgaagcagctttgtcaaacaccagcaaccccactgcctaca

SEQ ID NO: 1804 - DNA, 60 bp, Artificial Sequence
  Description of Artificial Sequence: Synthetic probe
gcaatttgacttgggtgcccaatggtgcccctgaagcagctttgtcaaacaccagcaacc

SEQ ID NO: 1805 - DNA, 60 bp, Artificial Sequence
  Description of Artificial Sequence: Synthetic probe
acggcaatttgacttgggtgcccaatggtgcccctgaagcagctttgtcaaacaccagca

SEQ ID NO: 1806 - DNA, 60 bp, Artificial Sequence
  Description of Artificial Sequence: Synthetic probe
gccgagctctactgccccaggccactgctggcagtggaggtgtcgtcgcaagacagacac

SEQ ID NO: 1807 - DNA, 60 bp, Artificial Sequence
  Description of Artificial Sequence: Synthetic probe
acagatgacaagactcttgacgaggcggaaaagaaccctctggagaccagcggtgccagc

SEQ ID NO: 1808 - DNA, 60 bp, Artificial Sequence
  Description of Artificial Sequence: Synthetic probe
caccacagatgacaagactcttgacgaggcggaaaagaaccctctggaaactagtggtgc

SEQ ID NO: 1809 - DNA, 60 bp, Artificial Sequence
  Description of Artificial Sequence: Synthetic probe
gcaaacatcaccacagatgacaagactcttgacgaggcggaaaagaaccctcaggagact

SEQ ID NO: 1810 - DNA, 60 bp, Artificial Sequence
  Description of Artificial Sequence: Synthetic probe
gcaaacatcaccacagatgacaagactcttgacgaggcggaaaagaaccctctggagacc

SEQ ID NO: 1811 - DNA, 60 bp, Artificial Sequence
  Description of Artificial Sequence: Synthetic probe
gtgaaggctgacaccatcacggagctgttgatccgcatgacgcgtgcggagacatactgc

SEQ ID NO: 1812 - DNA, 60 bp, Artificial Sequence
  Description of Artificial Sequence: Synthetic probe
cggtgctgtgaaggctgacaccatcacggagctgttgatccgcattaagcgtgcggacac

SEQ ID NO: 1813 - DNA, 60 bp, Artificial Sequence
  Description of Artificial Sequence: Synthetic probe
ccacctccttcaactacggtgctgcgaaggctgacaccatcacggagctgttgatccgca

SEQ ID NO: 1814 - DNA, 60 bp, Artificial Sequence
  Description of Artificial Sequence: Synthetic probe
cccacctccttcaactatggtgctgtgaaggctgacaccatcacggagctgttgatccgc

SEQ ID NO: 1815 - DNA, 60 bp, Artificial Sequence
  Description of Artificial Sequence: Synthetic probe
caatttcggagcaatacgggctacgcacatccacgagcttctcgtgcgcatgaagcgtgc

SEQ ID NO: 1816 - DNA, 60 bp, Artificial Sequence
  Description of Artificial Sequence: Synthetic probe
caatttcggagcaatacgggctatgcacatccacgagcttctcgtgcgcatgaagcgtgc

SEQ ID NO: 1817 - DNA, 51 bp, Artificial Sequence
  Description of Artificial Sequence: Synthetic probe
ccccacccacgtcattgacctcatgcaaacccaccagcactcgctggtagg

SEQ ID NO: 1818 - DNA, 60 bp, Artificial Sequence
  Description of Artificial Sequence: Synthetic probe
gccgcaaactaccaccgccggggaatctgcagaccctgtcaccaccaccgtcgagaacta

SEQ ID NO: 1819 - DNA, 60 bp, Artificial Sequence
  Description of Artificial Sequence: Synthetic probe
gtcgcaaactaccaccgccggggaatctgcagaccctgtcaccaccaccgtcgagaacta

SEQ ID NO: 1820 - DNA, 60 bp, Artificial Sequence
  Description of Artificial Sequence: Synthetic probe
ggtcgcaaactaccaccgccggggaatctgcagaccctgtcaccaccaccgtcgagaact

SEQ ID NO: 1821 - DNA, 60 bp, Artificial Sequence
  Description of Artificial Sequence: Synthetic probe
cgcgcttctccgcgcagccacatactacttctctgacttggaaattgcagtgacccacac

SEQ ID NO: 1822 - DNA, 50 bp, Artificial Sequence
  Description of Artificial Sequence: Synthetic probe
actgagcttctgatccgcatgaaacgcgcggagacatactgccccaggcc

SEQ ID NO: 1823 - DNA, 60 bp, Artificial Sequence
  Description of Artificial Sequence: Synthetic probe
tgaagcgggctgaactgtactgcccaaggccactcctcccggcttaccaacacgaaaacc

SEQ ID NO: 1824 - DNA, 60 bp, Artificial Sequence
  Description of Artificial Sequence: Synthetic probe
acgtttactacaggatgaagcgggctgaactgtactgcccaaggccactcctcccggctt

SEQ ID NO: 1825 - DNA, 60 bp, Artificial Sequence
  Description of Artificial Sequence: Synthetic probe
tgaccgcgccgtgctggcagccaaatacgccgacaccagacactcgcttccgtccacgtt

SEQ ID NO: 1826 - DNA, 60 bp, Artificial Sequence
  Description of Artificial Sequence: Synthetic probe
ttccgcaatccgcggtgaccgcgccgtgctggcagccaaatacgccgacaccagacactc

SEQ ID NO: 1827 - DNA, 60 bp, Artificial Sequence
  Description of Artificial Sequence: Synthetic probe
ggtggagtcaccaggtttgccgtaccatacacatcgccacaccggttgcttgcaaccagg

SEQ ID NO: 1828 - DNA, 60 bp, Artificial Sequence
  Description of Artificial Sequence: Synthetic probe
cacggtggagtcaccaggtttgccgtaccatacacatcgccacaccggttgcttgcaacc

SEQ ID NO: 1829 - DNA, 60 bp, Artificial Sequence
  Description of Artificial Sequence: Synthetic probe
acggtgcgccgcgtactacgcagctgggagacaaccccatggtgttctcccacggtggag

SEQ ID NO: 1830 - DNA, 51 bp, Artificial Sequence
  Description of Artificial Sequence: Synthetic probe
acggtgcgccgcgtactacgcagctgggagacaaccccatggtgttctccc

SEQ ID NO: 1831 - DNA, 60 bp, Artificial Sequence
  Description of Artificial Sequence: Synthetic probe
aaattgcatgtgttggcgaccacaagcgcgtctactggcaacccaacggtgcgccgcgta

SEQ ID NO: 1832 - DNA, 60 bp, Artificial Sequence
  Description of Artificial Sequence: Synthetic probe
cctggaaattgcatgtgttggcgaccacaagcgcgtctactggcaacccaacggtgcgcc

SEQ ID NO: 1833 - DNA, 60 bp, Artificial Sequence
  Description of Artificial Sequence: Synthetic probe
gcgccctcctcagggcatcaacctactacttctgtgacctggaaattgcatgtgttggcg

SEQ ID NO: 1834 - DNA, 60 bp, Artificial Sequence
  Description of Artificial Sequence: Synthetic probe
caagctctagtaggcgccctcctcagggcatcaacctactacttctgtgacctggaaatt

SEQ ID NO: 1835 - DNA, 53 bp, Artificial Sequence
  Description of Artificial Sequence: Synthetic probe
tcgtgcttgacagattcacccatgtgcacaccaaaaagaccaccttcaacgtg

SEQ ID NO: 1836 - DNA, 60 bp, Artificial Sequence
  Description of Artificial Sequence: Synthetic probe
cggtggaatggtgacggagaagaggcggatgcacacagacgttgcattcgtgcttgacag

SEQ ID NO: 1837 - DNA, 60 bp, Artificial Sequence
  Description of Artificial Sequence: Synthetic probe
gcacggtggaatggtgacggagaagaggcggatgcacacagacgttgcattcgtgcttga

SEQ ID NO: 1838 - DNA, 59 bp, Artificial Sequence
  Description of Artificial Sequence: Synthetic probe
aaggggcagacgtcgtcacgactgacccatcaacgcacggtggaatggtgacggagaag

SEQ ID NO: 1839 - DNA, 60 bp, Artificial Sequence
  Description of Artificial Sequence: Synthetic probe
accaccagtgctggcgaaggggcagacgtcgtcacgactgacccatcaacgcacggtgga

SEQ ID NO: 1840 - DNA, 60 bp, Artificial Sequence
  Description of Artificial Sequence: Synthetic probe
aacggtgagtgtagctaccaggtgcccgtcaccgccatccgcggtgaccgcgctgttctg

SEQ ID NO: 1841 - DNA, 60 bp, Artificial Sequence
  Description of Artificial Sequence: Synthetic probe
cgcaggcagcacactgacgtgtctttcctccttgaccggttcaccctggtcgggaagact

SEQ ID NO: 1842 - DNA, 60 bp, Artificial Sequence
  Description of Artificial Sequence: Synthetic probe
ccgcgccgctcgcaggcagcacactgacgtgtctttcctccttgaccggttcaccctggt

SEQ ID NO: 1843 - DNA, 60 bp, Artificial Sequence
  Description of Artificial Sequence: Synthetic probe
gctgccacgtactacttctccgacttggagattgtggtgcgccacgacggcaacctgaca

SEQ ID NO: 1844 - DNA, 60 bp, Artificial Sequence
  Description of Artificial Sequence: Synthetic probe
ctttgttagctcttgacaccactcaggaccgccgtaaacaggagatcattgcacctgaaa

SEQ ID NO: 1845 - DNA, 60 bp, Artificial Sequence
  Description of Artificial Sequence: Synthetic probe
aaccacgacaactgttggttgaacaccatccttcagttgttcaggtatgtcgacgaaacc

SEQ ID NO: 1846 - DNA, 60 bp, Artificial Sequence
  Description of Artificial Sequence: Synthetic probe
aaccacgacaactgttggttgaacaccatccttcagttgtttaggtacgtcgacgaaccc

SEQ ID NO: 1847 - DNA, 60 bp, Artificial Sequence
  Description of Artificial Sequence: Synthetic probe
catccacgagcttctcgtgcgcatgaaaagggctgaactttactgccctagaccgctgtt

SEQ ID NO: 1848 - DNA, 60 bp, Artificial Sequence
  Description of Artificial Sequence: Synthetic probe
ggtgcaatcaaggcccagaccatccacgagcttctcgtgcgcatgaaaagggcggagctc

SEQ ID NO: 1849 - DNA, 60 bp, Artificial Sequence
  Description of Artificial Sequence: Synthetic probe
acaaacgtgtctactggcagcctaacggcgcgccacgcacaacagttttgggagacaacc

SEQ ID NO: 1850 - DNA, 60 bp, Artificial Sequence
  Description of Artificial Sequence: Synthetic probe
cacacacgtgtctactggcagcctaacggcgcgccacgcgcaacagcactgggagacaac

SEQ ID NO: 1851 - DNA, 60 bp, Artificial Sequence
  Description of Artificial Sequence: Synthetic probe
gcttgtgttggcacgcacacacgtgtctactggcagcctaacggcgcgccacgcgcaaca

SEQ ID NO: 1852 - DNA, 56 bp, Artificial Sequence
  Description of Artificial Sequence: Synthetic probe
ggcgtcaacctactacttctgtgatctggagatcgcttgtgttggcacacacaaac

SEQ ID NO: 1853 - DNA, 60 bp, Artificial Sequence
  Description of Artificial Sequence: Synthetic probe
ggcgtcaacctactacttctgtgatctggagatcgcttgtgttggcacacacaaacgtgt

SEQ ID NO: 1854 - DNA, 60 bp, Artificial Sequence
  Description of Artificial Sequence: Synthetic probe
ccctcctcagggcgtcaacctactacttctgtgatctggagattgcttgtgttggcacgc

SEQ ID NO: 1855 - DNA, 55 bp, Artificial Sequence
  Description of Artificial Sequence: Synthetic probe
tcttgctacagtttacaacggaaactgcaaatactccaagacccaacacgttgca

SEQ ID NO: 1856 - DNA, 60 bp, Artificial Sequence
  Description of Artificial Sequence: Synthetic probe
ccacaagatgcattcccacgacattcaacttcggaagattgttgtgtgaatcaggtgagg

SEQ ID NO: 1857 - DNA, 53 bp, Artificial Sequence
  Description of Artificial Sequence: Synthetic probe
actacgaccacatgggcaaggatcgctacaaaaccgcgataactaggcctgcc

SEQ ID NO: 1858 - DNA, 60 bp, Artificial Sequence
  Description of Artificial Sequence: Synthetic probe
cgcagaactctactgcccgcgacccattctcacacactacgaccacatgggcaaggatcg

SEQ ID NO: 1859 - DNA, 60 bp, Artificial Sequence
  Description of Artificial Sequence: Synthetic probe
ggcaggttatacacagaagccgaggttgacgtgtatgtcaggatgaagcgcgcagaactc

SEQ ID NO: 1860 - DNA, 60 bp, Artificial Sequence
  Description of Artificial Sequence: Synthetic probe
accactttcaactatggcaggttatacacagaagccgaggttgacgtgtatgtcaggatg

SEQ ID NO: 1861 - DNA, 60 bp, Artificial Sequence
  Description of Artificial Sequence: Synthetic probe
actggcacggccccacgcgaaaacattcgcggggacctcgcaaccctcgcggctaagatc

SEQ ID NO: 1862 - DNA, 60 bp, Artificial Sequence
  Description of Artificial Sequence: Synthetic probe
agtacaagcccactggcacggccccacgcgaaaacattcgcggggacctcgcaaccctcg

SEQ ID NO: 1863 - DNA, 55 bp, Artificial Sequence
  Description of Artificial Sequence: Synthetic probe
tggactcccaacggagctcccgagtttcttgaagtgggcgacaacccatgtgtct

SEQ ID NO: 1864 - DNA, 60 bp, Artificial Sequence
  Description of Artificial Sequence: Synthetic probe
ccacaccgcgtgttggcaaccgagtacaacgggacgaacaggtacactgtgagtggctca

SEQ ID NO: 1865 - DNA, 60 bp, Artificial Sequence
  Description of Artificial Sequence: Synthetic probe
ctcccctacacggcgccacaccgcgtgttggcaaccgagtacaacgggacgaacaggtac

SEQ ID NO: 1866 - DNA, 60 bp, Artificial Sequence
  Description of Artificial Sequence: Synthetic probe
cggcaacctgacttgggtacccaatggcgctcctgaatcggccttgtctaacatcagcaa

SEQ ID NO: 1867 - DNA, 60 bp, Artificial Sequence
  Description of Artificial Sequence: Synthetic probe
aagatcaacagtctcagtcccacacatgtcatagacctcatgcagacccaccaacacggg

SEQ ID NO: 1868 - DNA, 60 bp, Artificial Sequence
  Description of Artificial Sequence: Synthetic probe
gcaccgcggaccgcccaacttggtgataatcccatggttttcgccaagggtggtgtgacc

SEQ ID NO: 1869 - DNA, 60 bp, Artificial Sequence
  Description of Artificial Sequence: Synthetic probe
tggcagcctaacggggcaccgcgggccacccaacttggtgataatcccatggttttcgcc

SEQ ID NO: 1870 - DNA, 60 bp, Artificial Sequence
  Description of Artificial Sequence: Synthetic probe
ccttcgttcttgaccggtttgtgaaggtccaagtgtcagacaaccaacacacgctggacg

SEQ ID NO: 1871 - DNA, 60 bp, Artificial Sequence
  Description of Artificial Sequence: Synthetic probe
ccgacgttgccttcgttcttgaccggtttgtgaaggtccaagtgtcagacaaccaacaca

SEQ ID NO: 1872 - DNA, 60 bp, Artificial Sequence
  Description of Artificial Sequence: Synthetic probe
tcgtgaccgccgacaaaccagtcgacgtttactaccggatgaagcgagcggagctgtact

SEQ ID NO: 1873 - DNA, 60 bp, Artificial Sequence
  Description of Artificial Sequence: Synthetic probe
ggttgccctagtaaaaccagagaaacaattgtgtaacttcgacctgttaaagttggccgg

SEQ ID NO: 1874 - DNA, 60 bp, Artificial Sequence
  Description of Artificial Sequence: Synthetic probe
cagatacaaggttgccctagtaaaaccagagaaacaattgtgtaacttcgacctgttaaa

SEQ ID NO: 1875 - DNA, 60 bp, Artificial Sequence
  Description of Artificial Sequence: Synthetic probe
tgtgattcgggcgacgtgtattacaggatgaagagggcggagctatactgcccgcgccct

SEQ ID NO: 1876 - DNA, 60 bp, Artificial Sequence
  Description of Artificial Sequence: Synthetic probe
gtaggctgttgtgtgattcgggcgacgtgtattacaggatgaagagggcggagctatact

SEQ ID NO: 1877 - DNA, 60 bp, Artificial Sequence
  Description of Artificial Sequence: Synthetic probe
ccgcgacgcggcgatcttgccgtgttgtctgaacgcgttgagactgaacaagaaagatgc

SEQ ID NO: 1878 - DNA, 60 bp, Artificial Sequence
  Description of Artificial Sequence: Synthetic probe
tggtgtgactcgctttgcgttgccttttactgcaccacacggtgtcctttcaaccgtgta

SEQ ID NO: 1879 - DNA, 60 bp, Artificial Sequence
  Description of Artificial Sequence: Synthetic probe
cgttcactcgaagaatggtgtgactcgctttgcgttgccttttactgcaccacacggtgt

SEQ ID NO: 1880 - DNA, 60 bp, Artificial Sequence
  Description of Artificial Sequence: Synthetic probe
gggtacccaacgggtgcccacacaccacaagagtggaagacaatccaatcgttcactcga

SEQ ID NO: 1881 - DNA, 60 bp, Artificial Sequence
  Description of Artificial Sequence: Synthetic probe
tgggtacccaacgggtgcccacacaccacaagagtggaagacaatccaatcgttcactcg

SEQ ID NO: 1882 - DNA, 60 bp, Artificial Sequence
  Description of Artificial Sequence: Synthetic probe
ttttgccttgccctacaccgcgccacacagatgtctggcaacaacctacaacggtgactg

SEQ ID NO: 1883 - DNA, 60 bp, Artificial Sequence
  Description of Artificial Sequence: Synthetic probe
gctggcacagccccgcgtgagaacatccgcggggacctcgcgactcttgcggagaggatt

SEQ ID NO: 1884 - DNA, 60 bp, Artificial Sequence
  Description of Artificial Sequence: Synthetic probe
cgtctcctcctgtaacggcaccacccgctttgcactgccctacactgctccacacaggtg

SEQ ID NO: 1885 - DNA, 60 bp, Artificial Sequence
  Description of Artificial Sequence: Synthetic probe
gctccggagcttactgaagtaggcgacaatccagtcgtctcctcctgtaacggcaccacc

SEQ ID NO: 1886 - DNA, 60 bp, Artificial Sequence
  Description of Artificial Sequence: Synthetic probe
tggactcccaacggagctccggagcttactgaagtaggcgacaatccagtcgtctcctcc

SEQ ID NO: 1887 - DNA, 60 bp, Artificial Sequence
  Description of Artificial Sequence: Synthetic probe
taacggtgcccctgagagcgctcttcagaacgcgagcaaccccacggcctaccacaaggc

SEQ ID NO: 1888 - DNA, 60 bp, Artificial Sequence
  Description of Artificial Sequence: Synthetic probe
cctaacggtgccccggagagcgctcttcagaacgcgagcaaccccacggcctaccacaag

SEQ ID NO: 1889 - DNA, 60 bp, Artificial Sequence
  Description of Artificial Sequence: Synthetic probe
cgggtaagcaacaggctgcccacctccttcaactacggtgctgtgaaggctgacaccatc

SEQ ID NO: 1890 - DNA, 60 bp, Artificial Sequence
  Description of Artificial Sequence: Synthetic probe
gcacagcgggtaagcaacaggctgcccacctccttcaactacggtgctgtgaaggctgac

SEQ ID NO: 1891 - DNA, 60 bp, Artificial Sequence
  Description of Artificial Sequence: Synthetic probe
ttgcacagcgggtaagcaacaggctgcccacctccttcaactacggtgctgtgaaggctg

SEQ ID NO: 1892 - DNA, 60 bp, Artificial Sequence
  Description of Artificial Sequence: Synthetic probe
cttgcacagcgggtaagcaacaggctgcccacctccttcaactacggtgctgtgaaggct

SEQ ID NO: 1893 - DNA, 52 bp, Artificial Sequence
  Description of Artificial Sequence: Synthetic probe
ggtagcacctgagaaacagctttccaatttcgacctgttggcgttggccgga

SEQ ID NO: 1894 - DNA, 60 bp, Artificial Sequence
  Description of Artificial Sequence: Synthetic probe
ctgatggtcaggtacgtgcacaccactgacaggtacaagaccaaactggtagcacctgag

SEQ ID NO: 1895 - DNA, 60 bp, Artificial Sequence
  Description of Artificial Sequence: Synthetic probe
cctctgatggtcaggtacgtgcacaccactgacaggtacaagaccaaactggtagcacct

SEQ ID NO: 1896 - DNA, 60 bp, Artificial Sequence
  Description of Artificial Sequence: Synthetic probe
gtgggaacgtgtactaccgtatgaagagagcggagctttactgcccccgacctctgatgg

SEQ ID NO: 1897 - DNA, 60 bp, Artificial Sequence
  Description of Artificial Sequence: Synthetic probe
cccacgactttcaactacggtcgattgttgtgtgacagtgggaacgtgtactaccgtatg

SEQ ID NO: 1898 - DNA, 60 bp, Artificial Sequence
  Description of Artificial Sequence: Synthetic probe
cacaagatgcattcccacgactttcaactacggtcgattgttgtgtgacagtgggaacgt

SEQ ID NO: 1899 - DNA, 60 bp, Artificial Sequence
  Description of Artificial Sequence: Synthetic probe
ccccgccggggcgacctggccgtgttgtctcgacgcgttgagaatgaaaccacaagatgc

SEQ ID NO: 1900 - DNA, 60 bp, Artificial Sequence
  Description of Artificial Sequence: Synthetic probe
tgtctacaacggctactgcaagtactcaaagacccaacgcgtggctccccgccggggcga

SEQ ID NO: 1901 - DNA, 60 bp, Artificial Sequence
  Description of Artificial Sequence: Synthetic probe
ccactgtctacaacggctactgcaagtactcaaagacccaacgcgtggctccccgccggg

SEQ ID NO: 1902 - DNA, 60 bp, Artificial Sequence
  Description of Artificial Sequence: Synthetic probe
gctcgctttgcaatcccatacactgcacctcatggtgtacttgccactgtctacaacggc

SEQ ID NO: 1903 - DNA, 60 bp, Artificial Sequence
  Description of Artificial Sequence: Synthetic probe
cggtgctgctcgctttgcaatcccatacactgcacctcatggtgtacttgccactgtcta

SEQ ID NO: 1904 - DNA, 60 bp, Artificial Sequence
  Description of Artificial Sequence: Synthetic probe
ttggggagtccgcagaccctgtcaccaccaccgtggagaactacggcggtgagacacaaa

SEQ ID NO: 1905 - DNA, 60 bp, Artificial Sequence
  Description of Artificial Sequence: Synthetic probe
accactactactggggagtccgcagaccctgtcaccaccaccgtggagaactacggcggt

SEQ ID NO: 1906 - DNA, 60 bp, Artificial Sequence
  Description of Artificial Sequence: Synthetic probe
accactgctactggggagtccgcagaccctgtcaccaccaccgtggagaactacggcggc

SEQ ID NO: 1907 - DNA, 60 bp, Artificial Sequence
  Description of Artificial Sequence: Synthetic probe
accactgctactggggagtccgcagaccctgtcaccaccaccgtggagaactacggcggt

SEQ ID NO: 1908 - DNA, 54 bp, Artificial Sequence
  Description of Artificial Sequence: Synthetic probe
agagcggagctgtactgccccagaccactgctggcagtagaagtgacttcacaa

SEQ ID NO: 1909 - DNA, 60 bp, Artificial Sequence
  Description of Artificial Sequence: Synthetic probe
acggtgcaatcaaggctgaaaccatccacgagcttctcgtgcgcatgaaaagagcggagc

SEQ ID NO: 1910 - DNA, 60 bp, Artificial Sequence
  Description of Artificial Sequence: Synthetic probe
gcggcacgggtctcgaaacagctccccgcatcgttcaactacggtgcaatcaaggctgaa

SEQ ID NO: 1911 - DNA, 60 bp, Artificial Sequence
  Description of Artificial Sequence: Synthetic probe
ggggtctctcgcggcacgggtctcgaaacagctccccgcatcgttcaactacggtgcaat

SEQ ID NO: 1912 - DNA, 60 bp, Artificial Sequence
  Description of Artificial Sequence: Synthetic probe
aacgggacgagtaagtacactgcgagcggttcaaaccggcgtggtgacttggggtctctc

SEQ ID NO: 1913 - DNA, 60 bp, Artificial Sequence
  Description of Artificial Sequence: Synthetic probe
ttgacctgggtgcccaacggtgcccctgagtcggccctgtcaaacaccagcaaccccact

SEQ ID NO: 1914 - DNA, 60 bp, Artificial Sequence
  Description of Artificial Sequence: Synthetic probe
cgacggcaacttgacctgggtgcccaacggtgcccctgagtcggccctgtcaaacaccag

SEQ ID NO: 1915 - DNA, 60 bp, Artificial Sequence
  Description of Artificial Sequence: Synthetic probe
gacctcatgcaaacacatcaacacggtctggtgggcgcgttgctgcgtgcagctacatac

SEQ ID NO: 1916 - DNA, 60 bp, Artificial Sequence
  Description of Artificial Sequence: Synthetic probe
attgacctcatgcaaacacatcaacacggtctggtgggcgcgttgctgcgtgcagctaca

SEQ ID NO: 1917 - DNA, 60 bp, Artificial Sequence
  Description of Artificial Sequence: Synthetic probe
ggacagatttgtgaagatcacacacttgagcccaacacacgtgattgacctcatgcaaac

SEQ ID NO: 1918 - DNA, 60 bp, Artificial Sequence
  Description of Artificial Sequence: Synthetic probe
tcataatggacagatttgtgaagatcacacacttgagcccaacacacgtgattgacctca

SEQ ID NO: 1919 - DNA, 60 bp, Artificial Sequence
  Description of Artificial Sequence: Synthetic probe
cggcggtgagacacaagtccagagacgtcaccacacagacgttggtttcataatggacag

SEQ ID NO: 1920 - DNA, 60 bp, Artificial Sequence
  Description of Artificial Sequence: Synthetic probe
ctacggcggtgagacacaagtccagagacgtcaccacacagacgttggtttcataatgga

SEQ ID NO: 1921 - DNA, 60 bp, Artificial Sequence
  Description of Artificial Sequence: Synthetic probe
ctcgccacacagctccctgcctccttcaacttcggcgcaattcgagccacggagatccaa

SEQ ID NO: 1922 - DNA, 60 bp, Artificial Sequence
  Description of Artificial Sequence: Synthetic probe
cacgagcaaccccactgcctaccacaaagcaccgtttacgagacttgcactcccttacac

SEQ ID NO: 1923 - DNA, 60 bp, Artificial Sequence
  Description of Artificial Sequence: Synthetic probe
gcgcgcggccacttactacttttctgatcttgagattgtggtgagccacgcgggtaacct

SEQ ID NO: 1924 - DNA, 60 bp, Artificial Sequence
  Description of Artificial Sequence: Synthetic probe
ctgttgcgcgcggccacttactacttttctgatcttgagattgtggtgagccacgcgggt

SEQ ID NO: 1925 - DNA, 60 bp, Artificial Sequence
  Description of Artificial Sequence: Synthetic probe
cgccggatccgtctgacgttctggtgtttgtcccgtacgatcaagaaccactcaacgggg

SEQ ID NO: 1926 - DNA, 60 bp, Artificial Sequence
  Description of Artificial Sequence: Synthetic probe
actcccctacaccgccccccaccgtgtgctggcaacagtgtacaacgggaagacaacgta

SEQ ID NO: 1927 - DNA, 60 bp, Artificial Sequence
  Description of Artificial Sequence: Synthetic probe
accgttcacgagacttgctctcccctacactgcgccgcaccgtgtgctggcaactgtcta

SEQ ID NO: 1928 - DNA, 60 bp, Artificial Sequence
  Description of Artificial Sequence: Synthetic probe
catcccaacaacattcaactacgggatgatctacacagaggcagaagtggacgtgtacct

SEQ ID NO: 1929 - DNA, 57 bp, Artificial Sequence
  Description of Artificial Sequence: Synthetic probe
aaactggtagcacctgataagcaactgtgcaatttgcacctgttaaagttggccgga

SEQ ID NO: 1930 - DNA, 60 bp, Artificial Sequence
  Description of Artificial Sequence: Synthetic probe
tgcaaatactccaagacccagcacgtcacaccacgccgtggcgacatggcagtgttggca

SEQ ID NO: 1931 - DNA, 60 bp, Artificial Sequence
  Description of Artificial Sequence: Synthetic probe
aactgcaaatactccaagacccagcacgtcacaccacgccgtggtgacatggcagtgttg

SEQ ID NO: 1932 - DNA, 60 bp, Artificial Sequence
  Description of Artificial Sequence: Synthetic probe
caacgggaactgcaaatactccaagacccagcacgtcacaccacgccgtggcgacatggc

SEQ ID NO: 1933 - DNA, 60 bp, Artificial Sequence
  Description of Artificial Sequence: Synthetic probe
ccgacgtcctggtatttgttccgtacgatcaagaaccacttaacggagaatggaaggcaa

SEQ ID NO: 1934 - DNA, 60 bp, Artificial Sequence
  Description of Artificial Sequence: Synthetic probe
gaccctagtaggtgccctcctgagggcctccacctactacttctgtgacctggaaattgc

SEQ ID NO: 1935 - DNA, 60 bp, Artificial Sequence
  Description of Artificial Sequence: Synthetic probe
ccaccgcttacaacaaagcgccgttcacgaggcttgccctcccttacactgcgccacacc

SEQ ID NO: 1936 - DNA, 60 bp, Artificial Sequence
  Description of Artificial Sequence: Synthetic probe
accgcttacaacaaagcgccgttcacgaggcttgccctcccttacactgcgccacaccgc

SEQ ID NO: 1937 - DNA, 60 bp, Artificial Sequence
  Description of Artificial Sequence: Synthetic probe
ttctccgctaacggcaccacccgttttgcactgccctacaccgcaccacacaggtgtctc

SEQ ID NO: 1938 - DNA, 60 bp, Artificial Sequence
  Description of Artificial Sequence: Synthetic probe
ccagcgacgtcaacacaccgacgtcagcttcatcatggacagatttgtgaaaatcaaccc

SEQ ID NO: 1939 - DNA, 60 bp, Artificial Sequence
  Description of Artificial Sequence: Synthetic probe
cccagcgacgtcaacacaccgacgtcagcttcatcatggacagatttgtgaaaatcaacc

SEQ ID NO: 1940 - DNA, 55 bp, Artificial Sequence
  Description of Artificial Sequence: Synthetic probe
gactcgggtgactgaactgctttaccgcatgaaaagggctgagacatactgcccc

SEQ ID NO: 1941 - DNA, 56 bp, Artificial Sequence
  Description of Artificial Sequence: Synthetic probe
gactcgggtgactgaactgctttaccgcatgaaaagggctgagacatactgccccc

SEQ ID NO: 1942 - DNA, 60 bp, Artificial Sequence
  Description of Artificial Sequence: Synthetic probe
gtagaggtgtcttcacaagacagacacaaacagaagatcattgcacctgcaaggcagctc

SEQ ID NO: 1943 - DNA, 60 bp, Artificial Sequence
  Description of Artificial Sequence: Synthetic probe
acatacggggaaacaacctcacggcgtggtgatatggcggccctcacacagagactgagc

SEQ ID NO: 1944 - DNA, 55 bp, Artificial Sequence
  Description of Artificial Sequence: Synthetic probe
ttgtcgtgaagaagatctccgactcgctctccagtctctttcacgtgccggcccc

SEQ ID NO: 1945 - DNA, 60 bp, Artificial Sequence
  Description of Artificial Sequence: Synthetic probe
agtgttggcccagaaggcggcgagaacgctgcctacctccttcaactacggtgccatcaa

SEQ ID NO: 1946 - DNA, 51 bp, Artificial Sequence
  Description of Artificial Sequence: Synthetic probe
cagcacgaagcagcaattgaattctttgagggaatggtgcacgactccatc

SEQ ID NO: 1947 - DNA, 60 bp, Artificial Sequence
  Description of Artificial Sequence: Synthetic probe
cagcacgaagcagcaattgaattctttgagggaatggtgcacgactccatcaaggaggaa

SEQ ID NO: 1948 - DNA, 55 bp, Artificial Sequence
  Description of Artificial Sequence: Synthetic probe
cagcagaaatgctcccaacttgagacttcaagtgttggctcaagtggcacggacg

SEQ ID NO: 1949 - DNA, 60 bp, Artificial Sequence
  Description of Artificial Sequence: Synthetic probe
ccccgcgtgttggcaaccgtgggtgggtgcaggtacagcagaaatgctcccaacttgaga

SEQ ID NO: 1950 - DNA, 60 bp, Artificial Sequence
  Description of Artificial Sequence: Synthetic probe
gccctgcccactgcgccccgcgtgttggcaaccgtgggtgggtgcaggtacagcagaaat

SEQ ID NO: 1951 - DNA, 60 bp, Artificial Sequence
  Description of Artificial Sequence: Synthetic probe
gtgaaacaggtgaagtctactaccggatgaaaagggctgagctgtactgtccacgacccc

SEQ ID NO: 1952 - DNA, 60 bp, Artificial Sequence
  Description of Artificial Sequence: Synthetic probe
gtgatacaggtgacctctactaccggatgaaaagggctgagctgtactgcccacgacccc

SEQ ID NO: 1953 - DNA, 60 bp, Artificial Sequence
  Description of Artificial Sequence: Synthetic probe
gtgacacaggtgaagtctactaccggatgaaaagggctgagctgtactgtccacgacccc

SEQ ID NO: 1954 - DNA, 60 bp, Artificial Sequence
  Description of Artificial Sequence: Synthetic probe
agactgttgtgtgatacaggtgacctctactaccggatgaaaagggctgagctgtactgc

SEQ ID NO: 1955 - DNA, 60 bp, Artificial Sequence
  Description of Artificial Sequence: Synthetic probe
ggagactgttgtgtgacacaggtgaagtctactaccggatgaaaagggctgagctgtact

SEQ ID NO: 1956 - DNA, 60 bp, Artificial Sequence
  Description of Artificial Sequence: Synthetic probe
ggagactgttgtgtgaaacaggtgaagtctactaccggatgaaaagggctgagctgtact

SEQ ID NO: 1957 - DNA, 60 bp, Artificial Sequence
  Description of Artificial Sequence: Synthetic probe
cacacaggtcgttggcaacagcctacaacggtgactgtaagtacaagcccgctggcactg

SEQ ID NO: 1958 - DNA, 60 bp, Artificial Sequence
  Description of Artificial Sequence: Synthetic probe
agctcctgaactttgacctgctcaagttggcgggagacgttgagtccaaccctgggccct

SEQ ID NO: 1959 - DNA, 60 bp, Artificial Sequence
  Description of Artificial Sequence: Synthetic probe
acagctcctgaactttgacctgctcaagttggcgggagacgttgagtccaaccctgggcc

SEQ ID NO: 1960 - DNA, 60 bp, Artificial Sequence
  Description of Artificial Sequence: Synthetic probe
ccgaggtcgacgtgtacgtcaggatgaagcgcgcggagctttactgcccgcgacctcttc

SEQ ID NO: 1961 - DNA, 60 bp, Artificial Sequence
  Description of Artificial Sequence: Synthetic probe
gcaccgcgtgctggcaacggtgtacaacgggacgagcaagtactctgtgaccacctcccc

SEQ ID NO: 1962 - DNA, 60 bp, Artificial Sequence
  Description of Artificial Sequence: Synthetic probe
gcatgctcggcatttgccgacatcgttcaactttggtgcagttaaagcagaaacaatcac

SEQ ID NO: 1963 - DNA, 60 bp, Artificial Sequence
  Description of Artificial Sequence: Synthetic probe
cggcaccagcactcgccctagcgagatctgtgtgatcaacggggttgtcatgaccctggc

SEQ ID NO: 1964 - DNA, 60 bp, Artificial Sequence
  Description of Artificial Sequence: Synthetic probe
tgatcaaacaactttctgattacaccaaacttgatctttcagacggtggaccaccggcac

SEQ ID NO: 1965 - DNA, 58 bp, Artificial Sequence
  Description of Artificial Sequence: Synthetic probe
tgcagctctttcgatacgtcgacgagccgcttttcgagtctgagtatttgtcacctga

SEQ ID NO: 1966 - DNA, 60 bp, Artificial Sequence
  Description of Artificial Sequence: Synthetic probe
ttgcagctcttccgatacgtggatgagccgcttttcgagtctgagtatttgtcacctgag

SEQ ID NO: 1967 - DNA, 60 bp, Artificial Sequence
  Description of Artificial Sequence: Synthetic probe
tcgagccacgaccatccacgagcttctcgtgcgcatgaagcgtgctgagctctactgccc

SEQ ID NO: 1968 - DNA, 56 bp, Artificial Sequence
  Description of Artificial Sequence: Synthetic probe
cttcgactgggtctatgactcacctgaaaatcttactcttgatgcaattaggcaac

SEQ ID NO: 1969 - DNA, 60 bp, Artificial Sequence
  Description of Artificial Sequence: Synthetic probe
ggtgaaaagaagaccttctactctagacccaacaaccatgacaactgttggctgaacgcc

SEQ ID NO: 1970 - DNA, 60 bp, Artificial Sequence
  Description of Artificial Sequence: Synthetic probe
acaacggtgaaaagaagaccttctactctagacccaacaaccatgacaactgttggctga

SEQ ID NO: 1971 - DNA, 60 bp, Artificial Sequence
  Description of Artificial Sequence: Synthetic probe
atggacacaactgactgttttatcgctctgctaaacgcttttagagagattacgtcactg

SEQ ID NO: 1972 - DNA, 60 bp, Artificial Sequence
  Description of Artificial Sequence: Synthetic probe
aaccctaccgcctataacaaagcgccgttcacgaggcttgcgcttccctacactgcgcca

SEQ ID NO: 1973 - DNA, 60 bp, Artificial Sequence
  Description of Artificial Sequence: Synthetic probe
aaccctaccgcctacaacaaagcgccgttcacgaggcttgcgcttccctacactgcgccg

SEQ ID NO: 1974 - DNA, 60 bp, Artificial Sequence
  Description of Artificial Sequence: Synthetic probe
gaaccctaccgcctacaacaaagcgccgttcacgaggcttgcgcttccctacactgcgcc

SEQ ID NO: 1975 - DNA, 60 bp, Artificial Sequence
  Description of Artificial Sequence: Synthetic probe
aaccctaccgcctacaacaaagcgccgttcacgaggcttgcgcttccctacactgcgcca

SEQ ID NO: 1976 - DNA, 60 bp, Artificial Sequence
  Description of Artificial Sequence: Synthetic probe
ctacggcggtgagacacaagttcagagacgccaccacaccgacgttggcttcatcatgga

SEQ ID NO: 1977 - DNA, 60 bp, Artificial Sequence
  Description of Artificial Sequence: Synthetic probe
tagagaactacggcggtgagacacaagttcagagacgccaccacaccgacgttggcttca

SEQ ID NO: 1978 - DNA, 60 bp, Artificial Sequence
  Description of Artificial Sequence: Synthetic probe
aactctactgcccccgacctgttctcacgcactacgaccacagcggcaaggaccgttaca

SEQ ID NO: 1979 - DNA, 60 bp, Artificial Sequence
  Description of Artificial Sequence: Synthetic probe
aactctactgcccccgacctgttctcacgcactacgaccacggtggcaaggaccgttaca

SEQ ID NO: 1980 - DNA, 60 bp, Artificial Sequence
  Description of Artificial Sequence: Synthetic probe
cccacattccaacgacattcaactatggaatgatttacacacaggcagaggtggacgtgt

SEQ ID NO: 1981 - DNA, 60 bp, Artificial Sequence
  Description of Artificial Sequence: Synthetic probe
tagtgagacccacattccaacgacattcaactatggaatgatttacacacaggcagaggt

SEQ ID NO: 1982 - DNA, 60 bp, Artificial Sequence
  Description of Artificial Sequence: Synthetic probe
ttcgcggtgaccttgcaacgctggctgcgcggattgctagtgagacccacattccaacga

SEQ ID NO: 1983 - DNA, 60 bp, Artificial Sequence
  Description of Artificial Sequence: Synthetic probe
cgcgagaacattcgcggtgaccttgcaacgctggctaagcggattgctagtgagacccac

SEQ ID NO: 1984 - DNA, 60 bp, Artificial Sequence
  Description of Artificial Sequence: Synthetic probe
ccccgcgagaacattcgcggtgaccttgcaacgctggctaagcggattgctagtgagacc

SEQ ID NO: 1985 - DNA, 60 bp, Artificial Sequence
  Description of Artificial Sequence: Synthetic probe
aatggtgactgcaagtacaaacccactagcaccccgccccgcgagaacattcgcggtgac

SEQ ID NO: 1986 - DNA, 60 bp, Artificial Sequence
  Description of Artificial Sequence: Synthetic probe
tcgcaacagtatacaatggtgactgcaagtacaaacccactggcaccccgccccgcgaga

SEQ ID NO: 1987 - DNA, 60 bp, Artificial Sequence
  Description of Artificial Sequence: Synthetic probe
tcgcaacagtatacaatggtgactgcaagtacaaacccactagcaccccgccccgcgaga

SEQ ID NO: 1988 - DNA, 60 bp, Artificial Sequence
  Description of Artificial Sequence: Synthetic probe
cttcgcgctcccttacaccgcacctcaccgggtgctcgcaacagtatacaatggtgactg

SEQ ID NO: 1989 - DNA, 60 bp, Artificial Sequence
  Description of Artificial Sequence: Synthetic probe
tggaggcaccactcgcttcgcgctcccttacaccgcacctcaccgggtgctcgcaacagt

SEQ ID NO: 1990 - DNA, 60 bp, Artificial Sequence
  Description of Artificial Sequence: Synthetic probe
tggagacaccactcgcttcgcgctcccttacaccgcacctcaccgggtgctcgcaacagt

SEQ ID NO: 1991 - DNA, 60 bp, Artificial Sequence
  Description of Artificial Sequence: Synthetic probe
aaaattaaccctgtgacccccacacatgtcattgacctcatgcagacccaccaacacgcg

SEQ ID NO: 1992 - DNA, 60 bp, Artificial Sequence
  Description of Artificial Sequence: Synthetic probe
aaaattaaccctgtggcccccacacatgtcattgacctcatgcagacccaccaacacgcg

SEQ ID NO: 1993 - DNA, 59 bp, Artificial Sequence
  Description of Artificial Sequence: Synthetic probe
aatggaattcacactttacaacggtgagaagaagactttctactccaggcccaacaacc

SEQ ID NO: 1994 - DNA, 58 bp, Artificial Sequence
  Description of Artificial Sequence: Synthetic probe
gtacacgcctgaaccgctggcagttgactggcaggggaaatgcgcgctcttcctgaag

SEQ ID NO: 1995 - DNA, 60 bp, Artificial Sequence
  Description of Artificial Sequence: Synthetic probe
acacccagtccagatgatgtgctcgtctacgtcccgtacacgcctgaaccgctggcagtt

SEQ ID NO: 1996 - DNA, 60 bp, Artificial Sequence
  Description of Artificial Sequence: Synthetic probe
cacttctacccctggacacccagtccagatgatgtgctcgtctacgtcccgtacacgcct

SEQ ID NO: 1997 - DNA, 60 bp, Artificial Sequence
  Description of Artificial Sequence: Synthetic probe
gatgtgtctagccgacttccacgccggaatctttttgaaaggtactgaacacgccgtgtt

SEQ ID NO: 1998 - DNA, 60 bp, Artificial Sequence
  Description of Artificial Sequence: Synthetic probe
cgccccagtgagatttgtgtcgtcaacggtgtacagatgtgtctagccgacttccacgcc

SEQ ID NO: 1999 - DNA, 60 bp, Artificial Sequence
  Description of Artificial Sequence: Synthetic probe
gtcggcacttcgactcgccccagtgagatttgtgtcgtcaacggtgtacagatgtgtcta

SEQ ID NO: 2000 - DNA, 60 bp, Artificial Sequence
  Description of Artificial Sequence: Synthetic probe
cctcccgcgctcgtgatctgggcaattaaggacatcttgatgaccggagtcggcacttcg

SEQ ID NO: 2001 - DNA, 60 bp, Artificial Sequence
  Description of Artificial Sequence: Synthetic probe
gacctcccgcgctcgtgatctgggcaattaaggacatcttgatgaccggagtcggcactt

SEQ ID NO: 2002 - DNA, 60 bp, Artificial Sequence
  Description of Artificial Sequence: Synthetic probe
atgattgaacaactcatggaacacaccggcatggacctgcgagagggcggacctcccgcg

SEQ ID NO: 2003 - DNA, 60 bp, Artificial Sequence
  Description of Artificial Sequence: Synthetic probe
catgattgaacaactcatggaacacaccggcatggacctgcgagagggcggacctcccgc

SEQ ID NO: 2004 - DNA, 60 bp, Artificial Sequence
  Description of Artificial Sequence: Synthetic probe
gaacctctctttgaaagtgagtacctcgcccccgaaaaccacacggggcgcatgattgaa

SEQ ID NO: 2005 - DNA, 60 bp, Artificial Sequence
  Description of Artificial Sequence: Synthetic probe
cgacaactgctggttgaatgcaatgctgcaactcttccggtacgttgacgaacctctctt

SEQ ID NO: 2006 - DNA, 60 bp, Artificial Sequence
  Description of Artificial Sequence: Synthetic probe
acgacaactgctggttgaatgcaatgctgcaactcttccggtacgttgacgaacctctct

SEQ ID NO: 2007 - DNA, 60 bp, Artificial Sequence
  Description of Artificial Sequence: Synthetic probe
cggtgagaagaaaactttctacagcagaccaaacacacacgacaactgctggttgaatgc

SEQ ID NO: 2008 - DNA, 60 bp, Artificial Sequence
  Description of Artificial Sequence: Synthetic probe
cacactgtacaacggtgagaagaaaactttctacagcagaccaaacacacacgacaactg

SEQ ID NO: 2009 - DNA, 60 bp, Artificial Sequence
  Description of Artificial Sequence: Synthetic probe
cgtcaccacactgacgttgccttcgttcttgaccggtttgtgaaggtccatgtgtcggac

SEQ ID NO: 2010 - DNA, 60 bp, Artificial Sequence
  Description of Artificial Sequence: Synthetic probe
acgcggcgaccttgccgtgttgtccacacgtgttgagacggaacaggaacgatgtttgcc

SEQ ID NO: 2011 - DNA, 60 bp, Artificial Sequence
  Description of Artificial Sequence: Synthetic probe
ccccgacgcggcgaccttgccgtgttgtccacacgtgttgagacggaacaggaacgatgt

SEQ ID NO: 2012 - DNA, 60 bp, Artificial Sequence
  Description of Artificial Sequence: Synthetic probe
cgcgtgactccccgacgcggcgaccttgccgtgttgtccacacgtgttgagacggaacag

SEQ ID NO: 2013 - DNA, 60 bp, Artificial Sequence
  Description of Artificial Sequence: Synthetic probe
acccaacgcgtgactccccgacgcggcgaccttgccgtgttgtccacacgtgttgagacg

SEQ ID NO: 2014 - DNA, 60 bp, Artificial Sequence
  Description of Artificial Sequence: Synthetic probe
caaccgtgtacaatggaacatgcaagtactcaaacacccaacgcgtgactccccgacgcg

SEQ ID NO: 2015 - DNA, 60 bp, Artificial Sequence
  Description of Artificial Sequence: Synthetic probe
cacacggtgtcctctcaaccgtgtacaatggaacatgcaagtactcaaacacccaacgcg

SEQ ID NO: 2016 - DNA, 60 bp, Artificial Sequence
  Description of Artificial Sequence: Synthetic probe
gacccgattcgcgctgccttttactgcgccacacggtgtcctctcaaccgtgtacaatgg

SEQ ID NO: 2017 - DNA, 60 bp, Artificial Sequence
  Description of Artificial Sequence: Synthetic probe
aaacggtgtgacccgattcgcgctgccttttactgcgccacacggtgtcctctcaaccgt

SEQ ID NO: 2018 - DNA, 60 bp, Artificial Sequence
  Description of Artificial Sequence: Synthetic probe
ctcgaaaaacggtgtgacccgattcgcgctgccttttactgcgccacacggtgtcctctc

SEQ ID NO: 2019 - DNA, 60 bp, Artificial Sequence
  Description of Artificial Sequence: Synthetic probe
cgttcactcgaaaaacggtgtgacccgattcgcgctgccttttactgcgccacacggtgt

SEQ ID NO: 2020 - DNA, 60 bp, Artificial Sequence
  Description of Artificial Sequence: Synthetic probe
cgtcttggctgcaaagtatgccaacaccaagcacgagctcccgtccaccttcaacttcgg

SEQ ID NO: 2021 - DNA, 60 bp, Artificial Sequence
  Description of Artificial Sequence: Synthetic probe
tcgttcttgacaggtttgtgaaactcactgcacccaagaacattcagaccctcgacctca

SEQ ID NO: 2022 - DNA, 60 bp, Artificial Sequence
  Description of Artificial Sequence: Synthetic probe
tcgttcttgacaggtttgtgaaactcactgcacccaagaacattcagacccttgacctca

SEQ ID NO: 2023 - DNA, 60 bp, Artificial Sequence
  Description of Artificial Sequence: Synthetic probe
cccacctccttcaactacggcgctgtgaaggctgacaccatcactgagcttttgatccgc

SEQ ID NO: 2024 - DNA, 60 bp, Artificial Sequence
  Description of Artificial Sequence: Synthetic probe
ccacaagatgcaggcccacgacattcaacttcgggagattgttgtgtgacacaggtgagg

SEQ ID NO: 2025 - DNA, 60 bp, Artificial Sequence
  Description of Artificial Sequence: Synthetic probe
ccacaagatgcaggcccacgacattcaacttcgggagattgttgtgtgacacaggtgatg

SEQ ID NO: 2026 - DNA, 60 bp, Artificial Sequence
  Description of Artificial Sequence: Synthetic probe
ggcgccgtgaaggctgagaacatcactgagcttttgatccgcatgaagcgcgcggagaca

SEQ ID NO: 2027 - DNA, 60 bp, Artificial Sequence
  Description of Artificial Sequence: Synthetic probe
atccaaggcacgaccatccacgagctcctcgtgcgcatgaagcgtgccgagctctactgc

SEQ ID NO: 2028 - DNA, 59 bp, Artificial Sequence
  Description of Artificial Sequence: Synthetic probe
aactacggtggatggggccgcttcgtgcgagccgctcgcctggtgtaccacggctgtta

SEQ ID NO: 2029 - DNA, 60 bp, Artificial Sequence
  Description of Artificial Sequence: Synthetic probe
cactcccggtggggggccgttcgacgctccacggtctcccccgaacaacaaactacggtg

SEQ ID NO: 2030 - DNA, 60 bp, Artificial Sequence
  Description of Artificial Sequence: Synthetic probe
ttgtgcggacgaacgccgcttgcgcacctcgcgtgaccggttaatactctcaccactttc

SEQ ID NO: 2031 - DNA, 60 bp, Artificial Sequence
  Description of Artificial Sequence: Synthetic probe
atttagctggattgtgcggacgaacgccgcttgcgcacctcgcgtgaccggttaatactc

SEQ ID NO: 2032 - DNA, 50 bp, Artificial Sequence
  Description of Artificial Sequence: Synthetic probe
gcactccacacttacgtttgtgtgtgcgcgggaaccgatggaccatcgtt

SEQ ID NO: 2033 - DNA, 60 bp, Artificial Sequence
  Description of Artificial Sequence: Synthetic probe
gcactccacacttacgtttgtgtgtgcgcgggaaccgatggaccatcgttcacccaccta

SEQ ID NO: 2034 - DNA, 60 bp, Artificial Sequence
  Description of Artificial Sequence: Synthetic probe
ggcgctagggtctcatccctagtatgccaacgactgcatcctgcgtcgcactccacactt

SEQ ID NO: 2035 - DNA, 60 bp, Artificial Sequence
  Description of Artificial Sequence: Synthetic probe
gggggcgctagggtctcatccctagtatgccaacgactgcatcctgcgtcgcactccaca

SEQ ID NO: 2036 - DNA, 53 bp, Artificial Sequence
  Description of Artificial Sequence: Synthetic probe
ccactcaggaccgccgtaaacaggagatcattgcacctgaaaagcagatgatg

SEQ ID NO: 2037 - DNA, 60 bp, Artificial Sequence
  Description of Artificial Sequence: Synthetic probe
catgtcattgacctcatgcaaactcaccaacacgggttggtgggtgccctgttgcgtgct

SEQ ID NO: 2038 - DNA, 60 bp, Artificial Sequence
  Description of Artificial Sequence: Synthetic probe
ccacgtactacttctccgacctggagattgtggttcgtcacgacggcaacctgacgtggg

SEQ ID NO: 2039 - DNA, 60 bp, Artificial Sequence
  Description of Artificial Sequence: Synthetic probe
atgaagcgggctgaactctactgccccaggccactgcttgcagtggaagtgtcggcacaa

SEQ ID NO: 2040 - DNA, 60 bp, Artificial Sequence
  Description of Artificial Sequence: Synthetic probe
ctcgtgcgcatgaagcgggctgaactctactgccccaggccactgcttgcagtggaagtg

SEQ ID NO: 2041 - DNA, 60 bp, Artificial Sequence
  Description of Artificial Sequence: Synthetic probe
gtgtaagtactccacgggtactacaggaagacagggcgatttggagtctctcgcggcgag

SEQ ID NO: 2042 - DNA, 60 bp, Artificial Sequence
  Description of Artificial Sequence: Synthetic probe
gggacgtgtaagtactccacgggtactacaggaagacagggcgatttggagtctctcgcg

SEQ ID NO: 2043 - DNA, 60 bp, Artificial Sequence
  Description of Artificial Sequence: Synthetic probe
tacactgcgccgcaccgcgtgttggcaacggtatacaacgggacgtgtaagtactccacg

SEQ ID NO: 2044 - DNA, 60 bp, Artificial Sequence
  Description of Artificial Sequence: Synthetic probe
ttgcactcccttacactgcgccgcaccgcgtgttggcaacggtatacaacgggacgtgta

SEQ ID NO: 2045 - DNA, 60 bp, Artificial Sequence
  Description of Artificial Sequence: Synthetic probe
agcaaccccaccgcctacaacaaggcgccattcacaaggcttgcactcccttacactgcg

SEQ ID NO: 2046 - DNA, 60 bp, Artificial Sequence
  Description of Artificial Sequence: Synthetic probe
gtctaatgcaagcaaccccaccgcctacaacaaggcgccattcacaaggcttgcactccc

SEQ ID NO: 2047 - DNA, 60 bp, Artificial Sequence
  Description of Artificial Sequence: Synthetic probe
ttgtgaatatagacagtttgagtcccacacatgtcatcgacctcatgcagacccatcagc

SEQ ID NO: 2048 - DNA, 60 bp, Artificial Sequence
  Description of Artificial Sequence: Synthetic probe
tcatcatggacagatttgtgaatatagacagtttgagtcccacacatgtcatcgacctca

SEQ ID NO: 2049 - DNA, 60 bp, Artificial Sequence
  Description of Artificial Sequence: Synthetic probe
cggtggtgagacacagatccagagacgccagcacacggacgtcagtttcatcatggacag

SEQ ID NO: 2050 - DNA, 60 bp, Artificial Sequence
  Description of Artificial Sequence: Synthetic probe
ctacggtggtgagacacagatccagagacgccagcacacggacgtcagtttcatcatgga

SEQ ID NO: 2051 - DNA, 60 bp, Artificial Sequence
  Description of Artificial Sequence: Synthetic probe
ctacctctaccggggagtctgcagatcctgtcaccaccgctgttgagtactacggtggtg

SEQ ID NO: 2052 - DNA, 60 bp, Artificial Sequence
  Description of Artificial Sequence: Synthetic probe
actacctctaccggggagtctgcagatcctgtcaccaccgctgttgagtactacggtggt

SEQ ID NO: 2053 - DNA, 60 bp, Artificial Sequence
  Description of Artificial Sequence: Synthetic probe
gtctgcgacgtactacttctcagacctggaggttgcgattgtccacacaggcccaatcac

SEQ ID NO: 2054 - DNA, 60 bp, Artificial Sequence
  Description of Artificial Sequence: Synthetic probe
ccaatacggcctggtgggtgcaatgctgcgtgcagctacgtactacttttctgacttgga

SEQ ID NO: 2055 - DNA, 60 bp, Artificial Sequence
  Description of Artificial Sequence: Synthetic probe
ccaacacggcctggtgggtgcaatgctgcgtgcagctacgtactacttttctgatctgga

SEQ ID NO: 2056 - DNA, 60 bp, Artificial Sequence
  Description of Artificial Sequence: Synthetic probe
accaatacggcctggtgggtgcaatgctgcgtgcagctacgtactacttttctgacttgg

SEQ ID NO: 2057 - DNA, 60 bp, Artificial Sequence
  Description of Artificial Sequence: Synthetic probe
gcagactcaccaacacggcctggtgggtgcaatgctgcgtgcagctacgtactacttttc

SEQ ID NO: 2058 - DNA, 60 bp, Artificial Sequence
  Description of Artificial Sequence: Synthetic probe
tcatgcagactcaccaacacggcctggtgggtgcaatgctgcgtgcagctacgtactact

SEQ ID NO: 2059 - DNA, 60 bp, Artificial Sequence
  Description of Artificial Sequence: Synthetic probe
attgatgatgaggtgttctacccatggacacctgaccccgagaacgtgctcgcgtacgtg

SEQ ID NO: 2060 - DNA, 60 bp, Artificial Sequence
  Description of Artificial Sequence: Synthetic probe
gagggctggtacgctattgatgatgaggtgttctacccatggacacctgaccccgagaac

SEQ ID NO: 2061 - DNA, 60 bp, Artificial Sequence
  Description of Artificial Sequence: Synthetic probe
tgagtcagctgaccccgtgaccgctaccgttgagaactacggtggtgagacacaggtcca

SEQ ID NO: 2062 - DNA, 60 bp, Artificial Sequence
  Description of Artificial Sequence: Synthetic probe
gctgccacgtactacttctccgacttggagattgtggttcgtcacgacggcaacctgaca

SEQ ID NO: 2063 - DNA, 60 bp, Artificial Sequence
  Description of Artificial Sequence: Synthetic probe
atatcacaaggcaccgctcacccggcttgcactgccttacacggcaccacaccgcgtatt

SEQ ID NO: 2064 - DNA, 60 bp, Artificial Sequence
  Description of Artificial Sequence: Synthetic probe
ttgcacctaagaaacaggtactgaactttgacctgctgaagttggcgggagacgtggagt

SEQ ID NO: 2065 - DNA, 60 bp, Artificial Sequence
  Description of Artificial Sequence: Synthetic probe
ggaacaaccttcacggcgcggtgatatggcggcccttgcacagaggctgagcaggcagct

SEQ ID NO: 2066 - DNA, 60 bp, Artificial Sequence
  Description of Artificial Sequence: Synthetic probe
aacaaccttcacggcgcggtgatatggcggcccttgcacagaggctgagcaggcagctgc

SEQ ID NO: 2067 - DNA, 60 bp, Artificial Sequence
  Description of Artificial Sequence: Synthetic probe
aaacaaccttcacggcgcggtgatatggcggcccttgcacagaggctgagcaggcagctg

SEQ ID NO: 2068 - DNA, 60 bp, Artificial Sequence
  Description of Artificial Sequence: Synthetic probe
gaaacaaccttcacggcgcggtgatatggcggcccttgcacagaggctgagcaggcagct

SEQ ID NO: 2069 - DNA, 60 bp, Artificial Sequence
  Description of Artificial Sequence: Synthetic probe
gcgccacaccgcgtgttggcgacagtgtacaacgggaagacgacatatggggaacaacct

SEQ ID NO: 2070 - DNA, 54 bp, Artificial Sequence
  Description of Artificial Sequence: Synthetic probe
aaggggaacgaccgctacaaagtggccctgacaaagcctgctaaacaactgtgc

SEQ ID NO: 2071 - DNA, 60 bp, Artificial Sequence
  Description of Artificial Sequence: Synthetic probe
cgcacattccaactaccttcaactatggcaggctctacacggaggcggatgtcgacgtgt

SEQ ID NO: 2072 - DNA, 60 bp, Artificial Sequence
  Description of Artificial Sequence: Synthetic probe
gccagtgagacgcacattccaactaccttcaactatggcaggctctacacggaggcggat

SEQ ID NO: 2073 - DNA, 60 bp, Artificial Sequence
  Description of Artificial Sequence: Synthetic probe
ttcgcggggaccttgcaacactcgctgagcgcatcgccagtgagacgcacattccaacta

SEQ ID NO: 2074 - DNA, 60 bp, Artificial Sequence
  Description of Artificial Sequence: Synthetic probe
caccgcgaacgcacattcgcggggaccttgcaacactcgctgagcgcatcgccagtgaga

SEQ ID NO: 2075 - DNA, 60 bp, Artificial Sequence
  Description of Artificial Sequence: Synthetic probe
caacgggaccacccgctttgctttgccttacactgccccacacaggtgtcttgccaccgc

SEQ ID NO: 2076 - DNA, 60 bp, Artificial Sequence
  Description of Artificial Sequence: Synthetic probe
atgtgttggcgtgaacaagtgggttcggtggacgccgaatggcgcgccggagctcagtga

SEQ ID NO: 2077 - DNA, 60 bp, Artificial Sequence
  Description of Artificial Sequence: Synthetic probe
aggtggcatgtgttggcgtgaacaagtgggttcggtggacgccgaatggcgcgccggagc

SEQ ID NO: 2078 - DNA, 60 bp, Artificial Sequence
  Description of Artificial Sequence: Synthetic probe
tacttgaccggttcaccctggtcgggaggactcagaacaacagactgacactggacctgc

SEQ ID NO: 2079 - DNA, 60 bp, Artificial Sequence
  Description of Artificial Sequence: Synthetic probe
acgtctcattcatacttgaccggttcaccctggtcgggaggactcagaacaacagactga

SEQ ID NO: 2080 - DNA, 60 bp, Artificial Sequence
  Description of Artificial Sequence: Synthetic probe
gtggtggacgccgcaccgcttacaggcaccacactgacgtctcattcatacttgaccggt

SEQ ID NO: 2081 - DNA, 60 bp, Artificial Sequence
  Description of Artificial Sequence: Synthetic probe
cgctacacagcacggtggtggacgccgcaccgcttacaggcaccacactgacgtctcatt

SEQ ID NO: 2082 - DNA, 60 bp, Artificial Sequence
  Description of Artificial Sequence: Synthetic probe
aatcctgcgcgctgccacgtactacttctcggacttggaggtggcgtgtgttggcgtgaa

SEQ ID NO: 2083 - DNA, 60 bp, Artificial Sequence
  Description of Artificial Sequence: Synthetic probe
ccgaggtcgacgtgtacgtcaggatgaaacgtgcggaactttactgtccgcggcctcttc

SEQ ID NO: 2084 - DNA, 60 bp, Artificial Sequence
  Description of Artificial Sequence: Synthetic probe
agccgaggtcgacgtgtacgtcaggatgaaacgtgcggaactttactgtccgcggcctct

SEQ ID NO: 2085 - DNA, 60 bp, Artificial Sequence
  Description of Artificial Sequence: Synthetic probe
aagccgaggtcgacgtgtacgtcaggatgaaacgtgcggaactttactgtccgcggcctc

SEQ ID NO: 2086 - DNA, 60 bp, Artificial Sequence
  Description of Artificial Sequence: Synthetic probe
cagaatctacacacaagccgaggtcgacgtgtacgtcaggatgaaacgtgcggaacttta

SEQ ID NO: 2087 - DNA, 60 bp, Artificial Sequence
  Description of Artificial Sequence: Synthetic probe
tccaaccacttttaactatggcagaatctacacacaagccgaggtcgacgtgtacgtcag

SEQ ID NO: 2088 - DNA, 60 bp, Artificial Sequence
  Description of Artificial Sequence: Synthetic probe
cagcgagacacacattccaaccacttttaactatggcagaatctacacacaagccgaggt

SEQ ID NO: 2089 - DNA, 60 bp, Artificial Sequence
  Description of Artificial Sequence: Synthetic probe
ccagcgagacacacattccaaccacttttaactatggcagaatctacacacaagccgagg

SEQ ID NO: 2090 - DNA, 60 bp, Artificial Sequence
  Description of Artificial Sequence: Synthetic probe
cgcgcacgaacatccgcggggacctcgcaagtcttgcagagaggatcgccagcgagacac

SEQ ID NO: 2091 - DNA, 60 bp, Artificial Sequence
  Description of Artificial Sequence: Synthetic probe
ccgcgcacgaacatccgcggggatctcgcaagtcttgcagagaggatcgccagcgagaca

SEQ ID NO: 2092 - DNA, 60 bp, Artificial Sequence
  Description of Artificial Sequence: Synthetic probe
tggcaacactgtacaacggtgattgtaagtacaaacccgctggcacaaccccgcgcacga

SEQ ID NO: 2093 - DNA, 57 bp, Artificial Sequence
  Description of Artificial Sequence: Synthetic probe
gtatcgtcgcaagacagacacaaacagaagatcaatgcaccagcaaaacagctcttg

SEQ ID NO: 2094 - DNA, 60 bp, Artificial Sequence
  Description of Artificial Sequence: Synthetic probe
ctgcagacggtagaagtatcgtcgcaagacagacacaaacagaagatcaatgcaccagca

SEQ ID NO: 2095 - DNA, 60 bp, Artificial Sequence
  Description of Artificial Sequence: Synthetic probe
cccagaagactgcagacggtagaagtatcgtcgcaagacagacacaaacagaagatcaat

SEQ ID NO: 2096 - DNA, 60 bp, Artificial Sequence
  Description of Artificial Sequence: Synthetic probe
agtccatgcacgagcttctcgtaagcatgaagcgtgctgaactctactgccccagaagac

SEQ ID NO: 2097 - DNA, 60 bp, Artificial Sequence
  Description of Artificial Sequence: Synthetic probe
caagtccatgcacgagcttctcgtaagcatgaagcgtgccgaactctactgccccagaag

SEQ ID NO: 2098 - DNA, 55 bp, Artificial Sequence
  Description of Artificial Sequence: Synthetic probe
aaaacaagtctatgcacgagcttctcgtaagcatgaagcgtgctgaactctactg

SEQ ID NO: 2099 - DNA, 60 bp, Artificial Sequence
  Description of Artificial Sequence: Synthetic probe
gctaatggcaccacccgttttgcactgccctacaccgcaccgcacagatgcttggcaaca

SEQ ID NO: 2100 - DNA, 60 bp, Artificial Sequence
  Description of Artificial Sequence: Synthetic probe
gctaacggcaccacccgttttgcactgccctacaccgcaccacacagatgcttggcaaca

SEQ ID NO: 2101 - DNA, 60 bp, Artificial Sequence
  Description of Artificial Sequence: Synthetic probe
gcccccggcccgtgctgacacactacgaccaccaaggcaaagatcgctacaaggtggccc

SEQ ID NO: 2102 - DNA, 60 bp, Artificial Sequence
  Description of Artificial Sequence: Synthetic probe
gagctctactgcccccggcccgtgctgacacactacgaccaccaaaacaaagatcgctac

SEQ ID NO: 2103 - DNA, 60 bp, Artificial Sequence
  Description of Artificial Sequence: Synthetic probe
agaggcggaagtgacgtcgtacgtgaggatgaaacgggcggagctctactgcccccggcc

SEQ ID NO: 2104 - DNA, 60 bp, Artificial Sequence
  Description of Artificial Sequence: Synthetic probe
attcccaccagcttcaactacggcaggatctacacagaggcggaagtgacgtcgtacgtg

SEQ ID NO: 2105 - DNA, 60 bp, Artificial Sequence
  Description of Artificial Sequence: Synthetic probe
gcagaggagacacacattcccaccagcttcaactacggcaggatctacacagaggcggaa

SEQ ID NO: 2106 - DNA, 60 bp, Artificial Sequence
  Description of Artificial Sequence: Synthetic probe
cgcagaggagacacacattcccaccagcttcaactacggcaggatctacacagaggcgga

SEQ ID NO: 2107 - DNA, 60 bp, Artificial Sequence
  Description of Artificial Sequence: Synthetic probe
acagcgtatcgcagaggagacacacattcccaccagcttcaactacggcaggatctacac

SEQ ID NO: 2108 - DNA, 60 bp, Artificial Sequence
  Description of Artificial Sequence: Synthetic probe
acgaacatccgcggagatctcgcgacgctcgcacagcgtatcgcagaggagacacacatt

SEQ ID NO: 2109 - DNA, 60 bp, Artificial Sequence
  Description of Artificial Sequence: Synthetic probe
cggacgaacatccgcggagatctcgcgacgctcgcacagcgtatcgcagaggagacacac

SEQ ID NO: 2110 - DNA, 60 bp, Artificial Sequence
  Description of Artificial Sequence: Synthetic probe
ccccgcggacgaacatccgcggagatctcgcgacgctcgcacagcgtatcgcagaggaga

SEQ ID NO: 2111 - DNA, 60 bp, Artificial Sequence
  Description of Artificial Sequence: Synthetic probe
caaggtcaagccccgcggacgaacatccgcggagatctcgcgacgctcgcacagcgtatc

SEQ ID NO: 2112 - DNA, 60 bp, Artificial Sequence
  Description of Artificial Sequence: Synthetic probe
tacaacggtgactgcaagtacaacccacaaggtcaagccccgcggacgaacatccgcgga

SEQ ID NO: 2113 - DNA, 60 bp, Artificial Sequence
  Description of Artificial Sequence: Synthetic probe
cgcacagagtgcttgctactacctacaacggtgattgcaagtacaaaccacaaggtcaag

SEQ ID NO: 2114 - DNA, 60 bp, Artificial Sequence
  Description of Artificial Sequence: Synthetic probe
cccggtttgcaataccgtacacagccccgcacagagtgcttgctactacctacaacggtg

SEQ ID NO: 2115 - DNA, 60 bp, Artificial Sequence
  Description of Artificial Sequence: Synthetic probe
cacaacggaaccacccggtttgcaataccgtacacagccccgcacagagtgcttgctact

SEQ ID NO: 2116 - DNA, 60 bp, Artificial Sequence
  Description of Artificial Sequence: Synthetic probe
ctcacacaaacgaaccacccggtttgcaataccgtacacagccccgcacagagtgcttgc

SEQ ID NO: 2117 - DNA, 60 bp, Artificial Sequence
  Description of Artificial Sequence: Synthetic probe
cgttttctcacacaaacgaaccacccggtttgcaataccgtacacagccccgcacagagt

SEQ ID NO: 2118 - DNA, 60 bp, Artificial Sequence
  Description of Artificial Sequence: Synthetic probe
cctgagttgagtgaggtcggcgacaacccagtcgttttctcacacaacggaaccacccgg

SEQ ID NO: 2119 - DNA, 60 bp, Artificial Sequence
  Description of Artificial Sequence: Synthetic probe
gggtcgcctgagttgagtgaggtcggcgacaacccagtcgttttctcacacaaacgaacc

SEQ ID NO: 2120 - DNA, 60 bp, Artificial Sequence
  Description of Artificial Sequence: Synthetic probe
atgggtcacctgagttgagtgaggtcggcgacaacccagtcgttttctcacacaacggaa

SEQ ID NO: 2121 - DNA, 60 bp, Artificial Sequence
  Description of Artificial Sequence: Synthetic probe
aggtaacggcacaggacagacacaagcagaggatcattgcgcctgcaaaacagcttctga

SEQ ID NO: 2122 - DNA, 60 bp, Artificial Sequence
  Description of Artificial Sequence: Synthetic probe
gcggcaagaacgctgcccacctccttcaactacggtgccatcaaggccacccgggtgacc

SEQ ID NO: 2123 - DNA, 60 bp, Artificial Sequence
  Description of Artificial Sequence: Synthetic probe
cgtgactccacgccgaggcgacttggctgccttgagtcaacgcgttgagaatgaaaccac

SEQ ID NO: 2124 - DNA, 60 bp, Artificial Sequence
  Description of Artificial Sequence: Synthetic probe
acccagcacgtgactccacgccgaggcgacttggctgccttgagtcaacgcgttgagaat

SEQ ID NO: 2125 - DNA, 60 bp, Artificial Sequence
  Description of Artificial Sequence: Synthetic probe
ggcaaccgtctacaacggttactgcaggtacaagaaaacccagcacgtgactccacgccg

SEQ ID NO: 2126 - DNA, 60 bp, Artificial Sequence
  Description of Artificial Sequence: Synthetic probe
cacacggtgttctggcaaccgtctacaacggttactgcaggtacaagaaaacccagcacg

SEQ ID NO: 2127 - DNA, 60 bp, Artificial Sequence
  Description of Artificial Sequence: Synthetic probe
tcattcaaagggttcggtcgcccgctttgcactgccctacaccgcgccacacggtgttct

SEQ ID NO: 2128 - DNA, 60 bp, Artificial Sequence
  Description of Artificial Sequence: Synthetic probe
cgttcattcaaagggttcggtcgcccgctttgcactgccctacaccgcgccacacggtgt

SEQ ID NO: 2129 - DNA, 60 bp, Artificial Sequence
  Description of Artificial Sequence: Synthetic probe
tgcccgctcaccgatagagtggaggacaacccagtcgttcattcaaagggttcggtcgcc

SEQ ID NO: 2130 - DNA, 60 bp, Artificial Sequence
  Description of Artificial Sequence: Synthetic probe
tgggtgcctaacgggtgcccgctcaccgatagagtggaggacaacccagtcgttcattca

SEQ ID NO: 2131 - DNA, 60 bp, Artificial Sequence
  Description of Artificial Sequence: Synthetic probe
cactgtttctttcacgagtacgaggaaagatggaattcacactctacaacggtgagaaga

SEQ ID NO: 2132 - DNA, 60 bp, Artificial Sequence
  Description of Artificial Sequence: Synthetic probe
cgcttcgccctgcccttcacagccccacaccgtgttctggcaacagtttacaacggtgat

SEQ ID NO: 2133 - DNA, 60 bp, Artificial Sequence
  Description of Artificial Sequence: Synthetic probe
ctgccacgtactacttcgcagaccttgaggtggcgtgcgtgggcactaacaagtgggttg

SEQ ID NO: 2134 - DNA, 60 bp, Artificial Sequence
  Description of Artificial Sequence: Synthetic probe
gacgtggcgttccttctggacaggttcacactggtgggaaaaacacgggacaacaaaatg

SEQ ID NO: 2135 - DNA, 60 bp, Artificial Sequence
  Description of Artificial Sequence: Synthetic probe
acacgccgcgttcacacggacgtggcgttccttctggacaggttcacactggtgggaaaa

SEQ ID NO: 2136 - DNA, 60 bp, Artificial Sequence
  Description of Artificial Sequence: Synthetic probe
ggtgcagttaaagcagagacaattacagagctgcttgtgcgcatgaagcgtgctgaactc

SEQ ID NO: 2137 - DNA, 60 bp, Artificial Sequence
  Description of Artificial Sequence: Synthetic probe
ggtgcagttaaagcagagacaattacagagctgcttgtgcgcatgaaacgtgctgaactc

SEQ ID NO: 2138 - DNA, 60 bp, Artificial Sequence
  Description of Artificial Sequence: Synthetic probe
cgttcaactttggtgcagttaaagcagagacaattacagagctgcttgtgcgcatgaagc

SEQ ID NO: 2139 - DNA, 60 bp, Artificial Sequence
  Description of Artificial Sequence: Synthetic probe
cgttcaactttggtgcagttaaagcagagacaattacagagctgcttgtgcgcatgaaac

SEQ ID NO: 2140 - DNA, 60 bp, Artificial Sequence
  Description of Artificial Sequence: Synthetic probe
atgcaggtacacaaggacagtattgtgggcgcactcctccgcgcagccacatattacttc

SEQ ID NO: 2141 - DNA, 60 bp, Artificial Sequence
  Description of Artificial Sequence: Synthetic probe
gttatgcaggtacacaaggacagtattgtgggcgcactcctccgcgcagccacatattac

SEQ ID NO: 2142 - DNA, 60 bp, Artificial Sequence
  Description of Artificial Sequence: Synthetic probe
gttatgcaggtacacaaggacagtattgtgggcgcactcctacgcgcagccacatactac

SEQ ID NO: 2143 - DNA, 60 bp, Artificial Sequence
  Description of Artificial Sequence: Synthetic probe
agcaaaaccgccaccgccatccgtggagaccgcgcggcacttgctgcaaagtacgctagc

SEQ ID NO: 2144 - DNA, 60 bp, Artificial Sequence
  Description of Artificial Sequence: Synthetic probe
ggcgagtgcacctacagcaaaaccgccaccgccatccgtggagaccgcgcggcacttgcg

SEQ ID NO: 2145 - DNA, 60 bp, Artificial Sequence
  Description of Artificial Sequence: Synthetic probe
agcctaacggggcaccgcggaccacccaacttggtgataatcccatggttttcgccaagg

SEQ ID NO: 2146 - DNA, 60 bp, Artificial Sequence
  Description of Artificial Sequence: Synthetic probe
tggcagcccaacggggcaccgcggaccacccaacttggtgataatcccatggttttcgcc

SEQ ID NO: 2147 - DNA, 60 bp, Artificial Sequence
  Description of Artificial Sequence: Synthetic probe
acgtcaggatgaagcgcgcggagctttactgcccgcgacctcttctcacacactacgatc

SEQ ID NO: 2148 - DNA, 60 bp, Artificial Sequence
  Description of Artificial Sequence: Synthetic probe
ggagcaggtcagtcctctcccgccacagggtcacaaaaccaatctggcaacactggcagt

SEQ ID NO: 2149 - DNA, 60 bp, Artificial Sequence
  Description of Artificial Sequence: Synthetic probe
gccgctgctggcaatggaggtgtcggcggaaggcagacacaaacagaagatcattgcacc

SEQ ID NO: 2150 - DNA, 60 bp, Artificial Sequence
  Description of Artificial Sequence: Synthetic probe
aggccgctgctggcaatggaggtgtcggcggaaggcagacacaaacagaagatcattgca

SEQ ID NO: 2151 - DNA, 60 bp, Artificial Sequence
  Description of Artificial Sequence: Synthetic probe
cccaggccgctgctggcaatggaggtgtcggcggaaggcagacacaaacagaagatcatt

SEQ ID NO: 2152 - DNA, 60 bp, Artificial Sequence
  Description of Artificial Sequence: Synthetic probe
gccgagctctactgccccaggccgctgctggcaatggaggtgtcggcggaaggcagacac

SEQ ID NO: 2153 - DNA, 60 bp, Artificial Sequence
  Description of Artificial Sequence: Synthetic probe
gaggtgtcatcgcaagacagacacaaacagaagatcattgcacctgcaaaacaactcctg

SEQ ID NO: 2154 - DNA, 60 bp, Artificial Sequence
  Description of Artificial Sequence: Synthetic probe
ctcctacccgcctactctcacaacggtcgggataggtttgacgcgccaattggcgtggaa

SEQ ID NO: 2155 - DNA, 60 bp, Artificial Sequence
  Description of Artificial Sequence: Synthetic probe
tactgtccacggcccctcctacccgcctactctcacaacggtcgggataggtttgacgcg

SEQ ID NO: 2156 - DNA, 60 bp, Artificial Sequence
  Description of Artificial Sequence: Synthetic probe
aaaccagtcgacgtttactaccggatgaagcgcgctgagctctactgtccacggcccctc

SEQ ID NO: 2157 - DNA, 60 bp, Artificial Sequence
  Description of Artificial Sequence: Synthetic probe
catcaggggagacagagctgtcctggccgccaaatacaaggacgtggcccacagtttacc

SEQ ID NO: 2158 - DNA, 60 bp, Artificial Sequence
  Description of Artificial Sequence: Synthetic probe
caagacatccaaccccatcaggggagacagagctgtcctggccgccaaatacaaggacgt

SEQ ID NO: 2159 - DNA, 60 bp, Artificial Sequence
  Description of Artificial Sequence: Synthetic probe
tctgtgaccttgaggttgcatgtgttggtgaacacaagcgggtgttctggcagcccaatg

SEQ ID NO: 2160 - DNA, 60 bp, Artificial Sequence
  Description of Artificial Sequence: Synthetic probe
cggccacttactacttctgtgaccttgaggttgcatgtgttggtgaacacaagcgggtgt

SEQ ID NO: 2161 - DNA, 60 bp, Artificial Sequence
  Description of Artificial Sequence: Synthetic probe
caaagagaaaagcactggtcggcgcgattcttcgctcggccacttactacttctgtgacc

SEQ ID NO: 2162 - DNA, 60 bp, Artificial Sequence
  Description of Artificial Sequence: Synthetic probe
cgatctcatggacacaaagagaaaagcactggtcggcgcgattcttcgctcggccactta

SEQ ID NO: 2163 - DNA, 60 bp, Artificial Sequence
  Description of Artificial Sequence: Synthetic probe
gaccgcagcacgcacgtgcacaccaacaagacggcattcgctgtcgatctcatggacaca

SEQ ID NO: 2164 - DNA, 60 bp, Artificial Sequence
  Description of Artificial Sequence: Synthetic probe
ctgttggaccgcagcacgcacgtgcacaccaacaagacggcattcgctgtcgatctcatg

SEQ ID NO: 2165 - DNA, 60 bp, Artificial Sequence
  Description of Artificial Sequence: Synthetic probe
aggtacggcacggcgcatccacacggacgttgcgttcctgttggaccgcagcacgcacgt

SEQ ID NO: 2166 - DNA, 60 bp, Artificial Sequence
  Description of Artificial Sequence: Synthetic probe
acggtgggaccgaaggtacggcacggcgcatccacacggacgttgcgttcctgttggacc

SEQ ID NO: 2167 - DNA, 60 bp, Artificial Sequence
  Description of Artificial Sequence: Synthetic probe
gacggaacggacatgtgtttgggtgacttccacgttggcattttcgggaaaggacaagag

SEQ ID NO: 2168 - DNA, 60 bp, Artificial Sequence
  Description of Artificial Sequence: Synthetic probe
ccagcgaggtgtgtatggtggacggaacggacatgtgtttgggtgacttccacgctggca

SEQ ID NO: 2169 - DNA, 60 bp, Artificial Sequence
  Description of Artificial Sequence: Synthetic probe
tgcctcgcgccccagcgaggtgtgtatggtggacggaacggacatgtgtttgggtgactt

SEQ ID NO: 2170 - DNA, 60 bp, Artificial Sequence
  Description of Artificial Sequence: Synthetic probe
atcggcactgcctcgcgccccagcgaggtgtgtatggtggacggaacggacatgtgtttg

SEQ ID NO: 2171 - DNA, 60 bp, Artificial Sequence
  Description of Artificial Sequence: Synthetic probe
ttgtccaaggccacttctcccggcctatcaacacggtaaccgggacaggttcgacgcgcc

SEQ ID NO: 2172 - DNA, 60 bp, Artificial Sequence
  Description of Artificial Sequence: Synthetic probe
cgcacaaaagtgtttactggcagccgaatggcgcaccacgcacaacaacgctgggagaca

SEQ ID NO: 2173 - DNA, 59 bp, Artificial Sequence
  Description of Artificial Sequence: Synthetic probe
ttctcctcgatcgcagcacacacgtgcatacgaacaaccttgctgatgtgaagggaaag

SEQ ID NO: 2174 - DNA, 60 bp, Artificial Sequence
  Description of Artificial Sequence: Synthetic probe
cccttggacgccggatccgtccgacgttctggtgtttgttccgtatgatcaagaaccact

SEQ ID NO: 2175 - DNA, 60 bp, Artificial Sequence
  Description of Artificial Sequence: Synthetic probe
acttctacccttggacgccggatccgtccgacgttctggtgtttgttccgtacgatcaag

SEQ ID NO: 2176 - DNA, 60 bp, Artificial Sequence
  Description of Artificial Sequence: Synthetic probe
acttttacccctggacgccggatccgtccgacgttctggtgtttgtcccgtacgatcaag

SEQ ID NO: 2177 - DNA, 60 bp, Artificial Sequence
  Description of Artificial Sequence: Synthetic probe
acttctacccttggacgccggatccgtccgacgttctggtgtttgttccgtatgatcaag

SEQ ID NO: 2178 - DNA, 60 bp, Artificial Sequence
  Description of Artificial Sequence: Synthetic probe
actggagaccagcggtgccagcactgttggtttcagagagagaactctcccgggacacaa

SEQ ID NO: 2179 - DNA, 60 bp, Artificial Sequence
  Description of Artificial Sequence: Synthetic probe
tctactgccccagaccacttctcccggcatacgatcactcagaccgggacaggttcgacg

SEQ ID NO: 2180 - DNA, 60 bp, Artificial Sequence
  Description of Artificial Sequence: Synthetic probe
ggagctctactgccccagaccacttctcccggcatacgatcactcagaccgggacaggtt

SEQ ID NO: 2181 - DNA, 56 bp, Artificial Sequence
  Description of Artificial Sequence: Synthetic probe
aatacgccagcgtgaaacactcgctcccttccacgtttaactttggtcacgtcact

SEQ ID NO: 2182 - DNA, 60 bp, Artificial Sequence
  Description of Artificial Sequence: Synthetic probe
caactaagtacaacggcgagtgcaggtacacacaggaagcaagggccatccgtggtgacc

SEQ ID NO: 2183 - DNA, 60 bp, Artificial Sequence
  Description of Artificial Sequence: Synthetic probe
cccaccggttgcttgcaactaagtacaacggcgagtgcaggtacacacaggaagcaaggg

SEQ ID NO: 2184 - DNA, 60 bp, Artificial Sequence
  Description of Artificial Sequence: Synthetic probe
ctctcacaacaatgtgacacggttcgccattccctacactgcgccccaccggttgcttgc

SEQ ID NO: 2185 - DNA, 60 bp, Artificial Sequence
  Description of Artificial Sequence: Synthetic probe
ggttttctctcacaacaatgtgacacggttcgccattccctacactgcgccccaccggtt

SEQ ID NO: 2186 - DNA, 60 bp, Artificial Sequence
  Description of Artificial Sequence: Synthetic probe
ccaacggtgcgccccggacggcacagttaggggacaatccgatggttttctctcacaaca

SEQ ID NO: 2187 - DNA, 60 bp, Artificial Sequence
  Description of Artificial Sequence: Synthetic probe
tggcaacccaacggtgcgccccggacggcacagttaggggacaatccgatggttttctct

SEQ ID NO: 2188 - DNA, 60 bp, Artificial Sequence
  Description of Artificial Sequence: Synthetic probe
tacaaacccactggcaccgcgccccgcgaaaacatccgcggcgaccttgcaaccctggct

SEQ ID NO: 2189 - DNA, 60 bp, Artificial Sequence
  Description of Artificial Sequence: Synthetic probe
ggtcgacgtgtatgttaggatgaaacgtgcggagctctactgcccacgtcctctcctgac

SEQ ID NO: 2190 - DNA, 60 bp, Artificial Sequence
  Description of Artificial Sequence: Synthetic probe
ggtcgacgtgtatgttaggatgaaacgtgcggagctttactgcccacgccctctcctgac

SEQ ID NO: 2191 - DNA, 60 bp, Artificial Sequence
  Description of Artificial Sequence: Synthetic probe
gaggtcgacgtgtatgttaggatgaaacgtgcggagctttactgcccacgccctctcctg

SEQ ID NO: 2192 - DNA, 60 bp, Artificial Sequence
  Description of Artificial Sequence: Synthetic probe
ctgaggtcgacgtgtatgttaggatgaaacgtgcggagctttactgcccacgccctctcc

SEQ ID NO: 2193 - DNA, 60 bp, Artificial Sequence
  Description of Artificial Sequence: Synthetic probe
ctgaggtcgacgtgtatgttaggatgaaacgtgcggagctctactgcccacgtcctctcc

SEQ ID NO: 2194 - DNA, 60 bp, Artificial Sequence
  Description of Artificial Sequence: Synthetic probe
ggatttacacagaggctgaggtcgacgtgtatgttaggatgaaacgtgcggagctttact

SEQ ID NO: 2195 - DNA, 60 bp, Artificial Sequence
  Description of Artificial Sequence: Synthetic probe
gtgagacacacattccaaccactttcaactacggcaggatttacacagaggctgaggtcg

SEQ ID NO: 2196 - DNA, 60 bp, Artificial Sequence
  Description of Artificial Sequence: Synthetic probe
ccgcggagacctcgcgacccttgtgcagaggattgcaagtgagacacacattccaaccac

SEQ ID NO: 2197 - DNA, 60 bp, Artificial Sequence
  Description of Artificial Sequence: Synthetic probe
aggatgaaacgcgcggagctctactgtccgcgtcctgtcctgacgcactacgatcacggt

SEQ ID NO: 2198 - DNA, 60 bp, Artificial Sequence
  Description of Artificial Sequence: Synthetic probe
cgtgaggatgaaacgcgcggagctctactgtccgcgtcctgtcctgacgcactacgatca

SEQ ID NO: 2199 - DNA, 60 bp, Artificial Sequence
  Description of Artificial Sequence: Synthetic probe
tgtgaggatgaaacgcgcggagctctactgtccgcgtcctgtcctgacacactacgacca

SEQ ID NO: 2200 - DNA, 60 bp, Artificial Sequence
  Description of Artificial Sequence: Synthetic probe
tgggtcggatggactcccaacggagctccggagttgaacgaagtgtgcgacaatccagtc

SEQ ID NO: 2201 - DNA, 60 bp, Artificial Sequence
  Description of Artificial Sequence: Synthetic probe
aagtgggtcggatggactcccaacggagctccggagttggacgaagtaggcgacaatcca

SEQ ID NO: 2202 - DNA, 60 bp, Artificial Sequence
  Description of Artificial Sequence: Synthetic probe
gtgggcacgaacaagtgggtcggatggactcccaacggagctccggagttggacgaagta

SEQ ID NO: 2203 - DNA, 60 bp, Artificial Sequence
  Description of Artificial Sequence: Synthetic probe
acgggcacgaacaagtgggtcggatggactcccaacggagctccggagttgaacgaagtg

SEQ ID NO: 2204 - DNA, 60 bp, Artificial Sequence
  Description of Artificial Sequence: Synthetic probe
cgatcaagaaccgctcaatggagaatggaaagcaagggttcagaagcgactcaagggagc

SEQ ID NO: 2205 - DNA, 60 bp, Artificial Sequence
  Description of Artificial Sequence: Synthetic probe
tacgatcaagaaccgctcaatggagaatggaaagcaagggttcagaagcgactcaaggga

SEQ ID NO: 2206 - DNA, 60 bp, Artificial Sequence
  Description of Artificial Sequence: Synthetic probe
tgctcgtgcgtctcaaaatcgatgcttgatcagatgaaagcccacatcgacccggcacct

SEQ ID NO: 2207 - DNA, 60 bp, Artificial Sequence
  Description of Artificial Sequence: Synthetic probe
gtctgtatggacggtgataccatgcctggtcttttcgcgtaccgcgctgggaccaaggta

SEQ ID NO: 2208 - DNA, 60 bp, Artificial Sequence
  Description of Artificial Sequence: Synthetic probe
catggttctgaaccgtggacaacgcgttagagacatcacagcccacttccgcgacaccgt

SEQ ID NO: 2209 - DNA, 60 bp, Artificial Sequence
  Description of Artificial Sequence: Synthetic probe
caccgaccgacctgcaaaagatggtcatggccaacgtcaagcccgtcgagctcattctcg

SEQ ID NO: 2210 - DNA, 60 bp, Artificial Sequence
  Description of Artificial Sequence: Synthetic probe
agtatggcgagagccccgtgaccaatgtgagaggtgacctgcaagtgttggcccagaagg

SEQ ID NO: 2211 - DNA, 60 bp, Artificial Sequence
  Description of Artificial Sequence: Synthetic probe
gaacacggtaactgctggctcaactcactgttgcagctctttcgatacgtcgatgagccg

SEQ ID NO: 2212 - DNA, 60 bp, Artificial Sequence
  Description of Artificial Sequence: Synthetic probe
tcgagaaaggccagcacgaagcagcaattgaattctttgaggggatggtgcacgactcca

SEQ ID NO: 2213 - DNA, 60 bp, Artificial Sequence
  Description of Artificial Sequence: Synthetic probe
tcgagaaggggcagcacgaagcagcaattgaattctttgaggggatggtgcacgactcca

SEQ ID NO: 2214 - DNA, 60 bp, Artificial Sequence
  Description of Artificial Sequence: Synthetic probe
gcggaactctactgccccagaccactgttcgcagtcgaggtgtcgtctcaagacagacac

SEQ ID NO: 2215 - DNA, 60 bp, Artificial Sequence
  Description of Artificial Sequence: Synthetic probe
tgcgcatgaagcgggcggaactctactgccccagaccactgttcgcagtcgaggtgtcgt

SEQ ID NO: 2216 - DNA, 60 bp, Artificial Sequence
  Description of Artificial Sequence: Synthetic probe
ttaactacggtgcaatccaaggcacagccatccacgagctcctcgtgcgcatgaagcggg

SEQ ID NO: 2217 - DNA, 60 bp, Artificial Sequence
  Description of Artificial Sequence: Synthetic probe
ggggcgacctaggacctctctcttcgagggtcgctgctcaacttcctgcttcctttaact

SEQ ID NO: 2218 - DNA, 60 bp, Artificial Sequence
  Description of Artificial Sequence: Synthetic probe
aggggcgacctaggacctctctcttcgagggtcgctgctcaacttcctgcttcctttaac

SEQ ID NO: 2219 - DNA, 57 bp, Artificial Sequence
  Description of Artificial Sequence: Synthetic probe
cacccgaacgaggccagacacaaacagaagattgtggcacctgtgaagcagctcctg

SEQ ID NO: 2220 - DNA, 60 bp, Artificial Sequence
  Description of Artificial Sequence: Synthetic probe
ggaaaagaccctagtaggtgccttcctgagggcctccacctactacttctgtgacctgga

SEQ ID NO: 2221 - DNA, 59 bp, Artificial Sequence
  Description of Artificial Sequence: Synthetic probe
gcacggtggccgtgtagttgagaagagacggatgcacaccgatgttgcgttcgtgcttg

SEQ ID NO: 2222 - DNA, 60 bp, Artificial Sequence
  Description of Artificial Sequence: Synthetic probe
gaccgatccctccacgcacggtggccgtgtagttgagaagagacggatgcacacagatgt

SEQ ID NO: 2223 - DNA, 60 bp, Artificial Sequence
  Description of Artificial Sequence: Synthetic probe
tacgaccgatccctccacgcacggtggccgtgtagttgagaagagacggatgcacacaga

SEQ ID NO: 2224 - DNA, 60 bp, Artificial Sequence
  Description of Artificial Sequence: Synthetic probe
agcggacgttgttacgaccgatccctccacgcacggtggccgtgtagttgagaagagacg

SEQ ID NO: 2225 - DNA, 60 bp, Artificial Sequence
  Description of Artificial Sequence: Synthetic probe
ggcggtggaggtgtcgtcgcaagacagatacaagcagaaaatcattgcccctgcaaagca

SEQ ID NO: 2226 - DNA, 60 bp, Artificial Sequence
  Description of Artificial Sequence: Synthetic probe
tgctggcggtggaggtgtcgtcgcaagacagatacaagcagaaaatcattgcccctgcaa

SEQ ID NO: 2227 - DNA, 60 bp, Artificial Sequence
  Description of Artificial Sequence: Synthetic probe
ttcaactacggcgcagttcgagccacggagatccgagaactcctcgtgcgcatgaagcgt

SEQ ID NO: 2228 - DNA, 60 bp, Artificial Sequence
  Description of Artificial Sequence: Synthetic probe
cagctccctgcctccttcaactacggcgcagttcgagccacggagatccgagaactcctc

SEQ ID NO: 2229 - DNA, 60 bp, Artificial Sequence
  Description of Artificial Sequence: Synthetic probe
ccgctttgcactgccctacaccgcgccacacaggtgtctggcaacatcatacaacggtga

SEQ ID NO: 2230 - DNA, 60 bp, Artificial Sequence
  Description of Artificial Sequence: Synthetic probe
taatggcaccacccgctttgcactgccctacaccgcgccacacaggtgtctggcaacatc

SEQ ID NO: 2231 - DNA, 60 bp, Artificial Sequence
  Description of Artificial Sequence: Synthetic probe
tacgatcaagaaccactcaacggagaatggaaagcaaaggttcaaaaacgactcaagggg

SEQ ID NO: 2232 - DNA, 60 bp, Artificial Sequence
  Description of Artificial Sequence: Synthetic probe
caactacggtgcaattaaggccgagaccatccacgagcttctcgtgcgcatgaaacgggc

SEQ ID NO: 2233 - DNA, 60 bp, Artificial Sequence
  Description of Artificial Sequence: Synthetic probe
gccatccgtggagaccgcgcggcacttgcggcaaagtacgccagtaacacgcacactttg

SEQ ID NO: 2234 - DNA, 60 bp, Artificial Sequence
  Description of Artificial Sequence: Synthetic probe
ctcatgcaggtcccttcacaaacgctggttggagcactgcttcggtctgcgacgtactac

SEQ ID NO: 2235 - DNA, 60 bp, Artificial Sequence
  Description of Artificial Sequence: Synthetic probe
gagcacggtggcaaagaccgctacaaggtagccctcaccaaacctgccaaacaattgtgc

SEQ ID NO: 2236 - DNA, 60 bp, Artificial Sequence
  Description of Artificial Sequence: Synthetic probe
cacgtatgagcacggtggcaaagaccgctacaaggtagccctcaccaaacctgccaaaca

SEQ ID NO: 2237 - DNA, 60 bp, Artificial Sequence
  Description of Artificial Sequence: Synthetic probe
cgtggagatctcgcaacgctcgcagagcatatcgcgagtgaaacacacatcccaaccacc

SEQ ID NO: 2238 - DNA, 60 bp, Artificial Sequence
  Description of Artificial Sequence: Synthetic probe
cacggaccaacatccgtggagatctcgcaacgctcgcagagcatatcgcgagtgaaacac

SEQ ID NO: 2239 - DNA, 60 bp, Artificial Sequence
  Description of Artificial Sequence: Synthetic probe
cggtgactgcaagtacaagccagcggaacaagccccacggaccaacatccgtggagatct

SEQ ID NO: 2240 - DNA, 60 bp, Artificial Sequence
  Description of Artificial Sequence: Synthetic probe
tgcgaccacctacaacggtgactgcaagtacaagccagcggaacaagccccacggaccaa

SEQ ID NO: 2241 - DNA, 60 bp, Artificial Sequence
  Description of Artificial Sequence: Synthetic probe
gaactctattgtcctaggccgattcttccgattcagccaacgggcgatagacacaagcaa

SEQ ID NO: 2242 - DNA, 60 bp, Artificial Sequence
  Description of Artificial Sequence: Synthetic probe
aggatgaagcgcgcggaactctactgtccgcggcccattctcacgcactacgaccacaag

SEQ ID NO: 2243 - DNA, 60 bp, Artificial Sequence
  Description of Artificial Sequence: Synthetic probe
aactacggcaggctgtacacagaaggcgtggttgacgtgtacgtcaggatgaagcgcgcg

SEQ ID NO: 2244 - DNA, 60 bp, Artificial Sequence
  Description of Artificial Sequence: Synthetic probe
ttccaaccactttcaactacggcaggctgtacacagaaggcgtggttgacgtgtacgtca

SEQ ID NO: 2245 - DNA, 60 bp, Artificial Sequence
  Description of Artificial Sequence: Synthetic probe
actgtaagtacaagcccactggcacagccccgcgcgagaacattcgcggggacctcgcaa

SEQ ID NO: 2246 - DNA, 60 bp, Artificial Sequence
  Description of Artificial Sequence: Synthetic probe
aacggtgactgtaagtacaagcccactggcacagccccgcgcgagaacattcgcggggac

SEQ ID NO: 2247 - DNA, 60 bp, Artificial Sequence
  Description of Artificial Sequence: Synthetic probe
caatccatgcgtcttctccaaggatggaaccacccgttttgctctgccctacaccgcacc

SEQ ID NO: 2248 - DNA, 60 bp, Artificial Sequence
  Description of Artificial Sequence: Synthetic probe
tcttgaagtgggcgacaatccatgcgtcttctccaaggatggaaccacccgttttgctct

SEQ ID NO: 2249 - DNA, 60 bp, Artificial Sequence
  Description of Artificial Sequence: Synthetic probe
tgggtcggctggactcctaacggagctcccgaatttcttgaagtgggcgacaatccatgc

SEQ ID NO: 2250 - DNA, 60 bp, Artificial Sequence
  Description of Artificial Sequence: Synthetic probe
gtgggcgagaacaaatgggtcggctggactcctaacggagctcccgaatttcttgaagtg

SEQ ID NO: 2251 - DNA, 60 bp, Artificial Sequence
  Description of Artificial Sequence: Synthetic probe
ggcccgttctcactcactacgaccacaatggccaggaccgttacaagacgaccctcgtca

SEQ ID NO: 2252 - DNA, 60 bp, Artificial Sequence
  Description of Artificial Sequence: Synthetic probe
aactctactgtcctcggcccgttctcactcactacgaccacaatggccaggaccgttaca

SEQ ID NO: 2253 - DNA, 60 bp, Artificial Sequence
  Description of Artificial Sequence: Synthetic probe
aagtacaagcccactggtacaccaccacgcgagaacatccgcggtgacctcgcaactctg

SEQ ID NO: 2254 - DNA, 60 bp, Artificial Sequence
  Description of Artificial Sequence: Synthetic probe
aacggtgactgcaagtacaagcccactggtacaccaccacgcgagaacatccgcggtgac

SEQ ID NO: 2255 - DNA, 60 bp, Artificial Sequence
  Description of Artificial Sequence: Synthetic probe
acactgcaccccaccgggtgctcgccacaacttacaacggtgactgcaagtacaagccca

SEQ ID NO: 2256 - DNA, 60 bp, Artificial Sequence
  Description of Artificial Sequence: Synthetic probe
gttttgcactcccttacactgcaccccaccgggtgctcgccacaacttacaacggtgact

SEQ ID NO: 2257 - DNA, 60 bp, Artificial Sequence
  Description of Artificial Sequence: Synthetic probe
gaaccactcaacggagaatggaaggcaaaggttcaaaggcgacttaagggagccgggcat

SEQ ID NO: 2258 - DNA, 60 bp, Artificial Sequence
  Description of Artificial Sequence: Synthetic probe
cacgtcccagtgaggtgtgcatggtagacggaacggacatgtgcctggctgacttccatg

SEQ ID NO: 2259 - DNA, 60 bp, Artificial Sequence
  Description of Artificial Sequence: Synthetic probe
accaccgccaccggggagtctgcagaccctgtcaccaccaccgttgagaactacggcggc

SEQ ID NO: 2260 - DNA, 60 bp, Artificial Sequence
  Description of Artificial Sequence: Synthetic probe
ttgggtgcccaacggtgcccctgaagcagctttgtcaaacaccagcaaccccactgccta

SEQ ID NO: 2261 - DNA, 60 bp, Artificial Sequence
  Description of Artificial Sequence: Synthetic probe
gactcgggtgcccaacggtgcccctgaagcagctttgtcaaacaccagcaaccccactgc

SEQ ID NO: 2262 - DNA, 60 bp, Artificial Sequence
  Description of Artificial Sequence: Synthetic probe
tgacttgggtgcccaacggtgcccctgaagcagctttgtcaaacaccagcaaccccactg

SEQ ID NO: 2263 - DNA, 60 bp, Artificial Sequence
  Description of Artificial Sequence: Synthetic probe
acggcaatttgacttgggtgcccaacggtgcccctgaagcagctttgtcaaacaccagca

SEQ ID NO: 2264 - DNA, 60 bp, Artificial Sequence
  Description of Artificial Sequence: Synthetic probe
cccacgacccctacgggtcatgtacacgcacaccaccgaccggtacaagattaagctggt

SEQ ID NO: 2265 - DNA, 60 bp, Artificial Sequence
  Description of Artificial Sequence: Synthetic probe
gagctgtactgcccacgacccctacgggtcatgtacacgcacaccaccgaccggtacaag

SEQ ID NO: 2266 - DNA, 60 bp, Artificial Sequence
  Description of Artificial Sequence: Synthetic probe
tgtgtgacactggcgacgtctactaccggatgaagagggctgagctgtactgcccacgac

SEQ ID NO: 2267 - DNA, 60 bp, Artificial Sequence
  Description of Artificial Sequence: Synthetic probe
ggagattgttgtgtgacactggcgacgtctactaccggatgaagagggctgagctgtact

SEQ ID NO: 2268 - DNA, 60 bp, Artificial Sequence
  Description of Artificial Sequence: Synthetic probe
agtactcaaagacccaacacgttacaccacgccgcggcgatctagcggtgctggcacaac

SEQ ID NO: 2269 - DNA, 60 bp, Artificial Sequence
  Description of Artificial Sequence: Synthetic probe
caatgggaactgcaagtactcaaagacccaacacgttacaccacgccgcggcgatctagc

SEQ ID NO: 2270 - DNA, 59 bp, Artificial Sequence
  Description of Artificial Sequence: Synthetic probe
tgggttcctaacggatgcccgcacactgaccgcgtggaggacaacccagtcgttcacgc

SEQ ID NO: 2271 - DNA, 55 bp, Artificial Sequence
  Description of Artificial Sequence: Synthetic probe
tgccgatgaagtgaactctgagcccagcaaacccgcggagaaaccacaagctgaa

SEQ ID NO: 2272 - DNA, 60 bp, Artificial Sequence
  Description of Artificial Sequence: Synthetic probe
ggcttccgtgagagaaaactccccggacacaagactgccgatgaagtgaactctgagccc

SEQ ID NO: 2273 - DNA, 60 bp, Artificial Sequence
  Description of Artificial Sequence: Synthetic probe
acaaacccactgtcgggcttccgtgagagaaaactccccggacacaagactgccgatgaa

SEQ ID NO: 2274 - DNA, 60 bp, Artificial Sequence
  Description of Artificial Sequence: Synthetic probe
ctgacgacaaaacgcttgatgaggcggaaaagaaccctaggagggtgtcgacaaacccac

SEQ ID NO: 2275 - DNA, 60 bp, Artificial Sequence
  Description of Artificial Sequence: Synthetic probe
attatcatgatccgcgaaactcacaagcgtcagaagatggttgacgacgccctcgatgag

SEQ ID NO: 2276 - DNA, 60 bp, Artificial Sequence
  Description of Artificial Sequence: Synthetic probe
ctgttggcaaacatcattatcatgatccgcgaaactcacaagcgtcagaagatggttgac

SEQ ID NO: 2277 - DNA, 60 bp, Artificial Sequence
  Description of Artificial Sequence: Synthetic probe
gctgcaattgagttttacgaaggaatggtgcacgacagcatcaaggaagagctcaagccc

SEQ ID NO: 2278 - DNA, 60 bp, Artificial Sequence
  Description of Artificial Sequence: Synthetic probe
acagcacgaagctgcaattgagttttacgaaggaatggtgcacgacagcatcaaggaaga

SEQ ID NO: 2279 - DNA, 60 bp, Artificial Sequence
  Description of Artificial Sequence: Synthetic probe
atttccattccttctcaaaagtctgtgctctacttcctcatcgagaaaggacagcacgaa

SEQ ID NO: 2280 - DNA, 55 bp, Artificial Sequence
  Description of Artificial Sequence: Synthetic probe
atttccattccttctcaaaagtctgtgctctacttcctcatcgagaaaggacagc

SEQ ID NO: 2281 - DNA, 60 bp, Artificial Sequence
  Description of Artificial Sequence: Synthetic probe
cgtcttttccaacaacggtactacccgctttgcactgccctacaccgctccacacaggtg

SEQ ID NO: 2282 - DNA, 60 bp, Artificial Sequence
  Description of Artificial Sequence: Synthetic probe
ccatccacccgagcgaggccagacacaaacaaaagattgtggcacctgtgaaacagctcc

SEQ ID NO: 2283 - DNA, 60 bp, Artificial Sequence
  Description of Artificial Sequence: Synthetic probe
ggccatccacccgagcgaaactagacacaaacaaaagattgtggcacctgtgaaacagct

SEQ ID NO: 2284 - DNA, 60 bp, Artificial Sequence
  Description of Artificial Sequence: Synthetic probe
ccctctcctgacacactacgaccacggcgggaaggatcgctacaagaccgcgataaccaa

SEQ ID NO: 2285 - DNA, 60 bp, Artificial Sequence
  Description of Artificial Sequence: Synthetic probe
gtatgttaggatgaagcgcgcagaactctactgcccgcgccctgttctgacacactacga

SEQ ID NO: 2286 - DNA, 50 bp, Artificial Sequence
  Description of Artificial Sequence: Synthetic probe
ccacccacgaccgccgtaagcaggagatcattgcacctgagaagcaagtt

SEQ ID NO: 2287 - DNA, 60 bp, Artificial Sequence
  Description of Artificial Sequence: Synthetic probe
catgtcattgacctcatgcaaacccaccaacacgggctggtgggtgccctgttgcgtgct

SEQ ID NO: 2288 - DNA, 60 bp, Artificial Sequence
  Description of Artificial Sequence: Synthetic probe
aacaacctacaacggtgactgcaagtacaaacccgctggcacacccccgcgcaagaacat

SEQ ID NO: 2289 - DNA, 60 bp, Artificial Sequence
  Description of Artificial Sequence: Synthetic probe
tggcaacaacctacaacggtgactgcaagtacaaacccgctggcacacccccgcgcgaga

SEQ ID NO: 2290 - DNA, 60 bp, Artificial Sequence
  Description of Artificial Sequence: Synthetic probe
agcgcgcctcgtcaagcctgccaaacaattgtgcaacttcgacctgttaaaattggccgg

SEQ ID NO: 2291 - DNA, 60 bp, Artificial Sequence
  Description of Artificial Sequence: Synthetic probe
tacaaagcgcgcctcgtcaagcctgccaaacaattgtgcaacttcgacctgttaaaattg

SEQ ID NO: 2292 - DNA, 53 bp, Artificial Sequence
  Description of Artificial Sequence: Synthetic probe
acaacattcaactacgggatgatatacacagaggcagaagtcgacgtgtacct

SEQ ID NO: 2293 - DNA, 60 bp, Artificial Sequence
  Description of Artificial Sequence: Synthetic probe
gcactcccctacactgcaccccaccgggtcgttgccacaacttacaatggtgactgcaag

SEQ ID NO: 2294 - DNA, 60 bp, Artificial Sequence
  Description of Artificial Sequence: Synthetic probe
ccgttttgcactcccctacactgcaccccaccgggtcgttgccacaacttacaatggtga

SEQ ID NO: 2295 - DNA, 60 bp, Artificial Sequence
  Description of Artificial Sequence: Synthetic probe
gggcgacaatccagtcgtcttctcacacaacggcaccacccgttttgcactcccctacac

SEQ ID NO: 2296 - DNA, 60 bp, Artificial Sequence
  Description of Artificial Sequence: Synthetic probe
ctggaggaagtgggcgacaatccagtcgtcttctcacacaacggcaccacccgttttgca

SEQ ID NO: 2297 - DNA, 60 bp, Artificial Sequence
  Description of Artificial Sequence: Synthetic probe
gcaagcgagacacacatcccaaccaccttcaattttggcaggatctacacatacgccgag

SEQ ID NO: 2298 - DNA, 60 bp, Artificial Sequence
  Description of Artificial Sequence: Synthetic probe
gggacttcgcgactcttgcggagaggattgcaagcgagacacgcatcccaaccaccttca

SEQ ID NO: 2299 - DNA, 60 bp, Artificial Sequence
  Description of Artificial Sequence: Synthetic probe
tccgtggggacttcgcgactcttgcggagaggattgcaagcgagacacgcatcccaacca

SEQ ID NO: 2300 - DNA, 60 bp, Artificial Sequence
  Description of Artificial Sequence: Synthetic probe
cgtgagaacatccgcggggacctcgcgactcttgcggagaggattgcaagcgagacacac

SEQ ID NO: 2301 - DNA, 60 bp, Artificial Sequence
  Description of Artificial Sequence: Synthetic probe
ggctactgcggaggagccgtactcgcgaaggacggagccgagactttcatcgtcggcact

SEQ ID NO: 2302 - DNA, 60 bp, Artificial Sequence
  Description of Artificial Sequence: Synthetic probe
cccacacatgtcattgacctcatgcaaacccaccaacacgggctggtgggtgccctgttg

SEQ ID NO: 2303 - DNA, 60 bp, Artificial Sequence
  Description of Artificial Sequence: Synthetic probe
cgagtgcacctacacaaaaaccgccaccgccatccgtggagaccgcgcagcactcgcggc

SEQ ID NO: 2304 - DNA, 60 bp, Artificial Sequence
  Description of Artificial Sequence: Synthetic probe
cttttggcagcctaacggggcaccgcggaccacccaacttggtgacaaccccatggttta

SEQ ID NO: 2305 - DNA, 60 bp, Artificial Sequence
  Description of Artificial Sequence: Synthetic probe
accacctcagcgggagaaggcgcggatgtcgtcaccacagacccatctacacacggtggg

SEQ ID NO: 2306 - DNA, 60 bp, Artificial Sequence
  Description of Artificial Sequence: Synthetic probe
acatcttacaacggtgattgcaagtacaaacccactagcacacctccgcgcggcaacatc

SEQ ID NO: 2307 - DNA, 60 bp, Artificial Sequence
  Description of Artificial Sequence: Synthetic probe
gcttggcaacatcttacaacggtgattgcaagtacaaacccgctggcacagccccgcgcg

SEQ ID NO: 2308 - DNA, 60 bp, Artificial Sequence
  Description of Artificial Sequence: Synthetic probe
agcagaactctattgtcctcgccccgttctcacacactacagccacaacgacaaggaccg

SEQ ID NO: 2309 - DNA, 60 bp, Artificial Sequence
  Description of Artificial Sequence: Synthetic probe
gaatgaagagagcagaactctattgtcctcgccccgttctcacacactacagccacaacg

SEQ ID NO: 2310 - DNA, 60 bp, Artificial Sequence
  Description of Artificial Sequence: Synthetic probe
cgcgcgaatcgccagtgagacccacatcccgacaacgttcaactacgggatgatttatac

SEQ ID NO: 2311 - DNA, 60 bp, Artificial Sequence
  Description of Artificial Sequence: Synthetic probe
cgcgagaacattcgcggcgacctcgcaaccttggccgcgcgaatcgccagtgagacccac

SEQ ID NO: 2312 - DNA, 60 bp, Artificial Sequence
  Description of Artificial Sequence: Synthetic probe
actggcactccgccccgcgagaacattcgcggcgacctcgcaaccttggccgcgcgaatc

SEQ ID NO: 2313 - DNA, 60 bp, Artificial Sequence
  Description of Artificial Sequence: Synthetic probe
gccacaacctacaatggtgattgcaagtacaagcccactggcactccgccccgcgagaac

SEQ ID NO: 2314 - DNA, 60 bp, Artificial Sequence
  Description of Artificial Sequence: Synthetic probe
cccacagggtgctcgccacaacctacaatggtgattgcaagtacaagcccactggcactc

SEQ ID NO: 2315 - DNA, 60 bp, Artificial Sequence
  Description of Artificial Sequence: Synthetic probe
cggcgtcgctcgttttgcactcccctacacagcaccccacagggtgctcgccacaaccta

SEQ ID NO: 2316 - DNA, 60 bp, Artificial Sequence
  Description of Artificial Sequence: Synthetic probe
cgtcttctcgcgcaacggcgtcgctcgttttgcactcccctacacagcaccccacagggt

SEQ ID NO: 2317 - DNA, 60 bp, Artificial Sequence
  Description of Artificial Sequence: Synthetic probe
tcccaacggcagtccggtgttgagtgaagtgggcgacaacccagtcgtcttctcgcgcaa

SEQ ID NO: 2318 - DNA, 60 bp, Artificial Sequence
  Description of Artificial Sequence: Synthetic probe
tggactcccaacggcagtccggtgttgagtgaagtgggcgacaacccagtcgtcttctcg

SEQ ID NO: 2319 - DNA, 60 bp, Artificial Sequence
  Description of Artificial Sequence: Synthetic probe
gaggctgatggggcaactgcccacctccttcaactaccgcgctgtaaaggctgacaccat

SEQ ID NO: 2320 - DNA, 60 bp, Artificial Sequence
  Description of Artificial Sequence: Synthetic probe
tgcacagaggctgatggggcaactgcccacctccttcaactaccgcgctgtaaaggctga

SEQ ID NO: 2321 - DNA, 56 bp, Artificial Sequence
  Description of Artificial Sequence: Synthetic probe
acgggacgagcaggtacactgtgggtggttccaccaggcgaggtgacatggggtct

SEQ ID NO: 2322 - DNA, 60 bp, Artificial Sequence
  Description of Artificial Sequence: Synthetic probe
cactgcctacaacaaggcgccattcacaagacttgcactcccctacactgcgccacaccg

SEQ ID NO: 2323 - DNA, 60 bp, Artificial Sequence
  Description of Artificial Sequence: Synthetic probe
ccactgcctacaacaaggcgccattcacaagacttgcactcccctacactgcgccacacc

SEQ ID NO: 2324 - DNA, 60 bp, Artificial Sequence
  Description of Artificial Sequence: Synthetic probe
cggtggcgagacacaagttcagaggaggcatcacacggacattggctttattatggacag

SEQ ID NO: 2325 - DNA, 60 bp, Artificial Sequence
  Description of Artificial Sequence: Synthetic probe
ctacggtggcgagacacaagttcagaggaggcatcacacggacattggctttattatgga

SEQ ID NO: 2326 - DNA, 60 bp, Artificial Sequence
  Description of Artificial Sequence: Synthetic probe
aaccccactgcctacaacaaggcaccgttcacgaggcttgctctcccttacactgcgcca

SEQ ID NO: 2327 - DNA, 60 bp, Artificial Sequence
  Description of Artificial Sequence: Synthetic probe
accagcaaccccactgcctacaacaaggcaccgttcacgagacttgccctcccctacacc

SEQ ID NO: 2328 - DNA, 60 bp, Artificial Sequence
  Description of Artificial Sequence: Synthetic probe
gtcaaacaccggcaaccccactgcctacaacaaggcaccgttcacgaggcttgctctccc

SEQ ID NO: 2329 - DNA, 53 bp, Artificial Sequence
  Description of Artificial Sequence: Synthetic probe
cagtcccatcggtgttgagaaacaactgtgcaacttcgacctgttaaagttgg

SEQ ID NO: 2330 - DNA, 60 bp, Artificial Sequence
  Description of Artificial Sequence: Synthetic probe
gacctctcctccctggttacgaccacgcggaaagagataggtttgacagtcccatcggtg

SEQ ID NO: 2331 - DNA, 60 bp, Artificial Sequence
  Description of Artificial Sequence: Synthetic probe
ggtgatcgtgccgtcttggccgcgaaatacgccaacaccagacacgagctcccgtctacc

SEQ ID NO: 2332 - DNA, 60 bp, Artificial Sequence
  Description of Artificial Sequence: Synthetic probe
tccaccgccatccgcggtgatcgtgccgtcttggccgcgaaatacgccaacaccagacac

SEQ ID NO: 2333 - DNA, 51 bp, Artificial Sequence
  Description of Artificial Sequence: Synthetic probe
acacaacaacgtcacgcgttttgctgtcccgtacaccgcaccgcaccggct

SEQ ID NO: 2334 - DNA, 60 bp, Artificial Sequence
  Description of Artificial Sequence: Synthetic probe
cctccctggttacgaccacgcggccagggataggtttgacagtcccatcggtgttgagaa

SEQ ID NO: 2335 - DNA, 60 bp, Artificial Sequence
  Description of Artificial Sequence: Synthetic probe
ccaagacctctcctccctggttacgaccacgcggaaagagataggtttgacagtcccatc

SEQ ID NO: 2336 - DNA, 60 bp, Artificial Sequence
  Description of Artificial Sequence: Synthetic probe
ctgtccaagacctctcctccctggttacgaccacgcggccagggataggtttgacagtcc

SEQ ID NO: 2337 - DNA, 60 bp, Artificial Sequence
  Description of Artificial Sequence: Synthetic probe
cgaagtttactaccggatgaagagggcggaactctactgtccaagacctctcctccctgg

SEQ ID NO: 2338 - DNA, 60 bp, Artificial Sequence
  Description of Artificial Sequence: Synthetic probe
cgacgtttactaccggatgaagagggcggaactctactgtccaagacctctcctccctgg

SEQ ID NO: 2339 - DNA, 60 bp, Artificial Sequence
  Description of Artificial Sequence: Synthetic probe
gccgacaagccagtcgaagtttactaccggatgaagagggcggaactctactgtccaaga

SEQ ID NO: 2340 - DNA, 58 bp, Artificial Sequence
  Description of Artificial Sequence: Synthetic probe
gcggcttaagggagccggacaatccagtctggcgaccgggtcacaaaaccaatcaggc

SEQ ID NO: 2341 - DNA, 60 bp, Artificial Sequence
  Description of Artificial Sequence: Synthetic probe
ccgcttaatggagaatggaaggcaaaggttcaaaagcggcttaagggagccggacaatcc

SEQ ID NO: 2342 - DNA, 60 bp, Artificial Sequence
  Description of Artificial Sequence: Synthetic probe
ccgtccgatcaggaaccgcttaatggagaatggaaggcaaaggttcaaaagcggcttaag

SEQ ID NO: 2343 - DNA, 50 bp, Artificial Sequence
  Description of Artificial Sequence: Synthetic probe
cccgtccgacggactggtattggtgccgtccgatcaggaaccgcttaatg

SEQ ID NO: 2344 - DNA, 60 bp, Artificial Sequence
  Description of Artificial Sequence: Synthetic probe
aggacttttacccgtggacaccggacccgtccgacggactggtattggtgccgtccgatc

SEQ ID NO: 2345 - DNA, 60 bp, Artificial Sequence
  Description of Artificial Sequence: Synthetic probe
tgccatgttcgcctgtgtcacctccaaaggggggtacgcgtttggcgtcgaggactttta

SEQ ID NO: 2346 - DNA, 60 bp, Artificial Sequence
  Description of Artificial Sequence: Synthetic probe
ctggaaagtgaaacaccttgtagataccggaatcggcactgcctcgcgccccagcgagga

SEQ ID NO: 2347 - DNA, 60 bp, Artificial Sequence
  Description of Artificial Sequence: Synthetic probe
gctctggttatctggaaagtgaaacaccttgtagataccggaatcggcactgcctcgcgc

SEQ ID NO: 2348 - DNA, 60 bp, Artificial Sequence
  Description of Artificial Sequence: Synthetic probe
ctggtagaaattgttggcctagtagtacacgagggtgggccgcccgctctggttatctgg

SEQ ID NO: 2349 - DNA, 60 bp, Artificial Sequence
  Description of Artificial Sequence: Synthetic probe
ggcaactggtagaaattgttggcctagtagtacacgagggtgggccgcccgctctggtta

SEQ ID NO: 2350 - DNA, 60 bp, Artificial Sequence
  Description of Artificial Sequence: Synthetic probe
cgactgggtctacgactcacctgaaaacctcacgctggaggccatgaggcaactggtaga

SEQ ID NO: 2351 - DNA, 60 bp, Artificial Sequence
  Description of Artificial Sequence: Synthetic probe
cttcgactgggtctacgactcacctgaaaacctcacgctggaggccatgaggcaactggt

SEQ ID NO: 2352 - DNA, 60 bp, Artificial Sequence
  Description of Artificial Sequence: Synthetic probe
ccatcctccagttgttcaggtacgtcgatgaaccattcttcgactgggtctacgactcac

SEQ ID NO: 2353 - DNA, 60 bp, Artificial Sequence
  Description of Artificial Sequence: Synthetic probe
tggtggttaaacaccatcctccagttgttcaggtacgtcgatgaaccattcttcgactgg

SEQ ID NO: 2354 - DNA, 60 bp, Artificial Sequence
  Description of Artificial Sequence: Synthetic probe
agccgttctgcgcaaaggccaacaaccacgacaagtggtggttaaacaccatcctccagt

SEQ ID NO: 2355 - DNA, 60 bp, Artificial Sequence
  Description of Artificial Sequence: Synthetic probe
acaacaatgagaagaagccgttctgcgcaaaggccaacaaccacgacaagtggtggttaa

SEQ ID NO: 2356 - DNA, 60 bp, Artificial Sequence
  Description of Artificial Sequence: Synthetic probe
ccccactgcttctttcacaagtcacagggaaaatggaattcgctctttacaacaatgaga

SEQ ID NO: 2357 - DNA, 60 bp, Artificial Sequence
  Description of Artificial Sequence: Synthetic probe
taccccactgcttctttcacaagtcacagggaaaatggaattcgctctttacaacaatga

SEQ ID NO: 2358 - DNA, 60 bp, Artificial Sequence
  Description of Artificial Sequence: Synthetic probe
ctggaagttttatcgctctgttccacgccctcagggagattaccccactgcttctttcac

SEQ ID NO: 2359 - DNA, 60 bp, Artificial Sequence
  Description of Artificial Sequence: Synthetic probe
atgaatacaactggaagttttatcgctctgttccacgccctcagggagattaccccactg

SEQ ID NO: 2360 - DNA, 60 bp, Artificial Sequence
  Description of Artificial Sequence: Synthetic probe
gcggcacaacttcctgcttcctttaactacggtgcaatcaaggctacagccatccacgag

SEQ ID NO: 2361 - DNA, 60 bp, Artificial Sequence
  Description of Artificial Sequence: Synthetic probe
ggaggtgtcgtcacaagacagacacaaacagaagatcattgcaccagcaaaacagctcct

SEQ ID NO: 2362 - DNA, 60 bp, Artificial Sequence
  Description of Artificial Sequence: Synthetic probe
aacccaacggtgcgcccaggacaacccagttgggagacaacccaatggtcttctcccaca

SEQ ID NO: 2363 - DNA, 60 bp, Artificial Sequence
  Description of Artificial Sequence: Synthetic probe
tccggagctcagtgaagtaggcgacaacccagtcgtcttctccgctaacggcaccacccg

SEQ ID NO: 2364 - DNA, 60 bp, Artificial Sequence
  Description of Artificial Sequence: Synthetic probe
agctccggagctcagtgaagtaggcgacaacccagtcgtcttctccgctaacggcaccac

SEQ ID NO: 2365 - DNA, 60 bp, Artificial Sequence
  Description of Artificial Sequence: Synthetic probe
cgtcatcttttcgcagagaagtatgacaagatcatgttggacggccgcgccctgacagac

SEQ ID NO: 2366 - DNA, 60 bp, Artificial Sequence
  Description of Artificial Sequence: Synthetic probe
acactggacctgctccagaccaaggagaaagcactggtgggcgcaatcctgcgcgtcgcc

SEQ ID NO: 2367 - DNA, 60 bp, Artificial Sequence
  Description of Artificial Sequence: Synthetic probe
ccggcctcttttggccatccacccgaacgaggccagacacaaacagaagattgtggcacc

SEQ ID NO: 2368 - DNA, 57 bp, Artificial Sequence
  Description of Artificial Sequence: Synthetic probe
ccccggcctcttttggctatccacccgaacgaggccagacacaaacagaagattgtg

SEQ ID NO: 2369 - DNA, 52 bp, Artificial Sequence
  Description of Artificial Sequence: Synthetic probe
cgcgatcaccagacctgccaaacaattgtgcaacttcgacctgttaaagttg

SEQ ID NO: 2370 - DNA, 60 bp, Artificial Sequence
  Description of Artificial Sequence: Synthetic probe
cgacctcttctcacacactacgatcacaacggcaaggatcgctacaaaaccgcgatcacc

SEQ ID NO: 2371 - DNA, 60 bp, Artificial Sequence
  Description of Artificial Sequence: Synthetic probe
ccaacaactttcaactacggtaggatctacacagaggccgaggtcgacgtgtacgtcagg

SEQ ID NO: 2372 - DNA, 60 bp, Artificial Sequence
  Description of Artificial Sequence: Synthetic probe
cgagacacacattccaacaactttcaactacggtaggatctacacagaggccgaggtcga

SEQ ID NO: 2373 - DNA, 52 bp, Artificial Sequence
  Description of Artificial Sequence: Synthetic probe
cgcgactcttgcggcgaggatcgcgagcgagacacacattccaacaactttc

SEQ ID NO: 2374 - DNA, 60 bp, Artificial Sequence
  Description of Artificial Sequence: Synthetic probe
ttttgcactgccctacactgccccgcacagatgcctggcaacgtcctacaacggtgactg

SEQ ID NO: 2375 - DNA, 60 bp, Artificial Sequence
  Description of Artificial Sequence: Synthetic probe
cagaaccacccgttttgcactgccctacactgccccgcacagatgcctggcaacgtccta

SEQ ID NO: 2376 - DNA, 60 bp, Artificial Sequence
  Description of Artificial Sequence: Synthetic probe
gctcctgagttgagcgaggtgggcgacaatccagtcgtcttctcgaaaaacagaaccacc

SEQ ID NO: 2377 - DNA, 60 bp, Artificial Sequence
  Description of Artificial Sequence: Synthetic probe
ggaggagaaactcagacagccagacggcttcacactgacgttgcctttgttcttgacagg

SEQ ID NO: 2378 - DNA, 60 bp, Artificial Sequence
  Description of Artificial Sequence: Synthetic probe
gggtgactgaactgctttaccgcatgaaaagggctgagacatactgccctcggcccctgt

SEQ ID NO: 2379 - DNA, 60 bp, Artificial Sequence
  Description of Artificial Sequence: Synthetic probe
gagtgactgaactgctttaccgcatgaaaagggctgagacgtactgccctcggccccttc

SEQ ID NO: 2380 - DNA, 60 bp, Artificial Sequence
  Description of Artificial Sequence: Synthetic probe
actttgctgacctggaagtggcggtgaagcacgaggggaacctcacttgggtcccaaacg

SEQ ID NO: 2381 - DNA, 60 bp, Artificial Sequence
  Description of Artificial Sequence: Synthetic probe
actttgcttacttggaggtggcggtgaagcacgaggggaacctcacttgggtcccgaacg

SEQ ID NO: 2382 - DNA, 60 bp, Artificial Sequence
  Description of Artificial Sequence: Synthetic probe
tactttgctgacttggaggtggcggtgaagcacgaggggaacctcacttgggtcccgaac

SEQ ID NO: 2383 - DNA, 60 bp, Artificial Sequence
  Description of Artificial Sequence: Synthetic probe
ccaaccactttcaactatggcaggatttacacagaggccgaggttgacgtgtacgtcagg

SEQ ID NO: 2384 - DNA, 60 bp, Artificial Sequence
  Description of Artificial Sequence: Synthetic probe
ccaaccactttcaactatggcaggatttacacagaggctgaggttgacgtgtacgttagg

SEQ ID NO: 2385 - DNA, 60 bp, Artificial Sequence
  Description of Artificial Sequence: Synthetic probe
cactgtttctttcacggacacaaggaaagatggaattcacactttacaacggtgagaaaa

SEQ ID NO: 2386 - DNA, 60 bp, Artificial Sequence
  Description of Artificial Sequence: Synthetic probe
caaaacactgtttctttcacggacacaaggaaagatggaattcacactttacaacggtga

SEQ ID NO: 2387 - DNA, 60 bp, Artificial Sequence
  Description of Artificial Sequence: Synthetic probe
tgccggtgtcttcctgaaaggacaagaacacgctgtgtttgcctgtgtcacctccaacgg

SEQ ID NO: 2388 - DNA, 60 bp, Artificial Sequence
  Description of Artificial Sequence: Synthetic probe
aagagagcagaactctactgccctcgaccccttctcacgcactacgaccaccacgggagg

SEQ ID NO: 2389 - DNA, 60 bp, Artificial Sequence
  Description of Artificial Sequence: Synthetic probe
gaagagagcagaactctactgccctcgaccccttctcacgcactacgaccaccacgggag

SEQ ID NO: 2390 - DNA, 60 bp, Artificial Sequence
  Description of Artificial Sequence: Synthetic probe
aggatgaagagagcggaactctactgccctcgaccccttctcacgcactacgaccaccga

SEQ ID NO: 2391 - DNA, 60 bp, Artificial Sequence
  Description of Artificial Sequence: Synthetic probe
ggtgacctcgctacactagctgagcggattgccaatgagacacacatcccgacaaccttc

SEQ ID NO: 2392 - DNA, 60 bp, Artificial Sequence
  Description of Artificial Sequence: Synthetic probe
ccgcggtgacctcgctacgttagctgagcggattgccaatgagacacacatcccgacaac

SEQ ID NO: 2393 - DNA, 60 bp, Artificial Sequence
  Description of Artificial Sequence: Synthetic probe
ctgagggctggtacgccattgatgatgaggtgttctacccatggacaccggaccctgaga

SEQ ID NO: 2394 - DNA, 60 bp, Artificial Sequence
  Description of Artificial Sequence: Synthetic probe
tacgtgaggatgaagcgggcggagctttactgtccacgcccgttgctcaccaggtacgaa

SEQ ID NO: 2395 - DNA, 60 bp, Artificial Sequence
  Description of Artificial Sequence: Synthetic probe
gctgtcaaccgtgtacaacggtgagtgtgagtacacacggaaagcacaagccatccgtgg

SEQ ID NO: 2396 - DNA, 60 bp, Artificial Sequence
  Description of Artificial Sequence: Synthetic probe
tggcagcctaacggcgcgccccggacaactgcgttgggagacaacccgatggttttctca

SEQ ID NO: 2397 - DNA, 60 bp, Artificial Sequence
  Description of Artificial Sequence: Synthetic probe
agcagcccatcacccgcttggcactcccctacaccgccccccaccgtgtgctggcgacag

SEQ ID NO: 2398 - DNA, 60 bp, Artificial Sequence
  Description of Artificial Sequence: Synthetic probe
tttgagctaaggctgccggtggacgcccgtgcggaaaccacttctgcgggcgagtcagcg

SEQ ID NO: 2399 - DNA, 60 bp, Artificial Sequence
  Description of Artificial Sequence: Synthetic probe
ctttgagctaaggctgccggtggacgcccgtgcggaaaccacttctgcgggcgagtcagc

SEQ ID NO: 2400 - DNA, 60 bp, Artificial Sequence
  Description of Artificial Sequence: Synthetic probe
gcgacgctctggtcgtactggctagtgctggtaaagactttgagctaaggctgccggtgg

SEQ ID NO: 2401 - DNA, 60 bp, Artificial Sequence
  Description of Artificial Sequence: Synthetic probe
ggcaaggccgacggcgacgctctggtcgtactggctagtgctggtaaagactttgagcta

SEQ ID NO: 2402 - DNA, 60 bp, Artificial Sequence
  Description of Artificial Sequence: Synthetic probe
ggccgccgattacgcgtacaccgcgtctggcgtggccgagaccacaaatgtgcagggatg

SEQ ID NO: 2403 - DNA, 60 bp, Artificial Sequence
  Description of Artificial Sequence: Synthetic probe
catcccctacctctcggccgccgattacgcgtacaccgcgtctggcgtggccgagaccac

SEQ ID NO: 2404 - DNA, 60 bp, Artificial Sequence
  Description of Artificial Sequence: Synthetic probe
cccaagacacctgaggcggccgcgcactgcattcatgctgaatgggacactgggttaaac

SEQ ID NO: 2405 - DNA, 60 bp, Artificial Sequence
  Description of Artificial Sequence: Synthetic probe
ctaggcatggagccgcccaagacacctgaggcggccgcgcactgcattcatgctgaatgg

SEQ ID NO: 2406 - DNA, 60 bp, Artificial Sequence
  Description of Artificial Sequence: Synthetic probe
acaggacccactgacgcgaaggcgcgttacatggttgcctacgccccactaggcatggag

SEQ ID NO: 2407 - DNA, 60 bp, Artificial Sequence
  Description of Artificial Sequence: Synthetic probe
tcacaggacccactgacgcgaaggcgcgttacatggttgcctacgccccactaggcatgg

SEQ ID NO: 2408 - DNA, 60 bp, Artificial Sequence
  Description of Artificial Sequence: Synthetic probe
ccttcctcgcaggtcttgcgcagtactacacacagtacagtggcaccatcaacctgcact

SEQ ID NO: 2409 - DNA, 60 bp, Artificial Sequence
  Description of Artificial Sequence: Synthetic probe
acaaatgtcaaacaccttcctcgcaggtcttgcgcagtactacacacagtacagtggcac

SEQ ID NO: 2410 - DNA, 60 bp, Artificial Sequence
  Description of Artificial Sequence: Synthetic probe
acggactcggacaccctacttgctcagtttgacatgtctttggcagcaaaacaaatgtca

SEQ ID NO: 2411 - DNA, 57 bp, Artificial Sequence
  Description of Artificial Sequence: Synthetic probe
acggactcggacaccctacttgctcagtttgacatgtctttggcagcaaaacaaatg

SEQ ID NO: 2412 - DNA, 57 bp, Artificial Sequence
  Description of Artificial Sequence: Synthetic probe
tcgagggtggcgtaccgtacgtgaccacgaaaacggactcggacaccctacttgctc

SEQ ID NO: 2413 - DNA, 60 bp, Artificial Sequence
  Description of Artificial Sequence: Synthetic probe
gcccgacgtttctgcgcttcgagggtggcgtaccgtacgtgaccacgaaaacggactcgg

SEQ ID NO: 2414 - DNA, 60 bp, Artificial Sequence
  Description of Artificial Sequence: Synthetic probe
gtttatgggaaagtgttcaaccccccccgcaaccagttgccggggcgttttaccaacctc

SEQ ID NO: 2415 - DNA, 60 bp, Artificial Sequence
  Description of Artificial Sequence: Synthetic probe
tggtggcctggtgaccacggacccgaagacggctgaccccgtttatgggaaagtgttcaa

SEQ ID NO: 2416 - DNA, 60 bp, Artificial Sequence
  Description of Artificial Sequence: Synthetic probe
gcgacggctatggtggcctggtgaccacggacccgaagacggctgaccccgtttatggga

SEQ ID NO: 2417 - DNA, 60 bp, Artificial Sequence
  Description of Artificial Sequence: Synthetic probe
cttgacaccactcaggaccgccgtaaacaggagattatagcacctgaaaagcagacactg

SEQ ID NO: 2418 - DNA, 60 bp, Artificial Sequence
  Description of Artificial Sequence: Synthetic probe
atctcaattccttcccaaaaatccgtgttgtactttctcattgagaaaggccagcacgag

SEQ ID NO: 2419 - DNA, 60 bp, Artificial Sequence
  Description of Artificial Sequence: Synthetic probe
ctcgtcatcttttcgcagagaagtatgacaagatcatgttggacggtagagccatgacag

SEQ ID NO: 2420 - DNA, 60 bp, Artificial Sequence
  Description of Artificial Sequence: Synthetic probe
cctacctcgtgcctcgtcatcttttcgcagagaagtatgacaagatcatgttggacggtc

SEQ ID NO: 2421 - DNA, 60 bp, Artificial Sequence
  Description of Artificial Sequence: Synthetic probe
cgaccgacaggtataaaaccccgttggtgaaacccgagaaacaactgtgcaacttcgacc

SEQ ID NO: 2422 - DNA, 60 bp, Artificial Sequence
  Description of Artificial Sequence: Synthetic probe
tgaggtatgtgcacacgaccgacaggtataaaaccccgttggtgaaacccgagaaacaac

SEQ ID NO: 2423 - DNA, 59 bp, Artificial Sequence
  Description of Artificial Sequence: Synthetic probe
ggagactgttgtgcgacaagggtgaagtgtactaccgcatgaagcgtgccgagctctac

SEQ ID NO: 2424 - DNA, 53 bp, Artificial Sequence
  Description of Artificial Sequence: Synthetic probe
ggtgacctggccacactgtctcagcgcgttgagaatgaaaccacaagatgcat

SEQ ID NO: 2425 - DNA, 60 bp, Artificial Sequence
  Description of Artificial Sequence: Synthetic probe
attgtaagtacagcaaaacccaacgcgtgcagccgcgccggggtgacctggccacactgt

SEQ ID NO: 2426 - DNA, 60 bp, Artificial Sequence
  Description of Artificial Sequence: Synthetic probe
acaacggcaattgtaagtacagcaaaacccaacgcgtgcagccgcgccggggtgacctgg

SEQ ID NO: 2427 - DNA, 60 bp, Artificial Sequence
  Description of Artificial Sequence: Synthetic probe
ccctacaccgctccgcacggtgttttggcaactgtctacaacggcaattgtaagtacagc

SEQ ID NO: 2428 - DNA, 60 bp, Artificial Sequence
  Description of Artificial Sequence: Synthetic probe
tcgtttcgcattgccctacaccgctccgcacggtgttttggcaactgtctacaacggcaa

SEQ ID NO: 2429 - DNA, 60 bp, Artificial Sequence
  Description of Artificial Sequence: Synthetic probe
ggaagttactggtcttgaactacacgagggtggaccgcccgctcttgtcatttggaacat

SEQ ID NO: 2430 - DNA, 60 bp, Artificial Sequence
  Description of Artificial Sequence: Synthetic probe
cctgggtgcccaacggctcacccaaagatgctctagacaaccagaccaacccaactgcct

SEQ ID NO: 2431 - DNA, 60 bp, Artificial Sequence
  Description of Artificial Sequence: Synthetic probe
cacctgggtgcccaacggctcacccaaagatgctctagacaaccagaccaacccaactgc

SEQ ID NO: 2432 - DNA, 60 bp, Artificial Sequence
  Description of Artificial Sequence: Synthetic probe
gtgagacccacatcccgacaacattcaactacgggatgatctacacacaggcagaagtgg

SEQ ID NO: 2433 - DNA, 60 bp, Artificial Sequence
  Description of Artificial Sequence: Synthetic probe
aagcaagtactctacaactggtggtggtagaaggggtgacctgggacctcttgcggcgcg

SEQ ID NO: 2434 - DNA, 60 bp, Artificial Sequence
  Description of Artificial Sequence: Synthetic probe
taagcaagtactctacaactggtggtggtagaaggggtgacctgggacctctcgcggcgc

SEQ ID NO: 2435 - DNA, 60 bp, Artificial Sequence
  Description of Artificial Sequence: Synthetic probe
aacggagtaaacaagtactctacaactggtggtggtagaaggggtgacctgggacctctt

SEQ ID NO: 2436 - DNA, 60 bp, Artificial Sequence
  Description of Artificial Sequence: Synthetic probe
aacggagtaagcaagtactctacaactggtggtggtagaaggggtgacctgggacctctc

SEQ ID NO: 2437 - DNA, 60 bp, Artificial Sequence
  Description of Artificial Sequence: Synthetic probe
gaccgctgttggcagtagaggtgtcttcacaagacagacacaaacagaagatcattgcac

SEQ ID NO: 2438 - DNA, 60 bp, Artificial Sequence
  Description of Artificial Sequence: Synthetic probe
ggcattttcctgaaagggcaagagcatgccgtgttcgcctgtgtcacctccaatgggtgg

SEQ ID NO: 2439 - DNA, 60 bp, Artificial Sequence
  Description of Artificial Sequence: Synthetic probe
gctggcattttcctgaaagggcaagagcatgccgtgttcgcctgtgtcacctccaaaggg

SEQ ID NO: 2440 - DNA, 60 bp, Artificial Sequence
  Description of Artificial Sequence: Synthetic probe
acttccacgctggcattttcctgaaagggcaagagcatgccgtgttcgcctgtgtcacct

SEQ ID NO: 2441 - DNA, 60 bp, Artificial Sequence
  Description of Artificial Sequence: Synthetic probe
atttccacgctggcattttcctgaaagggcaagagcatgccgtgttcgcctgtgtcacct

SEQ ID NO: 2442 - DNA, 60 bp, Artificial Sequence
  Description of Artificial Sequence: Synthetic probe
gccttcaagcgcctgaaggaaaactttgagattgttgccctgtgtttgacccttttggca

SEQ ID NO: 2443 - DNA, 58 bp, Artificial Sequence
  Description of Artificial Sequence: Synthetic probe
aaaacgtgtgggatgtggactattcggcctttgatgctaaccactgcagtgacgcgat

SEQ ID NO: 2444 - DNA, 51 bp, Artificial Sequence
  Description of Artificial Sequence: Synthetic probe
caagaaccattggacgttgactggcaggaccgcgctggtctgttcctccgc

SEQ ID NO: 2445 - DNA, 60 bp, Artificial Sequence
  Description of Artificial Sequence: Synthetic probe
caccagcacacgccccagcgagatctgtgtgatcaacggggttgtcttgaccctagctga

SEQ ID NO: 2446 - DNA, 60 bp, Artificial Sequence
  Description of Artificial Sequence: Synthetic probe
cggcgttggcaccagcacacgccccagcgagatctgtgtgatcaacggggttgtcttgac

SEQ ID NO: 2447 - DNA, 60 bp, Artificial Sequence
  Description of Artificial Sequence: Synthetic probe
tgcactcgtgctctggctcatcaaggactgtcttcagaccggcgttggcaccagcacacg

SEQ ID NO: 2448 - DNA, 60 bp, Artificial Sequence
  Description of Artificial Sequence: Synthetic probe
ggtgggccacctgcactcgtgctctggctcatcaaggactgtcttcagaccggcgttggc

SEQ ID NO: 2449 - DNA, 60 bp, Artificial Sequence
  Description of Artificial Sequence: Synthetic probe
cagctttctgattacaccaagcttgacctctccgacggtgggccacctgcactcgtgctc

SEQ ID NO: 2450 - DNA, 60 bp, Artificial Sequence
  Description of Artificial Sequence: Synthetic probe
tggacatgatcagacagctttctgattacaccaagcttgacctctccgacggtgggccac

SEQ ID NO: 2451 - DNA, 60 bp, Artificial Sequence
  Description of Artificial Sequence: Synthetic probe
cgatgagccgctctttgagccagagtatctgtcaccagagaacaagacactggacatgat

SEQ ID NO: 2452 - DNA, 60 bp, Artificial Sequence
  Description of Artificial Sequence: Synthetic probe
ccacagactccggcacacgttcaaagcagaaaggaaaatggaattcacactttacaacgg

SEQ ID NO: 2453 - DNA, 60 bp, Artificial Sequence
  Description of Artificial Sequence: Synthetic probe
ttcgagatcttccacagactccggcacacgttcaaagcagaaaggaaaatggaattcaca

SEQ ID NO: 2454 - DNA, 60 bp, Artificial Sequence
  Description of Artificial Sequence: Synthetic probe
gacctcatgcaaatgccctcacacacgctggttggagcactgcttcggtctgcgacgtac

SEQ ID NO: 2455 - DNA, 60 bp, Artificial Sequence
  Description of Artificial Sequence: Synthetic probe
tctcccggcctatcaacacggtaaccgggacaggttcgacgcgcccattggcgtcgagaa

SEQ ID NO: 2456 - DNA, 60 bp, Artificial Sequence
  Description of Artificial Sequence: Synthetic probe
tctcccggcctaccaacacggtatccgggacaggttcgacgcgcccattggcgtcgagaa

SEQ ID NO: 2457 - DNA, 60 bp, Artificial Sequence
  Description of Artificial Sequence: Synthetic probe
gacgtttactacaggatgaagcgagcagagctgtattgtccaaggccacttctcccggcc

SEQ ID NO: 2458 - DNA, 60 bp, Artificial Sequence
  Description of Artificial Sequence: Synthetic probe
gccgaccaaccggttgacgtttactacaggatgaagcgagcagagctgtattgtccaagg

SEQ ID NO: 2459 - DNA, 60 bp, Artificial Sequence
  Description of Artificial Sequence: Synthetic probe
ccgaatccaggcacacgcttccatccacgttcaactttggacatgtgaccgccgaccaac

SEQ ID NO: 2460 - DNA, 60 bp, Artificial Sequence
  Description of Artificial Sequence: Synthetic probe
gttcgccatcccctacactgcaccacaccggttgcttgcgactgtgtacaacggtgagtg

SEQ ID NO: 2461 - DNA, 60 bp, Artificial Sequence
  Description of Artificial Sequence: Synthetic probe
gtcactaggttcgccatcccctacactgcaccacaccggttgcttgcgactgtgtacaac

SEQ ID NO: 2462 - DNA, 60 bp, Artificial Sequence
  Description of Artificial Sequence: Synthetic probe
gttactaggttcgccatcccctacactgcaccacaccggttgcttgcgactgtgtacaac

SEQ ID NO: 2463 - DNA, 60 bp, Artificial Sequence
  Description of Artificial Sequence: Synthetic probe
gccgtggacctcatggacaccaaagagaaggcgttggtaggtgccgttttgagatcagca

SEQ ID NO: 2464 - DNA, 60 bp, Artificial Sequence
  Description of Artificial Sequence: Synthetic probe
acggctgggttgtagtcttgcaggtcacagacactcactccgccgaggcagcagtagtgg

SEQ ID NO: 2465 - DNA, 60 bp, Artificial Sequence
  Description of Artificial Sequence: Synthetic probe
cagacgagtgacctgccaaggacacctgaggacgctgcgcactgctaccactctgaatgg

SEQ ID NO: 2466 - DNA, 60 bp, Artificial Sequence
  Description of Artificial Sequence: Synthetic probe
aggtccacaagaacacgtacctggctgggctcgccgactactacacacagtactccggca

SEQ ID NO: 2467 - DNA, 60 bp, Artificial Sequence
  Description of Artificial Sequence: Synthetic probe
gcggaaccgtcgaggtttacgcaaacatagccccaaccaacgtctacgtggccggtgaat

SEQ ID NO: 2468 - DNA, 60 bp, Artificial Sequence
  Description of Artificial Sequence: Synthetic probe
gcgcaacgggtgggatgttcaggtcagtgccaccagcacacagttcaacggaggttcact

SEQ ID NO: 2469 - DNA, 60 bp, Artificial Sequence
  Description of Artificial Sequence: Synthetic probe
ggagcagggcaatcaagtccggcgaccggatcgcagaaccaatctggcaacaccggcagc

SEQ ID NO: 2470 - DNA, 60 bp, Artificial Sequence
  Description of Artificial Sequence: Synthetic probe
gcacccacaaagcaaacactgaattttgacctactcaagttggcaggagacgtggagtcc

SEQ ID NO: 2471 - DNA, 60 bp, Artificial Sequence
  Description of Artificial Sequence: Synthetic probe
ggcacccacaaagcaaacactgaattttgacctactcaagttggcaggagacgtggagtc

SEQ ID NO: 2472 - DNA, 60 bp, Artificial Sequence
  Description of Artificial Sequence: Synthetic probe
gtggcacccacaaagcagacattgaattttgacctactcaagttggcaggagacgtggag

SEQ ID NO: 2473 - DNA, 60 bp, Artificial Sequence
  Description of Artificial Sequence: Synthetic probe
ttgtggcacccacaaagcagacattgaattttgacctactcaagttggcaggagacgtgg

SEQ ID NO: 2474 - DNA, 60 bp, Artificial Sequence
  Description of Artificial Sequence: Synthetic probe
cggaactctactgtccgcggcctctcctcacacactacgaccacgctggtaaagatcgct

SEQ ID NO: 2475 - DNA, 60 bp, Artificial Sequence
  Description of Artificial Sequence: Synthetic probe
cggaactttactgtccgcggcctcttctcacacactacgaccacgctggtaaagatcgct

SEQ ID NO: 2476 - DNA, 60 bp, Artificial Sequence
  Description of Artificial Sequence: Synthetic probe
ccgctggcacaaccccgcgcacgaacatccgcggggacctcgcaagtcttgcagagagga

SEQ ID NO: 2477 - DNA, 60 bp, Artificial Sequence
  Description of Artificial Sequence: Synthetic probe
gaggctgagtgggcaactgcccacctccttcaactacggcgctgtaaaggctgacaccat

SEQ ID NO: 2478 - DNA, 60 bp, Artificial Sequence
  Description of Artificial Sequence: Synthetic probe
gccattcacccgagcgaagctagacacaaacaaaagattgtggcacctgtgaaacagctt

SEQ ID NO: 2479 - DNA, 59 bp, Artificial Sequence
  Description of Artificial Sequence: Synthetic probe
ttttgtcccgtacgatcaagaaccacttaatggagaatggaagatgaaggttcagaagc

SEQ ID NO: 2480 - DNA, 60 bp, Artificial Sequence
  Description of Artificial Sequence: Synthetic probe
cgtccgatgttctggtttttgtcccgtacgatcaagaaccacttaatggagaatggaaga

SEQ ID NO: 2481 - DNA, 60 bp, Artificial Sequence
  Description of Artificial Sequence: Synthetic probe
ggcaagagcatgctgtgttcgcctgtgtcacctccgatgggtggtacgcgattgatgacg

SEQ ID NO: 2482 - DNA, 60 bp, Artificial Sequence
  Description of Artificial Sequence: Synthetic probe
atcttcctgaaagggcaagagcatgctgtgttcgcctgtgtcacctccgatgggtggtac

SEQ ID NO: 2483 - DNA, 60 bp, Artificial Sequence
  Description of Artificial Sequence: Synthetic probe
ggaactcactggtcttgagctgcacgagggcggaccacctgctctcgtcatttggaacat

SEQ ID NO: 2484 - DNA, 60 bp, Artificial Sequence
  Description of Artificial Sequence: Synthetic probe
aggaactcactggtcttgagctgcacgagggcggaccacctgctctcgtcatttggaaca

SEQ ID NO: 2485 - DNA, 60 bp, Artificial Sequence
  Description of Artificial Sequence: Synthetic probe
ctgagaacctcactcttgaggcgatcaaacaattggaggaactcactggtcttgagctgc

SEQ ID NO: 2486 - DNA, 60 bp, Artificial Sequence
  Description of Artificial Sequence: Synthetic probe
ggtttatgattcacctgagaacctcactcttgaggcgatcaaacaattggaggaactcac

SEQ ID NO: 2487 - DNA, 60 bp, Artificial Sequence
  Description of Artificial Sequence: Synthetic probe
ttattcagatatgtcgatgaaccattcttcgactgggtttatgattcacctgagaacctc

SEQ ID NO: 2488 - DNA, 60 bp, Artificial Sequence
  Description of Artificial Sequence: Synthetic probe
aacaccatccttcagttattcagatatgtcgatgaaccattcttcgactgggtttatgat

SEQ ID NO: 2489 - DNA, 56 bp, Artificial Sequence
  Description of Artificial Sequence: Synthetic probe
ttttcgctcacggacacaaggagagatggaattcacactctacaacggtgagaaaa

SEQ ID NO: 2490 - DNA, 60 bp, Artificial Sequence
  Description of Artificial Sequence: Synthetic probe
caaaacactttttcgctcacggacacaaggagagatggaattcacactctacaacggtga

SEQ ID NO: 2491 - DNA, 51 bp, Artificial Sequence
  Description of Artificial Sequence: Synthetic probe
tgaatacgactgactgttttatcgctctgttatacgctatcagagagatca

SEQ ID NO: 2492 - DNA, 60 bp, Artificial Sequence
  Description of Artificial Sequence: Synthetic probe
atgaatacgactgactgttttatcgctctgttatacgctatcagagagatcaaaacactt

SEQ ID NO: 2493 - DNA, 60 bp, Artificial Sequence
  Description of Artificial Sequence: Synthetic probe
gagctttactgcccacgcccgttgctcaccaggtacgaacacggtgggaaagaccgctac

SEQ ID NO: 2494 - DNA, 57 bp, Artificial Sequence
  Description of Artificial Sequence: Synthetic probe
acgggcggagctttactgcccacgcccgttgctcaccaggtacgaacacggtgagaa

SEQ ID NO: 2495 - DNA, 60 bp, Artificial Sequence
  Description of Artificial Sequence: Synthetic probe
aggatgaagcgggcggagctttactgcccacgcccgttgctcaccaggtacgaacacggt

SEQ ID NO: 2496 - DNA, 60 bp, Artificial Sequence
  Description of Artificial Sequence: Synthetic probe
actgcaagtacaggccagctgaccaagccccgcgaaccaacattcgcggagatctcgcga

SEQ ID NO: 2497 - DNA, 60 bp, Artificial Sequence
  Description of Artificial Sequence: Synthetic probe
cttctcacgcaacggtgccactcgctttgctctgccttacactgccccgcacaggtgcct

SEQ ID NO: 2498 - DNA, 60 bp, Artificial Sequence
  Description of Artificial Sequence: Synthetic probe
cttctcacacaacggtgccactcgctttgctctgccttacactgccccgcacaggtgcct

SEQ ID NO: 2499 - DNA, 60 bp, Artificial Sequence
  Description of Artificial Sequence: Synthetic probe
cgtcttctcacacaacggtgccactcgctttgctctgccttacactgccccgcacaggtg

SEQ ID NO: 2500 - DNA, 60 bp, Artificial Sequence
  Description of Artificial Sequence: Synthetic probe
cgtcttctcacgcaacggtgccactcgctttgctctgccttacactgccccgcacaggtg

SEQ ID NO: 2501 - DNA, 60 bp, Artificial Sequence
  Description of Artificial Sequence: Synthetic probe
caacccagtcgtcttctcacacaacggtgccactcgctttgctctgccttacactgcccc

SEQ ID NO: 2502 - DNA, 60 bp, Artificial Sequence
  Description of Artificial Sequence: Synthetic probe
gaatgaggtgggcgacaacccagtcgtcttctcacacaacggtgccactcgctttgctct

SEQ ID NO: 2503 - DNA, 60 bp, Artificial Sequence
  Description of Artificial Sequence: Synthetic probe
gcgagacacacatcccaaccactttcaattacggcaggatctacacagaggcggaagtcg

SEQ ID NO: 2504 - DNA, 60 bp, Artificial Sequence
  Description of Artificial Sequence: Synthetic probe
ccagcgagacacacatcccaaccactttcaattacggcaggatctacacagaggcggaag

SEQ ID NO: 2505 - DNA, 60 bp, Artificial Sequence
  Description of Artificial Sequence: Synthetic probe
tccgcggggacctcgcgacactcgccgcgcgcatcgccagcgagacacacatcccaacca

SEQ ID NO: 2506 - DNA, 60 bp, Artificial Sequence
  Description of Artificial Sequence: Synthetic probe
gcccccgacccacgtccgcggggacctcgcgacactcgccgcgcgcatcgccagcgagac

SEQ ID NO: 2507 - DNA, 60 bp, Artificial Sequence
  Description of Artificial Sequence: Synthetic probe
gcactgccatacactgccccacacaggtgccttgccactacctacaacggtaactgcaag

SEQ ID NO: 2508 - DNA, 60 bp, Artificial Sequence
  Description of Artificial Sequence: Synthetic probe
gatttgcactgccatacactgccccacacaggtgccttgccactacctacaacggtaact

SEQ ID NO: 2509 - DNA, 60 bp, Artificial Sequence
  Description of Artificial Sequence: Synthetic probe
tctctcacaacgggaccacccgatttgcactgccatacactgccccacacaggtgccttg

SEQ ID NO: 2510 - DNA, 60 bp, Artificial Sequence
  Description of Artificial Sequence: Synthetic probe
ggttggttggacaccgaatggtgctccagaacttagtgaagtgggcgacaacccagtcgt

SEQ ID NO: 2511 - DNA, 60 bp, Artificial Sequence
  Description of Artificial Sequence: Synthetic probe
tgggttggttggacaccgaatggtgctccagaacttagtgaagtgggcgacaacccagtc

SEQ ID NO: 2512 - DNA, 60 bp, Artificial Sequence
  Description of Artificial Sequence: Synthetic probe
gttggtacgaacaagtgggttggttggacaccgaatggtgctccagaacttagtgaagtg

SEQ ID NO: 2513 - DNA, 60 bp, Artificial Sequence
  Description of Artificial Sequence: Synthetic probe
tgcctgcgttggcacgcacaaacgtgtttactggcagcccaatggcgcaccacgcacaat

SEQ ID NO: 2514 - DNA, 60 bp, Artificial Sequence
  Description of Artificial Sequence: Synthetic probe
tgcacagaggctgagtgggcaactgcccacctccttcaactacggcgctgtaaaggctga

SEQ ID NO: 2515 - DNA, 60 bp, Artificial Sequence
  Description of Artificial Sequence: Synthetic probe
cgtggtgaccgtgctgtcctggcagcaaagtactctaacaccaagcacacgcttccgtcc

SEQ ID NO: 2516 - DNA, 60 bp, Artificial Sequence
  Description of Artificial Sequence: Synthetic probe
atccgtggtgaccgtgctgtcctggcagcaaagtactctaacaccaagcacacgcttccg

SEQ ID NO: 2517 - DNA, 54 bp, Artificial Sequence
  Description of Artificial Sequence: Synthetic probe
acactgcacctcaccgcctgctctcaactgtttacaacggtgaatgtgagtata

SEQ ID NO: 2518 - DNA, 54 bp, Artificial Sequence
  Description of Artificial Sequence: Synthetic probe
acactgcaccccaccgcctgctctcaactgtttacaacggtgaatgtgaatata

SEQ ID NO: 2519 - DNA, 60 bp, Artificial Sequence
  Description of Artificial Sequence: Synthetic probe
tctcgagcaacggtgtcactaggttcgctgtgccatacactgcacctcaccgcctgctct

SEQ ID NO: 2520 - DNA, 60 bp, Artificial Sequence
  Description of Artificial Sequence: Synthetic probe
caacccaatggttttctcgagcaacggtgtcactaggttcgctgtgccatacactgcacc

SEQ ID NO: 2521 - DNA, 60 bp, Artificial Sequence
  Description of Artificial Sequence: Synthetic probe
gagctcggggacaacccaatggttttctcgagcaacggtgtcactaggttcgctgtgcca

SEQ ID NO: 2522 - DNA, 60 bp, Artificial Sequence
  Description of Artificial Sequence: Synthetic probe
ctagaaccacagagctcggggacaacccaatggttttctcgagcaacggtgtcactaggt

SEQ ID NO: 2523 - DNA, 60 bp, Artificial Sequence
  Description of Artificial Sequence: Synthetic probe
cgtgtactggcaacctaacggcgcgcctagaaccacagtgctcggagacaacccaatggt

SEQ ID NO: 2524 - DNA, 60 bp, Artificial Sequence
  Description of Artificial Sequence: Synthetic probe
cgcgtgtactggcaacctaacggcgcgcctagaaccacagtgctcggagacaacccaatg

SEQ ID NO: 2525 - DNA, 60 bp, Artificial Sequence
  Description of Artificial Sequence: Synthetic probe
cgcgtgtactggcaacctaacggcgcgcctagaaccacagagctcggggacaacccaatg

SEQ ID NO: 2526 - DNA, 60 bp, Artificial Sequence
  Description of Artificial Sequence: Synthetic probe
cacgcaggaatcttcctgaaaggtactgaacacgctgtgtttgcctgtctgacctccaac

SEQ ID NO: 2527 - DNA, 60 bp, Artificial Sequence
  Description of Artificial Sequence: Synthetic probe
gactgttttatcgttttggtacaggctatcagagagattaaacttctgctcaaaggttca

SEQ ID NO: 2528 - DNA, 60 bp, Artificial Sequence
  Description of Artificial Sequence: Synthetic probe
caacgggaactgcaagtacggtgatggttcggtgaccaacataagaggtgacctacaggt

SEQ ID NO: 2529 - DNA, 60 bp, Artificial Sequence
  Description of Artificial Sequence: Synthetic probe
cggcttgcattgccgtacacggcaccacaccgtgtgttggcaaccgtttacaacgggaac

SEQ ID NO: 2530 - DNA, 60 bp, Artificial Sequence
  Description of Artificial Sequence: Synthetic probe
aaggcaccactcacccggcttgcattgccgtacacggcaccacaccgtgtgttggcaacc

SEQ ID NO: 2531 - DNA, 60 bp, Artificial Sequence
  Description of Artificial Sequence: Synthetic probe
gtactaccgcatgaagcgcgctgagctttactgcccccgcccgctccgggtgaggtacac

SEQ ID NO: 2532 - DNA, 60 bp, Artificial Sequence
  Description of Artificial Sequence: Synthetic probe
gggtgcccgcacaccgacagagtggaggacaacccagttgttcactcgaaaggttcagtc

SEQ ID NO: 2533 - DNA, 60 bp, Artificial Sequence
  Description of Artificial Sequence: Synthetic probe
tgggtgcccaacgggtgcccgcacaccgacagagtggaggacaacccagttgttcactcg

SEQ ID NO: 2534 - DNA, 60 bp, Artificial Sequence
  Description of Artificial Sequence: Synthetic probe
tgggtgcccaatggatgcccacacaccgacagagtggaggacaacccagttgttcactcg

SEQ ID NO: 2535 - DNA, 60 bp, Artificial Sequence
  Description of Artificial Sequence: Synthetic probe
gagacggcaccacacggatgttggcttcatcatggacagatttgtgaagataaacagcct

SEQ ID NO: 2536 - DNA, 60 bp, Artificial Sequence
  Description of Artificial Sequence: Synthetic probe
cccccgtccggtgttaactcactatgaccacaaagggcgcgaccgctacaaagtggccct

SEQ ID NO: 2537 - DNA, 60 bp, Artificial Sequence
  Description of Artificial Sequence: Synthetic probe
cggggaccttgcagtgctcgctgagcgcatcgccagtgagacgcacatcccaactacctt

SEQ ID NO: 2538 - DNA, 53 bp, Artificial Sequence
  Description of Artificial Sequence: Synthetic probe
ttggcgagaacaagtgggtcggctggacgcctaatggcgcgccagagctcagt

SEQ ID NO: 2539 - DNA, 60 bp, Artificial Sequence
  Description of Artificial Sequence: Synthetic probe
cgttcttacttgaccggttcaccctggtcgggaagacccaaaacaacagactgacactgg

SEQ ID NO: 2540 - DNA, 60 bp, Artificial Sequence
  Description of Artificial Sequence: Synthetic probe
aatcagcccatcccgccagaccacatcggcgggcgagggcgcggatccagtgaccaccga

SEQ ID NO: 2541 - DNA, 60 bp, Artificial Sequence
  Description of Artificial Sequence: Synthetic probe
tcagtccagggttgggtgggtgtctaccagatcacggacactcacgagaaggacggtgca

SEQ ID NO: 2542 - DNA, 60 bp, Artificial Sequence
  Description of Artificial Sequence: Synthetic probe
cacagtgccgtacgtgtcagcggcggactttgcctacacctactctgatgagcctgaaca

SEQ ID NO: 2543 - DNA, 60 bp, Artificial Sequence
  Description of Artificial Sequence: Synthetic probe
atcccaccgggcacacacccactgcccaacacgccagagatggcatcgcactgctaccac

SEQ ID NO: 2544 - DNA, 60 bp, Artificial Sequence
  Description of Artificial Sequence: Synthetic probe
gcttttggacacaaaaacctaaagaatacctacatgtctggcctcgcccagtactacacg

SEQ ID NO: 2545 - DNA, 60 bp, Artificial Sequence
  Description of Artificial Sequence: Synthetic probe
ccgcgaggaccgccttgcctggcaggttcaccaacctgttggacgtggctgaagcgtgcc

SEQ ID NO: 2546 - DNA, 60 bp, Artificial Sequence
  Description of Artificial Sequence: Synthetic probe
acccaccaacgtgtatgttgccggagagaggcccgtgaaacaaggcatcatccctgtggc

SEQ ID NO: 2547 - DNA, 60 bp, Artificial Sequence
  Description of Artificial Sequence: Synthetic probe
tgctccatacacaaatgaccagacaattggatcaacaaaggctgaggtctacgtcaacat

SEQ ID NO: 2548 - DNA, 60 bp, Artificial Sequence
  Description of Artificial Sequence: Synthetic probe
cccacggactaacaccacggcacacatccaggtaccgtacctgggcgtcgaccggcatga

SEQ ID NO: 2549 - DNA, 60 bp, Artificial Sequence
  Description of Artificial Sequence: Synthetic probe
taccaactcacgcttttcccacaccaatttctcaacccacggactaacaccacggcacac

SEQ ID NO: 2550 - DNA, 60 bp, Artificial Sequence
  Description of Artificial Sequence: Synthetic probe
ggtggttgtctcctggtggccatggtacctgagctttgcaaattgacagacagggagaag

SEQ ID NO: 2551 - DNA, 60 bp, Artificial Sequence
  Description of Artificial Sequence: Synthetic probe
aacgggtgggacgtgcaagtgtctgcaactgccacgcagttcaacggtggttgtctcctg

SEQ ID NO: 2552 - DNA, 56 bp, Artificial Sequence
  Description of Artificial Sequence: Synthetic probe
ggcgtgacctgcgggtacgccgaggacgaccacttcctacccgggcccaacacaaa

SEQ ID NO: 2553 - DNA, 60 bp, Artificial Sequence
  Description of Artificial Sequence: Synthetic probe
ggcacaatctgctttcagtggtctggttggagcgctcttggctaacaagaaaacggaaga

SEQ ID NO: 2554 - DNA, 60 bp, Artificial Sequence
  Description of Artificial Sequence: Synthetic probe
tactacatgcagcaataccaaaactcaatggacacccaacttggagacaacgccattagt

SEQ ID NO: 2555 - DNA, 60 bp, Artificial Sequence
  Description of Artificial Sequence: Synthetic probe
gtggtgcgccacgaaggcaacctgacgtgggtgcccaacggggcaccagaggcagccctg

SEQ ID NO: 2556 - DNA, 60 bp, Artificial Sequence
  Description of Artificial Sequence: Synthetic probe
ggcgctgtaaaggctgataacatcactgagctcctgatccgcatgaaacgcgcggagacg

SEQ ID NO: 2557 - DNA, 60 bp, Artificial Sequence
  Description of Artificial Sequence: Synthetic probe
aatggggcgcccgagacagcgttggacaacaccaccaatccaacggcttaccacaaggca

SEQ ID NO: 2558 - DNA, 60 bp, Artificial Sequence
  Description of Artificial Sequence: Synthetic probe
tcccgaatggggcgcccgagacagcgttggacaacaccaccaatccaacggcttaccaca

SEQ ID NO: 2559 - DNA, 60 bp, Artificial Sequence
  Description of Artificial Sequence: Synthetic probe
aagaccacttctcccggcctacgaccacagtgaccgggacaggttcgacgcccccattgg

SEQ ID NO: 2560 - DNA, 60 bp, Artificial Sequence
  Description of Artificial Sequence: Synthetic probe
tactacaggatgaagcgggcggagctgtactgtccaagaccacttctcccggcctacgac

SEQ ID NO: 2561 - DNA, 60 bp, Artificial Sequence
  Description of Artificial Sequence: Synthetic probe
cagccggttgacgtttactacaggatgaagcgggcggagctgtactgtccaagaccactt

SEQ ID NO: 2562 - DNA, 60 bp, Artificial Sequence
  Description of Artificial Sequence: Synthetic probe
acggtgagtgtaaatacacagaccgggtttccgcaatccgcggtgaccgcgctgtgttgg

SEQ ID NO: 2563 - DNA, 60 bp, Artificial Sequence
  Description of Artificial Sequence: Synthetic probe
tactggcaacctaatggtgcgccacgcacaacacccctgggagacaaccccatggtgttc

SEQ ID NO: 2564 - DNA, 60 bp, Artificial Sequence
  Description of Artificial Sequence: Synthetic probe
acacgcgtgtttactggcaacctaatggtgcgccacgcacaacacccctgggagacaacc

SEQ ID NO: 2565 - DNA, 60 bp, Artificial Sequence
  Description of Artificial Sequence: Synthetic probe
gtggacctaatggacactaagcaacaggccctagtgggtgccctacttagggcgtcaacc

SEQ ID NO: 2566 - DNA, 60 bp, Artificial Sequence
  Description of Artificial Sequence: Synthetic probe
ggttcacccacgttcacaccaacaagaccaccttcagtgtggacctaatggacactaagc

SEQ ID NO: 2567 - DNA, 60 bp, Artificial Sequence
  Description of Artificial Sequence: Synthetic probe
tcgtgcttgacaggttcacccacgttcacaccaacaagaccaccttcagtgtggacctaa

SEQ ID NO: 2568 - DNA, 55 bp, Artificial Sequence
  Description of Artificial Sequence: Synthetic probe
agcggacgtcgttacgactgacccctcgacacacggcggaagtgtagtagagaag

SEQ ID NO: 2569 - DNA, 60 bp, Artificial Sequence
  Description of Artificial Sequence: Synthetic probe
accactagcgccggagagggagcggacgtcgttacgactgacccctcgacacacggcgga

SEQ ID NO: 2570 - DNA, 55 bp, Artificial Sequence
  Description of Artificial Sequence: Synthetic probe
caggtacgaacacggtgagaaagaccgctaccaagtagccctcaccaaacctgcc

SEQ ID NO: 2571 - DNA, 60 bp, Artificial Sequence
  Description of Artificial Sequence: Synthetic probe
aactatggtaggatctacaccgaggcggaagccgacgtgtacgtgaggatgaagcgggcg

SEQ ID NO: 2572 - DNA, 60 bp, Artificial Sequence
  Description of Artificial Sequence: Synthetic probe
ctttcaactatggtaggatctacaccgaggcggaagccgacgtgtatgtgaggatgaagc

SEQ ID NO: 2573 - DNA, 60 bp, Artificial Sequence
  Description of Artificial Sequence: Synthetic probe
caaccaccttcaactatggtaggatctacaccgaggcggaagccgacgtgtacgtgagga

SEQ ID NO: 2574 - DNA, 60 bp, Artificial Sequence
  Description of Artificial Sequence: Synthetic probe
aagaaccactcaacggggaatggaaagcaaaggttcagaaacgacttaagggggccggac

SEQ ID NO: 2575 - DNA, 60 bp, Artificial Sequence
  Description of Artificial Sequence: Synthetic probe
cctgaaaggacaagagcacgctgtgtttgcttgcgtcacctctgacgggtggtacgcgat

SEQ ID NO: 2576 - DNA, 60 bp, Artificial Sequence
  Description of Artificial Sequence: Synthetic probe
tcacgctggcatcttcctgaaaggacaagagcacgctgtgtttgcttgcgtcacctctga

SEQ ID NO: 2577 - DNA, 60 bp, Artificial Sequence
  Description of Artificial Sequence: Synthetic probe
cccagtgaagtgtgcatggtggacggtacggacatgtgtttggttgactttcacgctggc

SEQ ID NO: 2578 - DNA, 60 bp, Artificial Sequence
  Description of Artificial Sequence: Synthetic probe
ttggaacatcaagcacctgctccacaccggagtcggcactgcctcgcgccccagtgaagt

SEQ ID NO: 2579 - DNA, 60 bp, Artificial Sequence
  Description of Artificial Sequence: Synthetic probe
tttggaacatcaagcacctgctccacaccggagtcggcactgcctcgcgccccagtgaag

SEQ ID NO: 2580 - DNA, 60 bp, Artificial Sequence
  Description of Artificial Sequence: Synthetic probe
cgcccgagaacctcactcttttgttaattaggcagttggaagatattactggtcttgagc

SEQ ID NO: 2581 - DNA, 60 bp, Artificial Sequence
  Description of Artificial Sequence: Synthetic probe
gtctacgagtcgcccgagaacctcactcttttgttaattaggcagttggaagatattact

SEQ ID NO: 2582 - DNA, 58 bp, Artificial Sequence
  Description of Artificial Sequence: Synthetic probe
ttttatcgctttgctgcacgccaccagagagatcaaaacactgtttctttcacgaaac

SEQ ID NO: 2583 - DNA, 60 bp, Artificial Sequence
  Description of Artificial Sequence: Synthetic probe
ctcaaacaaggaccgctaccgagtggccctcattaagcctgccaaacaaatgtgcaactt

SEQ ID NO: 2584 - DNA, 60 bp, Artificial Sequence
  Description of Artificial Sequence: Synthetic probe
tactgtcctcggcctcttcttacacactacgaccactcaaacaaggaccgctaccgagtg

SEQ ID NO: 2585 - DNA, 60 bp, Artificial Sequence
  Description of Artificial Sequence: Synthetic probe
aagagagcagaactctactgtcctcggcctcttcttacacactacgaccactcaaacaag

SEQ ID NO: 2586 - DNA, 60 bp, Artificial Sequence
  Description of Artificial Sequence: Synthetic probe
attacgggatgatttacacacaggcagaggtggacgtctacctgaggatgaagagagcag

SEQ ID NO: 2587 - DNA, 60 bp, Artificial Sequence
  Description of Artificial Sequence: Synthetic probe
tacaaacccactggcaccgcgccccgcggaaacatccgcggtgaccttgcaaccttggct

SEQ ID NO: 2588 - DNA, 60 bp, Artificial Sequence
  Description of Artificial Sequence: Synthetic probe
aacccagtcgttttctcacacggaggcacaacccgcttcgccttcccttacaccgcaccc

SEQ ID NO: 2589 - DNA, 60 bp, Artificial Sequence
  Description of Artificial Sequence: Synthetic probe
caacccagtcgttttctcacacggaggcacaacccgcttcgccttcccttacaccgcacc

SEQ ID NO: 2590 - DNA, 60 bp, Artificial Sequence
  Description of Artificial Sequence: Synthetic probe
ggtgtctaccagcattggaaaagtttcgacctgacgtcggagaagaagaagggcccgggg

SEQ ID NO: 2591 - DNA, 60 bp, Artificial Sequence
  Description of Artificial Sequence: Synthetic probe
gacgtggagctcaaccccgggcccttcttcttctccgacgtcaggtcgaacttttccaag

SEQ ID NO: 2592 - DNA, 60 bp, Artificial Sequence
  Description of Artificial Sequence: Synthetic probe
gcaaacagaagatcattgcacctgggaagcaggctctgaactttgacctactcaagttgg

SEQ ID NO: 2593 - DNA, 60 bp, Artificial Sequence
  Description of Artificial Sequence: Synthetic probe
tggatcaacagctcagctgatggtgtcagcctgcacagccccgtagttgaaggaggtggg

SEQ ID NO: 2594 - DNA, 60 bp, Artificial Sequence
  Description of Artificial Sequence: Synthetic probe
acccacctccttcaactacggggctgtgcaggctgacaccatcactgagctgttgatccg

SEQ ID NO: 2595 - DNA, 60 bp, Artificial Sequence
  Description of Artificial Sequence: Synthetic probe
aacagctcagctgatggtgtcagcctgcacagccccgtagttgaaggaggtgggtagcct

SEQ ID NO: 2596 - DNA, 60 bp, Artificial Sequence
  Description of Artificial Sequence: Synthetic probe
ggcaaacatagtgatcatgatccgcgagactcgcaggagacagcagatggtggatgatgc

SEQ ID NO: 2597 - DNA, 60 bp, Artificial Sequence
  Description of Artificial Sequence: Synthetic probe
ggcaaacatagtgatcatgatccgcgagactcgcaagagacagcagatggtggatgatgc

SEQ ID NO: 2598 - DNA, 60 bp, Artificial Sequence
  Description of Artificial Sequence: Synthetic probe
tcttctagcaaacatagtgatcatgatccgcgagactcgcaagagacagcagatggtgga

SEQ ID NO: 2599 - DNA, 60 bp, Artificial Sequence
  Description of Artificial Sequence: Synthetic probe
caatcactgagttgctcgtgcgcatgaagcgtgctgaactctattgtcctaggccgattc

SEQ ID NO: 2600 - DNA, 60 bp, Artificial Sequence
  Description of Artificial Sequence: Synthetic probe
gaaacaatcactgagttgctcgtgcgcatgaagcgtgctgaactctattgtcctaggccg

SEQ ID NO: 2601 - DNA, 60 bp, Artificial Sequence
  Description of Artificial Sequence: Synthetic probe
agaaacaatcactgagttgctcgtgcgcatgaagcgtgctgaactctattgtcctaggcc

SEQ ID NO: 2602 - DNA, 60 bp, Artificial Sequence
  Description of Artificial Sequence: Synthetic probe
gtgaaacgcgcagaactctactgtccgcgccctctcttgacacactacgaccacaacggc

SEQ ID NO: 2603 - DNA, 60 bp, Artificial Sequence
  Description of Artificial Sequence: Synthetic probe
gcgacccttgcgcagaggattgctagtgagacacacatccctaccacttttaactacggc

SEQ ID NO: 2604 - DNA, 60 bp, Artificial Sequence
  Description of Artificial Sequence: Synthetic probe
accttgcgacccttgcgcagaggattgctagtgagacacacatccctaccacttttaact

SEQ ID NO: 2605 - DNA, 60 bp, Artificial Sequence
  Description of Artificial Sequence: Synthetic probe
aaatatgcacccactggcacagccccacgcgagaacatccgcggggaccttgcgaccctt

SEQ ID NO: 2606 - DNA, 60 bp, Artificial Sequence
  Description of Artificial Sequence: Synthetic probe
ctgtaaatatgcacccactggcacagccccacgcgagaacatccgcggggaccttgcgac

SEQ ID NO: 2607 - DNA, 60 bp, Artificial Sequence
  Description of Artificial Sequence: Synthetic probe
gccccacacaggtgtcttgcaacaacttacaatggtaactgtaaatatgcacccactggc

SEQ ID NO: 2608 - DNA, 60 bp, Artificial Sequence
  Description of Artificial Sequence: Synthetic probe
ttgccatacaccgccccacacaggtgtcttgcaacaacttacaatggtaactgtaaatat

SEQ ID NO: 2609 - DNA, 60 bp, Artificial Sequence
  Description of Artificial Sequence: Synthetic probe
tcggcgacaacccagtcgtcttctccacacaaaaagtcgcccgatttgcattgccataca

SEQ ID NO: 2610 - DNA, 60 bp, Artificial Sequence
  Description of Artificial Sequence: Synthetic probe
ctgccctcggcccctgaaggtgagatacactcacaccactgaccggtacaagaccaagct

SEQ ID NO: 2611 - DNA, 60 bp, Artificial Sequence
  Description of Artificial Sequence: Synthetic probe
gctctgccttacacagcaccgcacagtgttcttgcaacagtctataatggcaactgcaaa

SEQ ID NO: 2612 - DNA, 60 bp, Artificial Sequence
  Description of Artificial Sequence: Synthetic probe
ttgctctgccttacacagcaccgcacagtgttcttgcaacagtctataatggcaactgca

SEQ ID NO: 2613 - DNA, 60 bp, Artificial Sequence
  Description of Artificial Sequence: Synthetic probe
acaccccagcacacacttgtaggtgccttgcttcgcgcggccacgtactacttctctgac

SEQ ID NO: 2614 - DNA, 60 bp, Artificial Sequence
  Description of Artificial Sequence: Synthetic probe
acaccccagcacacacttgtgggtgccttgcttcgcgcggccacgtactacttctctgac

SEQ ID NO: 2615 - DNA, 60 bp, Artificial Sequence
  Description of Artificial Sequence: Synthetic probe
gcagacaccccagcacacacttgtgggtgccttgcttcgcgcggccacgtactacttctc

SEQ ID NO: 2616 - DNA, 60 bp, Artificial Sequence
  Description of Artificial Sequence: Synthetic probe
attgacctcacgcagacaccccagcacacacttgtgggtgccttgcttcgcgcggccacg

SEQ ID NO: 2617 - DNA, 60 bp, Artificial Sequence
  Description of Artificial Sequence: Synthetic probe
attgacctcacgcagacaccccagcacacacttgtaggtgccttgcttcgcgcggccacg

SEQ ID NO: 2618 - DNA, 60 bp, Artificial Sequence
  Description of Artificial Sequence: Synthetic probe
aacaacgtgtgtacagggatgggtctgtgtgtaccaaatcacccacggtaaggcagacgc

SEQ ID NO: 2619 - DNA, 60 bp, Artificial Sequence
  Description of Artificial Sequence: Synthetic probe
aggctgaaacaacgtgtgtacagggatgggtctgtgtgtaccaaatcacccacggtaagg

SEQ ID NO: 2620 - DNA, 60 bp, Artificial Sequence
  Description of Artificial Sequence: Synthetic probe
accagttcatcaacccacgcaccaacatgacggcacacatcaccgtgcgatacgtgggtg

SEQ ID NO: 2621 - DNA, 60 bp, Artificial Sequence
  Description of Artificial Sequence: Synthetic probe
actgttggttgaacaccatcctccagttgtttaggtacgttgatgagcccttcttcgact

SEQ ID NO: 2622 - DNA, 60 bp, Artificial Sequence
  Description of Artificial Sequence: Synthetic probe
actgttggttaaacaccatcctccagttgtttaggtacgttgatgaacccttcttcgact

SEQ ID NO: 2623 - DNA, 60 bp, Artificial Sequence
  Description of Artificial Sequence: Synthetic probe
cacacactttgccgtcaaccttcaacttcgggtttgtgaccgtcgacaacccagtcgatg

SEQ ID NO: 2624 - DNA, 60 bp, Artificial Sequence
  Description of Artificial Sequence: Synthetic probe
tagcaacacgcacactttgccgtcaaccttcaacttcgggtttgtgaccgtcgacaaccc

SEQ ID NO: 2625 - DNA, 60 bp, Artificial Sequence
  Description of Artificial Sequence: Synthetic probe
gtacgctggcaacacacacactttgccgtcaaccttcaacttcgggtttgtgaccgtcga

SEQ ID NO: 2626 - DNA, 60 bp, Artificial Sequence
  Description of Artificial Sequence: Synthetic probe
cagagtgaacaaccggctgcccacctccttcaactacggtgcggtgaaggccgatgccat

SEQ ID NO: 2627 - DNA, 50 bp, Artificial Sequence
  Description of Artificial Sequence: Synthetic probe
ccactcaggaccgccgtaagcaggagatcattgcacctgagaagcaactt

SEQ ID NO: 2628 - DNA, 60 bp, Artificial Sequence
  Description of Artificial Sequence: Synthetic probe
cacacactaccctccaccttcaacttcggattcgtgacggcagacaaaccagtcaacgtc

SEQ ID NO: 2629 - DNA, 60 bp, Artificial Sequence
  Description of Artificial Sequence: Synthetic probe
tttggcaacctaacggggcgccgcgcactacgcagttgggtgacaacccgatggtgtttg

SEQ ID NO: 2630 - DNA, 60 bp, Artificial Sequence
  Description of Artificial Sequence: Synthetic probe
ttctgtgacctggaggtcgcatgcgtgggagaccacgcacgggtcttttggcaacctaac

SEQ ID NO: 2631 - DNA, 60 bp, Artificial Sequence
  Description of Artificial Sequence: Synthetic probe
ctacttctgtgacctggaggtcgcatgcgtgggagaccacgcacgggtcttttggcaacc

SEQ ID NO: 2632 - DNA, 60 bp, Artificial Sequence
  Description of Artificial Sequence: Synthetic probe
aaaacctcttttgccgtggacctcatggacaccaaagagaaggcgttggtaggtgccgtc

SEQ ID NO: 2633 - DNA, 60 bp, Artificial Sequence
  Description of Artificial Sequence: Synthetic probe
cacgtgcacaccaacaaaacctcttttgccgtggacctcatggacaccaaagagaaggcg

SEQ ID NO: 2634 - DNA, 52 bp, Artificial Sequence
  Description of Artificial Sequence: Synthetic probe
ctcacggagggcatcccaacgccgcccgccgcaagcacacggacatcgcctt

SEQ ID NO: 2635 - DNA, 60 bp, Artificial Sequence
  Description of Artificial Sequence: Synthetic probe
ggtgtgcatggtagacggtactgacatgtgtcttgctgatttccacgcaggaattttcct

SEQ ID NO: 2636 - DNA, 60 bp, Artificial Sequence
  Description of Artificial Sequence: Synthetic probe
gctcggcatttgccgacatcgttcaactttggtgcacttaaggcagaaacaatcactgag

SEQ ID NO: 2637 - DNA, 60 bp, Artificial Sequence
  Description of Artificial Sequence: Synthetic probe
acgcatgctcggcatttgccgacatcgttcaactttggtgcacttaaggcagaaacaatc

SEQ ID NO: 2638 - DNA, 60 bp, Artificial Sequence
  Description of Artificial Sequence: Synthetic probe
tacacggaggcggaagtcgacgtgtacgtgagaatgaagcgggcggagctctactgccct

SEQ ID NO: 2639 - DNA, 60 bp, Artificial Sequence
  Description of Artificial Sequence: Synthetic probe
aacaacttcctgcctcttttaactacggtgcaatcagggccgacaccatccacgagcttc

SEQ ID NO: 2640 - DNA, 60 bp, Artificial Sequence
  Description of Artificial Sequence: Synthetic probe
gaaacaacttcctgcctcttttaactacggtgcaatcagggccgacaccatccacgagct

SEQ ID NO: 2641 - DNA, 60 bp, Artificial Sequence
  Description of Artificial Sequence: Synthetic probe
gcgaaacaacttcctgcctcttttaactacggtgcaatcagggccgacaccatccacgag

SEQ ID NO: 2642 - DNA, 60 bp, Artificial Sequence
  Description of Artificial Sequence: Synthetic probe
cacaaacagaagatcattgcacctgcaaaacaacttttgaactttgatttgctcaagttg

SEQ ID NO: 2643 - DNA, 57 bp, Artificial Sequence
  Description of Artificial Sequence: Synthetic probe
cacgctcccgtccactttcaactttgggcacgtcaccgctgacgcgagtgttgacgt

SEQ ID NO: 2644 - DNA, 60 bp, Artificial Sequence
  Description of Artificial Sequence: Synthetic probe
cacgctcccgtccactttcaactttgggcacgtcaccgctgacgcgagtgttgacgtgta

SEQ ID NO: 2645 - DNA, 60 bp, Artificial Sequence
  Description of Artificial Sequence: Synthetic probe
gaccgcgctgtcctggcagcaaagtactccaacaccaaacacacgctcccgtccactttc

SEQ ID NO: 2646 - DNA, 60 bp, Artificial Sequence
  Description of Artificial Sequence: Synthetic probe
atccgcggtgaccgcgctgtcctggcagcaaagtactccaacaccaaacacacgctcccg

SEQ ID NO: 2647 - DNA, 60 bp, Artificial Sequence
  Description of Artificial Sequence: Synthetic probe
actgtctacaatggtgagtgcacatacacagtgcccgtcgctgctatccgcggtgaccgc

SEQ ID NO: 2648 - DNA, 60 bp, Artificial Sequence
  Description of Artificial Sequence: Synthetic probe
tttcaactgtctacaatggtgagtgcacatacacagtgcccgtcgctgctatccgcggtg

SEQ ID NO: 2649 - DNA, 60 bp, Artificial Sequence
  Description of Artificial Sequence: Synthetic probe
gtttgctgtgccgtacactgcaccccaccgcttgctttcaactgtctacaatggtgagtg

SEQ ID NO: 2650 - DNA, 60 bp, Artificial Sequence
  Description of Artificial Sequence: Synthetic probe
caagggtgttactaggtttgctgtgccgtacactgcaccccaccgcttgctttcaactgt

SEQ ID NO: 2651 - DNA, 51 bp, Artificial Sequence
  Description of Artificial Sequence: Synthetic probe
tgcacagaggctgagcgggcaactgcccacctccttcaactacggcgctgt

SEQ ID NO: 2652 - DNA, 53 bp, Artificial Sequence
  Description of Artificial Sequence: Synthetic probe
tcatcttttcgctgagaagtatgacaagatcatgttggacgggcgagccctga

SEQ ID NO: 2653 - DNA, 60 bp, Artificial Sequence
  Description of Artificial Sequence: Synthetic probe
atgtgaccgccgaccaaccagtcgacgtctactacaggatgaagcgggcggagctgtact

SEQ ID NO: 2654 - DNA, 60 bp, Artificial Sequence
  Description of Artificial Sequence: Synthetic probe
ggacatgtgaccgccgaccaaccagtcgacgtctactacaggatgaagcgggcggagctg

SEQ ID NO: 2655 - DNA, 60 bp, Artificial Sequence
  Description of Artificial Sequence: Synthetic probe
cgtgtacaacggtgagtgcaggtacacagacaaggttaccgcaattcgcggcgaccgtgc

SEQ ID NO: 2656 - DNA, 60 bp, Artificial Sequence
  Description of Artificial Sequence: Synthetic probe
tgctcgcgaccgtgtacaacggtgagtgcaggtacacagacaaggttaccgcaattcgcg

SEQ ID NO: 2657 - DNA, 60 bp, Artificial Sequence
  Description of Artificial Sequence: Synthetic probe
ccacaacggcgtcaccaggtttgccataccctacactgcaccgcaccggttgctcgcgac

SEQ ID NO: 2658 - DNA, 60 bp, Artificial Sequence
  Description of Artificial Sequence: Synthetic probe
acacacaaacgtgtctattggcagcctaacggcgcgccacgcacaacagtcctgggagac

SEQ ID NO: 2659 - DNA, 60 bp, Artificial Sequence
  Description of Artificial Sequence: Synthetic probe
gcacacacaaacgtgtctattggcagcctaacggcgcgccacgcacaacagtcctgggag

SEQ ID NO: 2660 - DNA, 53 bp, Artificial Sequence
  Description of Artificial Sequence: Synthetic probe
agacggatgcacacagatgttgcgttcgtgctcgacaggtttacccatgttca

SEQ ID NO: 2661 - DNA, 57 bp, Artificial Sequence
  Description of Artificial Sequence: Synthetic probe
accaccagcgccggagagggtgcggacgttgttacgaccgacccctcgacacacggc

SEQ ID NO: 2662 - DNA, 60 bp, Artificial Sequence
  Description of Artificial Sequence: Synthetic probe
acgacatctgctggcgaaggcgctgatgtcgtgactactgacccctccacacacggagga

SEQ ID NO: 2663 - DNA, 60 bp, Artificial Sequence
  Description of Artificial Sequence: Synthetic probe
cgtgagcttcttgttcgtatgaaacgggccgaactctactgccccagaccacttctggca

SEQ ID NO: 2664 - DNA, 60 bp, Artificial Sequence
  Description of Artificial Sequence: Synthetic probe
acgtgagcttcttgttcgtatgaaacgggccgaactctactgccccagaccacttctggc

SEQ ID NO: 2665 - DNA, 60 bp, Artificial Sequence
  Description of Artificial Sequence: Synthetic probe
acgcgagcttcttgtgcgcatgaaacgggccgaactctactgccccagaccactgctggc

SEQ ID NO: 2666 - DNA, 60 bp, Artificial Sequence
  Description of Artificial Sequence: Synthetic probe
cgtgcgcatgaagcgagccgaactctactgccctagaccacttttggcaatagaggtgtc

SEQ ID NO: 2667 - DNA, 60 bp, Artificial Sequence
  Description of Artificial Sequence: Synthetic probe
cttctcgtgcgcatgaagcgagccgaactctactgccctagaccacttttggcaatagag

SEQ ID NO: 2668 - DNA, 60 bp, Artificial Sequence
  Description of Artificial Sequence: Synthetic probe
taaaggctgacaccattactgagcttttgatccgcatgaaacgcgcggagacatactgcc

SEQ ID NO: 2669 - DNA, 60 bp, Artificial Sequence
  Description of Artificial Sequence: Synthetic probe
cagcttcgcgacaaccctatggtgttctcacacaacaacgtcacacgctttgctgtcccg

SEQ ID NO: 2670 - DNA, 60 bp, Artificial Sequence
  Description of Artificial Sequence: Synthetic probe
ggacaacccagcttcgcgacaaccctatggtgttctcacacaacaacgtcacacgctttg

SEQ ID NO: 2671 - DNA, 60 bp, Artificial Sequence
  Description of Artificial Sequence: Synthetic probe
tctacacagaggcggaagtcgacgtgtacgtgaggatgaaacgggcggagctctactgcc

SEQ ID NO: 2672 - DNA, 60 bp, Artificial Sequence
  Description of Artificial Sequence: Synthetic probe
ggatctacacagaggcggaagtcgacgtgtacgtgaggatgaaacgggcggagctctact

SEQ ID NO: 2673 - DNA, 60 bp, Artificial Sequence
  Description of Artificial Sequence: Synthetic probe
gcggtggaggtctcgtcgcaagacagacacaaacagaagatcattgcaccagcaaaacaa

SEQ ID NO: 2674 - DNA, 60 bp, Artificial Sequence
  Description of Artificial Sequence: Synthetic probe
gcggtggaggtctcgtcgcaagacagacacaaacagaagatcattgcaccagcaaaacag

SEQ ID NO: 2675 - DNA, 50 bp, Artificial Sequence
  Description of Artificial Sequence: Synthetic probe
aagagccactcaatggaggatggaaggccaacgttcagcgaaagctcaag

SEQ ID NO: 2676 - DNA, 60 bp, Artificial Sequence
  Description of Artificial Sequence: Synthetic probe
gccagacccgtctgatgtcctggtatttgttccgtacgatcaagagccactcaatggagg

SEQ ID NO: 2677 - DNA, 60 bp, Artificial Sequence
  Description of Artificial Sequence: Synthetic probe
cccatggacgccagacccgtctgatgtcctggtatttgttccgtacgatcaagagccact

SEQ ID NO: 2678 - DNA, 60 bp, Artificial Sequence
  Description of Artificial Sequence: Synthetic probe
ctactcaagggacaggaacacgctgtgtttgcgtgtgtcacctccaacggttggtacgca

SEQ ID NO: 2679 - DNA, 60 bp, Artificial Sequence
  Description of Artificial Sequence: Synthetic probe
ggcattctactcaagggacaggaacacgctgtgtttgcgtgtgtcacctccaacggttgg

SEQ ID NO: 2680 - DNA, 60 bp, Artificial Sequence
  Description of Artificial Sequence: Synthetic probe
ggacggtacggacatgtgtcttgctgactttcatgcaggcattctactcaagggacagga

SEQ ID NO: 2681 - DNA, 60 bp, Artificial Sequence
  Description of Artificial Sequence: Synthetic probe
aggtgtgtatggtggacggtacggacatgtgtcttgctgactttcatgcaggcattctac

SEQ ID NO: 2682 - DNA, 56 bp, Artificial Sequence
  Description of Artificial Sequence: Synthetic probe
agcaactggaggaactcacagggttggagttgcgcgagggtggaccgcccgccttg

SEQ ID NO: 2683 - DNA, 60 bp, Artificial Sequence
  Description of Artificial Sequence: Synthetic probe
ggctgttttatcgctgtggtcaacgctatcagagagataagagcacttttcctaccacgg

SEQ ID NO: 2684 - DNA, 60 bp, Artificial Sequence
  Description of Artificial Sequence: Synthetic probe
atgaatacaactggctgttttatcgctgtggtcaacgctatcagagagataagagcactt

SEQ ID NO: 2685 - DNA, 60 bp, Artificial Sequence
  Description of Artificial Sequence: Synthetic probe
acctggccgtcttggccgctcgcgtcgctgaggagactcacatcccgaccactttcaact

SEQ ID NO: 2686 - DNA, 60 bp, Artificial Sequence
  Description of Artificial Sequence: Synthetic probe
agagagatccgcggtgacctggccgtcttggccgctcgcgtcgctgaggagactcacatc

SEQ ID NO: 2687 - DNA, 60 bp, Artificial Sequence
  Description of Artificial Sequence: Synthetic probe
agagagatccgcggtgacatggccgtcttggccgctcgcgtcgctgaggagactcacatc

SEQ ID NO: 2688 - DNA, 60 bp, Artificial Sequence
  Description of Artificial Sequence: Synthetic probe
gagagatccgtggtgacctggccgtcttggccgctcgcgtcgctgaggagactcacatcc

SEQ ID NO: 2689 - DNA, 60 bp, Artificial Sequence
  Description of Artificial Sequence: Synthetic probe
tccctacaccgccccccaccgtgtactggcgacagtgtacaacgggaggacgacgtacgg

SEQ ID NO: 2690 - DNA, 60 bp, Artificial Sequence
  Description of Artificial Sequence: Synthetic probe
cccctacactgccccccaccgtgtactggcgacagtgtacaacgggaggacgacgtacgg

SEQ ID NO: 2691 - DNA, 60 bp, Artificial Sequence
  Description of Artificial Sequence: Synthetic probe
cccctacacggccccccaccgtgtactggcgacagtgtacaacgggaagactacgtacgg

SEQ ID NO: 2692 - DNA, 60 bp, Artificial Sequence
  Description of Artificial Sequence: Synthetic probe
acccgctctcgtcatttggaacatcaagcacttgtcccacaccggaatcggcattgcctc

SEQ ID NO: 2693 - DNA, 60 bp, Artificial Sequence
  Description of Artificial Sequence: Synthetic probe
gcccgctctcgtcatttggaacatcaagcacttgctccacaccggcatcggcatggcctc

SEQ ID NO: 2694 - DNA, 60 bp, Artificial Sequence
  Description of Artificial Sequence: Synthetic probe
ccgcccgctctcgtcatttggaacatcaagcacttgctccacaccggaatcggcactgct

SEQ ID NO: 2695 - DNA, 60 bp, Artificial Sequence
  Description of Artificial Sequence: Synthetic probe
tgcacgagggtggcccgcccgctctcgtcatttggaacatcaagcacttgctccacaccg

SEQ ID NO: 2696 - DNA, 60 bp, Artificial Sequence
  Description of Artificial Sequence: Synthetic probe
ggaccgctaccgagtggccctcattaagcctgccaaacaaatgtgcaacttcgacctgtt

SEQ ID NO: 2697 - DNA, 60 bp, Artificial Sequence
  Description of Artificial Sequence: Synthetic probe
ggaccgctaccaagtggccctcgtcaagcctgccaaacaaatgtgcaacttcgacctgtt

SEQ ID NO: 2698 - DNA, 60 bp, Artificial Sequence
  Description of Artificial Sequence: Synthetic probe
cagcccagtgctgagtgaggtgggcgacaacccagtcgttttctcacacaagggcacaac

SEQ ID NO: 2699 - DNA, 60 bp, Artificial Sequence
  Description of Artificial Sequence: Synthetic probe
cccaacggcagcccagtgctgagtgaggtgggcgacaacccagtcgttttctcacacgga

SEQ ID NO: 2700 - DNA, 60 bp, Artificial Sequence
  Description of Artificial Sequence: Synthetic probe
actcccaacggcagcccagtgctgagtgaggtgggcgacaacccagtcgttttctcacac

SEQ ID NO: 2701 - DNA, 60 bp, Artificial Sequence
  Description of Artificial Sequence: Synthetic probe
tggactcccaacggcagcccagtgctgagtgaggtgggcgacaacccagtcgttttctca

SEQ ID NO: 2702 - DNA, 60 bp, Artificial Sequence
  Description of Artificial Sequence: Synthetic probe
gccaggcacaaacaaaagattgtggcacctgtgaaacagcttctgaacttcgacctgctc

SEQ ID NO: 2703 - DNA, 54 bp, Artificial Sequence
  Description of Artificial Sequence: Synthetic probe
aacacgccgtgttcgcctgtttgacctccgacggatggtacgccattgacgacg

SEQ ID NO: 2704 - DNA, 60 bp, Artificial Sequence
  Description of Artificial Sequence: Synthetic probe
gaattttcctgaagggtactgaacacgccgtgttcgcctgtttgacctccgacggatggt

SEQ ID NO: 2705 - DNA, 60 bp, Artificial Sequence
  Description of Artificial Sequence: Synthetic probe
tataccggcatcggcactgcctcacgacccagtgaggtgtgcatggtagacggtactgac

SEQ ID NO: 2706 - DNA, 60 bp, Artificial Sequence
  Description of Artificial Sequence: Synthetic probe
atcaaacacttgctctataccggcatcggcactgcctcacgacccagtgaggtgtgcatg

SEQ ID NO: 2707 - DNA, 60 bp, Artificial Sequence
  Description of Artificial Sequence: Synthetic probe
cactcttcaagcaattgaacagctggaggaactcacaggacttgagttgcacgagggcgg

SEQ ID NO: 2708 - DNA, 60 bp, Artificial Sequence
  Description of Artificial Sequence: Synthetic probe
caactgactgttttatcgctttggtacaggctatcagagagattaaatcattgttcagaa

SEQ ID NO: 2709 - DNA, 60 bp, Artificial Sequence
  Description of Artificial Sequence: Synthetic probe
aacggtgactgcaagtacaaacccactggcacacctccgcgtgaaaacatccgcggagat

SEQ ID NO: 2710 - DNA, 60 bp, Artificial Sequence
  Description of Artificial Sequence: Synthetic probe
gcctacaacggtgactgcaagtacaaacccactggcacagctccacgcgaaaacattcgt

SEQ ID NO: 2711 - DNA, 60 bp, Artificial Sequence
  Description of Artificial Sequence: Synthetic probe
gccacgtactacttctctgacctggagattgtggtgagccacgcaggcaacctaacatgg

SEQ ID NO: 2712 - DNA, 56 bp, Artificial Sequence
  Description of Artificial Sequence: Synthetic probe
accgctacaaagtgccgctcaccaagccagagaaacaactagcaaacttcgaccag

SEQ ID NO: 2713 - DNA, 60 bp, Artificial Sequence
  Description of Artificial Sequence: Synthetic probe
gcaaaagatcattgcacctgcaaagcagctcctgaacttcgacctgctcaagttggcggg

SEQ ID NO: 2714 - DNA, 60 bp, Artificial Sequence
  Description of Artificial Sequence: Synthetic probe
tagtgaggtgggcgacaacccagtcgtcttctccgctaatggcaccacccgttttgcact

SEQ ID NO: 2715 - DNA, 60 bp, Artificial Sequence
  Description of Artificial Sequence: Synthetic probe
ctgggctagagttgcacgagggtggaccccccgctctcgtgatttggaacatcaaacact

SEQ ID NO: 2716 - DNA, 60 bp, Artificial Sequence
  Description of Artificial Sequence: Synthetic probe
agaacgtgctcgcgtacgtgccctacgaccaagaacctctggacgtagattggcaggacc

SEQ ID NO: 2717 - DNA, 60 bp, Artificial Sequence
  Description of Artificial Sequence: Synthetic probe
ccccgagaacgtgctcgcgtacgtgccctacgaccaagaacctctggacgtagattggca

SEQ ID NO: 2718 - DNA, 60 bp, Artificial Sequence
  Description of Artificial Sequence: Synthetic probe
gtaccgaacacgcggtgttcgctctcaacacttccgagggctggtacgctattgatgatg

SEQ ID NO: 2719 - DNA, 60 bp, Artificial Sequence
  Description of Artificial Sequence: Synthetic probe
gcattttcatcaaaggtaccgaacacgcggtgttcgctctcaacacttccgagggctggt

SEQ ID NO: 2720 - DNA, 60 bp, Artificial Sequence
  Description of Artificial Sequence: Synthetic probe
cggagttgttatgactctggctgatttccatgccggcattttcatcaaaggtaccgaaca

SEQ ID NO: 2721 - DNA, 60 bp, Artificial Sequence
  Description of Artificial Sequence: Synthetic probe
gatctgtgtgatcaacggagttgttatgactctggctgatttccatgccggcattttcat

SEQ ID NO: 2722 - DNA, 60 bp, Artificial Sequence
  Description of Artificial Sequence: Synthetic probe
gtcttcaaactggaatcggcaccagcactcgccctagcgagatctgtgtgatcaacggag

SEQ ID NO: 2723 - DNA, 60 bp, Artificial Sequence
  Description of Artificial Sequence: Synthetic probe
atcaaagactgtcttcaaactggaatcggcaccagcactcgccctagcgagatctgtgtg

SEQ ID NO: 2724 - DNA, 60 bp, Artificial Sequence
  Description of Artificial Sequence: Synthetic probe
cagacggtgggccacccgcacttgtgctctggctcatcaaagactgtcttcaaactggaa

SEQ ID NO: 2725 - DNA, 60 bp, Artificial Sequence
  Description of Artificial Sequence: Synthetic probe
ccaaacttgacctttcagacggtgggccacccgcacttgtgctctggctcatcaaagact

SEQ ID NO: 2726 - DNA, 60 bp, Artificial Sequence
  Description of Artificial Sequence: Synthetic probe
cagctcttccgatacgtggatgagccgcttttcgagtctgagtatttgtcacctgagaac

SEQ ID NO: 2727 - DNA, 60 bp, Artificial Sequence
  Description of Artificial Sequence: Synthetic probe
gtactgtccacgccctcttctcccagcttatgaccacaaaaacagagacaggtttgacgc

SEQ ID NO: 2728 - DNA, 60 bp, Artificial Sequence
  Description of Artificial Sequence: Synthetic probe
gtcgacgtttactaccgcatgaaacgtgctgagttgtactgtccacgccctcttctccca

SEQ ID NO: 2729 - DNA, 60 bp, Artificial Sequence
  Description of Artificial Sequence: Synthetic probe
accgccgacaaaccagtcgacgtttactaccgcatgaaacgtgctgagttgtactgtcca

SEQ ID NO: 2730 - DNA, 60 bp, Artificial Sequence
  Description of Artificial Sequence: Synthetic probe
gacacgcgttgccttccactttcaacttcgggttcgtgaccgccgacaaaccagtcgacg

SEQ ID NO: 2731 - DNA, 60 bp, Artificial Sequence
  Description of Artificial Sequence: Synthetic probe
acgcgtcgaccagacacgcgttgccttccactttcaacttcgggttcgtgaccgccgaca

SEQ ID NO: 2732 - DNA, 60 bp, Artificial Sequence
  Description of Artificial Sequence: Synthetic probe
gcgccgcacagactgttgtccacagtttacaacggcgagtgtgactacaactcgaaggtg

SEQ ID NO: 2733 - DNA, 60 bp, Artificial Sequence
  Description of Artificial Sequence: Synthetic probe
gccattccattcactgcgccgcacagactgttgtccacagtttacaacggcgagtgtgac

SEQ ID NO: 2734 - DNA, 60 bp, Artificial Sequence
  Description of Artificial Sequence: Synthetic probe
tgtgggcgaccacaaatgcgtgttctggcagcccaacggcgccccgcgtaccgtgcagct

SEQ ID NO: 2735 - DNA, 60 bp, Artificial Sequence
  Description of Artificial Sequence: Synthetic probe
ttggagatcgcgtgtgtgggcgaccacaaatgcgtgttctggcagcccaacggcgccccg

SEQ ID NO: 2736 - DNA, 55 bp, Artificial Sequence
  Description of Artificial Sequence: Synthetic probe
gacctcatggacaccaaggagaaagcgctcgtcggggccatcctgagatcagcaa

SEQ ID NO: 2737 - DNA, 52 bp, Artificial Sequence
  Description of Artificial Sequence: Synthetic probe
cacacggatgttaccttcctgctcgaccgcagcacgcacgtccataccaaca

SEQ ID NO: 2738 - DNA, 60 bp, Artificial Sequence
  Description of Artificial Sequence: Synthetic probe
aacgtccgcgggagagggtgccgacgtggtcaccaccgatcccaccacccacggtggttc

SEQ ID NO: 2739 - DNA, 60 bp, Artificial Sequence
  Description of Artificial Sequence: Synthetic probe
acaacgtccgcgggagagggtgccgacgtggtcaccaccgatcccaccacccacggtggt

SEQ ID NO: 2740 - DNA, 54 bp, Artificial Sequence
  Description of Artificial Sequence: Synthetic probe
agcggatgcccgccgaccgacttgcaaaagatggtcatggcaaacgtgaagccc

SEQ ID NO: 2741 - DNA, 60 bp, Artificial Sequence
  Description of Artificial Sequence: Synthetic probe
gggctgagacatactgcccaatgcccttgctggcaattcacccgagtgaagctagacaca

SEQ ID NO: 2742 - DNA, 60 bp, Artificial Sequence
  Description of Artificial Sequence: Synthetic probe
cggtgccatcaaagcgaccggggtgactgaactgctttaccggatgaaaagggctgagac

SEQ ID NO: 2743 - DNA, 60 bp, Artificial Sequence
  Description of Artificial Sequence: Synthetic probe
cggaaactgcaagtacggcagtagccacgtggctaatgtgagaggcgatctgcaagtgtt

SEQ ID NO: 2744 - DNA, 60 bp, Artificial Sequence
  Description of Artificial Sequence: Synthetic probe
ataccaccaacccaacagcataccacaaggcgcccctcacccggcttgcactgccttaca

SEQ ID NO: 2745 - DNA, 60 bp, Artificial Sequence
  Description of Artificial Sequence: Synthetic probe
acacgaggggaacctcacttgggttccgaacggagcgcctgagaaagcactggacaatac

SEQ ID NO: 2746 - DNA, 60 bp, Artificial Sequence
  Description of Artificial Sequence: Synthetic probe
cttctacgcgcgtccacttactacttctctgacttggaagtggcggtgaaacacgagggg

SEQ ID NO: 2747 - DNA, 60 bp, Artificial Sequence
  Description of Artificial Sequence: Synthetic probe
ggaggacaggttgtggagaagagacgaatgcacaccgacgttgcgttcgtacttgacagg

SEQ ID NO: 2748 - DNA, 60 bp, Artificial Sequence
  Description of Artificial Sequence: Synthetic probe
acacggaggacaggttgtggagaagagacgaatgcacaccgacgttgcgttcgtacttga

SEQ ID NO: 2749 - DNA, 60 bp, Artificial Sequence
  Description of Artificial Sequence: Synthetic probe
cggtggtgagacacaggtccagagacgccaacacacggatgtctcgttcatattagacag

SEQ ID NO: 2750 - DNA, 60 bp, Artificial Sequence
  Description of Artificial Sequence: Synthetic probe
cggtggtgagacacaggtccagagacgccaacacacggatgtctctttcatattggacag

SEQ ID NO: 2751 - DNA, 60 bp, Artificial Sequence
  Description of Artificial Sequence: Synthetic probe
ctacggtggtgagacacaggtccagagacgccaacacacggatgtctctttcatattgga

SEQ ID NO: 2752 - DNA, 60 bp, Artificial Sequence
  Description of Artificial Sequence: Synthetic probe
ctacggtggtgagacacaggtccagagacgccaacacacggatgtctcgttcatattaga

SEQ ID NO: 2753 - DNA, 60 bp, Artificial Sequence
  Description of Artificial Sequence: Synthetic probe
atccacgagctcctcgtgcgcatgaagcgtgccgagctctactgccccaggccactgctg

SEQ ID NO: 2754 - DNA, 60 bp, Artificial Sequence
  Description of Artificial Sequence: Synthetic probe
ttcttgcaaaggacggagccgagactttcatcgtcggcacacactccgcgggaggcaatg

SEQ ID NO: 2755 - DNA, 60 bp, Artificial Sequence
  Description of Artificial Sequence: Synthetic probe
gttcttgcaaaggacggagccgagactttcatcgtcggcacacactccgcgggaggcaat

SEQ ID NO: 2756 - DNA, 60 bp, Artificial Sequence
  Description of Artificial Sequence: Synthetic probe
cggtggaggtctcgtctcacgacagacacaaacagaagatcattgcaccagcaaaacagc

SEQ ID NO: 2757 - DNA, 60 bp, Artificial Sequence
  Description of Artificial Sequence: Synthetic probe
ttctcgtgcgcatgaagcgtgccgaactctactgccctagaccactgttggcagaggagg

SEQ ID NO: 2758 - DNA, 60 bp, Artificial Sequence
  Description of Artificial Sequence: Synthetic probe
acgggtggtacgcgattgatgacgaggacttttacccctggacgccggacccgtccgacg

SEQ ID NO: 2759 - DNA, 56 bp, Artificial Sequence
  Description of Artificial Sequence: Synthetic probe
gacgtctacgtgcgcatgaagcgggcggagctttactgccctcgccccgtgttgac

SEQ ID NO: 2760 - DNA, 60 bp, Artificial Sequence
  Description of Artificial Sequence: Synthetic probe
agtggacgtccatgtgcgcatgaagcgggcggagctttactgccctcgccccgtgttgac

SEQ ID NO: 2761 - DNA, 60 bp, Artificial Sequence
  Description of Artificial Sequence: Synthetic probe
agtggacgtctatgtgcgcatgaagcgggcggagctttactgccctcgccccgtgttgac

SEQ ID NO: 2762 - DNA, 60 bp, Artificial Sequence
  Description of Artificial Sequence: Synthetic probe
ctgactgaagcagaagtggacgtctacgtgcgcatgaagcgggcggagctttactgccct

SEQ ID NO: 2763 - DNA, 60 bp, Artificial Sequence
  Description of Artificial Sequence: Synthetic probe
cgcttcgccctgcccttcaccgctccacaccgtgttctggcaacagtttacaacggtgat

SEQ ID NO: 2764 - DNA, 60 bp, Artificial Sequence
  Description of Artificial Sequence: Synthetic probe
tagaggtgtcttcacaagacaggcacaagcaaaagatcattgcacccgcaaaacagttgc

SEQ ID NO: 2765 - DNA, 60 bp, Artificial Sequence
  Description of Artificial Sequence: Synthetic probe
gcaatagaggtgtcttcacaagacaggcacaagcaaaagatcattgcacctgcaagacag

SEQ ID NO: 2766 - DNA, 60 bp, Artificial Sequence
  Description of Artificial Sequence: Synthetic probe
ttctcctggacaggtcaacccacgttcacaccgggaagaccacattcgaggtcaacttga

SEQ ID NO: 2767 - DNA, 60 bp, Artificial Sequence
  Description of Artificial Sequence: Synthetic probe
gagggcgcggacgtagtgacgaccgacccaaccacacacggtggggcagtcacaaacccg

SEQ ID NO: 2768 - DNA, 60 bp, Artificial Sequence
  Description of Artificial Sequence: Synthetic probe
accacatcggcgggcgagggcgcggacgtagtgacgaccgacccaaccacacacggtggg

SEQ ID NO: 2769 - DNA, 60 bp, Artificial Sequence
  Description of Artificial Sequence: Synthetic probe
ggcactggtgggcgcaatcctgcgttctgccacgtactacttctcggatctggaagttgc

SEQ ID NO: 2770 - DNA, 60 bp, Artificial Sequence
  Description of Artificial Sequence: Synthetic probe
tcagaccaaggagaaggcactggtgggcgcaatcctgcgttctgccacgtactacttctc

SEQ ID NO: 2771 - DNA, 60 bp, Artificial Sequence
  Description of Artificial Sequence: Synthetic probe
ggagacgtcgagtccaaccctgggcccttcttcttctctgacgtcaggtcaaatttttcc

SEQ ID NO: 2772 - DNA, 57 bp, Artificial Sequence
  Description of Artificial Sequence: Synthetic probe
ggagacgtcgagtccaaccctgggcccttcttcttctctgacgtcaggtcaaatttt

SEQ ID NO: 2773 - DNA, 60 bp, Artificial Sequence
  Description of Artificial Sequence: Synthetic probe
aagttggcaggagacgtcgagtccaaccctgggcccttcttcttctctgacgtcaggacg

SEQ ID NO: 2774 - DNA, 57 bp, Artificial Sequence
  Description of Artificial Sequence: Synthetic probe
tggtggtagaaggggcgacctggggtctcttgcggcgcgggtcgccgcacagctacc

SEQ ID NO: 2775 - DNA, 60 bp, Artificial Sequence
  Description of Artificial Sequence: Synthetic probe
gccagtcgacgtttacttccgtatgaagaggacggagctgtactgccctcgcgctctcct

SEQ ID NO: 2776 - DNA, 60 bp, Artificial Sequence
  Description of Artificial Sequence: Synthetic probe
cgcggcgacagagcagcgttagcagcaaaatatgctgacaccaagcactcactgccgtcc

SEQ ID NO: 2777 - DNA, 60 bp, Artificial Sequence
  Description of Artificial Sequence: Synthetic probe
acccagctgcgcgacaacccaatggtctttgcccacaacaacgtgacgcggtttgcactg

SEQ ID NO: 2778 - DNA, 60 bp, Artificial Sequence
  Description of Artificial Sequence: Synthetic probe
aaatcgcttgtgtgggtgaccaccagagagtcttctggcagcccaacggggccccgcgca

SEQ ID NO: 2779 - DNA, 60 bp, Artificial Sequence
  Description of Artificial Sequence: Synthetic probe
cgctccttcgatctgcgacctattacttctgtgacctggaaatcgcttgtgtgggtgacc

SEQ ID NO: 2780 - DNA, 60 bp, Artificial Sequence
  Description of Artificial Sequence: Synthetic probe
cacaccaataagaccacatttgagattaacctcatggacaccaacgacaagacactgata

SEQ ID NO: 2781 - DNA, 60 bp, Artificial Sequence
  Description of Artificial Sequence: Synthetic probe
tcagaccacgagtgcaggtgaaggtgctgatgttgtaaccacggacccgtcgacccacgg

SEQ ID NO: 2782 - DNA, 60 bp, Artificial Sequence
  Description of Artificial Sequence: Synthetic probe
ggtttcagtcagcgccggacctgacttggagttccgattcccgattgacccggtgcgtca

SEQ ID NO: 2783 - DNA, 60 bp, Artificial Sequence
  Description of Artificial Sequence: Synthetic probe
cccaatttacctttgctgtgccgtacgtctcggccagtgacttctcatacacccacactg

SEQ ID NO: 2784 - DNA, 60 bp, Artificial Sequence
  Description of Artificial Sequence: Synthetic probe
ccccgaggacgccgctcactgttaccactcggaatgggacacaggactgaattcccaatt

SEQ ID NO: 2785 - DNA, 55 bp, Artificial Sequence
  Description of Artificial Sequence: Synthetic probe
tacaccggtcccactcatcacaaagccaaattcatggtagcctacgttccacccg

SEQ ID NO: 2786 - DNA, 60 bp, Artificial Sequence
  Description of Artificial Sequence: Synthetic probe
tacacaggaacacctttctcgcggggcttgcggactactacacacagtattccggctcgc

SEQ ID NO: 2787 - DNA, 60 bp, Artificial Sequence
  Description of Artificial Sequence: Synthetic probe
ggcaacaaagtcatgaccgcgtttgatgtggcctttacacacaaggtacacaggaacacc

SEQ ID NO: 2788 - DNA, 60 bp, Artificial Sequence
  Description of Artificial Sequence: Synthetic probe
agcctgtcccacactgctcaactttgatgggaagccatacgtggtgaccgggaacagcgg

SEQ ID NO: 2789 - DNA, 60 bp, Artificial Sequence
  Description of Artificial Sequence: Synthetic probe
cgacccaaagacagcagaccccatttacgggcacgtgtacaacccgtctcgtgacggttg

SEQ ID NO: 2790 - DNA, 59 bp, Artificial Sequence
  Description of Artificial Sequence: Synthetic probe
tacgttgctggagagatgcccgcgaaacagggaatcttgccggtggcatgcgcggacgg

SEQ ID NO: 2791 - DNA, 60 bp, Artificial Sequence
  Description of Artificial Sequence: Synthetic probe
gatggtgttgacgcccctcacaaccgaggcgcagatgaactctggcactgtcgaggtgta

SEQ ID NO: 2792 - DNA, 60 bp, Artificial Sequence
  Description of Artificial Sequence: Synthetic probe
acccccaccagtttatcaacccgcggactaacaccaccgcgcacatccaggttccttacc

SEQ ID NO: 2793 - DNA, 60 bp, Artificial Sequence
  Description of Artificial Sequence: Synthetic probe
ccccgaactctgctcgcccagggaaagagaggagttccagctgactctttacccccacca

SEQ ID NO: 2794 - DNA, 60 bp, Artificial Sequence
  Description of Artificial Sequence: Synthetic probe
gcacactccacatcttagagttgcccaaggaccacaagggaatttacgggagcctgaccg

SEQ ID NO: 2795 - DNA, 60 bp, Artificial Sequence
  Description of Artificial Sequence: Synthetic probe
gcaagcagagaggttcttcaaggaaaagttgtttgactggacatctgacaaaccctttgg

SEQ ID NO: 2796 - DNA, 60 bp, Artificial Sequence
  Description of Artificial Sequence: Synthetic probe
acaacccgccacggtacaaccacctccactacgcagagctcagttggggtgacctacggt

SEQ ID NO: 2797 - DNA, 60 bp, Artificial Sequence
  Description of Artificial Sequence: Synthetic probe
cagaagagaccactctgcttgaggaccgtatcgtcacaacccgccacggtacaaccacct

SEQ ID NO: 2798 - DNA, 60 bp, Artificial Sequence
  Description of Artificial Sequence: Synthetic probe
tccacccacactaacaacacccagaacaatgactggtttaccaagcttgcacagtccgcc

SEQ ID NO: 2799 - DNA, 60 bp, Artificial Sequence
  Description of Artificial Sequence: Synthetic probe
ggtgacaacgccattagcggtggttccaatgagggtagcacagacacaacctccacccac

SEQ ID NO: 2800 - DNA, 60 bp, Artificial Sequence
  Description of Artificial Sequence: Synthetic probe
caacaactactacatgcaacaataccagaactccatggacacccaacttggtgacaacgc

SEQ ID NO: 2801 - DNA, 60 bp, Artificial Sequence
  Description of Artificial Sequence: Synthetic probe
ggagccggtcagtcgtcgcccgccactgggtcacagaaccagtccggtaacactggtagc

SEQ ID NO: 2802 - DNA, 60 bp, Artificial Sequence
  Description of Artificial Sequence: Synthetic probe
cgggtgagtcagctgaccccgtaaccactaccgttgagaactacggtggtgagacacagg

SEQ ID NO: 2803 - DNA, 60 bp, Artificial Sequence
  Description of Artificial Sequence: Synthetic probe
gccgtgccctgacagacagtgacttcagagtgtttgagtttgaggtgaaagtaaagggac

SEQ ID NO: 2804 - DNA, 53 bp, Artificial Sequence
  Description of Artificial Sequence: Synthetic probe
gcaacgggaagaagtcactgctcttgtgctgcgggggggggggccccctgctc

SEQ ID NO: 2805 - DNA, 60 bp, Artificial Sequence
  Description of Artificial Sequence: Synthetic probe
catcctacagttgttcaggtacgtcgataaacctttcttcgacggggtctacgactcgcc

SEQ ID NO: 2806 - DNA, 60 bp, Artificial Sequence
  Description of Artificial Sequence: Synthetic probe
agactttctactccgggcccaacaaccacgacaactgtggggtgaacaccatcctacagt

SEQ ID NO: 2807 - DNA, 60 bp, Artificial Sequence
  Description of Artificial Sequence: Synthetic probe
acaacggtgagaaaaagactttctactccgggcccaacaaccacgacaactgtggggtga

SEQ ID NO: 2808 - DNA, 60 bp, Artificial Sequence
  Description of Artificial Sequence: Synthetic probe
ggcactgtgcctttcacggagcacagggaaaagggaattcacactccacaacggtgagaa

SEQ ID NO: 2809 - DNA, 60 bp, Artificial Sequence
  Description of Artificial Sequence: Synthetic probe
atggacacgagggacggttttctcgctctgctgcacgccttcagagagaacaaggcactg

SEQ ID NO: 2810 - DNA, 60 bp, Artificial Sequence
  Description of Artificial Sequence: Synthetic probe
agtgcacgcggggatttggctcacctaaagacgacgcatgctcggcatttgccgacatcg

SEQ ID NO: 2811 - DNA, 60 bp, Artificial Sequence
  Description of Artificial Sequence: Synthetic probe
tacgacctacatcgccagtgcacgcggggatttggctcacctaaagacgacgcatgctcg

SEQ ID NO: 2812 - DNA, 60 bp, Artificial Sequence
  Description of Artificial Sequence: Synthetic probe
gcgtacactggcactacgacctacatcgccagtgcacgcggggatttggctcacctaaag

SEQ ID NO: 2813 - DNA, 54 bp, Artificial Sequence
  Description of Artificial Sequence: Synthetic probe
acttaacaacacaaccaatcccactgcctaccacaagggcccggtaactcgact

SEQ ID NO: 2814 - DNA, 60 bp, Artificial Sequence
  Description of Artificial Sequence: Synthetic probe
gccctgttgcgtgctgccacgtactacttctccgacctggagattgtggttcgtcacgac

SEQ ID NO: 2815 - DNA, 60 bp, Artificial Sequence
  Description of Artificial Sequence: Synthetic probe
cacgtgggtcccaaacggggctcctgagaccgcgctggacaacaccaccaacccaacagc

SEQ ID NO: 2816 - DNA, 60 bp, Artificial Sequence
  Description of Artificial Sequence: Synthetic probe
acccacgacattcaacttcgggagactgttgtgtgaaacaggcgaggtctactatcggat

SEQ ID NO: 2817 - DNA, 60 bp, Artificial Sequence
  Description of Artificial Sequence: Synthetic probe
ccataagatgcagacccacgacattcaacttcgggagactgttgtgtgatacaggtgacc

SEQ ID NO: 2818 - DNA, 60 bp, Artificial Sequence
  Description of Artificial Sequence: Synthetic probe
gtgttgagactgaaaccataagatgcagacccacgacattcaacttcgggagactgttgt

SEQ ID NO: 2819 - DNA, 60 bp, Artificial Sequence
  Description of Artificial Sequence: Synthetic probe
tattacaggatgaagcgtgctgaactgtactgccccaggccacttctcccggcttacgac

SEQ ID NO: 2820 - DNA, 60 bp, Artificial Sequence
  Description of Artificial Sequence: Synthetic probe
gaaggtccaagtgtcgggcaaccaacacacactggacattatgcagtcacacaaggacag

SEQ ID NO: 2821 - DNA, 60 bp, Artificial Sequence
  Description of Artificial Sequence: Synthetic probe
tgaccgttttgtgaaggtccaagtgtcgggcaaccaacacacactggacattatgcagtc

SEQ ID NO: 2822 - DNA, 60 bp, Artificial Sequence
  Description of Artificial Sequence: Synthetic probe
cgtcttctccgctaacggcaccacccgctttgcgctgccctacaccgcgccacacagatg

SEQ ID NO: 2823 - DNA, 60 bp, Artificial Sequence
  Description of Artificial Sequence: Synthetic probe
cggggcgacctagggcctctgggggcgagggtcgccgcacagcttcctgcctctttcaac

SEQ ID NO: 2824 - DNA, 60 bp, Artificial Sequence
  Description of Artificial Sequence: Synthetic probe
acaccgcgtgttggcaacagtgtacaacgggacgagcaagtactcgacaggtgcctcacc

SEQ ID NO: 2825 - DNA, 60 bp, Artificial Sequence
  Description of Artificial Sequence: Synthetic probe
tcgtgaaggttaacaccgtgggctccactcacgtcattgacctcacgcagacaccccagc

SEQ ID NO: 2826 - DNA, 60 bp, Artificial Sequence
  Description of Artificial Sequence: Synthetic probe
acacatgttcacacgaacaaaactacattcaacgtggacctcatggacaccaaggaaaag

SEQ ID NO: 2827 - DNA, 50 bp, Artificial Sequence
  Description of Artificial Sequence: Synthetic probe
ggggcacggatatgtgtttggctgactttcacgctggcatcttcctgaaa

SEQ ID NO: 2828 - DNA, 60 bp, Artificial Sequence
  Description of Artificial Sequence: Synthetic probe
aggtgtgcatggtggggggcacggatatgtgtttggctgactttcacgctggcatcttcc

SEQ ID NO: 2829 - DNA, 60 bp, Artificial Sequence
  Description of Artificial Sequence: Synthetic probe
cccacgacattcaacttcggaagattgttgtgtgatacaggtgaggtctactaccggatg

SEQ ID NO: 2830 - DNA, 58 bp, Artificial Sequence
  Description of Artificial Sequence: Synthetic probe
tcccgacaacattcaactacgggatgatctacacagaggcagaggtggacgtgtacct

SEQ ID NO: 2831 - DNA, 60 bp, Artificial Sequence
  Description of Artificial Sequence: Synthetic probe
aggagaatgcacactgatgttgcctttgtcatggacaggttcacccacgtccacaccaac

SEQ ID NO: 2832 - DNA, 60 bp, Artificial Sequence
  Description of Artificial Sequence: Synthetic probe
tcgtgcgcatgaagcgtgccgaactctactgccccagaccattgttggcagaggaggtct

SEQ ID NO: 2833 - DNA, 54 bp, Artificial Sequence
  Description of Artificial Sequence: Synthetic probe
ttggtcaagcctgaaaaacaactgtgcaacttcgacctgttgaagttggccgga

SEQ ID NO: 2834 - DNA, 50 bp, Artificial Sequence
  Description of Artificial Sequence: Synthetic probe
tgagctctactgcccacgcccgctttacgtgaagtacacccacacaaatg

SEQ ID NO: 2835 - DNA, 60 bp, Artificial Sequence
  Description of Artificial Sequence: Synthetic probe
ttgtgcgacacaggtgaagtgtactaccgcatgaagcgcgctgagctctactgcccacgc

SEQ ID NO: 2836 - DNA, 60 bp, Artificial Sequence
  Description of Artificial Sequence: Synthetic probe
gggagattgttgtgcgacacaggtgaagtgtactaccgcatgaagcgcgctgagctctac

SEQ ID NO: 2837 - DNA, 60 bp, Artificial Sequence
  Description of Artificial Sequence: Synthetic probe
cacggttccacgccgaggtgacttggccgtgttgagccaacgcgttgagaatgaaaccac

SEQ ID NO: 2838 - DNA, 60 bp, Artificial Sequence
  Description of Artificial Sequence: Synthetic probe
acccaacgcacggttccacgccgaggtgacttggccgtgttgagccaacgcgttgagaat

SEQ ID NO: 2839 - DNA, 60 bp, Artificial Sequence
  Description of Artificial Sequence: Synthetic probe
ggcaactgtctacaatggaaactgcaagtacagtaacacccaacgcacggttccacgccg

SEQ ID NO: 2840 - DNA, 60 bp, Artificial Sequence
  Description of Artificial Sequence: Synthetic probe
cacacggtgttttggcaactgtctacaatggaaactgcaagtacagtaacacccaacgca

SEQ ID NO: 2841 - DNA, 60 bp, Artificial Sequence
  Description of Artificial Sequence: Synthetic probe
tgtctactcgaaaggttcggttgctcgctttgcactgccctacaccgcaccacacggtgt

SEQ ID NO: 2842 - DNA, 60 bp, Artificial Sequence
  Description of Artificial Sequence: Synthetic probe
gggtgcctaacgggtgcccacacaccgatagagtggaggacaatccagttgtctactcga

SEQ ID NO: 2843 - DNA, 60 bp, Artificial Sequence
  Description of Artificial Sequence: Synthetic probe
tgggtgcctaacgggtgcccacacaccgatagagtggaggacaatccagttgtctactcg

SEQ ID NO: 2844 - DNA, 51 bp, Artificial Sequence
  Description of Artificial Sequence: Synthetic probe
ggtaaccaacacacactcgacgtgatgcaggcacacaaagacaacatcgtg

SEQ ID NO: 2845 - DNA, 60 bp, Artificial Sequence
  Description of Artificial Sequence: Synthetic probe
gtgcaattaaggcccagaacatacacgagcttctcgtgcgcatgaagcgggccgaactct

SEQ ID NO: 2846 - DNA, 58 bp, Artificial Sequence
  Description of Artificial Sequence: Synthetic probe
caacggaacgagcaagtacactgtgagtggttcaaacagtcggggcgacttgggcgcc

SEQ ID NO: 2847 - DNA, 58 bp, Artificial Sequence
  Description of Artificial Sequence: Synthetic probe
caacggaacgagcaagtacactgtgagtggttcaaacaggcggggcgacttgggcgcc

SEQ ID NO: 2848 - DNA, 60 bp, Artificial Sequence
  Description of Artificial Sequence: Synthetic probe
ctgatctggaaattgttgtgcggcacgacggtaacctgacttgggtacccaacggtgccc

SEQ ID NO: 2849 - DNA, 60 bp, Artificial Sequence
  Description of Artificial Sequence: Synthetic probe
cttctctgatctggaaattgttgtgcggcacgacggtaacctgacttgggtacccaacgg

SEQ ID NO: 2850 - DNA, 60 bp, Artificial Sequence
  Description of Artificial Sequence: Synthetic probe
cgacctactacttctctgatctggaaattgttgtgcggcacgacggtaacctgacttggg

SEQ ID NO: 2851 - DNA, 60 bp, Artificial Sequence
  Description of Artificial Sequence: Synthetic probe
gcggcgacctactacttctctgatctggaaattgttgtgcggcacgacggtaacctgact

SEQ ID NO: 2852 - DNA, 60 bp, Artificial Sequence
  Description of Artificial Sequence: Synthetic probe
gccccacccatgttattgacctcatgcaaacccaccaacacggcctagtgggagcgctgc

SEQ ID NO: 2853 - DNA, 60 bp, Artificial Sequence
  Description of Artificial Sequence: Synthetic probe
ttggcaccagcactcgccccagcgagatctgtgtgatcaacggagtcgtgatgacactgg

SEQ ID NO: 2854 - DNA, 60 bp, Artificial Sequence
  Description of Artificial Sequence: Synthetic probe
tgagtacaaaacgcgcgtgaccgccatccgcggtgaccgcgccgtgctggcgtccaagta

SEQ ID NO: 2855 - DNA, 60 bp, Artificial Sequence
  Description of Artificial Sequence: Synthetic probe
gaccgtttacaacggtgagtgtgagtacaaaacgcgcgtgaccgccattcgcggtgaccg

SEQ ID NO: 2856 - DNA, 60 bp, Artificial Sequence
  Description of Artificial Sequence: Synthetic probe
ctcgaccgtttacaacggtgagtgtgagtacaaaacgcgcgtgaccgccattcgcggtga

SEQ ID NO: 2857 - DNA, 60 bp, Artificial Sequence
  Description of Artificial Sequence: Synthetic probe
caccgtctgctctcgaccgtttacaacggtgagtgtgagtacaaaacgcgcgtgaccgcc

SEQ ID NO: 2858 - DNA, 60 bp, Artificial Sequence
  Description of Artificial Sequence: Synthetic probe
gcaccacaccgtctgctctcgaccgtttacaacggtgagtgtgagtacaaaacgcgcgtg

SEQ ID NO: 2859 - DNA, 60 bp, Artificial Sequence
  Description of Artificial Sequence: Synthetic probe
acactgcaccacaccgtctgctctcgaccgtttacaacggtgagtgtgagtacaaaacgc

SEQ ID NO: 2860 - DNA, 60 bp, Artificial Sequence
  Description of Artificial Sequence: Synthetic probe
ctgtgccatacactgcaccacaccgtctgctctcgaccgtttacaacggtgagtgtgagt

SEQ ID NO: 2861 - DNA, 60 bp, Artificial Sequence
  Description of Artificial Sequence: Synthetic probe
cggttcgctgtgccatacactgcaccacaccgtctgctctcgaccgtttacaacggtgag

SEQ ID NO: 2862 - DNA, 60 bp, Artificial Sequence
  Description of Artificial Sequence: Synthetic probe
aacggtgtcactcggttcgctgtgccatacactgcaccacaccgtctgctctcgaccgtt

SEQ ID NO: 2863 - DNA, 60 bp, Artificial Sequence
  Description of Artificial Sequence: Synthetic probe
tgaggtaaaagtaaaaggacaggacatgctctcagatgccgcgctgatggttctccactc

SEQ ID NO: 2864 - DNA, 60 bp, Artificial Sequence
  Description of Artificial Sequence: Synthetic probe
tgaggtgaaagtaaaaggacaggacatgctctcagatgccgcgctgatggttctccactc

SEQ ID NO: 2865 - DNA, 60 bp, Artificial Sequence
  Description of Artificial Sequence: Synthetic probe
gcagagctatactgtccaaggccacttctcccggcctaccagcacaataaccgggacagg

SEQ ID NO: 2866 - DNA, 60 bp, Artificial Sequence
  Description of Artificial Sequence: Synthetic probe
tgaagcgggctgagctatactgtccaaggccacttctcccggcctaccagcacaatgacc

SEQ ID NO: 2867 - DNA, 60 bp, Artificial Sequence
  Description of Artificial Sequence: Synthetic probe
tacaggatgaagcgggctgagctatactgtccaaggccacttctcccggcctaccagcac

SEQ ID NO: 2868 - DNA, 60 bp, Artificial Sequence
  Description of Artificial Sequence: Synthetic probe
gacacgtgaccgccgaccaaccggtcgacgtttactacaggatgaagcgggctgagctat

SEQ ID NO: 2869 - DNA, 60 bp, Artificial Sequence
  Description of Artificial Sequence: Synthetic probe
caattttggatacgtgaccgccgaccaaccggtcgacgtttactacaggatgaagcgggc

SEQ ID NO: 2870 - DNA, 60 bp, Artificial Sequence
  Description of Artificial Sequence: Synthetic probe
ccacgttcaattttggacacgtgaccgccgaccaaccggtcgacgtttactacaggatga

SEQ ID NO: 2871 - DNA, 60 bp, Artificial Sequence
  Description of Artificial Sequence: Synthetic probe
tacgccagctccagacacgcgcttccatccacgttcaattttggatacgtgaccgccgac

SEQ ID NO: 2872 - DNA, 60 bp, Artificial Sequence
  Description of Artificial Sequence: Synthetic probe
gtgttggcagccaagtacgccagctccagacacgcgcttccatccacgttcaattttgga

SEQ ID NO: 2873 - DNA, 60 bp, Artificial Sequence
  Description of Artificial Sequence: Synthetic probe
ccgcgctgtgttggcagccaagtacgccagctccagacacgcgcttccatccacgttcaa

SEQ ID NO: 2874 - DNA, 60 bp, Artificial Sequence
  Description of Artificial Sequence: Synthetic probe
actacaaagatcgagtctccgcaatccgcggtgaccgcgctgtgttggcagccaagtacg

SEQ ID NO: 2875 - DNA, 60 bp, Artificial Sequence
  Description of Artificial Sequence: Synthetic probe
gtgagtgtaactacaaagatcgagtctccgcaatccgcggtgaccgcgctgtgttggcag

SEQ ID NO: 2876 - DNA, 60 bp, Artificial Sequence
  Description of Artificial Sequence: Synthetic probe
tgccgtaccctacactgcgccacaccggttgcttgcgaccaggtacaacggtgagtgtaa

SEQ ID NO: 2877 - DNA, 56 bp, Artificial Sequence
  Description of Artificial Sequence: Synthetic probe
gagcagacgtcgtgacgactgatccctcgacgcacggtgggagtgtagtagagaag

SEQ ID NO: 2878 - DNA, 50 bp, Artificial Sequence
  Description of Artificial Sequence: Synthetic probe
cttacgaccacgcgagtcgggataggtttgacgccccaattggcgtcgag

SEQ ID NO: 2879 - DNA, 60 bp, Artificial Sequence
  Description of Artificial Sequence: Synthetic probe
caactttggacacatcaccgcagacaaaccggttgacgtgtactacaggatgaagcgtgc

SEQ ID NO: 2880 - DNA, 60 bp, Artificial Sequence
  Description of Artificial Sequence: Synthetic probe
gctcccttccacgttcaactttggacacatcaccgcagacaaaccggttgacgtgtacta

SEQ ID NO: 2881 - DNA, 51 bp, Artificial Sequence
  Description of Artificial Sequence: Synthetic probe
ccgcaccgtttgctgtcaactgtttacaacggtgagtgcgggtacgggaca

SEQ ID NO: 2882 - DNA, 57 bp, Artificial Sequence
  Description of Artificial Sequence: Synthetic probe
caaccccatggttttcccgaggaacggtgtcactcggttcgccgtgccatacactgc

SEQ ID NO: 2883 - DNA, 60 bp, Artificial Sequence
  Description of Artificial Sequence: Synthetic probe
tactggcaacccaacggtgcacccagaaccactgtgctcggggacaaccccatggttttc

SEQ ID NO: 2884 - DNA, 60 bp, Artificial Sequence
  Description of Artificial Sequence: Synthetic probe
cgcgtgtactggcaacccaacggtgcacccagaaccactgtgctcggggacaaccccatg

SEQ ID NO: 2885 - DNA, 58 bp, Artificial Sequence
  Description of Artificial Sequence: Synthetic probe
ttttatcgctctgttgcacgctctcagagagatcaaaacactgtttctttcacggaca

SEQ ID NO: 2886 - DNA, 58 bp, Artificial Sequence
  Description of Artificial Sequence: Synthetic probe
ttttgtcgctctgttgcacgctctcagagagatcaaaacactgtttctttcacggaca

SEQ ID NO: 2887 - DNA, 60 bp, Artificial Sequence
  Description of Artificial Sequence: Synthetic probe
tgttttatcgctttgctgcacgctctcagagagatcaaaacactgtttctttcacggacc

SEQ ID NO: 2888 - DNA, 60 bp, Artificial Sequence
  Description of Artificial Sequence: Synthetic probe
ctgtttcatcgccctgttgcacggtctcagagagatcaaaacactgtttctttcacggac

SEQ ID NO: 2889 - DNA, 60 bp, Artificial Sequence
  Description of Artificial Sequence: Synthetic probe
gccttcaagcgcctgaaggaaaacttcgagatcgttgctctcgtcgttgggctgttggca

SEQ ID NO: 2890 - DNA, 60 bp, Artificial Sequence
  Description of Artificial Sequence: Synthetic probe
ccagcttcgccaaacgtgctttcaagcgcctgaaggaaaacttcgagatcgttgctctcg

SEQ ID NO: 2891 - DNA, 60 bp, Artificial Sequence
  Description of Artificial Sequence: Synthetic probe
gcacgaagctgcaattgaattctacgaagggatggtgcacgacagcatcaaggaagagct

SEQ ID NO: 2892 - DNA, 60 bp, Artificial Sequence
  Description of Artificial Sequence: Synthetic probe
acagcacgaagctgcaattgaattctacgaagggatggtgcacgacagcatcaaggaaga

SEQ ID NO: 2893 - DNA, 60 bp, Artificial Sequence
  Description of Artificial Sequence: Synthetic probe
ttcctcattgagaaaggacagcacgaagctgcaattgaattctatgaagggatggtgcac

SEQ ID NO: 2894 - DNA, 60 bp, Artificial Sequence
  Description of Artificial Sequence: Synthetic probe
actggtaggcgcaatcctgcgttctgccacgtactacttcgctgatcttgaggtggcgtg

SEQ ID NO: 2895 - DNA, 60 bp, Artificial Sequence
  Description of Artificial Sequence: Synthetic probe
ggcggcaagaacgctgcctacctccttcaactacggtgccatcaaagccacttgggtcac

SEQ ID NO: 2896 - DNA, 60 bp, Artificial Sequence
  Description of Artificial Sequence: Synthetic probe
cggcgtcaccacactgatgtcggcttcataatggacagatttgtgaagattaacaacacc

SEQ ID NO: 2897 - DNA, 60 bp, Artificial Sequence
  Description of Artificial Sequence: Synthetic probe
gacgttgccttcgttcttgaccggtttgtgaaggtccaagtgtcaggtaaccagcacaca

SEQ ID NO: 2898 - DNA, 60 bp, Artificial Sequence
  Description of Artificial Sequence: Synthetic probe
gacgttgccttcgttcttgaccggtttgtgaaggtccaagtgtcgggtaaccagcacaca

SEQ ID NO: 2899 - DNA, 60 bp, Artificial Sequence
  Description of Artificial Sequence: Synthetic probe
ctgacgttgccttcgttcttgaccggtttgtgaaggtccaagtgtcaggtaaccagcaca

SEQ ID NO: 2900 - DNA, 60 bp, Artificial Sequence
  Description of Artificial Sequence: Synthetic probe
ggaccgctacaaagtggccctgacaaagcctgccaagcaactgtgcaacttcgacctgtt

SEQ ID NO: 2901 - DNA, 55 bp, Artificial Sequence
  Description of Artificial Sequence: Synthetic probe
gccagaactcaatgaggtcggcgacaacccagtcgtcttttctcacaacgagacc

SEQ ID NO: 2902 - DNA, 60 bp, Artificial Sequence
  Description of Artificial Sequence: Synthetic probe
tggacaccgaacggggcgccagaactcaatgaggtcggcgacaacccagtcgtcttttct

SEQ ID NO: 2903 - DNA, 60 bp, Artificial Sequence
  Description of Artificial Sequence: Synthetic probe
gcgtgcggaactctactgtccgcgacctctcctcacacactatgaccacggtggcaaaga

SEQ ID NO: 2904 - DNA, 60 bp, Artificial Sequence
  Description of Artificial Sequence: Synthetic probe
gtacgtcaggatgaagcgtgcggaactctactgtccgcgacctctcctcacacactatga

SEQ ID NO: 2905 - DNA, 60 bp, Artificial Sequence
  Description of Artificial Sequence: Synthetic probe
ccgcgtggaaacatccgcggggacctcgcaactcttgcggcgagaattgcaagcgagaca

SEQ ID NO: 2906 - DNA, 60 bp, Artificial Sequence
  Description of Artificial Sequence: Synthetic probe
tggcaacatcatacaacggtgattgcaagtacaagcccgctggcgaccccccgcgtggaa

SEQ ID NO: 2907 - DNA, 50 bp, Artificial Sequence
  Description of Artificial Sequence: Synthetic probe
tggcaacatcatacaacggtgattgcaagtacaagcccgctggcgacccc

SEQ ID NO: 2908 - DNA, 60 bp, Artificial Sequence
  Description of Artificial Sequence: Synthetic probe
ggcaccacccgttttgctctgccctacaccgctccacacagatgtctggcaacatcatac

SEQ ID NO: 2909 - DNA, 60 bp, Artificial Sequence
  Description of Artificial Sequence: Synthetic probe
gaatggcaccacccgttttgctctgccctacaccgctccacacagatgtctggcaacatc

SEQ ID NO: 2910 - DNA, 55 bp, Artificial Sequence
  Description of Artificial Sequence: Synthetic probe
gtacgaccaccactcgcgcgaccggtttgactcgcccattggcgtagaaaaacaa

SEQ ID NO: 2911 - DNA, 51 bp, Artificial Sequence
  Description of Artificial Sequence: Synthetic probe
gtacgaccaccactcgcgcgaccggtttgactcgcccattggcgtagaaaa

SEQ ID NO: 2912 - DNA, 60 bp, Artificial Sequence
  Description of Artificial Sequence: Synthetic probe
ggcgtacgaccaccactcgcgcgaccggtttgactcgcccattggcgtagaaaaacaact

SEQ ID NO: 2913 - DNA, 54 bp, Artificial Sequence
  Description of Artificial Sequence: Synthetic probe
ggcgtacgaccaccactcgcgcgaccggtttgactcgcccattggcgtagaaaa

SEQ ID NO: 2914 - DNA, 60 bp, Artificial Sequence
  Description of Artificial Sequence: Synthetic probe
atgaagagagctgagttctactgcccacgagcactcttgccggcgtacgaccaccactcg

SEQ ID NO: 2915 - DNA, 60 bp, Artificial Sequence
  Description of Artificial Sequence: Synthetic probe
atgaagagagctgagttctactgcccacgagcactgttgccggcgtacgaccaccactcg

SEQ ID NO: 2916 - DNA, 60 bp, Artificial Sequence
  Description of Artificial Sequence: Synthetic probe
taccgtatgaagagagctgagttctactgcccacgagcactcttgccggcgtacgaccac

SEQ ID NO: 2917 - DNA, 60 bp, Artificial Sequence
  Description of Artificial Sequence: Synthetic probe
tactaccgtatgaagagagctgagttctactgcccacgagcactgttgccggcgtacgac

SEQ ID NO: 2918 - DNA, 60 bp, Artificial Sequence
  Description of Artificial Sequence: Synthetic probe
ggttacgtgaccgcagacgaacctgtggacgtgtactaccgtatgaagagagctgagttc

SEQ ID NO: 2919 - DNA, 60 bp, Artificial Sequence
  Description of Artificial Sequence: Synthetic probe
acggttacgtgaccgcagacgaacctgtggacgtgtactaccgtatgaagagagctgagt

SEQ ID NO: 2920 - DNA, 60 bp, Artificial Sequence
  Description of Artificial Sequence: Synthetic probe
ccagcactttcaactacggttacgtgaccgcagacgaacctgtggacgtgtactaccgta

SEQ ID NO: 2921 - DNA, 60 bp, Artificial Sequence
  Description of Artificial Sequence: Synthetic probe
ggtgttggcagcaaagtacagcaaccgcaagcaccaattgcccagcactttcaactacgg

SEQ ID NO: 2922 - DNA, 60 bp, Artificial Sequence
  Description of Artificial Sequence: Synthetic probe
cagacaggtgttggcagcaaagtacagcaaccgcaagcaccaattgcccagcactttcaa

SEQ ID NO: 2923 - DNA, 60 bp, Artificial Sequence
  Description of Artificial Sequence: Synthetic probe
gacaggcaggtgttggcagcaaagtacagcaaccgcaagcaccaattgcccagcactttc

SEQ ID NO: 2924 - DNA, 60 bp, Artificial Sequence
  Description of Artificial Sequence: Synthetic probe
agacaggcaggtgttggcagcaaagtacagcaaccgcaagcaccaattgcccagcacttt

SEQ ID NO: 2925 - DNA, 60 bp, Artificial Sequence
  Description of Artificial Sequence: Synthetic probe
ccaggtttgccatcccctacacagcaccgcacagactgctctccacggtttacaacggtg

SEQ ID NO: 2926 - DNA, 60 bp, Artificial Sequence
  Description of Artificial Sequence: Synthetic probe
cgacaacccgatggtgttctcacacaaccgggtcaccaggtttgccatcccctacacagc

SEQ ID NO: 2927 - DNA, 60 bp, Artificial Sequence
  Description of Artificial Sequence: Synthetic probe
caccacacagcttggcgacaacccgatggtgttctcgcacaaccgggtcaccaggtttgc

SEQ ID NO: 2928 - DNA, 60 bp, Artificial Sequence
  Description of Artificial Sequence: Synthetic probe
caccacacagcttggcgacaacccgatggtgttctcacacaaccgggtcaccaggtttgc

SEQ ID NO: 2929 - DNA, 56 bp, Artificial Sequence
  Description of Artificial Sequence: Synthetic probe
ccaccacgtactactttgctgaccttgaaatcgcgtgtgtgggcgaccacaagcgc

SEQ ID NO: 2930 - DNA, 60 bp, Artificial Sequence
  Description of Artificial Sequence: Synthetic probe
ccaccacgtactactttgctgaccttgaaatcgcgtgtgtgggagaccacaagcgcgtgt

SEQ ID NO: 2931 - DNA, 55 bp, Artificial Sequence
  Description of Artificial Sequence: Synthetic probe
cgaacaagaccacgtttgctgtggacctcttggacactaaggacaaaacgttggt

SEQ ID NO: 2932 - DNA, 56 bp, Artificial Sequence
  Description of Artificial Sequence: Synthetic probe
acgaacaagaccacgtttgctgtggacctcttggacacaaaggacaaaacgctggt

SEQ ID NO: 2933 - DNA, 60 bp, Artificial Sequence
  Description of Artificial Sequence: Synthetic probe
aggagttgtggacaccaagaagcgcagatggcacacagacgtgagcttcgtcatggaccg

SEQ ID NO: 2934 - DNA, 60 bp, Artificial Sequence
  Description of Artificial Sequence: Synthetic probe
acacggaggagttgtggacaccaagaagcgcagatggcacacagacgtgagcttcgtcat

SEQ ID NO: 2935 - DNA, 60 bp, Artificial Sequence
  Description of Artificial Sequence: Synthetic probe
ccacacacggaggagttgtggacaccaagaagcgcagatggcacacagacgtgagcttcg

SEQ ID NO: 2936 - DNA, 60 bp, Artificial Sequence
  Description of Artificial Sequence: Synthetic probe
gaaggcgctgatgtcgtgactactgacccctccacacacggaggagttgtggacaccaag

SEQ ID NO: 2937 - DNA, 60 bp, Artificial Sequence
  Description of Artificial Sequence: Synthetic probe
tcaactacggtgcaatcaaggccaccgccattcacgagctcctcgtgcgtatgaagcggg

SEQ ID NO: 2938 - DNA, 60 bp, Artificial Sequence
  Description of Artificial Sequence: Synthetic probe
tcttcctgcctctttcaactacggtgcaatcaaggccaccgccattcacgagctcctcgt

SEQ ID NO: 2939 - DNA, 60 bp, Artificial Sequence
  Description of Artificial Sequence: Synthetic probe
cgtggtgacatggggtctctcgcggcacgagtcgcgaaacatcttcctgcctctttcaac

SEQ ID NO: 2940 - DNA, 60 bp, Artificial Sequence
  Description of Artificial Sequence: Synthetic probe
tcaagtagacgtggtgacatggggtctctcgcggcacgagtcgcgaaacatcttcctgcc

SEQ ID NO: 2941 - DNA, 60 bp, Artificial Sequence
  Description of Artificial Sequence: Synthetic probe
gtctacaacgggacaagcaaatacaccgagggtggttcaagtagacgtggtgacatgggg

SEQ ID NO: 2942 - DNA, 60 bp, Artificial Sequence
  Description of Artificial Sequence: Synthetic probe
gtgtgctggcaacagtctacaacgggacaagcaaatacaccgagggtggttcaagtagac

SEQ ID NO: 2943 - DNA, 60 bp, Artificial Sequence
  Description of Artificial Sequence: Synthetic probe
gcccctgtgtcagccctagagaacactggcaaccccactgcctacaacaaggcaccattc

SEQ ID NO: 2944 - DNA, 60 bp, Artificial Sequence
  Description of Artificial Sequence: Synthetic probe
aacggcgcccctgtgtcagccctagagaacactggcaaccccactgcctacaacaaggca

SEQ ID NO: 2945 - DNA, 60 bp, Artificial Sequence
  Description of Artificial Sequence: Synthetic probe
aagatcaaggacgtggaaacaacgcatgtcattgacctcatgcaaactcaccaacacggc

SEQ ID NO: 2946 - DNA, 60 bp, Artificial Sequence
  Description of Artificial Sequence: Synthetic probe
gacgccatcacactgacattggcttcatcatggataggtttgtgaagatcaaggacgtgg

SEQ ID NO: 2947 - DNA, 53 bp, Artificial Sequence
  Description of Artificial Sequence: Synthetic probe
accaccactaccggggagtcggcagaccctgtcaccaccaccgtggagaacta

SEQ ID NO: 2948 - DNA, 60 bp, Artificial Sequence
  Description of Artificial Sequence: Synthetic probe
tggttactgctcctgcgtttccaggtccatgctcctacagatgaaggcacacatcgaccc

SEQ ID NO: 2949 - DNA, 51 bp, Artificial Sequence
  Description of Artificial Sequence: Synthetic probe
cactgagcttttaatccgcatgaaacgcgcggagacatactgccctaggcc

SEQ ID NO: 2950 - DNA, 50 bp, Artificial Sequence
  Description of Artificial Sequence: Synthetic probe
aagaacccttggacgttgactggcaggaccgggctggcctgttcctacgc

SEQ ID NO: 2951 - DNA, 60 bp, Artificial Sequence
  Description of Artificial Sequence: Synthetic probe
cccatggacaccggaccctgcggacgtacttgcgtacgtaccgtacgaccaagaaccctt

SEQ ID NO: 2952 - DNA, 52 bp, Artificial Sequence
  Description of Artificial Sequence: Synthetic probe
cccatggacaccggaccctgcggacgtacttgcgtacgtaccgtacgaccaa

SEQ ID NO: 2953 - DNA, 60 bp, Artificial Sequence
  Description of Artificial Sequence: Synthetic probe
agatggctggtacgccattgacgatgaagtgtgctacccatggacaccggaccctgcgga

SEQ ID NO: 2954 - DNA, 60 bp, Artificial Sequence
  Description of Artificial Sequence: Synthetic probe
gcccttaacacgtcagatggctggtacgccattgacgatgaagtgtgctacccatggaca

SEQ ID NO: 2955 - DNA, 60 bp, Artificial Sequence
  Description of Artificial Sequence: Synthetic probe
ttgtgctttggctcatcaaggactgtctttccaccggcgttggcaccagcactcgcccca

SEQ ID NO: 2956 - DNA, 60 bp, Artificial Sequence
  Description of Artificial Sequence: Synthetic probe
tgggccacctgcacttgtgctttggctcatcaaggactgtctttccaccggcgttggcac

SEQ ID NO: 2957 - DNA, 60 bp, Artificial Sequence
  Description of Artificial Sequence: Synthetic probe
ctttctgatttcactggacttgacctctcggatggtgggccacctgcacttgtgctttgg

SEQ ID NO: 2958 - DNA, 60 bp, Artificial Sequence
  Description of Artificial Sequence: Synthetic probe
gacatgatcaaacaactttctgatttcactggacttgacctctcggatggtgggccacct

SEQ ID NO: 2959 - DNA, 60 bp, Artificial Sequence
  Description of Artificial Sequence: Synthetic probe
acttctacccctggacaccggatccctccgacgtcctggtgtttgtcccgtacgatcaag

SEQ ID NO: 2960 - DNA, 60 bp, Artificial Sequence
  Description of Artificial Sequence: Synthetic probe
cctcgcgccctagcgaggtgtgcatggtggacggtacagacatgtgtttggctgactttc

SEQ ID NO: 2961 - DNA, 60 bp, Artificial Sequence
  Description of Artificial Sequence: Synthetic probe
cggcattggcaccgcctcgcgccctagcgaggtgtgcatggtggacggtacagacatgtg

SEQ ID NO: 2962 - DNA, 60 bp, Artificial Sequence
  Description of Artificial Sequence: Synthetic probe
ctcgttgtttggaacatcaagcacttgcttcacaccggcattggcaccgcctcgcgccct

SEQ ID NO: 2963 - DNA, 60 bp, Artificial Sequence
  Description of Artificial Sequence: Synthetic probe
ggtggaccgcccgccctcgttgtttggaacatcaagcacttgcttcacaccggcattggc

SEQ ID NO: 2964 - DNA, 60 bp, Artificial Sequence
  Description of Artificial Sequence: Synthetic probe
tacaagcaattggacaactggaggaactcaccggcctcgacctccgcgagggtggaccgc

SEQ ID NO: 2965 - DNA, 60 bp, Artificial Sequence
  Description of Artificial Sequence: Synthetic probe
tgatgaacccttctttgactgggtctatgagtcccccgagaaccttaccatacaagcaat

SEQ ID NO: 2966 - DNA, 60 bp, Artificial Sequence
  Description of Artificial Sequence: Synthetic probe
gctggctgaatgcaattctgcagttgtttaggtatgttgatgaacccttctttgactggg

SEQ ID NO: 2967 - DNA, 60 bp, Artificial Sequence
  Description of Artificial Sequence: Synthetic probe
aaacacgacaactgctggctgaatgcaattctgcagttgtttaggtatgttgatgaaccc

SEQ ID NO: 2968 - DNA, 60 bp, Artificial Sequence
  Description of Artificial Sequence: Synthetic probe
aaccagagacgtacacgccgcgttcacacggacgtagcgttccttctggacaggttcacg

SEQ ID NO: 2969 - DNA, 60 bp, Artificial Sequence
  Description of Artificial Sequence: Synthetic probe
aaccagagacggacatgccgcgttcacacggacgtagcgttccttctggacaggttcacg

SEQ ID NO: 2970 - DNA, 60 bp, Artificial Sequence
  Description of Artificial Sequence: Synthetic probe
acacggtggtaaccagagacgtacacgccgcgttcacacggacgtagcgttccttctgga

SEQ ID NO: 2971 - DNA, 60 bp, Artificial Sequence
  Description of Artificial Sequence: Synthetic probe
gctgagctctattgtcccaggccactgctggcagtagaagtgtcgtcacaggacagacac

SEQ ID NO: 2972 - DNA, 60 bp, Artificial Sequence
  Description of Artificial Sequence: Synthetic probe
gtgctgagctctattgtcccaggccactgctggcagtagaagtgtcgtcacaggacagac

SEQ ID NO: 2973 - DNA, 60 bp, Artificial Sequence
  Description of Artificial Sequence: Synthetic probe
cgcgccacgaccatccacgaacttctcgtgcgcatgaaacgtgctgagctctattgtccc

SEQ ID NO: 2974 - DNA, 60 bp, Artificial Sequence
  Description of Artificial Sequence: Synthetic probe
tggtgcaattcgcgccacgaccatccacgaacttctcgtgcgcatgaaacgtgctgagct

SEQ ID NO: 2975 - DNA, 60 bp, Artificial Sequence
  Description of Artificial Sequence: Synthetic probe
gcgacacgagtcgccgcacagctccctagctcttttaattttggtgcaattcgcgccacg

SEQ ID NO: 2976 - DNA, 60 bp, Artificial Sequence
  Description of Artificial Sequence: Synthetic probe
gggcctcttgcgacacgagtcgccgcacagctccctagctcttttaattttggtgcaatt

SEQ ID NO: 2977 - DNA, 60 bp, Artificial Sequence
  Description of Artificial Sequence: Synthetic probe
tactcatcaactagtggaggtagacgaggtgacccagggcctcttgcgacacgagtcgcc

SEQ ID NO: 2978 - DNA, 60 bp, Artificial Sequence
  Description of Artificial Sequence: Synthetic probe
acggcgtgaacaagtactcatcaactagtggaggtagacgaggtgacccagggcctcttg

SEQ ID NO: 2979 - DNA, 60 bp, Artificial Sequence
  Description of Artificial Sequence: Synthetic probe
caccgcgccgcaccgagtgttggcaacggtgtacaacggcgtgaacaagtactcatcaac

SEQ ID NO: 2980 - DNA, 60 bp, Artificial Sequence
  Description of Artificial Sequence: Synthetic probe
gcttgcgcttccttacaccgcgccgcaccgagtgttggcaacggtgtacaacggcgtgaa

SEQ ID NO: 2981 - DNA, 60 bp, Artificial Sequence
  Description of Artificial Sequence: Synthetic probe
ggtgcgtcacgaaggtaatttgacgtgggtgcccaatggagcacctgaagcagccttgtc

SEQ ID NO: 2982 - DNA, 60 bp, Artificial Sequence
  Description of Artificial Sequence: Synthetic probe
tggtgcgtcacgaaggtaatttgacgtgggtgcccaatggagcacctgaagcagccttgt

SEQ ID NO: 2983 - DNA, 60 bp, Artificial Sequence
  Description of Artificial Sequence: Synthetic probe
ggacaggtttgtgaaaataagtcctaagaccccaacacacgtcattgaccttatgcaaac

SEQ ID NO: 2984 - DNA, 60 bp, Artificial Sequence
  Description of Artificial Sequence: Synthetic probe
tcataatggacaggtttgtgaaaataagtcctaagaccccaacacacgtcattgacctta

SEQ ID NO: 2985 - DNA, 60 bp, Artificial Sequence
  Description of Artificial Sequence: Synthetic probe
gcgagacacaggcccagcgacgccaacacactgacgtcggcttcataatggacaggtttg

SEQ ID NO: 2986 - DNA, 60 bp, Artificial Sequence
  Description of Artificial Sequence: Synthetic probe
ctacggtggcgagacacaggcccagcgacgccaacacactgacgtcggcttcataatgga

SEQ ID NO: 2987 - DNA, 60 bp, Artificial Sequence
  Description of Artificial Sequence: Synthetic probe
gagtctgcagaccctgtcactaccactgttgagaactacggtggcgagacacaggcccag

SEQ ID NO: 2988 - DNA, 60 bp, Artificial Sequence
  Description of Artificial Sequence: Synthetic probe
accactgctaccggggagtctgcagaccctgtcactaccactgttgagaactacggtggc

SEQ ID NO: 2989 - DNA, 60 bp, Artificial Sequence
  Description of Artificial Sequence: Synthetic probe
ccacttcgcgcaggggagatctggcccaactggcggcaacacacgctcggcgactgccag

SEQ ID NO: 2990 - DNA, 60 bp, Artificial Sequence
  Description of Artificial Sequence: Synthetic probe
tacaacgacctacagcgctacctcgcgcaggggagatctggcccaactggcggcaacaca

SEQ ID NO: 2991 - DNA, 60 bp, Artificial Sequence
  Description of Artificial Sequence: Synthetic probe
actgcctaccacaagggaccgctgactcggctagccctcccgtacactgcgccacaccgt

SEQ ID NO: 2992 - DNA, 60 bp, Artificial Sequence
  Description of Artificial Sequence: Synthetic probe
aaccaacacacgctggacgttatgcaggtacacaaagacagtatcgtgggcgcgcttctc

SEQ ID NO: 2993 - DNA, 60 bp, Artificial Sequence
  Description of Artificial Sequence: Synthetic probe
ccgacgttgccttcgttctcgaccggtttgtgaaggtccaagtgtcagacaaccaacaca

SEQ ID NO: 2994 - DNA, 60 bp, Artificial Sequence
  Description of Artificial Sequence: Synthetic probe
acggaggagaaacacaaactcagcgtcgccaccacaccgacgttgccttcgttctcgacc

SEQ ID NO: 2995 - DNA, 60 bp, Artificial Sequence
  Description of Artificial Sequence: Synthetic probe
gaggtgtcgtcgcacgacagacacaaacagaaaatcatcgcgcctgcaaagcaactcctg

SEQ ID NO: 2996 - DNA, 60 bp, Artificial Sequence
  Description of Artificial Sequence: Synthetic probe
gcagaggaggtgtcgtcgcacgacagacacaaacagaaaatcatcgcgcctgcaaagcaa

SEQ ID NO: 2997 - DNA, 60 bp, Artificial Sequence
  Description of Artificial Sequence: Synthetic probe
gagtgagcaaccggctgcccacctccttcaactacggtgctgtgaaggctgacaccatca

SEQ ID NO: 2998 - DNA, 53 bp, Artificial Sequence
  Description of Artificial Sequence: Synthetic probe
ccactcaggaccgccgtaaacaggagatcattgcacctgagaaacaagtgttg

SEQ ID NO: 2999 - DNA, 60 bp, Artificial Sequence
  Description of Artificial Sequence: Synthetic probe
gggcggctgcccacctctttcaactacggcgctgtaaaggctgaaaacatcactgagctt

SEQ ID NO: 3000 - DNA, 60 bp, Artificial Sequence
  Description of Artificial Sequence: Synthetic probe
gctcattctcgacgggaagacagtagccatctgctgcgctaccggagtgtttggcactgc

SEQ ID NO: 3001 - DNA, 60 bp, Artificial Sequence
  Description of Artificial Sequence: Synthetic probe
gaacgctgcccacctccttcaactacggtgccattaaagctactcgggtgactgaactgc

SEQ ID NO: 3002 - DNA, 60 bp, Artificial Sequence
  Description of Artificial Sequence: Synthetic probe
gacggatggtacgccattgacgacgaggacttctacccgtggacaccagacccatctgat

SEQ ID NO: 3003 - DNA, 60 bp, Artificial Sequence
  Description of Artificial Sequence: Synthetic probe
cagacggggtgatctagggtctcttgcggcgagggtcgcaaaacagcttcccgcttcttt

SEQ ID NO: 3004 - DNA, 60 bp, Artificial Sequence
  Description of Artificial Sequence: Synthetic probe
cacaggtaatgcaggcagacggggtgatctagggtctcttgcggcgagggtcgcaaaaca

SEQ ID NO: 3005 - DNA, 60 bp, Artificial Sequence
  Description of Artificial Sequence: Synthetic probe
gctggcgacagtgtacaacgggacaaccaagtactccacaggtaatgcaggcagacgggg

SEQ ID NO: 3006 - DNA, 60 bp, Artificial Sequence
  Description of Artificial Sequence: Synthetic probe
tatgatcaagaaccactcaatggagaatggaaagcaaaggttcaaaaacgactaaaaggg

SEQ ID NO: 3007 - DNA, 60 bp, Artificial Sequence
  Description of Artificial Sequence: Synthetic probe
gcaccacccgttttgcactgccctacaccgcaccacacaggtgtctcgcaacatcctaca

SEQ ID NO: 3008 - DNA, 51 bp, Artificial Sequence
  Description of Artificial Sequence: Synthetic probe
actggtgacaggcacaagcaaccgttggtcgcgcctgcaaaacagttgttg

SEQ ID NO: 3009 - DNA, 60 bp, Artificial Sequence
  Description of Artificial Sequence: Synthetic probe
gggagctttattgccctaggcctatcctgcctatccaacctactggtgacaggcacaagc

SEQ ID NO: 3010 - DNA, 60 bp, Artificial Sequence
  Description of Artificial Sequence: Synthetic probe
tgcataaacgggagctttattgccctaggcctatcctgcctatccaacctactggtgaca

SEQ ID NO: 3011 - DNA, 60 bp, Artificial Sequence
  Description of Artificial Sequence: Synthetic probe
caaagcagagaccatcactgagctgttggtgcggatgcataaacgggagctttattgccc

SEQ ID NO: 3012 - DNA, 60 bp, Artificial Sequence
  Description of Artificial Sequence: Synthetic probe
caactttggtgctatcaaagcagagaccatcactgagctgttggtgcggatgcataaacg

SEQ ID NO: 3013 - DNA, 60 bp, Artificial Sequence
  Description of Artificial Sequence: Synthetic probe
cctgaagggacaagagcatgctgtgttcgcctgtgtcacctctgacgggtggtacgcgat

SEQ ID NO: 3014 - DNA, 60 bp, Artificial Sequence
  Description of Artificial Sequence: Synthetic probe
tgcccaatggcgcgcccgaggcagctttgtccaacacaagcaaccccactgcctaccaca

SEQ ID NO: 3015 - DNA, 60 bp, Artificial Sequence
  Description of Artificial Sequence: Synthetic probe
cgaccacaacggagctgacaggtacaagaccacgctggtagcaccagagaaacaacttgc

SEQ ID NO: 3016 - DNA, 60 bp, Artificial Sequence
  Description of Artificial Sequence: Synthetic probe
tacgaccacaacggagctgacaggtacaagaccacgctggtagcaccagagaaacaactt

SEQ ID NO: 3017 - DNA, 60 bp, Artificial Sequence
  Description of Artificial Sequence: Synthetic probe
ctcaccacgtacgaccacaacggagctgacaggtacaagaccacgctggtagcaccagag

SEQ ID NO: 3018 - DNA, 60 bp, Artificial Sequence
  Description of Artificial Sequence: Synthetic probe
ttctgctcaccacgtacgaccacgacggagctgacaggtacaagaccacgctggtagcac

SEQ ID NO: 3019 - DNA, 60 bp, Artificial Sequence
  Description of Artificial Sequence: Synthetic probe
ctgagctctactgcccacgctttctgctcaccacgtacgaccacaacggagctgacaggt

SEQ ID NO: 3020 - DNA, 60 bp, Artificial Sequence
  Description of Artificial Sequence: Synthetic probe
cgctgaggagactcacatcccgaccactttcaactacgggatgatcttgaccgaaagcga

SEQ ID NO: 3021 - DNA, 60 bp, Artificial Sequence
  Description of Artificial Sequence: Synthetic probe
ggtacgtcgacgaaccattcttcgactgggtctacaactcgcccgagaacctcactctcc

SEQ ID NO: 3022 - DNA, 60 bp, Artificial Sequence
  Description of Artificial Sequence: Synthetic probe
ctgcaattgttcaggtacgtcgacgaaccattcttcgactgggtctacaactcgcccgag

SEQ ID NO: 3023 - DNA, 60 bp, Artificial Sequence
  Description of Artificial Sequence: Synthetic probe
cagcttgcgatgatgtgaactccgagcccgcccaacctgttgaggagcaaccacaagctg

SEQ ID NO: 3024 - DNA, 60 bp, Artificial Sequence
  Description of Artificial Sequence: Synthetic probe
cgggtcacacagcttgcgatgatgtgaactccgagcccgcccaacctgttgaggagcaac

SEQ ID NO: 3025 - DNA, 60 bp, Artificial Sequence
  Description of Artificial Sequence: Synthetic probe
gtggtgccagcactgttggcttcagagagagaactctcccgggtcacacagcttgcgatg

SEQ ID NO: 3026 - DNA, 60 bp, Artificial Sequence
  Description of Artificial Sequence: Synthetic probe
gatgacaaaactcttgacgaagcggagaagagacctctggagactagtggtgccagcact

SEQ ID NO: 3027 - DNA, 60 bp, Artificial Sequence
  Description of Artificial Sequence: Synthetic probe
gcaaacatcaccacagatgacaaaactcttgacgaagcggagaagagacctctggagact

SEQ ID NO: 3028 - DNA, 60 bp, Artificial Sequence
  Description of Artificial Sequence: Synthetic probe
atccaacagacctcatttgtgaagcgcgcgtttaagcgcctgaaggagaactttgagatt

SEQ ID NO: 3029 - DNA, 60 bp, Artificial Sequence
  Description of Artificial Sequence: Synthetic probe
atcacgcaggccgggatagattcgatgccccaattggtgtcgaaaaacagttgtgtaact

SEQ ID NO: 3030 - DNA, 60 bp, Artificial Sequence
  Description of Artificial Sequence: Synthetic probe
cttctcccggcttacgatcacgcagaccgggatagattcgatgccccaattggtgtcgaa

SEQ ID NO: 3031 - DNA, 60 bp, Artificial Sequence
  Description of Artificial Sequence: Synthetic probe
cggtgccatcaaggctactcgggtgactgaactgctttaccgcatgaagagggctgaaac

SEQ ID NO: 3032 - DNA, 60 bp, Artificial Sequence
  Description of Artificial Sequence: Synthetic probe
tgaagagagcggagctctactgtccaagaccccttctccctggctacgaccacgcagaca

SEQ ID NO: 3033 - DNA, 60 bp, Artificial Sequence
  Description of Artificial Sequence: Synthetic probe
gtatgccaacaccaagcacgagctcccgtccaccttcaacttcggttacgtgaccgccga

SEQ ID NO: 3034 - DNA, 60 bp, Artificial Sequence
  Description of Artificial Sequence: Synthetic probe
aagtatgccaacaccaagcacgagctcccgtccaccttcaacttcggctacgtgaccgcc

SEQ ID NO: 3035 - DNA, 60 bp, Artificial Sequence
  Description of Artificial Sequence: Synthetic probe
ccatggtgttttcccacaacaaagtcacgcgtttcgctgtcccgtacactgcaccgcacc

SEQ ID NO: 3036 - DNA, 60 bp, Artificial Sequence
  Description of Artificial Sequence: Synthetic probe
cgctccgtgacaaccccatggtgttttcccacaacaaagtcacgcgtttcgctgtcccgt

SEQ ID NO: 3037 - DNA, 60 bp, Artificial Sequence
  Description of Artificial Sequence: Synthetic probe
cgcggacaaccacgctccggcacaaccccatggtgttttcccacaacaaagtcacgcgtt

SEQ ID NO: 3038 - DNA, 60 bp, Artificial Sequence
  Description of Artificial Sequence: Synthetic probe
gggtcgccgcggacaaccacgctccggcacaaccccatggtgttttcccacaacaaagtc

SEQ ID NO: 3039 - DNA, 58 bp, Artificial Sequence
  Description of Artificial Sequence: Synthetic probe
ctgtctcggcgaacacacacgcgtgtggtggcagcccaacgggtcgccgcggacaacc

SEQ ID NO: 3040 - DNA, 60 bp, Artificial Sequence
  Description of Artificial Sequence: Synthetic probe
aaattgcctgtctcggcgaacacacacgcgtgtggtggcatcccaacgggtcgccgcgga

SEQ ID NO: 3041 - DNA, 60 bp, Artificial Sequence
  Description of Artificial Sequence: Synthetic probe
tggaaattgcctgtctcggcgaacacacacgcgtgtggtggcagcccaacgggtcgccgc

SEQ ID NO: 3042 - DNA, 59 bp, Artificial Sequence
  Description of Artificial Sequence: Synthetic probe
ttgctgcgcgcagccacctattatttctgtgacctggaaattgcctgtctcggcgaaca

SEQ ID NO: 3043 - DNA, 60 bp, Artificial Sequence
  Description of Artificial Sequence: Synthetic probe
gtgcgttgctgcgtgcagccacctattatttctgtgacctggaaattgcctgtctcggcg

SEQ ID NO: 3044 - DNA, 60 bp, Artificial Sequence
  Description of Artificial Sequence: Synthetic probe
gaccctaataggtgcgttgctgcgtgcagccacctattatttctgtgacctggaaattgc

SEQ ID NO: 3045 - DNA, 60 bp, Artificial Sequence
  Description of Artificial Sequence: Synthetic probe
gacgcatgcacacagacgtggcatttgtcatggacagattcacacatgctctgacaaaca

SEQ ID NO: 3046 - DNA, 56 bp, Artificial Sequence
  Description of Artificial Sequence: Synthetic probe
accaccagctcgggagaaggagcagacgtcgtcacgaccgacccttcaacccacgg

SEQ ID NO: 3047 - DNA, 59 bp, Artificial Sequence
  Description of Artificial Sequence: Synthetic probe
cgccgacgaaccagtcgacgtgtactacaggatgaagcgtgctgaactgtactgtccca

SEQ ID NO: 3048 - DNA, 60 bp, Artificial Sequence
  Description of Artificial Sequence: Synthetic probe
gcaatggagttactcggtttgccgtgccatacacagcgccacaccgtttgttgtcaactg

SEQ ID NO: 3049 - DNA, 60 bp, Artificial Sequence
  Description of Artificial Sequence: Synthetic probe
gatgttgcgttcgtgcttgacaggttcacgcatgttcacacaaataagacaaccttcagt

SEQ ID NO: 3050 - DNA, 60 bp, Artificial Sequence
  Description of Artificial Sequence: Synthetic probe
taactgacacccactcggcagaagcggcggttgtcgtttctgtgagcgctgggcccgatc

SEQ ID NO: 3051 - DNA, 60 bp, Artificial Sequence
  Description of Artificial Sequence: Synthetic probe
tcccaccaggcattgacacagacaaactgcccaagacccccgaggatgcagctcactgtt

SEQ ID NO: 3052 - DNA, 60 bp, Artificial Sequence
  Description of Artificial Sequence: Synthetic probe
tcacacataaggttcacaagaacaccttcttggctgggctcgctgactactacacgcagt

SEQ ID NO: 3053 - DNA, 60 bp, Artificial Sequence
  Description of Artificial Sequence: Synthetic probe
acggttatgtgtacaacccgtctcggaatgactgtcacggcaggtactccaacctgttgg

SEQ ID NO: 3054 - DNA, 60 bp, Artificial Sequence
  Description of Artificial Sequence: Synthetic probe
ggcgagaaaccggccaaacagggcatcataccagtcgcctgttctgacggttacggtggt

SEQ ID NO: 3055 - DNA, 60 bp, Artificial Sequence
  Description of Artificial Sequence: Synthetic probe
tacctgggtgtcaaccggcacgatcagggtaaacgccaccaggcgtggtccctggttgtc

SEQ ID NO: 3056 - DNA, 60 bp, Artificial Sequence
  Description of Artificial Sequence: Synthetic probe
cgagacagggaagaattccagctcaccctgtacccgcaccagttcatcaaccctaggacc

SEQ ID NO: 3057 - DNA, 60 bp, Artificial Sequence
  Description of Artificial Sequence: Synthetic probe
acatgcgcaacggttgggatgttcaggtgaccgccaccagcacacagtttaacggcggtt

SEQ ID NO: 3058 - DNA, 60 bp, Artificial Sequence
  Description of Artificial Sequence: Synthetic probe
gattggacatcggacaaaccatttgggactttgcatgtgttggagctccctgcggaccat

SEQ ID NO: 3059 - DNA, 60 bp, Artificial Sequence
  Description of Artificial Sequence: Synthetic probe
gcaccaccacctccacaacgcagagttctgtcggtattacctacgggtatgccgatgccg

SEQ ID NO: 3060 - DNA, 60 bp, Artificial Sequence
  Description of Artificial Sequence: Synthetic probe
ggtgcaggccaatcttctccagccaccgggtcgcaaaatcaatctggtaacactggtagt

SEQ ID NO: 3061 - DNA, 60 bp, Artificial Sequence
  Description of Artificial Sequence: Synthetic probe
gggaactgcaagtatggcgagagctccgagaccaatgtgagaggtgacctacaagtgttg

SEQ ID NO: 3062 - DNA, 60 bp, Artificial Sequence
  Description of Artificial Sequence: Synthetic probe
cgactccagacacacgcttccatccaggttcaactttggacatgtgaccgccgaccagcc

SEQ ID NO: 3063 - DNA, 60 bp, Artificial Sequence
  Description of Artificial Sequence: Synthetic probe
ggcgtcaacctactacttttgtgacctggagattgcttgtgttggcacgcacacgcgtgt

SEQ ID NO: 3064 - DNA, 60 bp, Artificial Sequence
  Description of Artificial Sequence: Synthetic probe
ggtgccctcctcagggcgtcaacctactacttttgtgacctggagattgcttgcgttggc

SEQ ID NO: 3065 - DNA, 57 bp, Artificial Sequence
  Description of Artificial Sequence: Synthetic probe
cacccgacggaagctagacacaaacaaaagattgtggcacctgtgaaacagcttttg

SEQ ID NO: 3066 - DNA, 60 bp, Artificial Sequence
  Description of Artificial Sequence: Synthetic probe
tcgttcttgacaggtttgtgaaactcactgcacccaagaacgaccagacccttgacctca

SEQ ID NO: 3067 - DNA, 60 bp, Artificial Sequence
  Description of Artificial Sequence: Synthetic probe
cacgggcaaccccactgcttaccacaaagcaccgttcacgagacttgcactcccttacac

SEQ ID NO: 3068 - DNA, 50 bp, Artificial Sequence
  Description of Artificial Sequence: Synthetic probe
gggcagctgcccacctccttcaactacggcgctgtaaaggctgacaccat

SEQ ID NO: 3069 - DNA, 55 bp, Artificial Sequence
  Description of Artificial Sequence: Synthetic probe
gtacaagaccccactggtcggacctgaaaaacaactttgcaatttcgacctgcta

SEQ ID NO: 3070 - DNA, 57 bp, Artificial Sequence
  Description of Artificial Sequence: Synthetic probe
cgtgaggtacacgcacacgactgacaggtacaagaccccactggtcggacctgaaaa

SEQ ID NO: 3071 - DNA, 60 bp, Artificial Sequence
  Description of Artificial Sequence: Synthetic probe
cgtgaggtacacgcacacgactgacaggtacaagaccccactggtcggacctgaaaaaca

SEQ ID NO: 3072 - DNA, 60 bp, Artificial Sequence
  Description of Artificial Sequence: Synthetic probe
gactgttgtgtgaaacgggtgaggtgtactaccgcatgaagcgtgctgagctttactgcc

SEQ ID NO: 3073 - DNA, 56 bp, Artificial Sequence
  Description of Artificial Sequence: Synthetic probe
gactgttgtgtgataggggtgaggtgtactaccgcatgaagcgtgctgagctttac

SEQ ID NO: 3074 - DNA, 60 bp, Artificial Sequence
  Description of Artificial Sequence: Synthetic probe
ccccgcacacactctggtgggagcgctccttcgtactgccacttactatttcgctgactt

SEQ ID NO: 3075 - DNA, 60 bp, Artificial Sequence
  Description of Artificial Sequence: Synthetic probe
tccccgcacacactctggtgggagcgctccttcgtactgccacttactatttcgctgact

SEQ ID NO: 3076 - DNA, 60 bp, Artificial Sequence
  Description of Artificial Sequence: Synthetic probe
acgagcttctcgtgcggatgaaacgggccgagctctactgccctagaccgctcctggcaa

SEQ ID NO: 3077 - DNA, 60 bp, Artificial Sequence
  Description of Artificial Sequence: Synthetic probe
ccatccacgagcttctcgtgcggatgaaacgggccgagctctactgccctagaccgctcc

SEQ ID NO: 3078 - DNA, 60 bp, Artificial Sequence
  Description of Artificial Sequence: Synthetic probe
cctgcatctttcaactacggtgcactcagagctacgaccatccacgagcttctcgtgcgg

SEQ ID NO: 3079 - DNA, 60 bp, Artificial Sequence
  Description of Artificial Sequence: Synthetic probe
cgcgcgacagcttcctgcatctttcaactacggtgcactcagagctacgaccatccacga

SEQ ID NO: 3080 - DNA, 60 bp, Artificial Sequence
  Description of Artificial Sequence: Synthetic probe
gcaggtgcctcaggtaggcgaggtgacatgggggcccttgcggcgagggtcgcgcgacag

SEQ ID NO: 3081 - DNA, 60 bp, Artificial Sequence
  Description of Artificial Sequence: Synthetic probe
tggcaacggtgtacaacgggacgagcaagtactctgcaggtgcctcaggtaggcgaggtg

SEQ ID NO: 3082 - DNA, 60 bp, Artificial Sequence
  Description of Artificial Sequence: Synthetic probe
caccacaccgcgtgctggcaacggtgtacaacgggacgagcaagtactctgcaggtgcct

SEQ ID NO: 3083 - DNA, 60 bp, Artificial Sequence
  Description of Artificial Sequence: Synthetic probe
acaaggcacctttcacgagactcgcgctcccttacactgcaccacaccgcgtgctggcaa

SEQ ID NO: 3084 - DNA, 60 bp, Artificial Sequence
  Description of Artificial Sequence: Synthetic probe
caccgcctaccacaaggcacctttcacgagactcgcgctcccttacactgcaccacaccg

SEQ ID NO: 3085 - DNA, 60 bp, Artificial Sequence
  Description of Artificial Sequence: Synthetic probe
gctcccgaggccgccctccagaacacgagcaaccccaccgcctaccacaaggcacctttc

SEQ ID NO: 3086 - DNA, 60 bp, Artificial Sequence
  Description of Artificial Sequence: Synthetic probe
tgggtgcctaacggcgctcccgaggccgccctccagaacacgagcaaccccaccgcctac

SEQ ID NO: 3087 - DNA, 60 bp, Artificial Sequence
  Description of Artificial Sequence: Synthetic probe
cttgcaaaggacggagccgagactttcatcgtcggcactcactccgcaggcggtaatgga

SEQ ID NO: 3088 - DNA, 60 bp, Artificial Sequence
  Description of Artificial Sequence: Synthetic probe
cgcggagacctcgcgacccttgcgcagaggattgcaagtgagacacacattccaaccact

SEQ ID NO: 3089 - DNA, 56 bp, Artificial Sequence
  Description of Artificial Sequence: Synthetic probe
gcctaccacaaggcaccgctcacccggcttgcactgccttacacggcaccacaccg

SEQ ID NO: 3090 - DNA, 56 bp, Artificial Sequence
  Description of Artificial Sequence: Synthetic probe
ccacaaggcaccgctcacccggcttgcactgccttacacggcaccacaccgtgtat

SEQ ID NO: 3091 - DNA, 60 bp, Artificial Sequence
  Description of Artificial Sequence: Synthetic probe
ccctcctcctttaactacggtgcaattaaggccgagaacatccacgagcttctcgtgcgt

SEQ ID NO: 3092 - DNA, 60 bp, Artificial Sequence
  Description of Artificial Sequence: Synthetic probe
aagacagcttccctcctcctttaactacggtgcaattaaggccgagaacatccacgagct

SEQ ID NO: 3093 - DNA, 58 bp, Artificial Sequence
  Description of Artificial Sequence: Synthetic probe
taacgggacgagcaagtacgctgtgggtggttccgccaggcgaggtgacatggggtct

SEQ ID NO: 3094 - DNA, 60 bp, Artificial Sequence
  Description of Artificial Sequence: Synthetic probe
cactgtctacaacaaggcaccattcacaaggcttgcgctcccctacactgcgccgcaccg

SEQ ID NO: 3095 - DNA, 60 bp, Artificial Sequence
  Description of Artificial Sequence: Synthetic probe
ccactgtctacaacaaggcaccattcacaaggcttgcgctcccctacactgcgccgcacc

SEQ ID NO: 3096 - DNA, 52 bp, Artificial Sequence
  Description of Artificial Sequence: Synthetic probe
aattgtcgtgaaacacgacggcaacctgacctgggtacctaacggtgctcct

SEQ ID NO: 3097 - DNA, 60 bp, Artificial Sequence
  Description of Artificial Sequence: Synthetic probe
atgtgtctcaaacccatgttattgacctcatgcaaactcaccaacacggcctagtgggcg

SEQ ID NO: 3098 - DNA, 59 bp, Artificial Sequence
  Description of Artificial Sequence: Synthetic probe
cgctcatggttctccactctggaaaccgcgtgcgcgatctcacgggacacttccgtgac

SEQ ID NO: 3099 - DNA, 60 bp, Artificial Sequence
  Description of Artificial Sequence: Synthetic probe
gccgcgctaatggttctccacaccggaaaccgcgtgcgcgatctcacgggacacttccgt

SEQ ID NO: 3100 - DNA, 60 bp, Artificial Sequence
  Description of Artificial Sequence: Synthetic probe
gagcggctgcccacctccttcaactacggcgctgtaaaggctgaaaccatcactgagctc

SEQ ID NO: 3101 - DNA, 60 bp, Artificial Sequence
  Description of Artificial Sequence: Synthetic probe
gtccgcgtcccattctgacacactacaaccacggtggtaaggatcgctacaagaccgcga

SEQ ID NO: 3102 - DNA, 60 bp, Artificial Sequence
  Description of Artificial Sequence: Synthetic probe
tacgaccaccagaatagagacaggttcgacgctccgattggagtagagaaacaattgtgc

SEQ ID NO: 3103 - DNA, 60 bp, Artificial Sequence
  Description of Artificial Sequence: Synthetic probe
cttacgaccaccagaatagagacaggttcgacgctccgattggagtagagaaacaattgt

SEQ ID NO: 3104 - DNA, 60 bp, Artificial Sequence
  Description of Artificial Sequence: Synthetic probe
cgtgccgagctgtactgtccacgccctctcctaccagcttacgaccaccagaatagagac

SEQ ID NO: 3105 - DNA, 60 bp, Artificial Sequence
  Description of Artificial Sequence: Synthetic probe
ctaccgaatgaagcgtgccgagctgtactgtccacgccctctcctaccagcttacgacca

SEQ ID NO: 3106 - DNA, 60 bp, Artificial Sequence
  Description of Artificial Sequence: Synthetic probe
ggtgctagctcagaaatacgcgtcaaccaaacacgcgttaccatcaacgttcaacttcgg

SEQ ID NO: 3107 - DNA, 60 bp, Artificial Sequence
  Description of Artificial Sequence: Synthetic probe
cagacaggtgctagctcagaaatacgcgtcaaccaaacacgcgttaccatcaacgttcaa

SEQ ID NO: 3108 - DNA, 51 bp, Artificial Sequence
  Description of Artificial Sequence: Synthetic probe
tacaacggagagtgtgagtaccgcactaatgttaccgccattcgcggtgac

SEQ ID NO: 3109 - DNA, 60 bp, Artificial Sequence
  Description of Artificial Sequence: Synthetic probe
tacaacggagagtgtgagtaccgcactaatgttaccgccattcgcggtgacagacaggtg

SEQ ID NO: 3110 - DNA, 60 bp, Artificial Sequence
  Description of Artificial Sequence: Synthetic probe
ccgcgcactaccaagcttggagacaacccgatggtgtacgcacacaatcatgtcactcgg

SEQ ID NO: 3111 - DNA, 60 bp, Artificial Sequence
  Description of Artificial Sequence: Synthetic probe
gctccgcgcactaccaagcttggagacaacccgatggtgtacgcacacaatcatgtcact

SEQ ID NO: 3112 - DNA, 60 bp, Artificial Sequence
  Description of Artificial Sequence: Synthetic probe
tcggcgacctactacttctgtgatcttgaaattgcatgtgtgggtgaccacacccgcgtc

SEQ ID NO: 3113 - DNA, 60 bp, Artificial Sequence
  Description of Artificial Sequence: Synthetic probe
ggtgccatcctgagatcggcgacctactacttctgtgatcttgaaattgcatgtgtgggt

SEQ ID NO: 3114 - DNA, 60 bp, Artificial Sequence
  Description of Artificial Sequence: Synthetic probe
tggacctcatggacactaaggagaaagccctggtgggtgccatcctgagatcggcgacct

SEQ ID NO: 3115 - DNA, 60 bp, Artificial Sequence
  Description of Artificial Sequence: Synthetic probe
aaacgagctttgcggtggacctcatggacactaaggagaaagccctggtgggtgccatcc

SEQ ID NO: 3116 - DNA, 60 bp, Artificial Sequence
  Description of Artificial Sequence: Synthetic probe
cctcctcgaccgcagcactcacgtcttcaccgacaaaacgagctttgcggtggacctcat

SEQ ID NO: 3117 - DNA, 60 bp, Artificial Sequence
  Description of Artificial Sequence: Synthetic probe
cacagatgttgctttcctcctcgaccgcagcactcacgtcttcaccgacaaaacgagctt

SEQ ID NO: 3118 - DNA, 60 bp, Artificial Sequence
  Description of Artificial Sequence: Synthetic probe
gcggccattgcacaaagggtgaacaacagcctacccacctccttcaactacggtgctgtc

SEQ ID NO: 3119 - DNA, 60 bp, Artificial Sequence
  Description of Artificial Sequence: Synthetic probe
gcggccttggcacagagggtgaacaacagcctacccacctccttcaactacggtgcagtt

SEQ ID NO: 3120 - DNA, 60 bp, Artificial Sequence
  Description of Artificial Sequence: Synthetic probe
tgcggccattgcacaaagggtgaacaacagcctacccacctccttcaactacggtgctgt

SEQ ID NO: 3121 - DNA, 60 bp, Artificial Sequence
  Description of Artificial Sequence: Synthetic probe
tgatcttgcggccttggcacagagggtgaacaacagcctacccacctccttcaactacgg

SEQ ID NO: 3122 - DNA, 60 bp, Artificial Sequence
  Description of Artificial Sequence: Synthetic probe
gcctacctccttcaacttcggtgccatcaaggcaactcgtgttactgaactgctctaccg

SEQ ID NO: 3123 - DNA, 60 bp, Artificial Sequence
  Description of Artificial Sequence: Synthetic probe
actctgcctacctccttcaacttcggtgccatcaaggcaactcgtgttactgaactgctc

SEQ ID NO: 3124 - DNA, 54 bp, Artificial Sequence
  Description of Artificial Sequence: Synthetic probe
gccttacacggctccacaccgtgttttagcgaccgtttacaacggtagcagcaa

SEQ ID NO: 3125 - DNA, 60 bp, Artificial Sequence
  Description of Artificial Sequence: Synthetic probe
gcgatctcacctgggttccaaacggcgcccctgagaccgcactggacaacactaccaacc

SEQ ID NO: 3126 - DNA, 60 bp, Artificial Sequence
  Description of Artificial Sequence: Synthetic probe
acttctctgacctggagctggccgttaagcacgagggcgatctcacctgggttccaaacg

SEQ ID NO: 3127 - DNA, 60 bp, Artificial Sequence
  Description of Artificial Sequence: Synthetic probe
tacggccacctactacttctctgacctggagctggccgttaagcacgagggcgatctcac

SEQ ID NO: 3128 - DNA, 60 bp, Artificial Sequence
  Description of Artificial Sequence: Synthetic probe
atccctgcccacaccttggtaggtgcgctcctgcgtacggccacctactacttctctgac

SEQ ID NO: 3129 - DNA, 60 bp, Artificial Sequence
  Description of Artificial Sequence: Synthetic probe
ttggacctgatgcagatccctgcccacaccttggtaggtgcgctcctgcgtacggccacc

SEQ ID NO: 3130 - DNA, 60 bp, Artificial Sequence
  Description of Artificial Sequence: Synthetic probe
tcgtgaaagttaagccaaaggaacaagttaatgtgttggacctgatgcagatccctgccc

SEQ ID NO: 3131 - DNA, 60 bp, Artificial Sequence
  Description of Artificial Sequence: Synthetic probe
tcatcttggaccgtttcgtgaaagttaagccaaaggaacaagttaatgtgttggacctga

SEQ ID NO: 3132 - DNA, 60 bp, Artificial Sequence
  Description of Artificial Sequence: Synthetic probe
tgagtctgcggacccggtgactgccaccgttgagaactacggtggtgagacccaagttca

SEQ ID NO: 3133 - DNA, 60 bp, Artificial Sequence
  Description of Artificial Sequence: Synthetic probe
accacctctgcgggtgagtctgcggacccggtgactgccaccgttgagaactacggtggt

SEQ ID NO: 3134 - DNA, 60 bp, Artificial Sequence
  Description of Artificial Sequence: Synthetic probe
tgggtgcctaacggctgcccacacaccgaccgcgtggaagacaacccagtcgttcacgcc

SEQ ID NO: 3135 - DNA, 60 bp, Artificial Sequence
  Description of Artificial Sequence: Synthetic probe
tgggtgccgaatgcgtgcccacacaccgaccgcgtggaagacaacccagtcgttcacgcc

SEQ ID NO: 3136 - DNA, 60 bp, Artificial Sequence
  Description of Artificial Sequence: Synthetic probe
tgggtgcccaacggctgcccacacaccgaccgcgtggaagacaacccagtcgttcacgcg

SEQ ID NO: 3137 - DNA, 60 bp, Artificial Sequence
  Description of Artificial Sequence: Synthetic probe
tgggtgcccaatggctgcccacacaccgaccgcgtggaagacaacccagtcgtacacgcg

SEQ ID NO: 3138 - DNA, 60 bp, Artificial Sequence
  Description of Artificial Sequence: Synthetic probe
ggtgacctcgcaactctgcgtgcgcggattgctagtgagacccacatcccgacaacattc

SEQ ID NO: 3139 - DNA, 60 bp, Artificial Sequence
  Description of Artificial Sequence: Synthetic probe
ccgcggtgacctcgcaactctgcgtgcgcggattgctagtgagacccacatcccgacaac

SEQ ID NO: 3140 - DNA, 60 bp, Artificial Sequence
  Description of Artificial Sequence: Synthetic probe
gcctttgcttgctcttgacaccgcccaggaccgccgtaaacaggagatcattgcacctaa

SEQ ID NO: 3141 - DNA, 60 bp, Artificial Sequence
  Description of Artificial Sequence: Synthetic probe
tacacacaagccgaggtggacgtgtacgttaggatgaagcgcgcggagctttactgcccg

SEQ ID NO: 3142 - DNA, 60 bp, Artificial Sequence
  Description of Artificial Sequence: Synthetic probe
tggcaggatttacacacaagccgaggtggacgtgtacgttaggatgaagcgcgcggagct

SEQ ID NO: 3143 - DNA, 60 bp, Artificial Sequence
  Description of Artificial Sequence: Synthetic probe
ggcacaccaccgcgtgacaacatccgcggggaccttgcaactcttgcacagaagattgct

SEQ ID NO: 3144 - DNA, 60 bp, Artificial Sequence
  Description of Artificial Sequence: Synthetic probe
aacccactggcacaccaccgcgtgacaacatccgcggggaccttgcaactcttgcacaga

SEQ ID NO: 3145 - DNA, 60 bp, Artificial Sequence
  Description of Artificial Sequence: Synthetic probe
gtctggcaacaacctacaacggtgactgtaagtacaaacccactggcacaccaccgcgtg

SEQ ID NO: 3146 - DNA, 60 bp, Artificial Sequence
  Description of Artificial Sequence: Synthetic probe
gcaccagagcttagcgaagcaggcgacaatccagtcgtcttctccaccaatggcaccacc

SEQ ID NO: 3147 - DNA, 60 bp, Artificial Sequence
  Description of Artificial Sequence: Synthetic probe
tggactcccaacggagcaccagagcttagcgaagcaggcgacaatccagtcgtcttctcc

SEQ ID NO: 3148 - DNA, 56 bp, Artificial Sequence
  Description of Artificial Sequence: Synthetic probe
accattaccgagcttttggtccgcatgaaacgcgcggagacatactgccccaggcc

SEQ ID NO: 3149 - DNA, 60 bp, Artificial Sequence
  Description of Artificial Sequence: Synthetic probe
gacgtctacgtgagaatgaagagggctgagctctactgtccacgctttctgctcaccacg

SEQ ID NO: 3150 - DNA, 60 bp, Artificial Sequence
  Description of Artificial Sequence: Synthetic probe
gacgtctacgtgagaatgaagagggctgagctctactgcccacgctttctgctcaccacg

SEQ ID NO: 3151 - DNA, 60 bp, Artificial Sequence
  Description of Artificial Sequence: Synthetic probe
gttgacgtctacgtgagaatgaagagggctgagctctactgcccacgctttctgctcacc

SEQ ID NO: 3152 - DNA, 60 bp, Artificial Sequence
  Description of Artificial Sequence: Synthetic probe
agcgaagttgacgtctacgtgagaatgaagagggctgagctctactgtccacgctttctg

SEQ ID NO: 3153 - DNA, 60 bp, Artificial Sequence
  Description of Artificial Sequence: Synthetic probe
aagcgaagttgacgtctacgtgagaatgaagagggctgagctctactgcccacgctttct

SEQ ID NO: 3154 - DNA, 60 bp, Artificial Sequence
  Description of Artificial Sequence: Synthetic probe
ttgaccgaaagcgaagttgacgtctacgtgagaatgaagagggctgagctctactgccca

SEQ ID NO: 3155 - DNA, 60 bp, Artificial Sequence
  Description of Artificial Sequence: Synthetic probe
cccgaccactttcaactacgggatgatcttgaccgaaagcgaagttgacgtctacgtgag

SEQ ID NO: 3156 - DNA, 60 bp, Artificial Sequence
  Description of Artificial Sequence: Synthetic probe
gaggagactcacatcccgaccactttcaactacgggatgatcttgaccgaaagcgaagtt

SEQ ID NO: 3157 - DNA, 60 bp, Artificial Sequence
  Description of Artificial Sequence: Synthetic probe
aggagactcacatcccgaccactttcaactacgggatgatcttgaccgaaagcgaagttg

SEQ ID NO: 3158 - DNA, 60 bp, Artificial Sequence
  Description of Artificial Sequence: Synthetic probe
gggcaactgcccacctccttcaactacggcgctgtaaaggctgacaccatcacggagctt

SEQ ID NO: 3159 - DNA, 60 bp, Artificial Sequence
  Description of Artificial Sequence: Synthetic probe
atgggttccgaacggagcgcctgagaaggcgttggacaacaccaccaacccaacagccta

SEQ ID NO: 3160 - DNA, 60 bp, Artificial Sequence
  Description of Artificial Sequence: Synthetic probe
ccgctctcgtgatttggaacatcaaacacttgctctacaccggcatcggtacagcctcgc

SEQ ID NO: 3161 - DNA, 60 bp, Artificial Sequence
  Description of Artificial Sequence: Synthetic probe
agccgttctcgccaaggacggagccgacacattcatcgttggcacacactccgcaggtgg

SEQ ID NO: 3162 - DNA, 60 bp, Artificial Sequence
  Description of Artificial Sequence: Synthetic probe
gcgccctctcagagtcaggtacacccacaccactgacaggtacaacctcgccctggttaa

SEQ ID NO: 3163 - DNA, 60 bp, Artificial Sequence
  Description of Artificial Sequence: Synthetic probe
ccgcgccctctcagagtcaggtacacccacaccactgataggtacaaggtcgccctagtt

SEQ ID NO: 3164 - DNA, 60 bp, Artificial Sequence
  Description of Artificial Sequence: Synthetic probe
cccgcgccctctcagagtcaggtacacccacaccactgacagatacaaggttgccctagt

SEQ ID NO: 3165 - DNA, 60 bp, Artificial Sequence
  Description of Artificial Sequence: Synthetic probe
gagctatactgcccgcgccctctcagagtcaggtacacccacaccactgacagatacaag

SEQ ID NO: 3166 - DNA, 60 bp, Artificial Sequence
  Description of Artificial Sequence: Synthetic probe
gagctttactgcccgcgccctctcagagtcaggtacacccacaccactgacaggtacaac

SEQ ID NO: 3167 - DNA, 60 bp, Artificial Sequence
  Description of Artificial Sequence: Synthetic probe
ggagctttactgcccgcgccctctcagagtcaggtacacccacaccactgataggtacaa

SEQ ID NO: 3168 - DNA, 60 bp, Artificial Sequence
  Description of Artificial Sequence: Synthetic probe
aacaagacgtcgttcaacgtggacctcatggacaccaaggaaaagaccctagtaggtgcc

SEQ ID NO: 3169 - DNA, 60 bp, Artificial Sequence
  Description of Artificial Sequence: Synthetic probe
aacaaaactacattcaacgtggacctcatggacaccaaggaaaagaccctagtaggtgcc

SEQ ID NO: 3170 - DNA, 60 bp, Artificial Sequence
  Description of Artificial Sequence: Synthetic probe
gccgacgcaccagtcgacgtttactaccgaatgaaacgtgcagagctgtaccgcccacga

SEQ ID NO: 3171 - DNA, 60 bp, Artificial Sequence
  Description of Artificial Sequence: Synthetic probe
gggtttgtgaccgccgacgcaccagtcgacgtttactaccgaatgaaacgtgcagagctg

SEQ ID NO: 3172 - DNA, 60 bp, Artificial Sequence
  Description of Artificial Sequence: Synthetic probe
ttgctgccatccgcggcgacaggcaggttctagctcagaaatacgcgtcaaccaagcacg

SEQ ID NO: 3173 - DNA, 60 bp, Artificial Sequence
  Description of Artificial Sequence: Synthetic probe
atacaccaccaacgttgctgccatccgcggcgacaggcaggttctagctcagaaatacgc

SEQ ID NO: 3174 - DNA, 60 bp, Artificial Sequence
  Description of Artificial Sequence: Synthetic probe
cagccccgcaccgactgttgtccacagtctacaacggggaatgcaaatacaccaccaacg

SEQ ID NO: 3175 - DNA, 60 bp, Artificial Sequence
  Description of Artificial Sequence: Synthetic probe
gtgttttcacacaatcgtgtcacccgctttgctattccgttcacagccccgcaccgactg

SEQ ID NO: 3176 - DNA, 60 bp, Artificial Sequence
  Description of Artificial Sequence: Synthetic probe
ggcaacccaacggtgcgccacgaactcaacagctcggagacaacccgatggtgttttcac

SEQ ID NO: 3177 - DNA, 60 bp, Artificial Sequence
  Description of Artificial Sequence: Synthetic probe
gcgtgtgttctggcaacccaacggtgcgccacgaactcaacagctcggagacaacccgat

SEQ ID NO: 3178 - DNA, 60 bp, Artificial Sequence
  Description of Artificial Sequence: Synthetic probe
gcgacctactacttttgtgacctggaagttgcgtgtgtgggtgaacacgcgcgtgtgttc

SEQ ID NO: 3179 - DNA, 60 bp, Artificial Sequence
  Description of Artificial Sequence: Synthetic probe
cagcactcacgtgcacaccagaaaaaccagctttgcggtcgacctcatggacaccaagga

SEQ ID NO: 3180 - DNA, 60 bp, Artificial Sequence
  Description of Artificial Sequence: Synthetic probe
cgcgtccacacggacgtcgctttcctcctcgatcgcagcactcacgtgcacaccagaaaa

SEQ ID NO: 3181 - DNA, 60 bp, Artificial Sequence
  Description of Artificial Sequence: Synthetic probe
gttagtgcgccacggcgcgtccacacggacgtcgctttcctcctcgatcgcagcactcac

SEQ ID NO: 3182 - DNA, 60 bp, Artificial Sequence
  Description of Artificial Sequence: Synthetic probe
cctgtcttctgcggactactcctacacacacactgacaccccagctatggctaccaccaa

SEQ ID NO: 3183 - DNA, 60 bp, Artificial Sequence
  Description of Artificial Sequence: Synthetic probe
tctgaatgggacacaggtctgaactcgagcttcaccttcgcagtaccatacctgtcttct

SEQ ID NO: 3184 - DNA, 60 bp, Artificial Sequence
  Description of Artificial Sequence: Synthetic probe
acgtcgcgtccctgcccaagacacccgaggatgcggcacactgctaccattctgaatggg

SEQ ID NO: 3185 - DNA, 60 bp, Artificial Sequence
  Description of Artificial Sequence: Synthetic probe
cacccaccacaaagccaaatccatggtagcatacgttcctccgggcatagacgtcgcgtc

SEQ ID NO: 3186 - DNA, 60 bp, Artificial Sequence
  Description of Artificial Sequence: Synthetic probe
cacaagaacacgtacttggctggactcgcagactactacacacagtactctggcagtctc

SEQ ID NO: 3187 - DNA, 60 bp, Artificial Sequence
  Description of Artificial Sequence: Synthetic probe
ggtgacaaagtcatgactgcatttgacgtggctttcacacacaaggtacacaagaacacg

SEQ ID NO: 3188 - DNA, 60 bp, Artificial Sequence
  Description of Artificial Sequence: Synthetic probe
cgtgccccacgctcctcaacttcgatggcaagccatacgtggtgaccaagaacaacggtg

SEQ ID NO: 3189 - DNA, 60 bp, Artificial Sequence
  Description of Artificial Sequence: Synthetic probe
aatgactgccacggtaggttctcaaacctgcttgatgtggccgaagcgtgccccacgctc

SEQ ID NO: 3190 - DNA, 60 bp, Artificial Sequence
  Description of Artificial Sequence: Synthetic probe
caaagtccgcagatccaatctacgggcatgtgtacaacccatcgaggaatgactgccacg

SEQ ID NO: 3191 - DNA, 60 bp, Artificial Sequence
  Description of Artificial Sequence: Synthetic probe
agacacagatgaccagcgggaccgtggaggtctacgccaacatcgcaccaaccaatgtcc

SEQ ID NO: 3192 - DNA, 60 bp, Artificial Sequence
  Description of Artificial Sequence: Synthetic probe
ccagggcaaacgacatcaaacctggtcgctagtggtgatggtgctgacacctctgacaac

SEQ ID NO: 3193 - DNA, 57 bp, Artificial Sequence
  Description of Artificial Sequence: Synthetic probe
acccaggtaccctacctaggtgtgaaccgctatgaccagggcaaacgacatcaaacc

SEQ ID NO: 3194 - DNA, 60 bp, Artificial Sequence
  Description of Artificial Sequence: Synthetic probe
ttacgctctacccacaccaactcatcaacccacggacaaacaccacagcgcacacccagg

SEQ ID NO: 3195 - DNA, 60 bp, Artificial Sequence
  Description of Artificial Sequence: Synthetic probe
gggaagagttccaacttacgctctacccacaccaactcatcaacccacggacaaacacca

SEQ ID NO: 3196 - DNA, 60 bp, Artificial Sequence
  Description of Artificial Sequence: Synthetic probe
gttgcaatggttcctgaactatgcagcctcagagagagggaagagttccaacttacgctc

SEQ ID NO: 3197 - DNA, 60 bp, Artificial Sequence
  Description of Artificial Sequence: Synthetic probe
gtgttggagttgcccaaagaccacaagggcatctacggtaaactcaccgactcttacacg

SEQ ID NO: 3198 - DNA, 60 bp, Artificial Sequence
  Description of Artificial Sequence: Synthetic probe
aaactgttcgactggaccagcgacaaaccattcggaacgctgtatgtgttggagttgccc

SEQ ID NO: 3199 - DNA, 60 bp, Artificial Sequence
  Description of Artificial Sequence: Synthetic probe
caacttggtgacaacgccatcagtggtggttccaacgaggggtcgactgacaccacatcg

SEQ ID NO: 3200 - DNA, 60 bp, Artificial Sequence
  Description of Artificial Sequence: Synthetic probe
gctgctcgtgcgcatgaagcgtgccgaactctactgccccagaccactgttggcggtgaa

SEQ ID NO: 3201 - DNA, 60 bp, Artificial Sequence
  Description of Artificial Sequence: Synthetic probe
ctggagtgtttggcactgcctacctcgtgcctcgtcatctcttcgcggagaagtatgaca

SEQ ID NO: 3202 - DNA, 60 bp, Artificial Sequence
  Description of Artificial Sequence: Synthetic probe
aggacaggacatgctctcagacgccgcgctcatggtgctccaccgtgggaaccgcgtgag

SEQ ID NO: 3203 - DNA, 60 bp, Artificial Sequence
  Description of Artificial Sequence: Synthetic probe
ttggtgggtgccctgttgcgtgcggccacgtactacttctctgacctggagattgtggtg

SEQ ID NO: 3204 - DNA, 60 bp, Artificial Sequence
  Description of Artificial Sequence: Synthetic probe
acgatcacaataaccgggacaggtttgacgcccccatcggcgttgaaaaacagttgtgca

SEQ ID NO: 3205 - DNA, 60 bp, Artificial Sequence
  Description of Artificial Sequence: Synthetic probe
acgatcacaatgaccgggataggttcgacgcccccatcggcgttgaaaaacagttgtgca

SEQ ID NO: 3206 - DNA, 60 bp, Artificial Sequence
  Description of Artificial Sequence: Synthetic probe
cgcagcagaggcacacattccaaccaccttcaactacggcaggatttacacagaggcgga

SEQ ID NO: 3207 - DNA, 60 bp, Artificial Sequence
  Description of Artificial Sequence: Synthetic probe
tatcgcagcagaggcacacattccaaccaccttcaactacggcaggatttacacagaggc

SEQ ID NO: 3208 - DNA, 60 bp, Artificial Sequence
  Description of Artificial Sequence: Synthetic probe
ccccgcacaggtgtcttgcaaccacctacaacggtgactgtaagtacaaaccagctagag

SEQ ID NO: 3209 - DNA, 60 bp, Artificial Sequence
  Description of Artificial Sequence: Synthetic probe
ctgccccgcacaggtgtcttgcaaccacctacaacggtgactgtaagtacaaaccagcta

SEQ ID NO: 3210 - DNA, 60 bp, Artificial Sequence
  Description of Artificial Sequence: Synthetic probe
agcaccggagctgaatgaggttggcgacaaccccgtcgtcttctcacacaacagcaccac

SEQ ID NO: 3211 - DNA, 60 bp, Artificial Sequence
  Description of Artificial Sequence: Synthetic probe
tggactcccaacggagcaccggagctgaatgaggttggcgacaaccccgtcgtcttctca

SEQ ID NO: 3212 - DNA, 60 bp, Artificial Sequence
  Description of Artificial Sequence: Synthetic probe
ccgttgagaactacggaggagagacgcaagtccaacgtcgtcaccacactgacgttgcct

SEQ ID NO: 3213 - DNA, 60 bp, Artificial Sequence
  Description of Artificial Sequence: Synthetic probe
cacccggaccaggctagacacaaacagaagattgtggcacccgtgaaacagcttttaaac

SEQ ID NO: 3214 - DNA, 60 bp, Artificial Sequence
  Description of Artificial Sequence: Synthetic probe
caactacggtgccatcaaggctacccgagtgactgaactgctctaccgcatgaaaagggc

SEQ ID NO: 3215 - DNA, 60 bp, Artificial Sequence
  Description of Artificial Sequence: Synthetic probe
gtgagaggtgacctgcaagtgttagtccagaaggcggcgagagcgctgcctacatccttc

SEQ ID NO: 3216 - DNA, 60 bp, Artificial Sequence
  Description of Artificial Sequence: Synthetic probe
accaatgtgagaggtgacctgcaagtgttagtccagaaggcggcgagagcgctgcctaca

SEQ ID NO: 3217 - DNA, 55 bp, Artificial Sequence
  Description of Artificial Sequence: Synthetic probe
ccctacacggcaccacaccgtgtactggccactgtttacaacgggaactgcaagt

SEQ ID NO: 3218 - DNA, 60 bp, Artificial Sequence
  Description of Artificial Sequence: Synthetic probe
aacccaacagcataccacaaggcaccactcacccggcttgcattgccctacacggcacca

SEQ ID NO: 3219 - DNA, 60 bp, Artificial Sequence
  Description of Artificial Sequence: Synthetic probe
ccaccaacccaacagcataccacaaggcaccactcacccggcttgcattgccctacacgg

SEQ ID NO: 3220 - DNA, 60 bp, Artificial Sequence
  Description of Artificial Sequence: Synthetic probe
tttcgctgacttagaggtggcagtgaagcacgaggggaatctcacctgggtcccgaacgg

SEQ ID NO: 3221 - DNA, 60 bp, Artificial Sequence
  Description of Artificial Sequence: Synthetic probe
gctgctacctactatttcgctgacttagaggtggcagtgaagcacgaggggaatctcacc

SEQ ID NO: 3222 - DNA, 60 bp, Artificial Sequence
  Description of Artificial Sequence: Synthetic probe
gacagatttgtgaaagtagcaccaaaagaccaagctaatgtactagacctgatgcaaacc

SEQ ID NO: 3223 - DNA, 60 bp, Artificial Sequence
  Description of Artificial Sequence: Synthetic probe
gtctcgttcatactggacagatttgtgaaagtagcaccaaaagaccaagctaatgtacta

SEQ ID NO: 3224 - DNA, 60 bp, Artificial Sequence
  Description of Artificial Sequence: Synthetic probe
cggtggtgagacacaggtccaaaggcgccaacacacggacgtctcgttcatactggacag

SEQ ID NO: 3225 - DNA, 60 bp, Artificial Sequence
  Description of Artificial Sequence: Synthetic probe
tcgagaactacggtggtgagacacaggtccaaaggcgccaacacacggacgtctcgttca

SEQ ID NO: 3226 - DNA, 60 bp, Artificial Sequence
  Description of Artificial Sequence: Synthetic probe
gcctccttcaacttcggcgcaattcgagccacggagatccaagaactcctcgtgcgcatg

SEQ ID NO: 3227 - DNA, 60 bp, Artificial Sequence
  Description of Artificial Sequence: Synthetic probe
tccctgcctccttcaacttcggcgcaattcgagccacggagatccaacaactcctcgtgc

SEQ ID NO: 3228 - DNA, 60 bp, Artificial Sequence
  Description of Artificial Sequence: Synthetic probe
cagctccctgcctccttcaacttcggcgcaattcgagccacggagatccaagaactcctc

SEQ ID NO: 3229 - DNA, 60 bp, Artificial Sequence
  Description of Artificial Sequence: Synthetic probe
gtacaagacagcactcatcaaacctgagaaacagttgtgtaacttcgacctgttgaagtt

SEQ ID NO: 3230 - DNA, 60 bp, Artificial Sequence
  Description of Artificial Sequence: Synthetic probe
cccgcccgctccgagtgaggtacacacacgtgactgacaggtacaagacagcactcatca

SEQ ID NO: 3231 - DNA, 60 bp, Artificial Sequence
  Description of Artificial Sequence: Synthetic probe
ctttactgcccccgcccgctccgagtgaggtacacacacgtgactgacaggtacaagaca

SEQ ID NO: 3232 - DNA, 60 bp, Artificial Sequence
  Description of Artificial Sequence: Synthetic probe
ttgttgtgtgaatcaggtgaggtgtactaccgcatgaagcgcgctgagctttactgcccc

SEQ ID NO: 3233 - DNA, 60 bp, Artificial Sequence
  Description of Artificial Sequence: Synthetic probe
gattgttgtgtgaatcaggtgaggtgtactaccgcatgaagcgcgctgagctttactgcc

SEQ ID NO: 3234 - DNA, 60 bp, Artificial Sequence
  Description of Artificial Sequence: Synthetic probe
ccacgccggggtgacctggccgtgctgagccagcgcgttgagaatgaaaccacaagatgc

SEQ ID NO: 3235 - DNA, 60 bp, Artificial Sequence
  Description of Artificial Sequence: Synthetic probe
acccaacgcgtcgccccacgccggggtgacctggccgtgctgagccagcgcgttgagaat

SEQ ID NO: 3236 - DNA, 60 bp, Artificial Sequence
  Description of Artificial Sequence: Synthetic probe
caactgtgtacaatggtaactgcaagtacaacaaaacccaacgcgtcgccccacgccggg

SEQ ID NO: 3237 - DNA, 60 bp, Artificial Sequence
  Description of Artificial Sequence: Synthetic probe
tgttcactcgaagggctcagtcgcccgctttgcactaccctacaccgcaccacacggtgt

SEQ ID NO: 3238 - DNA, 60 bp, Artificial Sequence
  Description of Artificial Sequence: Synthetic probe
atgcccacacaccgacagagtggaggacaacccagttgttcactcgaagggctcagtcgc

SEQ ID NO: 3239 - DNA, 60 bp, Artificial Sequence
  Description of Artificial Sequence: Synthetic probe
cgcccgttttgcattgccctacactgccccacacaggtgcttggcaacactgtacaacgg

SEQ ID NO: 3240 - DNA, 60 bp, Artificial Sequence
  Description of Artificial Sequence: Synthetic probe
atcgcaccgcccgttttgcattgccctacactgccccacacaggtgcttggcaacactgt

SEQ ID NO: 3241 - DNA, 60 bp, Artificial Sequence
  Description of Artificial Sequence: Synthetic probe
gaatcgcaccactcgtttcgcactgccctacactgccccacacaggtgcttggcaacact

SEQ ID NO: 3242 - DNA, 60 bp, Artificial Sequence
  Description of Artificial Sequence: Synthetic probe
agcggctgcccacctcgtttaactacggcgctgtaaaggctgaaaccatcactgagcttt

SEQ ID NO: 3243 - DNA, 60 bp, Artificial Sequence
  Description of Artificial Sequence: Synthetic probe
cagtcgacgtttactaccggatgaagagagcggagctttactgtccgaggcctctcctcc

SEQ ID NO: 3244 - DNA, 60 bp, Artificial Sequence
  Description of Artificial Sequence: Synthetic probe
gacctcttttggctattcacccgagccaggccagacacaaacaaaagatcgtggcgccgg

SEQ ID NO: 3245 - DNA, 60 bp, Artificial Sequence
  Description of Artificial Sequence: Synthetic probe
tgcccccgacctcttttggctattcacccgagccaggccagacacaaacaaaagatcgtg

SEQ ID NO: 3246 - DNA, 60 bp, Artificial Sequence
  Description of Artificial Sequence: Synthetic probe
aatgtgaggggtgacctccaggtgttggcccagaaggcggcgagaacgttgcccacctcc

SEQ ID NO: 3247 - DNA, 60 bp, Artificial Sequence
  Description of Artificial Sequence: Synthetic probe
ggcaccccgacgaccaatgtgaggggtgacctccaggtgttggcccagaaggcggcgaga

SEQ ID NO: 3248 - DNA, 60 bp, Artificial Sequence
  Description of Artificial Sequence: Synthetic probe
caccgcgttctggcaactgtttacaacggaaactgcaagtacggtggcaccccgacgacc

SEQ ID NO: 3249 - DNA, 60 bp, Artificial Sequence
  Description of Artificial Sequence: Synthetic probe
gaccacaccgcgttctggcaactgtttacaacggaaactgcaagtacggtggcaccccga

SEQ ID NO: 3250 - DNA, 60 bp, Artificial Sequence
  Description of Artificial Sequence: Synthetic probe
atatcacaaggcaccactcacccgacttgctctgccgtacacgcgaccacaccgcgttct

SEQ ID NO: 3251 - DNA, 60 bp, Artificial Sequence
  Description of Artificial Sequence: Synthetic probe
cacagcatatcacaaggcaccactcacccgacttgctctgccgtacacgcgaccacaccg

SEQ ID NO: 3252 - DNA, 60 bp, Artificial Sequence
  Description of Artificial Sequence: Synthetic probe
cggagcgcctgaaacagcactggacaacaccaccaaccccacagcatatcacaaggcacc

SEQ ID NO: 3253 - DNA, 60 bp, Artificial Sequence
  Description of Artificial Sequence: Synthetic probe
tgggttccgaacggagcgcctgaaacagcactggacaacaccaccaaccccacagcatat

SEQ ID NO: 3254 - DNA, 56 bp, Artificial Sequence
  Description of Artificial Sequence: Synthetic probe
atcacgcagaccgggataggttcgacgccccgattggtgtcgagaaacaactgtgc

SEQ ID NO: 3255 - DNA, 60 bp, Artificial Sequence
  Description of Artificial Sequence: Synthetic probe
atcacgcagaccgggataggttcgacgccccgattggtgtcgagaaacaactgtgcaact

SEQ ID NO: 3256 - DNA, 60 bp, Artificial Sequence
  Description of Artificial Sequence: Synthetic probe
aagcgtgctgaactttactgtcccagacctcttctcccggcctacgatcacgcagaccgg

SEQ ID NO: 3257 - DNA, 60 bp, Artificial Sequence
  Description of Artificial Sequence: Synthetic probe
tgaagcgtactgaactttactgtcccagacctcttctcccggcctacgaccacgcaggcc

SEQ ID NO: 3258 - DNA, 60 bp, Artificial Sequence
  Description of Artificial Sequence: Synthetic probe
gatgaagcgtactgaactttactgtcccagacctcttctcccggcctacgaccacgcagg

SEQ ID NO: 3259 - DNA, 60 bp, Artificial Sequence
  Description of Artificial Sequence: Synthetic probe
gatgaagcgtgctgaactttactgtcccagacctcttctcccggcctacgatcacgcaga

SEQ ID NO: 3260 - DNA, 60 bp, Artificial Sequence
  Description of Artificial Sequence: Synthetic probe
ccaacacaaagcacacgctcccgtccacattcaacttcgggcacatcaccgccgacaaac

SEQ ID NO: 3261 - DNA, 60 bp, Artificial Sequence
  Description of Artificial Sequence: Synthetic probe
agtactccaacacaaagcacacgctcccgtccacattcaacttcgggcatgtcaccgccg

SEQ ID NO: 3262 - DNA, 60 bp, Artificial Sequence
  Description of Artificial Sequence: Synthetic probe
aaagtactccaacacaaagcacacgctcccgtccacattcaacttcgggcacatcaccgc

SEQ ID NO: 3263 - DNA, 60 bp, Artificial Sequence
  Description of Artificial Sequence: Synthetic probe
ctggcagcaaagtactccaacacaaagcacacgctcccgtccacattcaacttcgggcac

SEQ ID NO: 3264 - DNA, 60 bp, Artificial Sequence
  Description of Artificial Sequence: Synthetic probe
ctgtcctggcagcaaagtactccaacacaaagcacacgctcccgtccacattcaacttcg

SEQ ID NO: 3265 - DNA, 60 bp, Artificial Sequence
  Description of Artificial Sequence: Synthetic probe
cgctgttctggcagcaaagtactccaacacaaagcacacgctcccgtccacattcaactt

SEQ ID NO: 3266 - DNA, 50 bp, Artificial Sequence
  Description of Artificial Sequence: Synthetic probe
ttgtcaactgtttacaacggtgagtgtagctaccaggtgcccgttaccgc

SEQ ID NO: 3267 - DNA, 60 bp, Artificial Sequence
  Description of Artificial Sequence: Synthetic probe
acactgcaccccaccgtttgttgtcaactgtttacaacggtgagtgtagctaccaggtgc

SEQ ID NO: 3268 - DNA, 60 bp, Artificial Sequence
  Description of Artificial Sequence: Synthetic probe
acactgcgccccaccgcttgttgtcaactgtttacaacggtgagtgtagctaccaggtgc

SEQ ID NO: 3269 - DNA, 60 bp, Artificial Sequence
  Description of Artificial Sequence: Synthetic probe
tctcgcgcgatggcgtgaccaggtttgctgtgccatacactgcaccccaccgtttgttgt

SEQ ID NO: 3270 - DNA, 60 bp, Artificial Sequence
  Description of Artificial Sequence: Synthetic probe
taacccgatggttttctcgcgcgatggcgtgaccaggtttgctgtgccatacactgcacc

SEQ ID NO: 3271 - DNA, 60 bp, Artificial Sequence
  Description of Artificial Sequence: Synthetic probe
taacccgatggttttctcgcgcgatggcgtgaccaggtttgctgtgccatacactgcgcc

SEQ ID NO: 3272 - DNA, 60 bp, Artificial Sequence
  Description of Artificial Sequence: Synthetic probe
aacccaactcggagataacccgatggttttctcgcgcgatggcgtgaccaggtttgctgt

SEQ ID NO: 3273 - DNA, 60 bp, Artificial Sequence
  Description of Artificial Sequence: Synthetic probe
gcccaacggcgcacctagaacaacccaactcggagataacccgatggttttctcgcgcga

SEQ ID NO: 3274 - DNA, 60 bp, Artificial Sequence
  Description of Artificial Sequence: Synthetic probe
cccaacggcgcacctagaacaacccaactcggagataacccgatggttttctcgcgcgat

SEQ ID NO: 3275 - DNA, 60 bp, Artificial Sequence
  Description of Artificial Sequence: Synthetic probe
cgggtgtattggcaacccaacggcgcacctagaacaacccaactcggagataacccgatg

SEQ ID NO: 3276 - DNA, 60 bp, Artificial Sequence
  Description of Artificial Sequence: Synthetic probe
cgggtgtattggcagcccaacggcgcacctagaacaacccaactcggagataacccgatg

SEQ ID NO: 3277 - DNA, 60 bp, Artificial Sequence
  Description of Artificial Sequence: Synthetic probe
cgggtgtcttggcaacccaacggcgcacctagaacaacccaactcggagataacccgatg

SEQ ID NO: 3278 - DNA, 52 bp, Artificial Sequence
  Description of Artificial Sequence: Synthetic probe
acgagctgctcgtgcgcatgaagcgtgccgaactctactgccccaggccact

SEQ ID NO: 3279 - DNA, 60 bp, Artificial Sequence
  Description of Artificial Sequence: Synthetic probe
cgtgaccgccgacaaaccagtcgacgtttactaccggatgaagagagcggagctctactg

SEQ ID NO: 3280 - DNA, 60 bp, Artificial Sequence
  Description of Artificial Sequence: Synthetic probe
ggctacgtgaccgccgacaaaccagtcgacgtttactaccggatgaagagagcggagctc

SEQ ID NO: 3281 - DNA, 60 bp, Artificial Sequence
  Description of Artificial Sequence: Synthetic probe
gagaaagcaaacatcaccacagatgacaagactcttgacgaggcggaaaagaaccccctg

SEQ ID NO: 3282 - DNA, 60 bp, Artificial Sequence
  Description of Artificial Sequence: Synthetic probe
ccccaggagacagcacaccaacgtcgagtttctgcttgacaggttcacacacattggggc

SEQ ID NO: 3283 - DNA, 60 bp, Artificial Sequence
  Description of Artificial Sequence: Synthetic probe
acaactcacgctgttcccacaccagttcatcaacccacgtaccaacacgacggcacacat

SEQ ID NO: 3284 - DNA, 59 bp, Artificial Sequence
  Description of Artificial Sequence: Synthetic probe
aggtgtcgtcgcaagacagacacaaacagaagatcattgcaccagcaaaacagtctttg

SEQ ID NO: 3285 - DNA, 60 bp, Artificial Sequence
  Description of Artificial Sequence: Synthetic probe
cacggtgggagtgtagtagagaagagacggatgcacacagatgttgcgttcgtgcttgac

SEQ ID NO: 3286 - DNA, 60 bp, Artificial Sequence
  Description of Artificial Sequence: Synthetic probe
gcacggtgggagtgtagtagagaagagacggatgcacacagatgttgcgttcgtgcttga

SEQ ID NO: 3287 - DNA, 60 bp, Artificial Sequence
  Description of Artificial Sequence: Synthetic probe
ctgtattgcccgcgccccgttctcacgcactatgaccacggagacaaagaccgctacaag

SEQ ID NO: 3288 - DNA, 60 bp, Artificial Sequence
  Description of Artificial Sequence: Synthetic probe
agagggccgagctgtattgcccgcgccccgttctcacgcactatgaccacggagacaaag

SEQ ID NO: 3289 - DNA, 60 bp, Artificial Sequence
  Description of Artificial Sequence: Synthetic probe
tacaccgagagcgaagtggacgtgtacgtgcgaatgaagagggccgagctgtattgcccg

SEQ ID NO: 3290 - DNA, 60 bp, Artificial Sequence
  Description of Artificial Sequence: Synthetic probe
caagtacaagcccactgaacaaccaccgcgaaccaacatccgcggtgacttggcggtgct

SEQ ID NO: 3291 - DNA, 60 bp, Artificial Sequence
  Description of Artificial Sequence: Synthetic probe
acggtgcgccacagctaaccgaggtaggtgacaacccagtcatcttctcgcacaacggca

SEQ ID NO: 3292 - DNA, 60 bp, Artificial Sequence
  Description of Artificial Sequence: Synthetic probe
tggaagttgcgtgtgtgggcactaacaagtgggttggatggacacctaacggtgcgccac

SEQ ID NO: 3293 - DNA, 60 bp, Artificial Sequence
  Description of Artificial Sequence: Synthetic probe
gatgcctcccaacacggcggcactagcaggcgagtgcgacgtcaacacaccgatgtcagc

SEQ ID NO: 3294 - DNA, 60 bp, Artificial Sequence
  Description of Artificial Sequence: Synthetic probe
ccgccaggcagaccacgtcagccggtgagggtgctgaacccgttaccacggatgcctccc

SEQ ID NO: 3295 - DNA, 60 bp, Artificial Sequence
  Description of Artificial Sequence: Synthetic probe
agacggtgctgtgattgtaagtgtgagtgctggacccgacttcgagttccggatgccact

SEQ ID NO: 3296 - DNA, 60 bp, Artificial Sequence
  Description of Artificial Sequence: Synthetic probe
tctgttcaaggttgggtgggtgtctaccaaatcaccgacacacacgagaaagacggtgct

SEQ ID NO: 3297 - DNA, 60 bp, Artificial Sequence
  Description of Artificial Sequence: Synthetic probe
tgcggaatgggacactgggctcaactccactttcacgttcacggtcccgtacatctcggc

SEQ ID NO: 3298 - DNA, 60 bp, Artificial Sequence
  Description of Artificial Sequence: Synthetic probe
tacatcccgcctgggacggccccgctgcctgacacacctgaaagtgcttcccactgctac

SEQ ID NO: 3299 - DNA, 60 bp, Artificial Sequence
  Description of Artificial Sequence: Synthetic probe
tacacaggcccgactaacaacaaggccaagtacatggtggcgtacatcccgcctgggacg

SEQ ID NO: 3300 - DNA, 60 bp, Artificial Sequence
  Description of Artificial Sequence: Synthetic probe
gcccaatactacacacaatacagtggcacactgaacttgcactttatgtacacaggcccg

SEQ ID NO: 3301 - DNA, 60 bp, Artificial Sequence
  Description of Artificial Sequence: Synthetic probe
ttgatgtggccgaggcttgtccaacgtttttggacttcaacggggtgccctacgtgaaaa

SEQ ID NO: 3302 - DNA, 60 bp, Artificial Sequence
  Description of Artificial Sequence: Synthetic probe
cgtatacaaccccgctcgcaccggctatccgggcaggtacaccaacctgcttgatgtggc

SEQ ID NO: 3303 - DNA, 60 bp, Artificial Sequence
  Description of Artificial Sequence: Synthetic probe
actgaccccaaaacatctgacccggtttacggacacgtatacaaccccgctcgcaccggc

SEQ ID NO: 3304 - DNA, 60 bp, Artificial Sequence
  Description of Artificial Sequence: Synthetic probe
gctgaagtttatgtgaacattgcaccaaccaacgtttacgtcgcaggtgagaaacccgtt

SEQ ID NO: 3305 - DNA, 60 bp, Artificial Sequence
  Description of Artificial Sequence: Synthetic probe
aggtacctttcctgggtgtagacagacacgatcaaggcatgcgccacagagcgtggaccc

SEQ ID NO: 3306 - DNA, 60 bp, Artificial Sequence
  Description of Artificial Sequence: Synthetic probe
gtaccaactcaccctattcccacaccaatacttaaatccaagaacaaacaccacagcaca

SEQ ID NO: 3307 - DNA, 60 bp, Artificial Sequence
  Description of Artificial Sequence: Synthetic probe
gtctcagccacggccacccaattcaacggtggttgcctacttgtggccatggtgcctgaa

SEQ ID NO: 3308 - DNA, 60 bp, Artificial Sequence
  Description of Artificial Sequence: Synthetic probe
ggacaactggtggactcacacgcctacatccgtaacggttgggacgtccaagtctcagcc

SEQ ID NO: 3309 - DNA, 60 bp, Artificial Sequence
  Description of Artificial Sequence: Synthetic probe
atggaacaacagtttggtgtcacgcacattctggaactgcccactgaccacaagggcatt

SEQ ID NO: 3310 - DNA, 60 bp, Artificial Sequence
  Description of Artificial Sequence: Synthetic probe
aagtttctcccagggccaaacaccaacggtctggagactcgtgtcgagcaagcagagagg

SEQ ID NO: 3311 - DNA, 60 bp, Artificial Sequence
  Description of Artificial Sequence: Synthetic probe
cgaccacccagagctcagtgggcgtcacctacgggtacgctccatcagacaagtttctcc

SEQ ID NO: 3312 - DNA, 60 bp, Artificial Sequence
  Description of Artificial Sequence: Synthetic probe
cactctgctcgaggaccgtatcatgaccaccagccatggaacgacaacctcgaccaccca

SEQ ID NO: 3313 - DNA, 60 bp, Artificial Sequence
  Description of Artificial Sequence: Synthetic probe
cacgagctcccgtctaccttcaacttcggttacgtgaccgccgacaagccagtcgacgtt

SEQ ID NO: 3314 - DNA, 60 bp, Artificial Sequence
  Description of Artificial Sequence: Synthetic probe
ggtgaccgtgccgccctggcgcaaacgtacgccaacaccagacacgagctcccgtctacc

SEQ ID NO: 3315 - DNA, 60 bp, Artificial Sequence
  Description of Artificial Sequence: Synthetic probe
tccgccgctatccgcggtgaccgtgccgccctggcgcaaacgtacgccaacaccagacac

SEQ ID NO: 3316 - DNA, 54 bp, Artificial Sequence
  Description of Artificial Sequence: Synthetic probe
ctcacacaacaacgtcacacgctttgctgttccatacaccgccccacaccggct

SEQ ID NO: 3317 - DNA, 57 bp, Artificial Sequence
  Description of Artificial Sequence: Synthetic probe
ccgaacggggcgccgcgtacaacaacactgcgcgataaccccatggtgttctcacac

SEQ ID NO: 3318 - DNA, 60 bp, Artificial Sequence
  Description of Artificial Sequence: Synthetic probe
ccgaacggggcgccgcgtacaacaacactgcgcgataaccccatggtgttctcacacaac

SEQ ID NO: 3319 - DNA, 59 bp, Artificial Sequence
  Description of Artificial Sequence: Synthetic probe
ttgtcatggacaggttcactcacgttctgacaaacaagaccgcgtttgcggttgacttg

SEQ ID NO: 3320 - DNA, 60 bp, Artificial Sequence
  Description of Artificial Sequence: Synthetic probe
ggcgctgtcacagagaagaggcgcatgcacacggacgtggcatttgtcatggacaggttc

SEQ ID NO: 3321 - DNA, 60 bp, Artificial Sequence
  Description of Artificial Sequence: Synthetic probe
ccatggtggcgctgtcacagagaagaggcgcatgcacacggacgtggcatttgtcatgga

SEQ ID NO: 3322 - DNA, 56 bp, Artificial Sequence
  Description of Artificial Sequence: Synthetic probe
gggcagacgtcgtgacgactgacccctcgacccatggtggcgctgtcacagagaag

SEQ ID NO: 3323 - DNA, 60 bp, Artificial Sequence
  Description of Artificial Sequence: Synthetic probe
accaccagctcaggagagggggcagacgtcgtgacgactgacccctcgacccatggtggc

SEQ ID NO: 3324 - DNA, 60 bp, Artificial Sequence
  Description of Artificial Sequence: Synthetic probe
gccgggacaggttcgacgccccgattggtgtcgagaaacaactgtgcaacttcgacctgt

SEQ ID NO: 3325 - DNA, 60 bp, Artificial Sequence
  Description of Artificial Sequence: Synthetic probe
gaccgggataggttcgacgccccgattggtgtcgagaaacaactgtgcaacttcgacctg

SEQ ID NO: 3326 - DNA, 60 bp, Artificial Sequence
  Description of Artificial Sequence: Synthetic probe
tcctgcttctttcaactacggtgcaatcaaggccgacaacgtacacgagcttctcgtgcg

SEQ ID NO: 3327 - DNA, 60 bp, Artificial Sequence
  Description of Artificial Sequence: Synthetic probe
aaggccacccgggtgactgaactgctttaccgcatgaagagggccgaaacatactgcccc

SEQ ID NO: 3328 - DNA, 60 bp, Artificial Sequence
  Description of Artificial Sequence: Synthetic probe
cggcggtgagacacaagtccaaagacggcaccacacggatgtcggcttcataatggacag

SEQ ID NO: 3329 - DNA, 60 bp, Artificial Sequence
  Description of Artificial Sequence: Synthetic probe
ctacggcggtgagacacaagtccaaagacggcaccacacggatgtcggcttcataatgga

SEQ ID NO: 3330 - DNA, 60 bp, Artificial Sequence
  Description of Artificial Sequence: Synthetic probe
gttaccgcggaccaaccagttgacgtgtactacaggatgaagcgtgctgaactgtactgc

SEQ ID NO: 3331 - DNA, 60 bp, Artificial Sequence
  Description of Artificial Sequence: Synthetic probe
cactttgccgtcaaccttcaacttcgggttcgtgaccgtcgacaaaccagtcgatgttta

SEQ ID NO: 3332 - DNA, 60 bp, Artificial Sequence
  Description of Artificial Sequence: Synthetic probe
ctacttttgtgaccttgagattgcatgtgtgggtgaccacactagggtcttttggcagcc

SEQ ID NO: 3333 - DNA, 60 bp, Artificial Sequence
  Description of Artificial Sequence: Synthetic probe
ctacttttgtgaccttgagattgcatgtgtgggcgaccacacaagggccttttggcagcc

SEQ ID NO: 3334 - DNA, 60 bp, Artificial Sequence
  Description of Artificial Sequence: Synthetic probe
tccttgcacaaaggctgagtgggcagctgcccacctccttcaactacgggctgtaaaggc

SEQ ID NO: 3335 - DNA, 60 bp, Artificial Sequence
  Description of Artificial Sequence: Synthetic probe
acgttcaacgtggacctgatggacaccaaggaaaagaccctagtaggtgccctcctgagg

SEQ ID NO: 3336 - DNA, 60 bp, Artificial Sequence
  Description of Artificial Sequence: Synthetic probe
ggctggtaccggtaggcggggtgacttgggggccctcgcggcgcgagtagccgcacaact

SEQ ID NO: 3337 - DNA, 60 bp, Artificial Sequence
  Description of Artificial Sequence: Synthetic probe
acgatcacaataaccgggacaggttcgacgcccccatcggcgttgaaaaacagttgtgca

SEQ ID NO: 3338 - DNA, 60 bp, Artificial Sequence
  Description of Artificial Sequence: Synthetic probe
caacacacggacgtcagtttcatcatggacagatttgtgaagatagacagccttggtccc

SEQ ID NO: 3339 - DNA, 60 bp, Artificial Sequence
  Description of Artificial Sequence: Synthetic probe
ccgaagacgccaacacacggacgtcagtttcatcatggacagatttgtgaagatagacag

SEQ ID NO: 3340 - DNA, 60 bp, Artificial Sequence
  Description of Artificial Sequence: Synthetic probe
gcggccacgtactacttctctgacctggagattgtggtgcgtcacgacggcaacctgaca

SEQ ID NO: 3341 - DNA, 60 bp, Artificial Sequence
  Description of Artificial Sequence: Synthetic probe
tgcggccacgtactacttctctgacctggagattgtggtgcgtcacgacggcaacctgac

SEQ ID NO: 3342 - DNA, 60 bp, Artificial Sequence
  Description of Artificial Sequence: Synthetic probe
cacgctgtgttcgccctcaacacgtctgagggctggtatgctattgatgatgaggtgttc

SEQ ID NO: 3343 - DNA, 60 bp, Artificial Sequence
  Description of Artificial Sequence: Synthetic probe
acacgctgtgttcgccctcaacacgtctgagggctggtatgctattgatgatgaggtgtt

SEQ ID NO: 3344 - DNA, 60 bp, Artificial Sequence
  Description of Artificial Sequence: Synthetic probe
ctggctgacttccacgccggtattttcatcaagggtactgaacacgctgtgttcgccctc

SEQ ID NO: 3345 - DNA, 60 bp, Artificial Sequence
  Description of Artificial Sequence: Synthetic probe
accatgactctggctgacttccacgccggtattttcatcaagggtactgaacacgctgtg

SEQ ID NO: 3346 - DNA, 60 bp, Artificial Sequence
  Description of Artificial Sequence: Synthetic probe
gcaccagcactcgcccaagcgagatctgtgtcatcaacggagtcaccatgactctggctg

SEQ ID NO: 3347 - DNA, 60 bp, Artificial Sequence
  Description of Artificial Sequence: Synthetic probe
gtgttggcaccagcactcgcccaagcgagatctgtgtcatcaacggagtcaccatgactc

SEQ ID NO: 3348 - DNA, 60 bp, Artificial Sequence
  Description of Artificial Sequence: Synthetic probe
tgggccaccagcactcgtgctttggctcatcaagggctgtcttcaaaccggtgttggcac

SEQ ID NO: 3349 - DNA, 60 bp, Artificial Sequence
  Description of Artificial Sequence: Synthetic probe
gacaactgactgttttagcgttttgttcgagatctttcacaggctcagacacacgctcaa

SEQ ID NO: 3350 - DNA, 60 bp, Artificial Sequence
  Description of Artificial Sequence: Synthetic probe
atgaagacaactgactgttttagcgttttgttcgagatctttcacaggctcagacacacg

SEQ ID NO: 3351 - DNA, 60 bp, Artificial Sequence
  Description of Artificial Sequence: Synthetic probe
cgctgcccacctccttcaactacggtgccatcaaggccactcgggtgacagaactgcttt

SEQ ID NO: 3352 - DNA, 60 bp, Artificial Sequence
  Description of Artificial Sequence: Synthetic probe
actggtgggcgcaatcctgcgcgctgccacgtactacttctcggacttggaggtggcatg

SEQ ID NO: 3353 - DNA, 60 bp, Artificial Sequence
  Description of Artificial Sequence: Synthetic probe
actggtgggcgcaatcctgcgcgctgccacgtactacttctcggacttggaggtggcgtg

SEQ ID NO: 3354 - DNA, 53 bp, Artificial Sequence
  Description of Artificial Sequence: Synthetic probe
gataaccaacacacactcgacgtgatgcaggcacacaaagacaatatcgtggg

SEQ ID NO: 3355 - DNA, 60 bp, Artificial Sequence
  Description of Artificial Sequence: Synthetic probe
agaactcctcgtgcgcatgaagcgtgccgagctctactgccccaggccactgttggcggt

SEQ ID NO: 3356 - DNA, 60 bp, Artificial Sequence
  Description of Artificial Sequence: Synthetic probe
agaactcctcgtgcgcatgaagcgtgccgagctctactgccccaggccactgctggcggt

SEQ ID NO: 3357 - DNA, 60 bp, Artificial Sequence
  Description of Artificial Sequence: Synthetic probe
gagcttctcgtgcgcatgaagcgtgccgagctctactgccccaggccactgctggcggtg

SEQ ID NO: 3358 - DNA, 60 bp, Artificial Sequence
  Description of Artificial Sequence: Synthetic probe
ggggcaggccagtcttcccccgcaacagggtcacaaaaccaatctggtaacactggcagc

SEQ ID NO: 3359 - DNA, 60 bp, Artificial Sequence
  Description of Artificial Sequence: Synthetic probe
ggagcaggtcagtcgtcgccagccacagggtcacaaaaccaatctggtaacactggcagc

SEQ ID NO: 3360 - DNA, 60 bp, Artificial Sequence
  Description of Artificial Sequence: Synthetic probe
gccgtgttcgctctcaacacatctgagggctggtacgccattgatgatgaggtgttctac

SEQ ID NO: 3361 - DNA, 60 bp, Artificial Sequence
  Description of Artificial Sequence: Synthetic probe
cacgctgtgttcgccctcaacacatccgagggctggtacgccattgatgatgaggtgttc

SEQ ID NO: 3362 - DNA, 53 bp, Artificial Sequence
  Description of Artificial Sequence: Synthetic probe
ccactcaggaccgccgtaaacaggagatcattgcacctgagaagcagatgata

SEQ ID NO: 3363 - DNA, 60 bp, Artificial Sequence
  Description of Artificial Sequence: Synthetic probe
cgctctcaacacatccgagggctggtacgctattgatgatgaggtgttctacccatggac

SEQ ID NO: 3364 - DNA, 60 bp, Artificial Sequence
  Description of Artificial Sequence: Synthetic probe
gcagtgttcgctctcaacacatccgagggctggtacgctattgatgatgaggtgttctac

SEQ ID NO: 3365 - DNA, 58 bp, Artificial Sequence
  Description of Artificial Sequence: Synthetic probe
tgatcaaacagctttctgattacaccaaacttgacctttcagacggtggaccaccggc

SEQ ID NO: 3366 - DNA, 60 bp, Artificial Sequence
  Description of Artificial Sequence: Synthetic probe
tgatcaaacagctttctgattacaccaaacttgacctttcagacggtggaccaccggctc

SEQ ID NO: 3367 - DNA, 55 bp, Artificial Sequence
  Description of Artificial Sequence: Synthetic probe
actcaagggagccgggcaatccagcccggcgaccgggtcacagaaccagtctggc

SEQ ID NO: 3368 - DNA, 60 bp, Artificial Sequence
  Description of Artificial Sequence: Synthetic probe
aaaggttcaaaagcgactcaagggagccgggcaatccagcccggcgaccgggtcacagaa

SEQ ID NO: 3369 - DNA, 60 bp, Artificial Sequence
  Description of Artificial Sequence: Synthetic probe
tggaaggcaaaggttcaaaagcgactcaagggagccgggcaatccagcccggcgaccggg

SEQ ID NO: 3370 - DNA, 60 bp, Artificial Sequence
  Description of Artificial Sequence: Synthetic probe
cttaacggagaatggaaggcaaaggttcaaaagcgactcaagggagccgggcaatccagc

SEQ ID NO: 3371 - DNA, 60 bp, Artificial Sequence
  Description of Artificial Sequence: Synthetic probe
cgggagtgttcgggacggcttacctcgtgcctcgtcatcttttcgctgagaagtatgaca

SEQ ID NO: 3372 - DNA, 60 bp, Artificial Sequence
  Description of Artificial Sequence: Synthetic probe
cttctcgtgcgcatgaaacgggccgagctctactgccctagaccactgttggcattagag

SEQ ID NO: 3373 - DNA, 60 bp, Artificial Sequence
  Description of Artificial Sequence: Synthetic probe
agcttctcgtgcgcatgaaacgggccgagctctactgtcccagaccgctgttggcagtag

SEQ ID NO: 3374 - DNA, 60 bp, Artificial Sequence
  Description of Artificial Sequence: Synthetic probe
caaccccatggttttctcgcgcaaccgtgtcactcggttcgccgtgccatacaccgcacc

SEQ ID NO: 3375 - DNA, 60 bp, Artificial Sequence
  Description of Artificial Sequence: Synthetic probe
gtgcgttgttgcgtgcagccacgtactacttctccgacttggagattgttgtgcggcacg

SEQ ID NO: 3376 - DNA, 60 bp, Artificial Sequence
  Description of Artificial Sequence: Synthetic probe
gagacgcacattccaaccaccttcaactacggcaggatctacacggaggcggaagtcgac

SEQ ID NO: 3377 - DNA, 60 bp, Artificial Sequence
  Description of Artificial Sequence: Synthetic probe
caggtacgagcacggcgggaaacaccgttacaaggtggccctcaccaaacctgccaaaca

SEQ ID NO: 3378 - DNA, 60 bp, Artificial Sequence
  Description of Artificial Sequence: Synthetic probe
cgctcgcagagcgcatcgcaacggaaacgcacattccaaccaccttcaactacggcagga

SEQ ID NO: 3379 - DNA, 60 bp, Artificial Sequence
  Description of Artificial Sequence: Synthetic probe
ctacactgctccacacaggtgtttggccaccacttacaacggtgactgcaagtacaaacc

SEQ ID NO: 3380 - DNA, 60 bp, Artificial Sequence
  Description of Artificial Sequence: Synthetic probe
aacaaatgggtcggttggactcccaacggagccccagagttggatgaggtgggcgacaac

SEQ ID NO: 3381 - DNA, 60 bp, Artificial Sequence
  Description of Artificial Sequence: Synthetic probe
agacgttgcgttccttcttgaccgattcacactaatcggtaagacacagggccgcaggtt

SEQ ID NO: 3382 - DNA, 60 bp, Artificial Sequence
  Description of Artificial Sequence: Synthetic probe
gcagtcgttgtgtcggtaagcgctggatccgacttcgagttcagaatgccgatcggccct

SEQ ID NO: 3383 - DNA, 60 bp, Artificial Sequence
  Description of Artificial Sequence: Synthetic probe
gtccagggttgggttggcgtgtatcagatcacggacacacacgagaaggacggcgcagtc

SEQ ID NO: 3384 - DNA, 60 bp, Artificial Sequence
  Description of Artificial Sequence: Synthetic probe
ccgcggctgatttcgcatacacctactctgacgagcctgaacaagcttcggtccagggtt

SEQ ID NO: 3385 - DNA, 55 bp, Artificial Sequence
  Description of Artificial Sequence: Synthetic probe
cgtcacactgctaccacgcggagtgggacacaggcctcaattccaccttcacctt

SEQ ID NO: 3386 - DNA, 60 bp, Artificial Sequence
  Description of Artificial Sequence: Synthetic probe
gctcagtactacacacagtactctggcacacttaacctgcacttcatgtatactggccca

SEQ ID NO: 3387 - DNA, 60 bp, Artificial Sequence
  Description of Artificial Sequence: Synthetic probe
tggatgtggctgaggcgtgcccaacgcttctggacttcaatggggtcccatacgtgacca

SEQ ID NO: 3388 - DNA, 60 bp, Artificial Sequence
  Description of Artificial Sequence: Synthetic probe
cccgatttatggacacgtgtacaaccccgcaaggaccgcccttcccggcaggttcaccaa

SEQ ID NO: 3389 - DNA, 60 bp, Artificial Sequence
  Description of Artificial Sequence: Synthetic probe
cgctgacggctatggcggcttccaaaacactgaccccaaaacatctgacccgatttatgg

SEQ ID NO: 3390 - DNA, 60 bp, Artificial Sequence
  Description of Artificial Sequence: Synthetic probe
tctacgtggccggcgagaaacccgccaaacaagggattctccccgtggctgtcgctgacg

SEQ ID NO: 3391 - DNA, 60 bp, Artificial Sequence
  Description of Artificial Sequence: Synthetic probe
agccgaggtttacgttaacattgcaccaaccaatgtctacgtggccggcgagaaacccgc

SEQ ID NO: 3392 - DNA, 60 bp, Artificial Sequence
  Description of Artificial Sequence: Synthetic probe
caggtcccgtacttgggtgttgaccgacacgaccaagggacacgtcacaaagcgtggaca

SEQ ID NO: 3393 - DNA, 60 bp, Artificial Sequence
  Description of Artificial Sequence: Synthetic probe
cccacaccaatatctcaacccacggacgaacaccacagctcacatccaggtcccgtactt

SEQ ID NO: 3394 - DNA, 60 bp, Artificial Sequence
  Description of Artificial Sequence: Synthetic probe
cggcgaccgcgacacagttcaacggtggctgcctgctggtggccttggtaccagaattgt

SEQ ID NO: 3395 - DNA, 60 bp, Artificial Sequence
  Description of Artificial Sequence: Synthetic probe
gaatttggcactacacacattctggaactacccactgaccacaaaggcatctacggccag

SEQ ID NO: 3396 - DNA, 60 bp, Artificial Sequence
  Description of Artificial Sequence: Synthetic probe
catccccgggcccaacacaaacgggctcgagacacgggttgaacaggcggagaggttctt

SEQ ID NO: 3397 - DNA, 60 bp, Artificial Sequence
  Description of Artificial Sequence: Synthetic probe
tacgacctccaccacacagagctcggttggcatcacctacgggtacgccgactcggacct

SEQ ID NO: 3398 - DNA, 60 bp, Artificial Sequence
  Description of Artificial Sequence: Synthetic probe
gaggagacaacccttctggaggaccgcatcctcaccaccagccatgggactacgacctcc

SEQ ID NO: 3399 - DNA, 60 bp, Artificial Sequence
  Description of Artificial Sequence: Synthetic probe
ggagcgggacagtcatcaccagccacaggatcacaaaaccaatcaggcaacactggaagc

SEQ ID NO: 3400 - DNA, 60 bp, Artificial Sequence
  Description of Artificial Sequence: Synthetic probe
cgggttcgtgaccgtcgacaaaccagtcgatgtttactaccggatgaagagggctgagtt

SEQ ID NO: 3401 - DNA, 60 bp, Artificial Sequence
  Description of Artificial Sequence: Synthetic probe
aaagtactctggaaaacaacacacgctaccgtccacattcaactttggttacgttacagc

SEQ ID NO: 3402 - DNA, 60 bp, Artificial Sequence
  Description of Artificial Sequence: Synthetic probe
tatgacatgcctgttaccgcaatccgcggtgaccgcgctgtcctggcggcaaagtactct

SEQ ID NO: 3403 - DNA, 60 bp, Artificial Sequence
  Description of Artificial Sequence: Synthetic probe
ccgcgccccaccgcttgctgtcgactgtctacaacggtgaatgcaagtatgacatgcctg

SEQ ID NO: 3404 - DNA, 60 bp, Artificial Sequence
  Description of Artificial Sequence: Synthetic probe
acaccgcgccccaccgcttgctgtcgactgtctacaacggtgaatgcaagtatgacatgc

SEQ ID NO: 3405 - DNA, 60 bp, Artificial Sequence
  Description of Artificial Sequence: Synthetic probe
tttctccaaccaaggtgtgactaggtttgccgtgccatacaccgcgccccaccgcttgct

SEQ ID NO: 3406 - DNA, 60 bp, Artificial Sequence
  Description of Artificial Sequence: Synthetic probe
caacccaatggttttctccaaccaaggtgtgactaggtttgccgtgccatacaccgcgcc

SEQ ID NO: 3407 - DNA, 60 bp, Artificial Sequence
  Description of Artificial Sequence: Synthetic probe
ggcagcccaacggtgcgcctaggactacccaacttggggacaacccaatggttttctcca

SEQ ID NO: 3408 - DNA, 60 bp, Artificial Sequence
  Description of Artificial Sequence: Synthetic probe
gacacctgaccctgagaacgtgcttgcgtacgtgccttacgaccaggaaccactggacgt

SEQ ID NO: 3409 - DNA, 60 bp, Artificial Sequence
  Description of Artificial Sequence: Synthetic probe
gacacctgaccctgaaaacgtgctcgcgtacgtgccttacgaccaggaaccactggacgt

SEQ ID NO: 3410 - DNA, 60 bp, Artificial Sequence
  Description of Artificial Sequence: Synthetic probe
caagcgttgacgtttactacagaatgaagcgtgctgaattgtactgtcccaggccacttc

SEQ ID NO: 3411 - DNA, 60 bp, Artificial Sequence
  Description of Artificial Sequence: Synthetic probe
cgttaccgctgacacaagcgttgacgtttactacagaatgaagcgtgctgaattgtactg

SEQ ID NO: 3412 - DNA, 60 bp, Artificial Sequence
  Description of Artificial Sequence: Synthetic probe
ttcgcggtgaccgcgccgcgttggcgtccaaatacgctagcgcgcgacacacgcttccgt

SEQ ID NO: 3413 - DNA, 60 bp, Artificial Sequence
  Description of Artificial Sequence: Synthetic probe
aattcgcggtgaccgcgccgcgttggcgtccaaatacgctaatgcgcgacacacgcttcc

SEQ ID NO: 3414 - DNA, 60 bp, Artificial Sequence
  Description of Artificial Sequence: Synthetic probe
tgccattcgcggtgaccgcgccgcgttggcgtccaaatacgccagcgcgcgacacacgct

SEQ ID NO: 3415 - DNA, 60 bp, Artificial Sequence
  Description of Artificial Sequence: Synthetic probe
tgccattcgcggtgaccgcgccgcgttggcgtccaaatacgctagcgcgcgacacacgct

SEQ ID NO: 3416 - DNA, 60 bp, Artificial Sequence
  Description of Artificial Sequence: Synthetic probe
tgcaattcgcggtgaccgcgccgcgttggcgtccaaatacgctaatgcgcgacacacgct

SEQ ID NO: 3417 - DNA, 50 bp, Artificial Sequence
  Description of Artificial Sequence: Synthetic probe
acaccgcaccacatcgcctgctctcaaccgtttacaacggtgagtgtgag

SEQ ID NO: 3418 - DNA, 60 bp, Artificial Sequence
  Description of Artificial Sequence: Synthetic probe
tttggcaacccaacggcgcgcccagaaccactcagctcggggacaaccccatggttttct

SEQ ID NO: 3419 - DNA, 60 bp, Artificial Sequence
  Description of Artificial Sequence: Synthetic probe
gtgttttggcaacccaacggcgcgcccagaaccactcagctcggggacaaccccatggtt

SEQ ID NO: 3420 - DNA, 60 bp, Artificial Sequence
  Description of Artificial Sequence: Synthetic probe
cgcgtgttttggcaacccaacggcgcgcccagaaccactcagctcggggacaaccccatg

SEQ ID NO: 3421 - DNA, 60 bp, Artificial Sequence
  Description of Artificial Sequence: Synthetic probe
tggcaacgcgaagtgggttggatgggtgccgaatggctgcccacacaccgaccgcgtgga

SEQ ID NO: 3422 - DNA, 60 bp, Artificial Sequence
  Description of Artificial Sequence: Synthetic probe
acacattgggtcgatcaccgcctcaaagaccattgacctcctcgagacaaaagaacacac

SEQ ID NO: 3423 - DNA, 60 bp, Artificial Sequence
  Description of Artificial Sequence: Synthetic probe
ccgcacaagggtgggtaacactgtaccaaattactgacacacatgaccctgattcggctg

SEQ ID NO: 3424 - DNA, 60 bp, Artificial Sequence
  Description of Artificial Sequence: Synthetic probe
agcccgtaccatcaacacccgaggaagcggcgcactgctaccactcggaatgggacactg

SEQ ID NO: 3425 - DNA, 60 bp, Artificial Sequence
  Description of Artificial Sequence: Synthetic probe
cttcctggacgtggcggaggcatgcccgacctttctggacttcaacggaacaccttacgt

SEQ ID NO: 3426 - DNA, 60 bp, Artificial Sequence
  Description of Artificial Sequence: Synthetic probe
tggcctgcaacgacggctacggtggctttcagaacactgatcccaagacctctgacccca

SEQ ID NO: 3427 - DNA, 60 bp, Artificial Sequence
  Description of Artificial Sequence: Synthetic probe
cacagctcacgctgtttccacaccaattcatcaacccacgcacaaacaccactgcccaca

SEQ ID NO: 3428 - DNA, 60 bp, Artificial Sequence
  Description of Artificial Sequence: Synthetic probe
cacttggaccgcttcgcagcagtacgcccacgttcacctgcttgaacttcccaccgacca

SEQ ID NO: 3429 - DNA, 60 bp, Artificial Sequence
  Description of Artificial Sequence: Synthetic probe
tccgctgaccggtttctcccaggaccgaacacaagtgggctggaaacgcgagtggaacag

SEQ ID NO: 3430 - DNA, 60 bp, Artificial Sequence
  Description of Artificial Sequence: Synthetic probe
tactaccacatccaccacgcagagttcggtgggagtgacgtacggttacgcgtccgctga

SEQ ID NO: 3431 - DNA, 60 bp, Artificial Sequence
  Description of Artificial Sequence: Synthetic probe
gaccgaggaaacaaccttgctcgaggaccgaatcctcacaacacgccacaatactaccac

SEQ ID NO: 3432 - DNA, 60 bp, Artificial Sequence
  Description of Artificial Sequence: Synthetic probe
ggagcgggccagtcttcccctgccacagggtcgcagaaccaatctggcaacactggcagc

SEQ ID NO: 3433 - DNA, 60 bp, Artificial Sequence
  Description of Artificial Sequence: Synthetic probe
cggcgctgtaaaggctgacaccatcactgagcttttgatccgcatgaaacgcgcggagac

SEQ ID NO: 3434 - DNA, 60 bp, Artificial Sequence
  Description of Artificial Sequence: Synthetic probe
acgctttctgctcaccacgtacgaccacaacggagctgacaggtacaagaccacgctggt

SEQ ID NO: 3435 - DNA, 60 bp, Artificial Sequence
  Description of Artificial Sequence: Synthetic probe
cacgctttctgctcaccacgtacgaccacaacggagctgacaggtacaagaccacgctgg

SEQ ID NO: 3436 - DNA, 53 bp, Artificial Sequence
  Description of Artificial Sequence: Synthetic probe
ggcgcagtcttgcgttccgccacgtactacttttcagacttggaggtagcatg

SEQ ID NO: 3437 - DNA, 54 bp, Artificial Sequence
  Description of Artificial Sequence: Synthetic probe
ggcgcagtcctgcgttccgccacgtactacttttcagacttggaggtggcatgc

SEQ ID NO: 3438 - DNA, 53 bp, Artificial Sequence
  Description of Artificial Sequence: Synthetic probe
ggcgcaatcttgcgttccgccacgtactacttttcagacttggaggtagcatg

SEQ ID NO: 3439 - DNA, 60 bp, Artificial Sequence
  Description of Artificial Sequence: Synthetic probe
acgtacggggaaacaactccacggcgtggtgatatggcggcccttgcacaaagactgagc

SEQ ID NO: 3440 - DNA, 60 bp, Artificial Sequence
  Description of Artificial Sequence: Synthetic probe
tacactggcccaaccaacaacaaggctaagtacatggtggcctacatccctccgggcaca

SEQ ID NO: 3441 - DNA, 60 bp, Artificial Sequence
  Description of Artificial Sequence: Synthetic probe
ctcaacctgcacttcatgtacacaggcccaaccaacaacaaggctaagtacatggtggcc

SEQ ID NO: 3442 - DNA, 60 bp, Artificial Sequence
  Description of Artificial Sequence: Synthetic probe
actgacgttgccttcgttcttgaccggtttgtgcaggtccaagtgtcaggtgaacaacac

SEQ ID NO: 3443 - DNA, 60 bp, Artificial Sequence
  Description of Artificial Sequence: Synthetic probe
actggtcttgagctgcacgagggtggaccacccgctctcgttatttgggacatcaagcac

SEQ ID NO: 3444 - DNA, 60 bp, Artificial Sequence
  Description of Artificial Sequence: Synthetic probe
attacaggtcttgagctgcacgagggtggaccacccgctctcgttatttggaacattaag

SEQ ID NO: 3445 - DNA, 60 bp, Artificial Sequence
  Description of Artificial Sequence: Synthetic probe
cagttagaagaggttactggtcttgagctgcacgagggtggaccacccgctctcgttatt

SEQ ID NO: 3446 - DNA, 60 bp, Artificial Sequence
  Description of Artificial Sequence: Synthetic probe
caggcagttagaagaggttactggtcttgagctgcacgagggtggaccacccgctctcgt

SEQ ID NO: 3447 - DNA, 60 bp, Artificial Sequence
  Description of Artificial Sequence: Synthetic probe
tctgtgatttggagattacgtgtgttggagaacacgcaagagttttctggcagcccaacg

SEQ ID NO: 3448 - DNA, 60 bp, Artificial Sequence
  Description of Artificial Sequence: Synthetic probe
cggccacctactacttctgtgatttggagattacgtgtgttggagaacacgcaagagttt

SEQ ID NO: 3449 - DNA, 60 bp, Artificial Sequence
  Description of Artificial Sequence: Synthetic probe
gtccacccacgtacacactgggaagaccaccttcgaggtcaacttgatggacaccaaaga

SEQ ID NO: 3450 - DNA, 60 bp, Artificial Sequence
  Description of Artificial Sequence: Synthetic probe
gacaggtccacccatgtacacactgggaagaccaccttcgaggtcaacttgatggacacc

SEQ ID NO: 3451 - DNA, 60 bp, Artificial Sequence
  Description of Artificial Sequence: Synthetic probe
ttctcttggacaggtccacccatgtacacactgggaagaccaccttcgaggtcaacttga

SEQ ID NO: 3452 - DNA, 60 bp, Artificial Sequence
  Description of Artificial Sequence: Synthetic probe
aggcgagggagcggatgtcgtgacgacggaccccaccacacacggtggggccgttgcaaa

SEQ ID NO: 3453 - DNA, 60 bp, Artificial Sequence
  Description of Artificial Sequence: Synthetic probe
accacatcggcaggcgagggagcggatgtcgtgacgacggaccccaccacacacggtggg

SEQ ID NO: 3454 - DNA, 60 bp, Artificial Sequence
  Description of Artificial Sequence: Synthetic probe
cccgcgccccctcctgacacactacgatcacaatggcaaggatcgctacaagaccgcgat

SEQ ID NO: 3455 - DNA, 60 bp, Artificial Sequence
  Description of Artificial Sequence: Synthetic probe
acggctccgcgcgacaacatccgcggagacctcgcgactctcgcgaacaggattgccaac

SEQ ID NO: 3456 - DNA, 60 bp, Artificial Sequence
  Description of Artificial Sequence: Synthetic probe
tacaaacccgctggcacggctccgcgcgacaacatccgcggagacctcgcgactctcgcg

SEQ ID NO: 3457 - DNA, 60 bp, Artificial Sequence
  Description of Artificial Sequence: Synthetic probe
cccaacggagctccagaacttagtgaagtgggcgacaacccggtcgtcttctccgctaac

SEQ ID NO: 3458 - DNA, 60 bp, Artificial Sequence
  Description of Artificial Sequence: Synthetic probe
tgggtcggttggactcccaacggagctccagaacttagtgaagtgggcgacaacccggtc

SEQ ID NO: 3459 - DNA, 60 bp, Artificial Sequence
  Description of Artificial Sequence: Synthetic probe
caccaccaacccaacagcctaccacaaggcaccgctcacccggcttgccctgccttacac

SEQ ID NO: 3460 - DNA, 60 bp, Artificial Sequence
  Description of Artificial Sequence: Synthetic probe
acaccaccaacccaacagcctaccacaaggcaccgcttacccggcttgcattgccctaca

SEQ ID NO: 3461 - DNA, 60 bp, Artificial Sequence
  Description of Artificial Sequence: Synthetic probe
acaccaccaacccaacagcctaccacaaggcaccactcacccggcttgccttgccctaca

SEQ ID NO: 3462 - DNA, 60 bp, Artificial Sequence
  Description of Artificial Sequence: Synthetic probe
acaacaccaccaacccaacagcctaccacaaggcaccactcacccggcttgccttgccct

SEQ ID NO: 3463 - DNA, 60 bp, Artificial Sequence
  Description of Artificial Sequence: Synthetic probe
gttggacaacaccaccaacccaacagcctaccacaaggcaccgcttacccggcttgcatt

SEQ ID NO: 3464 - DNA, 60 bp, Artificial Sequence
  Description of Artificial Sequence: Synthetic probe
ttgggtcccgaacggggcgcctgaacaggcgttggacaacaccaccaacccaacagccta

SEQ ID NO: 3465 - DNA, 60 bp, Artificial Sequence
  Description of Artificial Sequence: Synthetic probe
cgggcacttctccctgcgtacgaccacgcaaacagggacaggttcgatgcaccaattggc

SEQ ID NO: 3466 - DNA, 60 bp, Artificial Sequence
  Description of Artificial Sequence: Synthetic probe
gagctgtactgtccgcgggcacttctccctgcgtacgaccacgcaaacagggacaggttc

SEQ ID NO: 3467 - DNA, 60 bp, Artificial Sequence
  Description of Artificial Sequence: Synthetic probe
aaccagtcgacgtttactaccggatgaagcgagcggagctgtactgtccgcgggcacttc

SEQ ID NO: 3468 - DNA, 60 bp, Artificial Sequence
  Description of Artificial Sequence: Synthetic probe
aagccagtcgacgtttactaccggatgaagcgagcggagctgtactgtccgcgggcactt

SEQ ID NO: 3469 - DNA, 60 bp, Artificial Sequence
  Description of Artificial Sequence: Synthetic probe
tgggcacacactaccctcgaccttcaacttcgggttcgtgaccgccgacaaaccagtcga

SEQ ID NO: 3470 - DNA, 60 bp, Artificial Sequence
  Description of Artificial Sequence: Synthetic probe
aaaatacgcctctggtgggcacacactaccctcgaccttcaacttcgggttcgtgaccgc

SEQ ID NO: 3471 - DNA, 60 bp, Artificial Sequence
  Description of Artificial Sequence: Synthetic probe
aaagtacgcctctggtaggcacacactgccctcgaccttcaacttcgggttcgtgaccgc

SEQ ID NO: 3472 - DNA, 60 bp, Artificial Sequence
  Description of Artificial Sequence: Synthetic probe
gttctggcaacccaacggagcaccgcgaaccaacgagcttggagacaaccccatggtctt

SEQ ID NO: 3473 - DNA, 60 bp, Artificial Sequence
  Description of Artificial Sequence: Synthetic probe
gttctggcaacccaacggagcaccgcgaaccaacgagctgggagacaaccccatgatctt

SEQ ID NO: 3474 - DNA, 60 bp, Artificial Sequence
  Description of Artificial Sequence: Synthetic probe
tgaacacgcgcgcgtgttctggcaacccaacggagcaccgcgaaccaacgagcttggaga

SEQ ID NO: 3475 - DNA, 60 bp, Artificial Sequence
  Description of Artificial Sequence: Synthetic probe
tgaacacgcgcgcgtgttctggcaacccaacggagcaccgcgaaccaacgagctgggaga

SEQ ID NO: 3476 - DNA, 59 bp, Artificial Sequence
  Description of Artificial Sequence: Synthetic probe
ttacccttacccaggaccgccgtaaacaggagatcattgcacctgagaaacaggacctg

SEQ ID NO: 3477 - DNA, 60 bp, Artificial Sequence
  Description of Artificial Sequence: Synthetic probe
tgaaacgcgcggagacatactgccccaggccattactggctcttacccttacccaggacc

SEQ ID NO: 3478 - DNA, 60 bp, Artificial Sequence
  Description of Artificial Sequence: Synthetic probe
gatccgcatgaaacgcgcggagacatactgccccaggccattactggctcttacccttac

SEQ ID NO: 3479 - DNA, 60 bp, Artificial Sequence
  Description of Artificial Sequence: Synthetic probe
acgagcaaccccacagtctaccacaaagcaccatttacgagacttgcacttccctacacc

SEQ ID NO: 3480 - DNA, 60 bp, Artificial Sequence
  Description of Artificial Sequence: Synthetic probe
acgagcaaccccacagtctaccacaaagcaccatttaccagactcgcactcccctacact

SEQ ID NO: 3481 - DNA, 60 bp, Artificial Sequence
  Description of Artificial Sequence: Synthetic probe
gcaacctgacgtgggtgcctaacggtgcccccgaggccgctctccagaacacgagcaacc

SEQ ID NO: 3482 - DNA, 60 bp, Artificial Sequence
  Description of Artificial Sequence: Synthetic probe
ctgcgggcagccacgtactacttctccgacctggagattgtggtgcgccatgaaggcaat

SEQ ID NO: 3483 - DNA, 54 bp, Artificial Sequence
  Description of Artificial Sequence: Synthetic probe
ccaccagcacgcgttggtgggcgccctgctgcgggcagccacgtactacttctc

SEQ ID NO: 3484 - DNA, 60 bp, Artificial Sequence
  Description of Artificial Sequence: Synthetic probe
tgtcattgacctcatgcagacccaccagcacgcgttggtgggcgccctgctgcgggcagc

SEQ ID NO: 3485 - DNA, 60 bp, Artificial Sequence
  Description of Artificial Sequence: Synthetic probe
acgtcattgacctcatgcagactcaccagcacgcgttggtgggcgccctgctgcgggcag

SEQ ID NO: 3486 - DNA, 59 bp, Artificial Sequence
  Description of Artificial Sequence: Synthetic probe
tccgtccgacgtcctgtgttttgtcccgtacgacatggaaccatttaacggaaacgcag

SEQ ID NO: 3487 - DNA, 60 bp, Artificial Sequence
  Description of Artificial Sequence: Synthetic probe
cgccatagacgacgaggacttctacccatggacaccggatccgtccgacgtcctgtgttt

SEQ ID NO: 3488 - DNA, 60 bp, Artificial Sequence
  Description of Artificial Sequence: Synthetic probe
gacggatggtacgccatagacgacgaggacttctacccatggacaccggatccgtccgac

SEQ ID NO: 3489 - DNA, 60 bp, Artificial Sequence
  Description of Artificial Sequence: Synthetic probe
gtactgaacacgcagtgttcgcctgtctgacctccgacggatggtacgccatagacgacg

SEQ ID NO: 3490 - DNA, 60 bp, Artificial Sequence
  Description of Artificial Sequence: Synthetic probe
ggattttcctcaagggtactgaacacgcagtgttcgcctgtctgacctccgacggatggt

SEQ ID NO: 3491 - DNA, 60 bp, Artificial Sequence
  Description of Artificial Sequence: Synthetic probe
ggtggacggcacagagatgtgtctcgccgacttccacgcagggattttcctcaagggtac

SEQ ID NO: 3492 - DNA, 60 bp, Artificial Sequence
  Description of Artificial Sequence: Synthetic probe
ggtgtgcatggtggacggcacagagatgtgtctcgccgacttccacgcagggattttcct

SEQ ID NO: 3493 - DNA, 60 bp, Artificial Sequence
  Description of Artificial Sequence: Synthetic probe
atcaaacacctgctctacactgggattggtactgcctcgcgacccagcgaggtgtgcatg

SEQ ID NO: 3494 - DNA, 60 bp, Artificial Sequence
  Description of Artificial Sequence: Synthetic probe
ctgggcttgagttgcacgaaggcggaccccccgccctcgtgatttggaacatcaaacacc

SEQ ID NO: 3495 - DNA, 60 bp, Artificial Sequence
  Description of Artificial Sequence: Synthetic probe
cactctccaagcaattgaacaactggaggaactcactgggcttgagttgcacgaaggcgg

SEQ ID NO: 3496 - DNA, 60 bp, Artificial Sequence
  Description of Artificial Sequence: Synthetic probe
ctcgcccgagaacctcactctccaagcaattgaacaactggaggaactcactgggcttga

SEQ ID NO: 3497 - DNA, 56 bp, Artificial Sequence
  Description of Artificial Sequence: Synthetic probe
accttacaacggtgagaagaagactttctattctaggcccaacaaacacgacaact

SEQ ID NO: 3498 - DNA, 59 bp, Artificial Sequence
  Description of Artificial Sequence: Synthetic probe
atgaatacaactgactgttttatcgctttagtacaggctatcagagaggtcaagctgtt

SEQ ID NO: 3499 - DNA, 60 bp, Artificial Sequence
  Description of Artificial Sequence: Synthetic probe
gcctgcgtacgaccaccagtcacgcgacagggttgacgcacctattggggtagagaaaca

SEQ ID NO: 3500 - DNA, 60 bp, Artificial Sequence
  Description of Artificial Sequence: Synthetic probe
cacttccgtccaccttcaattttgggtacgtgaccgccgacaagccagtcgatgtttact

SEQ ID NO: 3501 - DNA, 60 bp, Artificial Sequence
  Description of Artificial Sequence: Synthetic probe
ggagacagggcggttttggcaaacaaatacgcccacagggaacacacacttccgtccacc

SEQ ID NO: 3502 - DNA, 60 bp, Artificial Sequence
  Description of Artificial Sequence: Synthetic probe
acgtggagacagggcggttttggcaaacaaatacgcccacagggaacacacacttccgtc

SEQ ID NO: 3503 - DNA, 60 bp, Artificial Sequence
  Description of Artificial Sequence: Synthetic probe
gcggccacctactacttctgtgatttggagattgcgtgtgttggagaacacacaagagtt

SEQ ID NO: 3504 - DNA, 60 bp, Artificial Sequence
  Description of Artificial Sequence: Synthetic probe
agtcccacacatgtcatagacctcatgcagacccaccaacacgggcttgtgggcgcgttg

SEQ ID NO: 3505 - DNA, 60 bp, Artificial Sequence
  Description of Artificial Sequence: Synthetic probe
accaccactgccggggagtcagcagaccctgtcaccaccaccgttgagaactacggcggt

SEQ ID NO: 3506 - DNA, 60 bp, Artificial Sequence
  Description of Artificial Sequence: Synthetic probe
gagccactcaacggggaatggaagatgaaggttcagaagcgactcaagggagccggacaa

SEQ ID NO: 3507 - DNA, 55 bp, Artificial Sequence
  Description of Artificial Sequence: Synthetic probe
gagccactcaacggggaatggaagatgaaggttcagaagcgactcaagggagccg

SEQ ID NO: 3508 - DNA, 60 bp, Artificial Sequence
  Description of Artificial Sequence: Synthetic probe
tgctctcgtcatctggaacattaaacatctgctccacaccgggatcggcaccgcctcgcg

SEQ ID NO: 3509 - DNA, 60 bp, Artificial Sequence
  Description of Artificial Sequence: Synthetic probe
gaagaactcactggccttgaactgcacgagggtggaccacctgctctcgtcatctggaac

SEQ ID NO: 3510 - DNA, 60 bp, Artificial Sequence
  Description of Artificial Sequence: Synthetic probe
ctggaggaactcactggtcttgaactgcacgagggtggaccacctgctctcgtcatctgg

SEQ ID NO: 3511 - DNA, 60 bp, Artificial Sequence
  Description of Artificial Sequence: Synthetic probe
ttggaagaactcactggccttgaactgcacgagggtggaccacctgctctcgtcatctgg

SEQ ID NO: 3512 - DNA, 60 bp, Artificial Sequence
  Description of Artificial Sequence: Synthetic probe
cctgtcaccaccactgtagagaactacggcggtgagacacaagttcagagacgccaccac

SEQ ID NO: 3513 - DNA, 60 bp, Artificial Sequence
  Description of Artificial Sequence: Synthetic probe
cctgtcaccaccactgtagagaactacggcggtgagacacaagttcagagacgccatcac

SEQ ID NO: 3514 - DNA, 60 bp, Artificial Sequence
  Description of Artificial Sequence: Synthetic probe
agaccctgtcaccaccactgtagagaactacggcggtgagacacaagttcagagacgcca

SEQ ID NO: 3515 - DNA, 60 bp, Artificial Sequence
  Description of Artificial Sequence: Synthetic probe
tgacgtttactatagaatgaagcgtgctgaattgtactgtcccaggccacttctcccggc

SEQ ID NO: 3516 - DNA, 60 bp, Artificial Sequence
  Description of Artificial Sequence: Synthetic probe
agcgttgacgtttactatagaatgaagcgtgctgaattgtactgtcccaggccacttctc

SEQ ID NO: 3517 - DNA, 60 bp, Artificial Sequence
  Description of Artificial Sequence: Synthetic probe
tcagagtgtttgagtttgaggtgaaagtaaagggacaggacatgctctcagacgccgctc

SEQ ID NO: 3518 - DNA, 60 bp, Artificial Sequence
  Description of Artificial Sequence: Synthetic probe
ccctgacagatagtgactttagagtgtttgagtttgaggtgaaagtaaagggacaggaca

SEQ ID NO: 3519 - DNA, 51 bp, Artificial Sequence
  Description of Artificial Sequence: Synthetic probe
ctgacgttgccttcgttcttgaccggtttgtgaaggtccatgtgtcgggta

SEQ ID NO: 3520 - DNA, 60 bp, Artificial Sequence
  Description of Artificial Sequence: Synthetic probe
cggtgttgcccgctttgccctgccgtatacagcaccacacagggttcttgccacagtgta

SEQ ID NO: 3521 - DNA, 60 bp, Artificial Sequence
  Description of Artificial Sequence: Synthetic probe
ggctgcccatacaccgatcgagtggaagacaacccagtcgttcacgcgaagaacggtgtc

SEQ ID NO: 3522 - DNA, 60 bp, Artificial Sequence
  Description of Artificial Sequence: Synthetic probe
ttctccgacttggagattgtggtgagacacgagggcaacttgacgtgggtgcccaacggc

SEQ ID NO: 3523 - DNA, 60 bp, Artificial Sequence
  Description of Artificial Sequence: Synthetic probe
cttctctgacttggagattgtggtaaaacacgagggcaacttgacgtgggtgcccaacgg

SEQ ID NO: 3524 - DNA, 60 bp, Artificial Sequence
  Description of Artificial Sequence: Synthetic probe
gagtcagcagaccctgtcaccaccaccgtggaaaactacggcggtgagacacaagtccag

SEQ ID NO: 3525 - DNA, 60 bp, Artificial Sequence
  Description of Artificial Sequence: Synthetic probe
cggctgcccacctcgtttaactacggcgctgtaaaggctgaaaccatcactgagcttttg

SEQ ID NO: 3526 - DNA, 60 bp, Artificial Sequence
  Description of Artificial Sequence: Synthetic probe
ctcaggtgatgcactgacctacaaagacctggtcgtttgtatggacggtgataccatgcc

SEQ ID NO: 3527 - DNA, 57 bp, Artificial Sequence
  Description of Artificial Sequence: Synthetic probe
gggtggtccaaccaggcgaggtgacctggggcctctggcggcaagagttgccgcgca

SEQ ID NO: 3528 - DNA, 60 bp, Artificial Sequence
  Description of Artificial Sequence: Synthetic probe
gggtggtccaaccaggcgaggtgacctggggcctctggcggcaagagttgccgcgcagct

SEQ ID NO: 3529 - DNA, 60 bp, Artificial Sequence
  Description of Artificial Sequence: Synthetic probe
tggagattgtggtgaggcacacaggcgagctgacgtgggtgcccaacggcgcccctgagg

SEQ ID NO: 3530 - DNA, 60 bp, Artificial Sequence
  Description of Artificial Sequence: Synthetic probe
cagaggcgacatcacacggatgtcagcttcatcatggacagatttgtaaaaataaacagc

SEQ ID NO: 3531 - DNA, 51 bp, Artificial Sequence
  Description of Artificial Sequence: Synthetic probe
cagaggcgacatcacacggatgtcagcttcatcatggacagatttgtaaaa

SEQ ID NO: 3532 - DNA, 60 bp, Artificial Sequence
  Description of Artificial Sequence: Synthetic probe
gaggtgggcgacaacccagtcgtcttttctcacaacggcactacccgctttgcactgcct

SEQ ID NO: 3533 - DNA, 60 bp, Artificial Sequence
  Description of Artificial Sequence: Synthetic probe
ccccagagctcaaagaggtgggcgacaacccagtcgtcttttctcacaacggcactaccc

SEQ ID NO: 3534 - DNA, 60 bp, Artificial Sequence
  Description of Artificial Sequence: Synthetic probe
caatggcaccacccgctttgcgctgccctacaccgctccacacaggtgcttggcaacaag

SEQ ID NO: 3535 - DNA, 60 bp, Artificial Sequence
  Description of Artificial Sequence: Synthetic probe
cgagctacagatcactttacctgcgttgggtgaacgccgtgtgcggtgacgcataatccc

SEQ ID NO: 3536 - DNA, 60 bp, Artificial Sequence
  Description of Artificial Sequence: Synthetic probe
gagattccaagctacagatcactttacctgcgttgggtgaacgccgtgtgcggacgcgca

SEQ ID NO: 3537 - DNA, 60 bp, Artificial Sequence
  Description of Artificial Sequence: Synthetic probe
ttggacgccggatccgtccgacgttttggtgtttgttccgtatgatcaagaaccactcaa

SEQ ID NO: 3538 - DNA, 60 bp, Artificial Sequence
  Description of Artificial Sequence: Synthetic probe
gtacaacggtgagtgtaaatacacagaccgggtctccgcaatccgcggtgaccgcactgt

SEQ ID NO: 3539 - DNA, 60 bp, Artificial Sequence
  Description of Artificial Sequence: Synthetic probe
tgtgtacaacggtgagtgtaaatacacagaccgggtctccgcaatccgcggtgaccgcac

SEQ ID NO: 3540 - DNA, 58 bp, Artificial Sequence
  Description of Artificial Sequence: Synthetic probe
tgtgtacaacggtgagtgtaaatacacagaccgggtctccgcaatccgcggtgaccgc

SEQ ID NO: 3541 - DNA, 60 bp, Artificial Sequence
  Description of Artificial Sequence: Synthetic probe
tgtgacctggagattgcctgcgttggcacgcacaaacgtgtttactggcagcccaatggc

SEQ ID NO: 3542 - DNA, 60 bp, Artificial Sequence
  Description of Artificial Sequence: Synthetic probe
gggcgtcaacctactacttctgtgacctggagattgcctgcgttggcacgcacaaaagtg

SEQ ID NO: 3543 - DNA, 60 bp, Artificial Sequence
  Description of Artificial Sequence: Synthetic probe
tagggcgtcaacctactacttctgtgacctggagattgcctgcgttggcacgcacaaaag

SEQ ID NO: 3544 - DNA, 60 bp, Artificial Sequence
  Description of Artificial Sequence: Synthetic probe
ctcggcacttgccgacgtcgttcaactttggtgcagttaaagcagaaacagtcactgagc

SEQ ID NO: 3545 - DNA, 60 bp, Artificial Sequence
  Description of Artificial Sequence: Synthetic probe
acacgctcggcacttgccgacgtcgttcaactttggtgcagttaaagcagaaacagtcac

SEQ ID NO: 3546 - DNA, 60 bp, Artificial Sequence
  Description of Artificial Sequence: Synthetic probe
gcatgctcggcacttgccgacatcgttcaactttggtgcagttaaagcagaaacaatcac

SEQ ID NO: 3547 - DNA, 60 bp, Artificial Sequence
  Description of Artificial Sequence: Synthetic probe
gctagtgagacacacattccaaccactttcaactatggcaggatttacacacaagccgag

SEQ ID NO: 3548 - DNA, 60 bp, Artificial Sequence
  Description of Artificial Sequence: Synthetic probe
tgtccgaggcctatccttacgcactacgaccacggtgacaaagaccgctacaagaccgcg

SEQ ID NO: 3549 - DNA, 50 bp, Artificial Sequence
  Description of Artificial Sequence: Synthetic probe
ctgtccgaggcctatccttacgcactacgaccacggtaacaaagatcgct

SEQ ID NO: 3550 - DNA, 60 bp, Artificial Sequence
  Description of Artificial Sequence: Synthetic probe
actgtccgaggcctatccttacgcactacgaccacggtgacaaagaccgctacaagaccg

SEQ ID NO: 3551 - DNA, 60 bp, Artificial Sequence
  Description of Artificial Sequence: Synthetic probe
ggacacacattccaaccaccttcaactacggcaggatctacacacaagccgaggttgacg

SEQ ID NO: 3552 - DNA, 60 bp, Artificial Sequence
  Description of Artificial Sequence: Synthetic probe
tcgcaagtgggacacacattccaaccaccttcaactacggcaggatctacacacaagccg

SEQ ID NO: 3553 - DNA, 60 bp, Artificial Sequence
  Description of Artificial Sequence: Synthetic probe
atcgcaagtaagacacacattccaaccaccttcaactacggcaggatctacacacaagcc

SEQ ID NO: 3554 - DNA, 60 bp, Artificial Sequence
  Description of Artificial Sequence: Synthetic probe
atcgcaagtgggacacacattccaaccaccttcaactacggcaggatctacacacaagcc

SEQ ID NO: 3555 - DNA, 60 bp, Artificial Sequence
  Description of Artificial Sequence: Synthetic probe
gttcaacttcggctacgtgaccgccgacaagccagtcgacgtttactaccgaatgaagag

SEQ ID NO: 3556 - DNA, 60 bp, Artificial Sequence
  Description of Artificial Sequence: Synthetic probe
aaacggaaccacccgcttcgcactgccctacaccgctccacacaggtgcttggcaacatc

SEQ ID NO: 3557 - DNA, 60 bp, Artificial Sequence
  Description of Artificial Sequence: Synthetic probe
aaacggaaccacccgcttcgcagtgccctacaccgctccacacaggtgcttggcaacatc

SEQ ID NO: 3558 - DNA, 60 bp, Artificial Sequence
  Description of Artificial Sequence: Synthetic probe
cgtcttctccagaaacggaaccacccgcttcgcactgccctacaccgctccacacaggtg

SEQ ID NO: 3559 - DNA, 60 bp, Artificial Sequence
  Description of Artificial Sequence: Synthetic probe
tctccagagttcgatgaagtgggcgacaacccagtcgtctcctccagaaacggaaccacc

SEQ ID NO: 3560 - DNA, 60 bp, Artificial Sequence
  Description of Artificial Sequence: Synthetic probe
gactcccaacggagctccagagttcgatgaagtgggcgacaacccagtcgtcttctccag

SEQ ID NO: 3561 - DNA, 60 bp, Artificial Sequence
  Description of Artificial Sequence: Synthetic probe
tggactcccaacagatctccagagttcgatgaagtgggcgacaacccagtcgtctcctcc

SEQ ID NO: 3562 - DNA, 60 bp, Artificial Sequence
  Description of Artificial Sequence: Synthetic probe
cttctggcaatagaggtgtcttcacaagacagacacaaacagaagatcattgcacccgca

SEQ ID NO: 3563 - DNA, 60 bp, Artificial Sequence
  Description of Artificial Sequence: Synthetic probe
attcgggccacgaccatccacgagcttctcgtgcgcatgaaacgtgccgagctctactgt

SEQ ID NO: 3564 - DNA, 60 bp, Artificial Sequence
  Description of Artificial Sequence: Synthetic probe
ctgactccaggcactcgcttccatccacgttcaactttggacatgtgaccgccgacagac

SEQ ID NO: 3565 - DNA, 60 bp, Artificial Sequence
  Description of Artificial Sequence: Synthetic probe
gcaccgggtcctcgcgaccaggtacaacggtgaatgtaaatacacagatcgggtctcccc

SEQ ID NO: 3566 - DNA, 60 bp, Artificial Sequence
  Description of Artificial Sequence: Synthetic probe
accttacactgcaccgcaccgggtcctcgcgaccaggtacaacggtgaatgtaaatacac

SEQ ID NO: 3567 - DNA, 58 bp, Artificial Sequence
  Description of Artificial Sequence: Synthetic probe
ttttgcccacaacggtgtcactcggtttgctgtaccttacactgcaccgcaccgggtc

SEQ ID NO: 3568 - DNA, 60 bp, Artificial Sequence
  Description of Artificial Sequence: Synthetic probe
ggcgataaccccatggtttttgcccacaacggtgtcactcggtttgctgtaccttacact

SEQ ID NO: 3569 - DNA, 60 bp, Artificial Sequence
  Description of Artificial Sequence: Synthetic probe
ctactggcagcccaacggagcgccgcgcacaacacagctgggcgataaccccatggtttt

SEQ ID NO: 3570 - DNA, 60 bp, Artificial Sequence
  Description of Artificial Sequence: Synthetic probe
acacgcgtgtctactggcagcccaacggagcgccgcgcacaacacagctgggcgataacc

SEQ ID NO: 3571 - DNA, 53 bp, Artificial Sequence
  Description of Artificial Sequence: Synthetic probe
ggcgtcaacctactatttctgtgatctggagatcgcgtgtgttggcgaacaca

SEQ ID NO: 3572 - DNA, 60 bp, Artificial Sequence
  Description of Artificial Sequence: Synthetic probe
ggcgtcaacctactatttctgtgatctggagatcgcgtgtgttggcgaacacacgcgtgt

SEQ ID NO: 3573 - DNA, 60 bp, Artificial Sequence
  Description of Artificial Sequence: Synthetic probe
cctcatggacaccaagcaacacgccctagtgggtgctctcctcagggcgtcaacctacta

SEQ ID NO: 3574 - DNA, 60 bp, Artificial Sequence
  Description of Artificial Sequence: Synthetic probe
gtggacctcatggacaccaagcaacacgccctagtgggtgctctcctcagggcgtcaacc

SEQ ID NO: 3575 - DNA, 60 bp, Artificial Sequence
  Description of Artificial Sequence: Synthetic probe
tcacccacgttcacactagcaaaaccactttcaatgtggacctcatggacaccaagcaac

SEQ ID NO: 3576 - DNA, 60 bp, Artificial Sequence
  Description of Artificial Sequence: Synthetic probe
tcgtgcttgacagattcacccacgttcacactagcaaaaccactttcaatgtggacctca

SEQ ID NO: 3577 - DNA, 60 bp, Artificial Sequence
  Description of Artificial Sequence: Synthetic probe
cggcgggaatgtgttggagaagaggcggatgcacacagacgtcgcattcgtgcttgacag

SEQ ID NO: 3578 - DNA, 60 bp, Artificial Sequence
  Description of Artificial Sequence: Synthetic probe
acacggcgggaatgtgttggagaagaggcggatgcacacagacgtcgcattcgtgcttga

SEQ ID NO: 3579 - DNA, 60 bp, Artificial Sequence
  Description of Artificial Sequence: Synthetic probe
agagggagcggacgtagtcacaacggacccctcgacacacggcgggaatgtgttggagaa

SEQ ID NO: 3580 - DNA, 60 bp, Artificial Sequence
  Description of Artificial Sequence: Synthetic probe
accaccagtgccggagagggagcggacgtagtcacaacggacccctcgacacacggcggg

SEQ ID NO: 3581 - DNA, 53 bp, Artificial Sequence
  Description of Artificial Sequence: Synthetic probe
accaccactaccggggagtctgcagaccctgtcaccaccaccgtcgaaaacta

SEQ ID NO: 3582 - DNA, 60 bp, Artificial Sequence
  Description of Artificial Sequence: Synthetic probe
cggtgaaggtctcgtctcaagacagacacaaacagaagatcattgcaccagtaaaacagc

SEQ ID NO: 3583 - DNA, 60 bp, Artificial Sequence
  Description of Artificial Sequence: Synthetic probe
ccactactggcggtggaggtgtccgcagacaggcacaagcagaaaattatcgcacctgca

SEQ ID NO: 3584 - DNA, 60 bp, Artificial Sequence
  Description of Artificial Sequence: Synthetic probe
atccacgagctcctcgtgcgcatgaagcgggctgagctctactgccccagaccactactg

SEQ ID NO: 3585 - DNA, 60 bp, Artificial Sequence
  Description of Artificial Sequence: Synthetic probe
ggcgaggtgacctggggtctctggcggcaagagttgccgcgcaacttcctgcatccttca

SEQ ID NO: 3586 - DNA, 60 bp, Artificial Sequence
  Description of Artificial Sequence: Synthetic probe
cgggcggttcaaccaggcgaggtgacctggggtctctggcggcaagagttgccgcgcaac

SEQ ID NO: 3587 - DNA, 60 bp, Artificial Sequence
  Description of Artificial Sequence: Synthetic probe
ttggcaacggtgtacaacgggacgaacaagtactccgcgggcggttcaaccaggcgaggt

SEQ ID NO: 3588 - DNA, 60 bp, Artificial Sequence
  Description of Artificial Sequence: Synthetic probe
gccacaccgcgtgttggcaacggtgtacaacgggacgaacaagtactccgcgggcggttc

SEQ ID NO: 3589 - DNA, 54 bp, Artificial Sequence
  Description of Artificial Sequence: Synthetic probe
actaccacaacgggggaatctgcagaccctgttacaaccaccgttgagaactac

SEQ ID NO: 3590 - DNA, 56 bp, Artificial Sequence
  Description of Artificial Sequence: Synthetic probe
aatccacccatgtcattgacctcatgcaaacccaccaacacggtctagtgggtgcg

SEQ ID NO: 3591 - DNA, 60 bp, Artificial Sequence
  Description of Artificial Sequence: Synthetic probe
gctgatggttaggtacactcacaccacagacagatacaaagttgcgcttgtgtcaccagc

SEQ ID NO: 3592 - DNA, 60 bp, Artificial Sequence
  Description of Artificial Sequence: Synthetic probe
tgcccacacaccgaccgcgtggaagacaacccagtcgttcacgccaaggggaatgttacc

SEQ ID NO: 3593 - DNA, 60 bp, Artificial Sequence
  Description of Artificial Sequence: Synthetic probe
cccgtatgatcaagaatcactcaatggagaatggaaggcaaaggttcagaaaaggctcaa

SEQ ID NO: 3594 - DNA, 60 bp, Artificial Sequence
  Description of Artificial Sequence: Synthetic probe
agactcgctccacactggaatcggcactgcttcgcgacccagcgaggtgtgtatggttga

SEQ ID NO: 3595 - DNA, 60 bp, Artificial Sequence
  Description of Artificial Sequence: Synthetic probe
tttggaacattaaagactcgctccacactggaatcggcactgcttcgcgacccagcgagg

SEQ ID NO: 3596 - DNA, 60 bp, Artificial Sequence
  Description of Artificial Sequence: Synthetic probe
tgaactacacgagggtggaccgcccgctcttgtcatttggaacattaaagactcgctcca

SEQ ID NO: 3597 - DNA, 60 bp, Artificial Sequence
  Description of Artificial Sequence: Synthetic probe
cgaggagagatggaattcacgctttacaacggtgagaaaaagaccttctactccaggccc

SEQ ID NO: 3598 - DNA, 60 bp, Artificial Sequence
  Description of Artificial Sequence: Synthetic probe
ctacggcgctgtgaaggctgacaccattactgagcttttgatccgcatgaaacgcgcgga

SEQ ID NO: 3599 - DNA, 60 bp, Artificial Sequence
  Description of Artificial Sequence: Synthetic probe
ttggtgcaattcgggccacgaccatccacgagcttctcgtgcgcatgaaacgtgccgagc

SEQ ID NO: 3600 - DNA, 60 bp, Artificial Sequence
  Description of Artificial Sequence: Synthetic probe
cgccacaccgcgtgttggcaactgtttacaacgggaactgcaagtacggtgatggtgcgg

SEQ ID NO: 3601 - DNA, 60 bp, Artificial Sequence
  Description of Artificial Sequence: Synthetic probe
gcgccacaccgcgtgttggcaactgtttacaacgggaactgcaagtacggtgatggtgcg

SEQ ID NO: 3602 - DNA, 60 bp, Artificial Sequence
  Description of Artificial Sequence: Synthetic probe
cgcgggcaaccccaccgcctacaacaaagcaccatttacgagactagcactcccctacac

SEQ ID NO: 3603 - DNA, 60 bp, Artificial Sequence
  Description of Artificial Sequence: Synthetic probe
agcaacgcgggcaaccccaccgcctacaacaaagcaccatttacgagactagcactcccc

SEQ ID NO: 3604 - DNA, 60 bp, Artificial Sequence
  Description of Artificial Sequence: Synthetic probe
aactcagacggccagacggctccacactgacgttgccttcgttctcgacaggtttgtgaa

SEQ ID NO: 3605 - DNA, 60 bp, Artificial Sequence
  Description of Artificial Sequence: Synthetic probe
caactacggtgccatcaaagccacttgggtgactgaactgctttaccgcatgaagagggc

SEQ ID NO: 3606 - DNA, 60 bp, Artificial Sequence
  Description of Artificial Sequence: Synthetic probe
tgatggtacggtgaccaacataagaggtgaccaacaagtgttggcccagaaggcggcgag

SEQ ID NO: 3607 - DNA, 60 bp, Artificial Sequence
  Description of Artificial Sequence: Synthetic probe
cgccacaccgcgtgttggcaagctgttacaacgggaactgcaagtacggtgatggtacgg

SEQ ID NO: 3608 - DNA, 60 bp, Artificial Sequence
  Description of Artificial Sequence: Synthetic probe
gcgccacaccgcgtgttggcaagctgttacaacgggaactgcaagtacggtgatggtacg

SEQ ID NO: 3609 - DNA, 60 bp, Artificial Sequence
  Description of Artificial Sequence: Synthetic probe
ctgaactctactgccccagaccggttcttccggtccaaccagcgggcgatagacacaaac

SEQ ID NO: 3610 - DNA, 60 bp, Artificial Sequence
  Description of Artificial Sequence: Synthetic probe
cgcatgaagcgtgctgaactctactgccccagaccggttcttccggtccaaccagcgggc

SEQ ID NO: 3611 - DNA, 60 bp, Artificial Sequence
  Description of Artificial Sequence: Synthetic probe
acaccgcgtgctggccacgacgtacaccggtacaacggcttacaccaccagtgtacgcag

SEQ ID NO: 3612 - DNA, 60 bp, Artificial Sequence
  Description of Artificial Sequence: Synthetic probe
tacaccgcaccacaccgcgtgctggccacgacgtacaccggtacaacggcttacaccacc

SEQ ID NO: 3613 - DNA, 60 bp, Artificial Sequence
  Description of Artificial Sequence: Synthetic probe
caaggacagtattgtgggcgcactcctacgcgcagccacatactacttctctgccttgga

SEQ ID NO: 3614 - DNA, 60 bp, Artificial Sequence
  Description of Artificial Sequence: Synthetic probe
tcgactgacaccacgtcgacccacaccaacaacacacagaacaacgattggttttcaaaa

SEQ ID NO: 3615 - DNA, 60 bp, Artificial Sequence
  Description of Artificial Sequence: Synthetic probe
gtccaacgaggggtcgactgacaccacgtcgacccacaccaacaacacccagaacaacga

SEQ ID NO: 3616 - DNA, 60 bp, Artificial Sequence
  Description of Artificial Sequence: Synthetic probe
gtgggtccaacgaggggtcgactgacaccacgtcgacccacaccaacaacacccagaaca

SEQ ID NO: 3617 - DNA, 53 bp, Artificial Sequence
  Description of Artificial Sequence: Synthetic probe
accaccgccaccggggaatcagcagaccctgtcacaaccaccgttgagaacta

SEQ ID NO: 3618 - DNA, 60 bp, Artificial Sequence
  Description of Artificial Sequence: Synthetic probe
agctttactgcccgcgtcccctcctgacacactacgaccacggtgggaaagatcgctaca

SEQ ID NO: 3619 - DNA, 60 bp, Artificial Sequence
  Description of Artificial Sequence: Synthetic probe
gcgcggagctttactgcccgcgtcccctcctgacacactacgaccacggtgggaaagatc

SEQ ID NO: 3620 - DNA, 60 bp, Artificial Sequence
  Description of Artificial Sequence: Synthetic probe
gcgtgagagacatcacgaagcactttcgtgacacagcaagaatgaagaaaggcacacccg

SEQ ID NO: 3621 - DNA, 60 bp, Artificial Sequence
  Description of Artificial Sequence: Synthetic probe
ccgtgtgagagacatcacgaagcactttcgtgacacagcaagaatgaagaaaggcacccc

SEQ ID NO: 3622 - DNA, 60 bp, Artificial Sequence
  Description of Artificial Sequence: Synthetic probe
accgtgtgagagacatcacgaagcactttcgtgacacagcaagaatgaagaaaggcaccc

SEQ ID NO: 3623 - DNA, 60 bp, Artificial Sequence
  Description of Artificial Sequence: Synthetic probe
accgcgtgagagacatcacgaagcactttcgtgacacagcaagaatgaagaaaggcacac

SEQ ID NO: 3624 - DNA, 60 bp, Artificial Sequence
  Description of Artificial Sequence: Synthetic probe
caacataagaggtgaccaacaagtgttggcccagaaggcggcgagagcgctgcctacctc

SEQ ID NO: 3625 - DNA, 60 bp, Artificial Sequence
  Description of Artificial Sequence: Synthetic probe
gcgagtgcaaatacagcagtaatgctgtgcccaatgtgagaggtgaccccaatgtgttgg

SEQ ID NO: 3626 - DNA, 60 bp, Artificial Sequence
  Description of Artificial Sequence: Synthetic probe
caacggcgagtgcaaatacagcagtaatgctgtgcccaatgtgagaggtgaccccaatgt

SEQ ID NO: 3627 - DNA, 60 bp, Artificial Sequence
  Description of Artificial Sequence: Synthetic probe
cacttgggttccaaacggggcgtctgaaaaggcgttggacaacaccaccaacccaacggc

SEQ ID NO: 3628 - DNA, 60 bp, Artificial Sequence
  Description of Artificial Sequence: Synthetic probe
cacgagggagacctcacttgggttccaaacggggcgtctgaaaaggcgttggacaacacc

SEQ ID NO: 3629 - DNA, 60 bp, Artificial Sequence
  Description of Artificial Sequence: Synthetic probe
agataccgtctcacactctggtgggggctcttctccgcgcgtccacttactacttctccg

SEQ ID NO: 3630 - DNA, 60 bp, Artificial Sequence
  Description of Artificial Sequence: Synthetic probe
gatgacaagactcttgacgaggcggaaaagaaccctcaggagactagcagtgccagcact

SEQ ID NO: 3631 - DNA, 60 bp, Artificial Sequence
  Description of Artificial Sequence: Synthetic probe
gggaggcaatggagttggttactgctcctgcgtttccaggtccatgctcctacagatgaa

SEQ ID NO: 3632 - DNA, 60 bp, Artificial Sequence
  Description of Artificial Sequence: Synthetic probe
gaggctgactgggcaactgcccacctccttcaactacggcgctgtaaaggctgacaccat

SEQ ID NO: 3633 - DNA, 60 bp, Artificial Sequence
  Description of Artificial Sequence: Synthetic probe
ccgcggggacctcgcgacactcgcggagaggattgccagtgagacacacattccaaccac

SEQ ID NO: 3634 - DNA, 60 bp, Artificial Sequence
  Description of Artificial Sequence: Synthetic probe
gcgagacacacattccaaccactttcaactatggcaggatttacacagaggctgaagtcg

SEQ ID NO: 3635 - DNA, 60 bp, Artificial Sequence
  Description of Artificial Sequence: Synthetic probe
caacaaagcaccattcacgagactagcactcccctacactgcgccacaccgcgtgttggc

SEQ ID NO: 3636 - DNA, 60 bp, Artificial Sequence
  Description of Artificial Sequence: Synthetic probe
tgctcgtgcgcatgaagcgtgccgaactctactgccccagaccactgttggcggtgaagg

SEQ ID NO: 3637 - DNA, 60 bp, Artificial Sequence
  Description of Artificial Sequence: Synthetic probe
acatttcgctcagtacaaaaacgtgtgggatgtggactattcggcctttgatgctaacca

SEQ ID NO: 3638 - DNA, 60 bp, Artificial Sequence
  Description of Artificial Sequence: Synthetic probe
aacgcaggcggcccgacgtcttcacaccgacgttgccttcgttctcgacaggtttgtgaa

SEQ ID NO: 3639 - DNA, 60 bp, Artificial Sequence
  Description of Artificial Sequence: Synthetic probe
cactggcagtatcatcaacaactactacatgcagcagtaccaaaattcaatggacaccca

SEQ ID NO: 3640 - DNA, 60 bp, Artificial Sequence
  Description of Artificial Sequence: Synthetic probe
ccatacacagcaccacaccgcgtgttggcaaccgtttacaacgggaactgcaagtacggc

SEQ ID NO: 3641 - DNA, 60 bp, Artificial Sequence
  Description of Artificial Sequence: Synthetic probe
gcaccacacggatgttggcttcatcatggacagatttgtgaagataaacagcctgagtcc

SEQ ID NO: 3642 - DNA, 60 bp, Artificial Sequence
  Description of Artificial Sequence: Synthetic probe
caccgctccccaccgtgtgctggcaacagtgtacaacgggaagacaacgtacgggaaaca

SEQ ID NO: 3643 - DNA, 60 bp, Artificial Sequence
  Description of Artificial Sequence: Synthetic probe
cacacagatgcttggcaacatcttacaacggtgattgcaagtacaaacccgctggcacag

SEQ ID NO: 3644 - DNA, 60 bp, Artificial Sequence
  Description of Artificial Sequence: Synthetic probe
gaaggcggcgagaacgctgcccacctccttcaactacggtgctatcaaggctacacgggt

SEQ ID NO: 3645 - DNA, 60 bp, Artificial Sequence
  Description of Artificial Sequence: Synthetic probe
cgaccctgttaccactaccgttgagaactacggaggagagacgcaagtccaacgtcgtca

SEQ ID NO: 3646 - DNA, 60 bp, Artificial Sequence
  Description of Artificial Sequence: Synthetic probe
ttaaggccgagaccatccacgagcttctcgtgcgcatgaaacgggctgagctctactgcc

SEQ ID NO: 3647 - DNA, 60 bp, Artificial Sequence
  Description of Artificial Sequence: Synthetic probe
gtctgcgacttactacttctcagacctggaggttgcgcttgtccacacaggccccgtcac

SEQ ID NO: 3648 - DNA, 60 bp, Artificial Sequence
  Description of Artificial Sequence: Synthetic probe
atctcaattccttcccaaaaatctgtgttgtacttcctcattgagaaaggccaacacgaa

SEQ ID NO: 3649 - DNA, 60 bp, Artificial Sequence
  Description of Artificial Sequence: Synthetic probe
tgagaactacggtggtgagacacaggcccagcggcgtcaccacactgatgtcggcttcat

SEQ ID NO: 3650 - DNA, 60 bp, Artificial Sequence
  Description of Artificial Sequence: Synthetic probe
attgacctcatgcagacccaccaacacgggctggtaggtgcgctgttgcgtgcagccacg

SEQ ID NO: 3651 - DNA, 60 bp, Artificial Sequence
  Description of Artificial Sequence: Synthetic probe
atggacacaactgactgttttatcgctttgctgcacgctctcagagagatcaaaacactg

SEQ ID NO: 3652 - DNA, 60 bp, Artificial Sequence
  Description of Artificial Sequence: Synthetic probe
tgaaacgggctgagctctactgccccaggccactgctggcaatagaggtgtcttcgcaag

SEQ ID NO: 3653 - DNA, 60 bp, Artificial Sequence
  Description of Artificial Sequence: Synthetic probe
acttttacccttggacgccggatccgtccgacgttttggtgtttgtcccgtacgatcaag

SEQ ID NO: 3654 - DNA, 60 bp, Artificial Sequence
  Description of Artificial Sequence: Synthetic probe
tgcagccacgtactacttctccgacttggagattgtggtgcggcacgacggtaatctgac

SEQ ID NO: 3655 - DNA, 60 bp, Artificial Sequence
  Description of Artificial Sequence: Synthetic probe
tgcagctacgtactacttctctgacctggagattgtggtgaggcacgagggcaacctgac

SEQ ID NO: 3656 - DNA, 60 bp, Artificial Sequence
  Description of Artificial Sequence: Synthetic probe
gctgctcgtgcgcatgaagcgtgccgaactctactgccccagaccgttgttggcggtgga

SEQ ID NO: 3657 - DNA, 60 bp, Artificial Sequence
  Description of Artificial Sequence: Synthetic probe
cctctttcaactttggtgcaattcaggccactaccatccacgagcttctcgtgcgcatga

SEQ ID NO: 3658 - DNA, 60 bp, Artificial Sequence
  Description of Artificial Sequence: Synthetic probe
ctacgacctacaccgccagtgcacgcggggatttggctcacctaacgacgacgcatgctc

SEQ ID NO: 3659 - DNA, 60 bp, Artificial Sequence
  Description of Artificial Sequence: Synthetic probe
aagcgtgccgagctctactgccccaggccactgctggcagtggaggtgtcgtcgcaagac

SEQ ID NO: 3660 - DNA, 60 bp, Artificial Sequence
  Description of Artificial Sequence: Synthetic probe
gcaattgaattctttgaggggatggtgcacgactccattaaggaggagctccggcccctc

SEQ ID NO: 3661 - DNA, 60 bp, Artificial Sequence
  Description of Artificial Sequence: Synthetic probe
cacatcccaaccactttcaactatggcaggatttacacagaagctgaggtcaacgtgtac

SEQ ID NO: 3662 - DNA, 60 bp, Artificial Sequence
  Description of Artificial Sequence: Synthetic probe
ggcggtgagacacaggcccagcggcgtcaccacactgacgtcagctttataatggacaga

SEQ ID NO: 3663 - DNA, 60 bp, Artificial Sequence
  Description of Artificial Sequence: Synthetic probe
cctacctccttcaactacggtgccatcaaggctacccgggtgacagaactgctttatcgc

SEQ ID NO: 3664 - DNA, 60 bp, Artificial Sequence
  Description of Artificial Sequence: Synthetic probe
tacttctcagacctggaggttgcgcttgtccacacgggcccagccacctgggtacccaat

SEQ ID NO: 3665 - DNA, 50 bp, Artificial Sequence
  Description of Artificial Sequence: Synthetic probe
gggcagctgcccacctctttcaactacggcgctgtgaaggctgaaaacat

SEQ ID NO: 3666 - DNA, 60 bp, Artificial Sequence
  Description of Artificial Sequence: Synthetic probe
gccggatccgtccgacgttctggtgtttgtcccgtacgatcaagaaccactcaacgggga

SEQ ID NO: 3667 - DNA, 60 bp, Artificial Sequence
  Description of Artificial Sequence: Synthetic probe
gttggcaaccgtttacaacgggaactgcaagtacggtgatggttcggtgaccaacataag

SEQ ID NO: 3668 - DNA, 50 bp, Artificial Sequence
  Description of Artificial Sequence: Synthetic probe
caacgggaccacccgctttgctttgccttacactgccccacacaggtgtc

SEQ ID NO: 3669 - DNA, 60 bp, Artificial Sequence
  Description of Artificial Sequence: Synthetic probe
ctacggtggtgagacacaggcccagcgacgtcaccacactgacgtcagcttcataatgga

SEQ ID NO: 3670 - DNA, 60 bp, Artificial Sequence
  Description of Artificial Sequence: Synthetic probe
gtacttgacatgctcaagaccaaggagaaagcactggtgggcgcaatcctgcgcgctgcc

SEQ ID NO: 3671 - DNA, 60 bp, Artificial Sequence
  Description of Artificial Sequence: Synthetic probe
ccatccacgagctgctcgtgcgcatgaagcgtgccgaactctactgccccagaccattgt

SEQ ID NO: 3672 - DNA, 60 bp, Artificial Sequence
  Description of Artificial Sequence: Synthetic probe
ttgggtgcccaacggcgccccggaagcagctcttgtaaacacgagtaaccccacagctta

SEQ ID NO: 3673 - DNA, 60 bp, Artificial Sequence
  Description of Artificial Sequence: Synthetic probe
atgacttgggtgcccaacggcgccccggaagcagctctcgcaaacacgagcaaccccaca

SEQ ID NO: 3674 - DNA, 60 bp, Artificial Sequence
  Description of Artificial Sequence: Synthetic probe
aacttgacttgggtgcccaacggcgccccggaagcagctcttgtaaacacgagtaacccc

SEQ ID NO: 3675 - DNA, 60 bp, Artificial Sequence
  Description of Artificial Sequence: Synthetic probe
tcataatggacagatttgtgaaagtgaacagtcctactcccacacacgtcatagacctca

SEQ ID NO: 3676 - DNA, 60 bp, Artificial Sequence
  Description of Artificial Sequence: Synthetic probe
tcataatggacagatttgtgaaagtgaacagtcctactcccacacatgtcatagacctca

SEQ ID NO: 3677 - DNA, 60 bp, Artificial Sequence
  Description of Artificial Sequence: Synthetic probe
gggaatctgcagaccctgtcaccaccactgtggaaaactacggtggtgagacacaaatcc

SEQ ID NO: 3678 - DNA, 60 bp, Artificial Sequence
  Description of Artificial Sequence: Synthetic probe
gggaatctgcagaccctgtcaccaccactgtggaaaactacggaggtgagacacaagtcc

SEQ ID NO: 3679 - DNA, 60 bp, Artificial Sequence
  Description of Artificial Sequence: Synthetic probe
gggaatctgcagaccctgtcaccaccactgtggaaaactacggcggtgagacacaagtcc

SEQ ID NO: 3680 - DNA, 60 bp, Artificial Sequence
  Description of Artificial Sequence: Synthetic probe
actactgcaacaggggaatctgcagaccctgtcaccaccactgtggaaaactacggaggt

SEQ ID NO: 3681 - DNA, 60 bp, Artificial Sequence
  Description of Artificial Sequence: Synthetic probe
catccacgagctcctcgtgcgcatgaagcgggctgagctctactgccccagaccactact

SEQ ID NO: 3682 - DNA, 60 bp, Artificial Sequence
  Description of Artificial Sequence: Synthetic probe
tgggtggtacgcgattgatgacgaggacttttacccttggacaccggacccgtccgatgt

SEQ ID NO: 3683 - DNA, 60 bp, Artificial Sequence
  Description of Artificial Sequence: Synthetic probe
gacgtactacttctcagacctggaggttgcgcttgttcacacaggaccagtcacttgggt

SEQ ID NO: 3684 - DNA, 60 bp, Artificial Sequence
  Description of Artificial Sequence: Synthetic probe
aaacaacttcacggcgcggtgatatggcggcccttgcacaaaggctgagcaggcagctgc

SEQ ID NO: 3685 - DNA, 60 bp, Artificial Sequence
  Description of Artificial Sequence: Synthetic probe
tagcgaggtgggcgacaacccagtcgtcttctccgctaacggcaccacccgtttcgcact

SEQ ID NO: 3686 - DNA, 60 bp, Artificial Sequence
  Description of Artificial Sequence: Synthetic probe
gagctttactgcccgcgccctctcctgacacactacgaccacggcggaaaggatcgctac

SEQ ID NO: 3687 - DNA, 60 bp, Artificial Sequence
  Description of Artificial Sequence: Synthetic probe
gctttgcgctaccttacactgcgccacacaggtgcttggcaacaacctacaacggtgact

SEQ ID NO: 3688 - DNA, 60 bp, Artificial Sequence
  Description of Artificial Sequence: Synthetic probe
aaccctacagcctacacaaaagcgccgttcacgaggcttgcgcttccctacactgcacca

SEQ ID NO: 3689 - DNA, 60 bp, Artificial Sequence
  Description of Artificial Sequence: Synthetic probe
cactgcgccacaccgtgtgttggcaacagtgtacaacgggacgaacaagtactccgcggc

SEQ ID NO: 3690 - DNA, 60 bp, Artificial Sequence
  Description of Artificial Sequence: Synthetic probe
tgaactgctttaccgcatgaagagggctgagacatactgcccccggccccttttggccat

SEQ ID NO: 3691 - DNA, 60 bp, Artificial Sequence
  Description of Artificial Sequence: Synthetic probe
cggcagagacgctgcctacctccttcaactacggtgccatcaaagccacttgggtgactg

SEQ ID NO: 3692 - DNA, 60 bp, Artificial Sequence
  Description of Artificial Sequence: Synthetic probe
gacaatccagtcgacatttactaccgaatgaagagggcagagctctactgtccacgagcc

SEQ ID NO: 3693 - DNA, 60 bp, Artificial Sequence
  Description of Artificial Sequence: Synthetic probe
ctggagtgtttggcactgcctatctcgtgcctcgtcatcttttcgctgagaagtatgaca

SEQ ID NO: 3694 - DNA, 60 bp, Artificial Sequence
  Description of Artificial Sequence: Synthetic probe
accactactgccggggagtccgcagaccccgtcaccaccactgttgagaactacggtggt

SEQ ID NO: 3695 - DNA, 60 bp, Artificial Sequence
  Description of Artificial Sequence: Synthetic probe
accaccactgccggggagtccgcagaccccgtcaccaccactgttgagaactacggtggt

SEQ ID NO: 3696 - DNA, 60 bp, Artificial Sequence
  Description of Artificial Sequence: Synthetic probe
acttttacccttggacgccggatccgtccgacgttctggtgtttgtcccgtacgatcaag

SEQ ID NO: 3697 - DNA, 60 bp, Artificial Sequence
  Description of Artificial Sequence: Synthetic probe
acaagtgttggcccagaaggcagcaagagcgctgcccacctccttcaactacggtgccat

SEQ ID NO: 3698 - DNA, 60 bp, Artificial Sequence
  Description of Artificial Sequence: Synthetic probe
gtgggcaactgcccacctccttcaactacggcgctgtaaaggctgacaccatcactgagc

SEQ ID NO: 3699 - DNA, 60 bp, Artificial Sequence
  Description of Artificial Sequence: Synthetic probe
aattgtactgccccaggccacttctcccggcttacgaacacgcaaaccgggacagattcg

SEQ ID NO: 3700 - DNA, 60 bp, Artificial Sequence
  Description of Artificial Sequence: Synthetic probe
aaacacctgctctacactgggattggtactgcctcgcgacccagcgaggtgtgcatggtg

SEQ ID NO: 3701 - DNA, 60 bp, Artificial Sequence
  Description of Artificial Sequence: Synthetic probe
cgccggatccgtccgacgttttggtgtttgtcccgtacgatcaagaaccactcaacggag

SEQ ID NO: 3702 - DNA, 60 bp, Artificial Sequence
  Description of Artificial Sequence: Synthetic probe
cccctacaccgcgccacaccgcgtgctggcaacagtgtacaacgggacgaccaagtactc

SEQ ID NO: 3703 - DNA, 60 bp, Artificial Sequence
  Description of Artificial Sequence: Synthetic probe
tcaattacggtgcaattagagccacaaccatccacgagcttctcgtgcgcatgaagcggg

SEQ ID NO: 3704 - DNA, 60 bp, Artificial Sequence
  Description of Artificial Sequence: Synthetic probe
taccatccatgagcttctcgtgcgcatgaagcgtgccgagctctactgccccaggccact

SEQ ID NO: 3705 - DNA, 60 bp, Artificial Sequence
  Description of Artificial Sequence: Synthetic probe
actggtgggcgcaatcctgcgctctgccacgtactacttcgcagaccttgaggtggcgtg

SEQ ID NO: 3706 - DNA, 60 bp, Artificial Sequence
  Description of Artificial Sequence: Synthetic probe
gcaaacatcaccacggatgacaagactcttgacgaggcggaaaagaacccctctgagatc

SEQ ID NO: 3707 - DNA, 59 bp, Artificial Sequence
  Description of Artificial Sequence: Synthetic probe
ggggctctcttgcgtgcggccacgtactacttctccgacctggagattgtggtgcgcca

SEQ ID NO: 3708 - DNA, 60 bp, Artificial Sequence
  Description of Artificial Sequence: Synthetic probe
caacggtgattgtaagtacaaacccactggcacagccccgcgtgagaacatccgtgggga

SEQ ID NO: 3709 - DNA, 60 bp, Artificial Sequence
  Description of Artificial Sequence: Synthetic probe
caccactaccggcgagtcagcagacccggtaacaaccacggttgagaactacggaggaga

SEQ ID NO: 3710 - DNA, 53 bp, Artificial Sequence
  Description of Artificial Sequence: Synthetic probe
accaccaccaccggggaatcagcagaccctgtcaccaccaccgttgagaacta

SEQ ID NO: 3711 - DNA, 60 bp, Artificial Sequence
  Description of Artificial Sequence: Synthetic probe
tgagattaaagtaaaaggacaggacatgctctcagacgccgctctcatggtgctgcaccg

SEQ ID NO: 3712 - DNA, 60 bp, Artificial Sequence
  Description of Artificial Sequence: Synthetic probe
gggaatcagcagaccctgtcaccaccaccgtggagaactacggcggtgagacacaagttc

SEQ ID NO: 3713 - DNA, 60 bp, Artificial Sequence
  Description of Artificial Sequence: Synthetic probe
accaatcccacacatgtcattgacctcatgcaaacccaccaacacgggctggtgggtgcc

SEQ ID NO: 3714 - DNA, 60 bp, Artificial Sequence
  Description of Artificial Sequence: Synthetic probe
aagaccaaggagaaagcactggtgggcgcaatcctgcgcgctgccacgtactacttctcg

SEQ ID NO: 3715 - DNA, 60 bp, Artificial Sequence
  Description of Artificial Sequence: Synthetic probe
tttgcaggtgcaatgatcttctgtttgtgtctgtcttgagacgacacctccactgccaac

SEQ ID NO: 3716 - DNA, 60 bp, Artificial Sequence
  Description of Artificial Sequence: Synthetic probe
tacgatcaagaaccactcaacggggaatggaaaacaaaagttcagaagaaactcaagggg

SEQ ID NO: 3717 - DNA, 60 bp, Artificial Sequence
  Description of Artificial Sequence: Synthetic probe
ccaccgtgggaaccgcgtgagagacatcacgaagcactttcgtgacacagcaagaatgaa

SEQ ID NO: 3718 - DNA, 60 bp, Artificial Sequence
  Description of Artificial Sequence: Synthetic probe
ttccctacactgcgccacaccgcgtgttggcaacagtgtacaacgggacgaacaagtact

SEQ ID NO: 3719 - DNA, 60 bp, Artificial Sequence
  Description of Artificial Sequence: Synthetic probe
ttggacgccggatccgtccgacgttctggtgtttgtcccgtacgatcaagaaccactcaa

SEQ ID NO: 3720 - DNA, 60 bp, Artificial Sequence
  Description of Artificial Sequence: Synthetic probe
ccgacgtcgttcaactttggtgcagttaaagcagaaacaatcactgagctgttggtgcgc

SEQ ID NO: 3721 - DNA, 60 bp, Artificial Sequence
  Description of Artificial Sequence: Synthetic probe
gccgacgtcgttcaactttggtgcagttaaagcagaaacagtcactgagctgctggtgcg

SEQ ID NO: 3722 - DNA, 60 bp, Artificial Sequence
  Description of Artificial Sequence: Synthetic probe
cctacaccgcgccgcaccgcgtgctggcaacggtgtacaacgggacgagcaagtactctg

SEQ ID NO: 3723 - DNA, 60 bp, Artificial Sequence
  Description of Artificial Sequence: Synthetic probe
aaccccacggcctaccacaaggccccgttcacgagactagcactgccctacaccgcgcca

SEQ ID NO: 3724 - DNA, 60 bp, Artificial Sequence
  Description of Artificial Sequence: Synthetic probe
caccggtagtatcattaacaactactacatgcaacagtaccaaaactccatggacaccca

SEQ ID NO: 3725 - DNA, 60 bp, Artificial Sequence
  Description of Artificial Sequence: Synthetic probe
ggcccagaaggcggcagagacgctgcctacctccttcaactacggtgccatcaaagccac

SEQ ID NO: 3726 - DNA, 60 bp, Artificial Sequence
  Description of Artificial Sequence: Synthetic probe
tgccctacaccgcgccgcaccgcgtgttggcaacggtgtacaacgggacgagcaagtact

SEQ ID NO: 3727 - DNA, 60 bp, Artificial Sequence
  Description of Artificial Sequence: Synthetic probe
tcgttcttgacaggtttgtgaaactcactgcacccaagaacactcagacccttgatctca

SEQ ID NO: 3728 - DNA, 60 bp, Artificial Sequence
  Description of Artificial Sequence: Synthetic probe
tgtgaaggctgacaccatcacggagctgttgatccgcatgaagcgtgcggagacatactg

SEQ ID NO: 3729 - DNA, 60 bp, Artificial Sequence
  Description of Artificial Sequence: Synthetic probe
ctacacagaggcggaagtcgatgtgtacgtgagaatgaagcgggcggagctctactgccc

SEQ ID NO: 3730 - DNA, 60 bp, Artificial Sequence
  Description of Artificial Sequence: Synthetic probe
gaaccgaaccacccgctttgcactgccctacaccgctccacacaggtgcctggcaacaac

SEQ ID NO: 3731 - DNA, 60 bp, Artificial Sequence
  Description of Artificial Sequence: Synthetic probe
gcaggccagtcctcacccgccacggggtcacaaaaccaatctggcaacactggtagcatt

SEQ ID NO: 3732 - DNA, 60 bp, Artificial Sequence
  Description of Artificial Sequence: Synthetic probe
acggcgctgtaaaggctgacaccatcactgagcttttgatccgcatgaagcgcgcggaga

SEQ ID NO: 3733 - DNA, 60 bp, Artificial Sequence
  Description of Artificial Sequence: Synthetic probe
ccctggacgcctgacccgtcagacggtttggtgtttgtcccgtacgatcaagaactactc

SEQ ID NO: 3734 - DNA, 60 bp, Artificial Sequence
  Description of Artificial Sequence: Synthetic probe
acccctggacgcctgacccgtcagacggtttggtgtttgtcccgtacgatcaagaactac

SEQ ID NO: 3735 - DNA, 60 bp, Artificial Sequence
  Description of Artificial Sequence: Synthetic probe
atgcatggttgacggtacggacatgtgcttggcggactttcacgctggcattttcctgaa

SEQ ID NO: 3736 - DNA, 60 bp, Artificial Sequence
  Description of Artificial Sequence: Synthetic probe
accggaattggcactgcttcgcgacccagcgaggtatgcatggttgacggtacggacatg

SEQ ID NO: 3737 - DNA, 60 bp, Artificial Sequence
  Description of Artificial Sequence: Synthetic probe
aagcacttgctccacaccggaattggcactgcttcgcgacccagcgaggtatgcatggtt

SEQ ID NO: 3738 - DNA, 60 bp, Artificial Sequence
  Description of Artificial Sequence: Synthetic probe
gcacgagggtggaccacccgcccttgtcatttggaatatcaagcacttgctccacaccgg

SEQ ID NO: 3739 - DNA, 60 bp, Artificial Sequence
  Description of Artificial Sequence: Synthetic probe
gacttgaactgcacgagggtggaccacccgcccttgtcatttggaatatcaagcacttgc

SEQ ID NO: 3740 - DNA, 60 bp, Artificial Sequence
  Description of Artificial Sequence: Synthetic probe
ccatcctccagttgtttaggtacgttgatgaacccttcttcgactgggtctatgagtcgc

SEQ ID NO: 3741 - DNA, 60 bp, Artificial Sequence
  Description of Artificial Sequence: Synthetic probe
catccacgagcttctcgtgcgcatgaaacgggcagagctctactgccccaggccactatt

SEQ ID NO: 3742 - DNA, 60 bp, Artificial Sequence
  Description of Artificial Sequence: Synthetic probe
tcgtgctctggctcatcaaggattgtcttcaaaccggcgttggcaccagcactcgcccca

SEQ ID NO: 3743 - DNA, 60 bp, Artificial Sequence
  Description of Artificial Sequence: Synthetic probe
cttgacctcatgcagatcccctcacacacgctggttggagcactgctccggtctgcgacg

SEQ ID NO: 3744 - DNA, 60 bp, Artificial Sequence
  Description of Artificial Sequence: Synthetic probe
gcaagaacatccgcggggacctcgcgacccttgcgcagaggattgcaagcgagacacaca

SEQ ID NO: 3745 - DNA, 60 bp, Artificial Sequence
  Description of Artificial Sequence: Synthetic probe
accaccgtggagaactacggcggtgagacacaaacccagagacggcaccacacggatgtt

SEQ ID NO: 3746 - DNA, 60 bp, Artificial Sequence
  Description of Artificial Sequence: Synthetic probe
tactgcctacaataaagcgccgttcacgaggcttgcgcttccctacactgcgccacaccg

SEQ ID NO: 3747 - DNA, 60 bp, Artificial Sequence
  Description of Artificial Sequence: Synthetic probe
agtggcgctccgccgaccgacttgcaaaagatggtcatggcgaacgtcaaaccagtcgag

SEQ ID NO: 3748 - DNA, 60 bp, Artificial Sequence
  Description of Artificial Sequence: Synthetic probe
agtggcgctccgccgaccgacttgcaaaagatggtcatggcgaacgtcaagcccgttgag

SEQ ID NO: 3749 - DNA, 60 bp, Artificial Sequence
  Description of Artificial Sequence: Synthetic probe
cctgcctacctccttcaactacggtgccatcaaggccacccgggtgactgagctgcttta

SEQ ID NO: 3750 - DNA, 60 bp, Artificial Sequence
  Description of Artificial Sequence: Synthetic probe
ctcctgaacttcgacctgcttaagttggcgggagacgttgagtccaaccctgggcccttc

SEQ ID NO: 3751 - DNA, 60 bp, Artificial Sequence
  Description of Artificial Sequence: Synthetic probe
gcgctctgctgtgcgacgggagtgttcgggaccgcctacctcgtgcctcgtcatcttttc

SEQ ID NO: 3752 - DNA, 60 bp, Artificial Sequence
  Description of Artificial Sequence: Synthetic probe
cactaccatccacgagcttctcgtgcgcatgaagcgtgccgaactctactgccccaggcc

SEQ ID NO: 3753 - DNA, 60 bp, Artificial Sequence
  Description of Artificial Sequence: Synthetic probe
cgccctcaacacatctgagggctggtacgccattgatgacgaggtgttttacccatggac

SEQ ID NO: 3754 - DNA, 60 bp, Artificial Sequence
  Description of Artificial Sequence: Synthetic probe
tactgcccgcgacccattctcacgcactacgaccacggtgacaaagatcgctacaagacc

SEQ ID NO: 3755 - DNA, 55 bp, Artificial Sequence
  Description of Artificial Sequence: Synthetic probe
actcaagggggccgggcaatccagcccggcgactgggtcacagaaccaatctggc

SEQ ID NO: 3756 - DNA, 60 bp, Artificial Sequence
  Description of Artificial Sequence: Synthetic probe
gcacaacgggtaagcaacaggctgcccacctccttcaactacggcgctgtgaaggctgac

SEQ ID NO: 3757 - DNA, 60 bp, Artificial Sequence
  Description of Artificial Sequence: Synthetic probe
gttgagctcatcctcgacgggaagacagtagccatctgctgcgctactggagtgttcggt

SEQ ID NO: 3758 - DNA, 60 bp, Artificial Sequence
  Description of Artificial Sequence: Synthetic probe
cctacctccttcaactacggtgccatcaaggccacccgggtgactgaactgctttaccgc

SEQ ID NO: 3759 - DNA, 60 bp, Artificial Sequence
  Description of Artificial Sequence: Synthetic probe
cccgttttgcactgccctacaccgcgccacacagatgcttggcgacatcttacaacggtg

SEQ ID NO: 3760 - DNA, 60 bp, Artificial Sequence
  Description of Artificial Sequence: Synthetic probe
tcacgaggcttgcgctcccctacactgcgccacaccgcgtgttggcaacagtgtacaacg

SEQ ID NO: 3761 - DNA, 60 bp, Artificial Sequence
  Description of Artificial Sequence: Synthetic probe
aaccccactgcctaccacaaggaaccattcacgagacttgcgcttccctacactgcgccg

SEQ ID NO: 3762 - DNA, 60 bp, Artificial Sequence
  Description of Artificial Sequence: Synthetic probe
tttacccctggacgccggacccgtccgacgttttggtgtttgtcccgtacgatcaagaac

SEQ ID NO: 3763 - DNA, 60 bp, Artificial Sequence
  Description of Artificial Sequence: Synthetic probe
gaggtgtcgtcacaagacagacacaaacagaagatcattgcacctgcaaaacaactcctg

SEQ ID NO: 3764 - DNA, 60 bp, Artificial Sequence
  Description of Artificial Sequence: Synthetic probe
actacttctcggacttggaagtggcctgcgttggcacgaacgagtgggttggctgggttc

SEQ ID NO: 3765 - DNA, 60 bp, Artificial Sequence
  Description of Artificial Sequence: Synthetic probe
catgctacggaccgagaagaaggccctggtgggtgcaatcctgcgctccgccacgtacta

SEQ ID NO: 3766 - DNA, 60 bp, Artificial Sequence
  Description of Artificial Sequence: Synthetic probe
cttcgcgccaaacaacttcggccggtgaaggtgctgaaccagtcacaactgatgcctcac

SEQ ID NO: 3767 - DNA, 60 bp, Artificial Sequence
  Description of Artificial Sequence: Synthetic probe
tctgcggcagattacgcctacacctacgcggacgagcctgaacaggcttccgttcaagga

SEQ ID NO: 3768 - DNA, 60 bp, Artificial Sequence
  Description of Artificial Sequence: Synthetic probe
cctacttgtcaggtttggcccagtactacgcacagtactcgggaactttgaatctgcact

SEQ ID NO: 3769 - DNA, 60 bp, Artificial Sequence
  Description of Artificial Sequence: Synthetic probe
acgtatacaacccggctcgcactggctaccccggtaggttcacaaacctgctggacgttg

SEQ ID NO: 3770 - DNA, 60 bp, Artificial Sequence
  Description of Artificial Sequence: Synthetic probe
aacgtctacgtggctggcgagaaacctgtcaaacagggtatctttccagtcgccgcggct

SEQ ID NO: 3771 - DNA, 60 bp, Artificial Sequence
  Description of Artificial Sequence: Synthetic probe
gcacattcaggtgccgtacctcggggttgatagacacgaccaagggcacaagcacaagcc

SEQ ID NO: 3772 - DNA, 60 bp, Artificial Sequence
  Description of Artificial Sequence: Synthetic probe
tcactcttttcccgcaccagttcctcaatcccaggacaaacactacagcgcacattcagg

SEQ ID NO: 3773 - DNA, 60 bp, Artificial Sequence
  Description of Artificial Sequence: Synthetic probe
gcatctacggtcagttggtggactcccacgcctacatcaggaatggttgggacgtggagg

SEQ ID NO: 3774 - DNA, 53 bp, Artificial Sequence
  Description of Artificial Sequence: Synthetic probe
tttgcccggaccaaacaccaacgggcttgaaacgagggtggaacaagcagaga

SEQ ID NO: 3775 - DNA, 60 bp, Artificial Sequence
  Description of Artificial Sequence: Synthetic probe
gtcgacccacaccaacaacacacagaacaacgattggttttcaaaattggcgcaatcggc

SEQ ID NO: 3776 - DNA, 60 bp, Artificial Sequence
  Description of Artificial Sequence: Synthetic probe
tgagacacacattccaaccactttcaactacggcaggatttacacagaggctgaggtcga

SEQ ID NO: 3777 - DNA, 60 bp, Artificial Sequence
  Description of Artificial Sequence: Synthetic probe
gttgagctcatcctcgacgggaagacagtagccatctgctgtgctactggagtgtttggc

SEQ ID NO: 3778 - DNA, 60 bp, Artificial Sequence
  Description of Artificial Sequence: Synthetic probe
tactgcccgcgccccgtcttgacacactacgaccacaagggtctggatcgctacaaaacc

SEQ ID NO: 3779 - DNA, 60 bp, Artificial Sequence
  Description of Artificial Sequence: Synthetic probe
agcgcgcagagctctactgcccgcgccccgtcttgacacactacgaccacaagggtctgg

SEQ ID NO: 3780 - DNA, 60 bp, Artificial Sequence
  Description of Artificial Sequence: Synthetic probe
ctctcgcgggtagaatttccgacgagacacacatccccaccactttcaactacggcagga

SEQ ID NO: 3781 - DNA, 60 bp, Artificial Sequence
  Description of Artificial Sequence: Synthetic probe
actctcgcgggtagaatttccgacgagacacacatccccaccactttcaactacggcagg

SEQ ID NO: 3782 - DNA, 60 bp, Artificial Sequence
  Description of Artificial Sequence: Synthetic probe
ttggcactgctccacgcgggaacatccgtggagacctcgcgactctcgcgggtagaattt

SEQ ID NO: 3783 - DNA, 60 bp, Artificial Sequence
  Description of Artificial Sequence: Synthetic probe
cggcccttgcacaaagactgatggggcagctgcccacctctttcaactacggcgctgtaa

SEQ ID NO: 3784 - DNA, 60 bp, Artificial Sequence
  Description of Artificial Sequence: Synthetic probe
acaaacccgttggcactgctccacgcgggaacatccgtggagacctcgcgactctcgcgg

SEQ ID NO: 3785 - DNA, 60 bp, Artificial Sequence
  Description of Artificial Sequence: Synthetic probe
tggcaccacccgttttgcactaccctacaccgcgccgcacagatgtctggcaacgtccta

SEQ ID NO: 3786 - DNA, 60 bp, Artificial Sequence
  Description of Artificial Sequence: Synthetic probe
ccagaactcagcgaaataggcgacaatccagtcgtgttatccgggaatggcaccacccgt

SEQ ID NO: 3787 - DNA, 60 bp, Artificial Sequence
  Description of Artificial Sequence: Synthetic probe
gctccagaactcagcgaaataggcgacaatccagtcgtgttatccgggaatggcaccacc

SEQ ID NO: 3788 - DNA, 60 bp, Artificial Sequence
  Description of Artificial Sequence: Synthetic probe
tcataatggacagatttgtgaagattaacaacaccagccccacacacgtcattgacctca

SEQ ID NO: 3789 - DNA, 60 bp, Artificial Sequence
  Description of Artificial Sequence: Synthetic probe
tcggcttcataatggacagatttgtgaagattaacaacaccagccccacacacgtcattg

SEQ ID NO: 3790 - DNA, 60 bp, Artificial Sequence
  Description of Artificial Sequence: Synthetic probe
tcggcttcataatggacagatttgtgaagattaacaacaccagccccatacacgtcattg

SEQ ID NO: 3791 - DNA, 60 bp, Artificial Sequence
  Description of Artificial Sequence: Synthetic probe
gcagagaggatcgccagcgagacacacattccaaccacttttaactatggcagaatctac

SEQ ID NO: 3792 - DNA, 51 bp, Artificial Sequence
  Description of Artificial Sequence: Synthetic probe
ctcgcaagtcttgcagagaggatcgccagcgagacacacattccaaccact

SEQ ID NO: 3793 - DNA, 60 bp, Artificial Sequence
  Description of Artificial Sequence: Synthetic probe
cgccagcgagacgcacattccaactaccttcaactacggcaggatctacacggaggcgga

SEQ ID NO: 3794 - DNA, 60 bp, Artificial Sequence
  Description of Artificial Sequence: Synthetic probe
accactttcaactacggcaggatttacactgaggccgaggttgacgtgtatgtaaggatg

SEQ ID NO: 3795 - DNA, 60 bp, Artificial Sequence
  Description of Artificial Sequence: Synthetic probe
accactgctgttggggagtccgcagaccctgtcaccaccaccgtggagaactacggtggt

SEQ ID NO: 3796 - DNA, 60 bp, Artificial Sequence
  Description of Artificial Sequence: Synthetic probe
accactgctgttggggagtccgcagaccctgtcaccaccaccgtggagaactacggcggt

SEQ ID NO: 3797 - DNA, 60 bp, Artificial Sequence
  Description of Artificial Sequence: Synthetic probe
accactgctgttggggagtccgcagaccctgtcaccaccaccgtggaaggctacggcggt

SEQ ID NO: 3798 - DNA, 60 bp, Artificial Sequence
  Description of Artificial Sequence: Synthetic probe
ggtggtgagacacaggcccagcgacgttaccacactgacgtcagcttcataatggacagg

SEQ ID NO: 3799 - DNA, 60 bp, Artificial Sequence
  Description of Artificial Sequence: Synthetic probe
cagttaaagcagaaacaatcactgagttgctcgtacgcatgaagcgtgctgaactctatt

SEQ ID NO: 3800 - DNA, 60 bp, Artificial Sequence
  Description of Artificial Sequence: Synthetic probe
aacgggacgagcaagtactcgacaactggtgggcacacacggggtgacttgggagctctt

SEQ ID NO: 3801 - DNA, 51 bp, Artificial Sequence
  Description of Artificial Sequence: Synthetic probe
ctgtaaaggctgaaaccattactgagctcctgatacgcatgaaacgcgcgg

SEQ ID NO: 3802 - DNA, 60 bp, Artificial Sequence
  Description of Artificial Sequence: Synthetic probe
caactacgggatgatctacacagaggcagaagtggacgtgtacctgaggatgaagagagc

SEQ ID NO: 3803 - DNA, 60 bp, Artificial Sequence
  Description of Artificial Sequence: Synthetic probe
gccccacacatgtcattgacctcatgcaaacccaccaacacgggttggtaggtgccctgt

SEQ ID NO: 3804 - DNA, 60 bp, Artificial Sequence
  Description of Artificial Sequence: Synthetic probe
tacgtgccttacgaccaggaaccactggacgttgattggcaggacagagccggtctgttc

SEQ ID NO: 3805 - DNA, 60 bp, Artificial Sequence
  Description of Artificial Sequence: Synthetic probe
aaagcaactcgggtgactgaactgctttaccgcatgaagagggctgagacgtactgcccc

SEQ ID NO: 3806 - DNA, 60 bp, Artificial Sequence
  Description of Artificial Sequence: Synthetic probe
tggacggtgacaccatgcctggactcttcgcgtaccgcgcagggaccaaagttggatact

SEQ ID NO: 3807 - DNA, 60 bp, Artificial Sequence
  Description of Artificial Sequence: Synthetic probe
aaggcaccgttcacgagactcgctctcccctacactgcgccacaccgtgtgttggcaaca

SEQ ID NO: 3808 - DNA, 54 bp, Artificial Sequence
  Description of Artificial Sequence: Synthetic probe
gtctcgttcattttagacagatttgtgaaagtgacaccaaaagaccaaattaat

SEQ ID NO: 3809 - DNA, 60 bp, Artificial Sequence
  Description of Artificial Sequence: Synthetic probe
gaagagctcaagcccttgttggagcaaaccagcttcgccaagcgtgctttcaagcgcctc

SEQ ID NO: 3810 - DNA, 60 bp, Artificial Sequence
  Description of Artificial Sequence: Synthetic probe
cgacagcattaaagaggagcttaagcccttgttggagcaaaccagcttcgccaagcgtgc

SEQ ID NO: 3811 - DNA, 53 bp, Artificial Sequence
  Description of Artificial Sequence: Synthetic probe
tttggcagcccaacggcgcgccccggacaaccgtgttgggagacaacccgatg

SEQ ID NO: 3812 - DNA, 60 bp, Artificial Sequence
  Description of Artificial Sequence: Synthetic probe
tgagaactacggcggtgagacacaagtccagcggcgtcaccacactaacgtcagcttcat

SEQ ID NO: 3813 - DNA, 60 bp, Artificial Sequence
  Description of Artificial Sequence: Synthetic probe
catgtcattgacctcatgcaaacccaccaacacgggttggtgggtgccctgttacgtgct

SEQ ID NO: 3814 - DNA, 60 bp, Artificial Sequence
  Description of Artificial Sequence: Synthetic probe
attcaagccacgaccatccacgagctcctcgtgcgcatgaagcgtgctgagctctactgc

SEQ ID NO: 3815 - DNA, 60 bp, Artificial Sequence
  Description of Artificial Sequence: Synthetic probe
ttggcacttccttacaccgcgccccaccgtgtgctggcaacagtgtacaacgggaagacg

SEQ ID NO: 3816 - DNA, 60 bp, Artificial Sequence
  Description of Artificial Sequence: Synthetic probe
gaggtgtcttcacaagacaggcacaagcaaaagatcattgcacctgcaaaacagttgctg

SEQ ID NO: 3817 - DNA, 60 bp, Artificial Sequence
  Description of Artificial Sequence: Synthetic probe
ttcagagtgtttgagtttgagattaaagtaaaaggacaggacatgctctctgacgccgct

SEQ ID NO: 3818 - DNA, 60 bp, Artificial Sequence
  Description of Artificial Sequence: Synthetic probe
ctagctctcgacactacccaggaccgccgtaagcaggagatcattgcacctgagaagcag

SEQ ID NO: 3819 - DNA, 60 bp, Artificial Sequence
  Description of Artificial Sequence: Synthetic probe
acgtcaggatgaaacgtgcggagctttactgcccgcgccctctcctgacacactacgatc

SEQ ID NO: 3820 - DNA, 60 bp, Artificial Sequence
  Description of Artificial Sequence: Synthetic probe
ctgcttcggtctgcgacgtactacttctcagacctagaggttgcgcttgtccacacaggc

SEQ ID NO: 3821 - DNA, 60 bp, Artificial Sequence
  Description of Artificial Sequence: Synthetic probe
cagggtgaaacgcgcagaactctactgtccgcgccctctcttgacacactacgaccacaa

SEQ ID NO: 3822 - DNA, 60 bp, Artificial Sequence
  Description of Artificial Sequence: Synthetic probe
aaacaacctcacggcgtggtgatatggcggcccttgcacaaaggctgagtggccggttgc

SEQ ID NO: 3823 - DNA, 60 bp, Artificial Sequence
  Description of Artificial Sequence: Synthetic probe
agaccgctgcccacctccttcaactacggtgccatcaaggccactcgggtgacagaactg

SEQ ID NO: 3824 - DNA, 60 bp, Artificial Sequence
  Description of Artificial Sequence: Synthetic probe
accatttacgaggcttgcgctcccctacactgcgccacaccgcgtgttggcaacagtgta

SEQ ID NO: 3825 - DNA, 60 bp, Artificial Sequence
  Description of Artificial Sequence: Synthetic probe
cctaacggcgacgcatgctcggcatttgccgacatcgttcaactttggtgcagttaaagc

SEQ ID NO: 3826 - DNA, 60 bp, Artificial Sequence
  Description of Artificial Sequence: Synthetic probe
ctactacatgcaacagtaccaaaattccatggacacccaactcggagacaacgccatctc

SEQ ID NO: 3827 - DNA, 60 bp, Artificial Sequence
  Description of Artificial Sequence: Synthetic probe
taataactattacatgcaacagtaccaaaattccatggacacccagcttggcgacaacgc

SEQ ID NO: 3828 - DNA, 60 bp, Artificial Sequence
  Description of Artificial Sequence: Synthetic probe
gcgacccagcgaggtgtgcatggtagacggtactgacatgtgtcttgctgacttccacgc

SEQ ID NO: 3829 - DNA, 60 bp, Artificial Sequence
  Description of Artificial Sequence: Synthetic probe
cgggcatgtcaccgccgacaaacaggtggatgtgtattacaggatgaagcgtactgaact

SEQ ID NO: 3830 - DNA, 60 bp, Artificial Sequence
  Description of Artificial Sequence: Synthetic probe
ttcaacttcgggcatgtcaccgccgacaaacaggtggatgtgtattacaggatgaagcgt

SEQ ID NO: 3831 - DNA, 60 bp, Artificial Sequence
  Description of Artificial Sequence: Synthetic probe
cgagaacgctgcccacctccttcaactacggtgccattaaagctactcgggtgactgaac

SEQ ID NO: 3832 - DNA, 60 bp, Artificial Sequence
  Description of Artificial Sequence: Synthetic probe
cgcgctcctccgcgcagctacatactacttctctgacttggaaattgcagtgacacacac

SEQ ID NO: 3833 - DNA, 60 bp, Artificial Sequence
  Description of Artificial Sequence: Synthetic probe
gaggtctcgtcgcaagacagacacaaacagaagatcattgcaccagcaaaacagctcctg

SEQ ID NO: 3834 - DNA, 60 bp, Artificial Sequence
  Description of Artificial Sequence: Synthetic probe
gcgcgcttctccgcgcagccacatactacttctctgacttggaaattgcagtggcccaca

SEQ ID NO: 3835 - DNA, 60 bp, Artificial Sequence
  Description of Artificial Sequence: Synthetic probe
gcgcgctcctccgcgcagctacatactacttctctgacttggaaattgcagtgacacaca

SEQ ID NO: 3836 - DNA, 60 bp, Artificial Sequence
  Description of Artificial Sequence: Synthetic probe
cgttgagaatgaaaccacaagatgcattcccacgacattcaacttcgggagactgttgtg

SEQ ID NO: 3837 - DNA, 60 bp, Artificial Sequence
  Description of Artificial Sequence: Synthetic probe
aagaacaaaacctttgtcgcttttgtcagctggggtgatggtttggccaagagacttgaa

SEQ ID NO: 3838 - DNA, 60 bp, Artificial Sequence
  Description of Artificial Sequence: Synthetic probe
gcctctttgcctacagagctgccaccaaggctggttactgtggaggagccgttcttgcca

SEQ ID NO: 3839 - DNA, 60 bp, Artificial Sequence
  Description of Artificial Sequence: Synthetic probe
tgcctggcctctttgcctacagagctgccaccaaggctggttactgtggaggagccgttc

SEQ ID NO: 3840 - DNA, 60 bp, Artificial Sequence
  Description of Artificial Sequence: Synthetic probe
ggagacatactgccccaggcctctgttggctcttgacaccacccaagaccgccgtaaaca

SEQ ID NO: 3841 - DNA, 60 bp, Artificial Sequence
  Description of Artificial Sequence: Synthetic probe
gcgtctttcaactacggtgcactcaaggccacgaccatccacgagcttctcgtgcgcatg

SEQ ID NO: 3842 - DNA, 60 bp, Artificial Sequence
  Description of Artificial Sequence: Synthetic probe
tctcgtgcgcatgaagcgtgccgaactctactgccccagaccactgttggcggtgaaggt

SEQ ID NO: 3843 - DNA, 60 bp, Artificial Sequence
  Description of Artificial Sequence: Synthetic probe
gctgttcttgcacagcgggaaagcaacaggctgcccacctccttcaactacggtgctgtg

SEQ ID NO: 3844 - DNA, 60 bp, Artificial Sequence
  Description of Artificial Sequence: Synthetic probe
acgaggcttgcgcttccctacactgcgccacaccgcgtgctggcaacagtgtacaacggg

SEQ ID NO: 3845 - DNA, 60 bp, Artificial Sequence
  Description of Artificial Sequence: Synthetic probe
tggccatccacccgagcgaggccagacacaaacaaaagattgtggcacctgtgaaacagc

SEQ ID NO: 3846 - DNA, 60 bp, Artificial Sequence
  Description of Artificial Sequence: Synthetic probe
tgacctggggtctcttgcggcgagagtcgccgctcaactccctgcatcctttaattacgg

SEQ ID NO: 3847 - DNA, 60 bp, Artificial Sequence
  Description of Artificial Sequence: Synthetic probe
cccacctccttcaactacggcgctgtaaaggctgacaccatcactgagctgttgatccgc

SEQ ID NO: 3848 - DNA, 60 bp, Artificial Sequence
  Description of Artificial Sequence: Synthetic probe
caccacactgacgttgccttcgttcttgaccggtttgtgaaggtccctgtgtcggacgga

SEQ ID NO: 3849 - DNA, 60 bp, Artificial Sequence
  Description of Artificial Sequence: Synthetic probe
cttgagttacacgagggcggcccgcctgccctcgtgatttggaacatcaaacacctgctc

SEQ ID NO: 3850 - DNA, 60 bp, Artificial Sequence
  Description of Artificial Sequence: Synthetic probe
acctatgccgccagtgcacgcggggatttggctcacctaacgacgacgcatgctcggtat

SEQ ID NO: 3851 - DNA, 60 bp, Artificial Sequence
  Description of Artificial Sequence: Synthetic probe
gtgccgtacgaccaagaacccttggacgttgactggcaagaccgggctggcctgttccta

SEQ ID NO: 3852 - DNA, 60 bp, Artificial Sequence
  Description of Artificial Sequence: Synthetic probe
gacgtactcgcgtacgtgccgtacgaccaagaacccttggacgttgactggcaagaccgg

SEQ ID NO: 3853 - DNA, 60 bp, Artificial Sequence
  Description of Artificial Sequence: Synthetic probe
gacaagcacagagatggaattcacactgtacaacggtgagaagaagattttctacagcag

SEQ ID NO: 3854 - DNA, 60 bp, Artificial Sequence
  Description of Artificial Sequence: Synthetic probe
aaaacaagcacagagatggaattcacactgtacaacggtgagaagaagaccttctacagc

SEQ ID NO: 3855 - DNA, 60 bp, Artificial Sequence
  Description of Artificial Sequence: Synthetic probe
cagacaaacgtttaagacaagcacagagatggaattcacactgtacaacggtgagaagaa

SEQ ID NO: 3856 - DNA, 60 bp, Artificial Sequence
  Description of Artificial Sequence: Synthetic probe
ttcaggcaaacgttcaaaacaagcacagagatggaattcacactgtacaacggtgagaag

SEQ ID NO: 3857 - DNA, 60 bp, Artificial Sequence
  Description of Artificial Sequence: Synthetic probe
ctgcaagtacaaacccactggcacagctccacgcgaaaacattcgtggagacctcgcaac

SEQ ID NO: 3858 - DNA, 60 bp, Artificial Sequence
  Description of Artificial Sequence: Synthetic probe
cttacctcgtgcctcgtcatcttttcgcagagaagtatgacaagattatgttggacggcc

SEQ ID NO: 3859 - DNA, 60 bp, Artificial Sequence
  Description of Artificial Sequence: Synthetic probe
ccgcatgaaacgcgcggagacatactgccccaggcctctgttggctcttgacaccaccca

SEQ ID NO: 3860 - DNA, 60 bp, Artificial Sequence
  Description of Artificial Sequence: Synthetic probe
aaccccaccgcctacaacaaagcgccgttcacgaggcttgcgcttccctacactgcacca

SEQ ID NO: 3861 - DNA, 60 bp, Artificial Sequence
  Description of Artificial Sequence: Synthetic probe
aacttcgggttcgtgaccgtcgacaagccagtcgacgtttactaccggatgaagagggct

SEQ ID NO: 3862 - DNA, 55 bp, Artificial Sequence
  Description of Artificial Sequence: Synthetic probe
tctactgccccaggccactgctggcaatagaggtgtcttcgcaagacaggcacaa

SEQ ID NO: 3863 - DNA, 60 bp, Artificial Sequence
  Description of Artificial Sequence: Synthetic probe
gcagaggattgcaagcgagacacacatcccaaccactttcaactatggcaggatttacac

SEQ ID NO: 3864 - DNA, 60 bp, Artificial Sequence
  Description of Artificial Sequence: Synthetic probe
tccagagacgtcaccacacggatgtcggcttcataatggacagatttgtgaagataaaca

SEQ ID NO: 3865 - DNA, 60 bp, Artificial Sequence
  Description of Artificial Sequence: Synthetic probe
acactgcgccgcaccgcgtgctggcaacagtgtacaacgggacgaacaagtactccgcgg

SEQ ID NO: 3866 - DNA, 60 bp, Artificial Sequence
  Description of Artificial Sequence: Synthetic probe
ttgagacgacacctccactgccaacagcggtctggggcagtagagttcggcacgcttcat

SEQ ID NO: 3867 - DNA, 60 bp, Artificial Sequence
  Description of Artificial Sequence: Synthetic probe
ccccgaccgacttgcaaaagatggtcatgggcaacaccaagcctgtcgagctcatcctcg

SEQ ID NO: 3868 - DNA, 56 bp, Artificial Sequence
  Description of Artificial Sequence: Synthetic probe
ccccgaagcagccctctcaaacaccagcaaccccactgcctacaacaaggcaccat

SEQ ID NO: 3869 - DNA, 60 bp, Artificial Sequence
  Description of Artificial Sequence: Synthetic probe
attcacgaggcttgcgcttccttacaccgcgccacaccgcgtgctggcaacagtgtacaa

SEQ ID NO: 3870 - DNA, 60 bp, Artificial Sequence
  Description of Artificial Sequence: Synthetic probe
gaccgccgacaaaccagtcgacgtttactaccggatgaagagggcggagctctactgtcc

SEQ ID NO: 3871 - DNA, 60 bp, Artificial Sequence
  Description of Artificial Sequence: Synthetic probe
gcggagctctactgtccaagacctctcctccctggttatgaccacgcaaacagggacagg

SEQ ID NO: 3872 - DNA, 60 bp, Artificial Sequence
  Description of Artificial Sequence: Synthetic probe
cccacctccttcaactacggcgctgtaaaggctgacaccattactgagcttttgatccgc

SEQ ID NO: 3873 - DNA, 60 bp, Artificial Sequence
  Description of Artificial Sequence: Synthetic probe
gcaagtgttggcccagaaggcggcgagaacgctgcctacctccttcaactacggtgccat

SEQ ID NO: 3874 - DNA, 60 bp, Artificial Sequence
  Description of Artificial Sequence: Synthetic probe
tgaaaccatcactgagctgttgatccgcatgaagcgcgcggagacatactgccccaggcc

SEQ ID NO: 3875 - DNA, 60 bp, Artificial Sequence
  Description of Artificial Sequence: Synthetic probe
cgtacgaacacgcgggacgggacaggttcgatgccccaattggtgtcgagaaacaactgt

SEQ ID NO: 3876 - DNA, 52 bp, Artificial Sequence
  Description of Artificial Sequence: Synthetic probe
ttgtcaactgtttacaacggtgagtgcgagtacaaaacagctgtcgccgcca

SEQ ID NO: 3877 - DNA, 51 bp, Artificial Sequence
  Description of Artificial Sequence: Synthetic probe
cggcgcacccagagccactcaacttggggacaaccctatggttttctctaa

SEQ ID NO: 3878 - DNA, 60 bp, Artificial Sequence
  Description of Artificial Sequence: Synthetic probe
ccactgacccttcgacccacggagggcaagtcaaggagaagagacggatgcacacagatg

SEQ ID NO: 3879 - DNA, 60 bp, Artificial Sequence
  Description of Artificial Sequence: Synthetic probe
accactgacccttcgacccacggagggcaagtcaaggagaagagacggatgcacacagat

SEQ ID NO: 3880 - DNA, 50 bp, Artificial Sequence
  Description of Artificial Sequence: Synthetic probe
tgtgaatgtaagtacagccaacgcgtcactgcaattcgcggtgaccgcgc

SEQ ID NO: 3881 - DNA, 60 bp, Artificial Sequence
  Description of Artificial Sequence: Synthetic probe
agctttactgcccgcgacccgttctcacgcactacgaccacggcgacaaggatcgctaca

SEQ ID NO: 3882 - DNA, 60 bp, Artificial Sequence
  Description of Artificial Sequence: Synthetic probe
gagctttactgcccgcgacccgttctcacgcactacgaccacggcgacaaggatcgctac

SEQ ID NO: 3883 - DNA, 60 bp, Artificial Sequence
  Description of Artificial Sequence: Synthetic probe
gacctcatgcaaatcccctcacacacgctggttggagcactgcttcggtctgcgacgtac

SEQ ID NO: 3884 - DNA, 60 bp, Artificial Sequence
  Description of Artificial Sequence: Synthetic probe
gagcgctcttcagaacgcgagcaaccccacggcctatcacaaggccccgttcacgagact

SEQ ID NO: 3885 - DNA, 60 bp, Artificial Sequence
  Description of Artificial Sequence: Synthetic probe
tgacctgggtgcctaacggtgcccctgagagcgctcttcagaacgcgagcaaccccacgg

SEQ ID NO: 3886 - DNA, 60 bp, Artificial Sequence
  Description of Artificial Sequence: Synthetic probe
tccttcaactacggcgctgtaaaggctgaaaacatcactgagctcttgatccgcatgaaa

SEQ ID NO: 3887 - DNA, 60 bp, Artificial Sequence
  Description of Artificial Sequence: Synthetic probe
gctttgcgctgccttacactgcgccacacaggtgcttggcaacaacctacaacggtgatt

SEQ ID NO: 3888 - DNA, 60 bp, Artificial Sequence
  Description of Artificial Sequence: Synthetic probe
ctacggtggtgagacacaggcccagcgacgtcatcacaccgacgtcagcttcataatgga

SEQ ID NO: 3889 - DNA, 60 bp, Artificial Sequence
  Description of Artificial Sequence: Synthetic probe
ctacggtggtgagacacaggcccagcgacgtcatcacactgacgtcagcttcataatgga

SEQ ID NO: 3890 - DNA, 60 bp, Artificial Sequence
  Description of Artificial Sequence: Synthetic probe
gctgctcgtgcgcatgaagcgtgccgaactctactgccccagaccactgttggcggtgga

SEQ ID NO: 3891 - DNA, 60 bp, Artificial Sequence
  Description of Artificial Sequence: Synthetic probe
tgacaccatcactgagcttttgatccgcatgaaacgcgcggagacatactgccctaggcc

SEQ ID NO: 3892 - DNA, 60 bp, Artificial Sequence
  Description of Artificial Sequence: Synthetic probe
caccagcaaccccactgcctacaacaaggcaccattcacgagactcgctctcccgtacac

SEQ ID NO: 3893 - DNA, 60 bp, Artificial Sequence
  Description of Artificial Sequence: Synthetic probe
ccgccctcgtcatttggaacatcaaacacctgctccacaccggagtcggcactgcctcac

SEQ ID NO: 3894 - DNA, 60 bp, Artificial Sequence
  Description of Artificial Sequence: Synthetic probe
acggtgactgtaagtacaaacccactggcacagccccacgcgaaaacatccgtggtgacc

SEQ ID NO: 3895 - DNA, 60 bp, Artificial Sequence
  Description of Artificial Sequence: Synthetic probe
ctgacaccatcactgagctgttgatccgcatgaagcgcgcggaaacctactgccccagac

SEQ ID NO: 3896 - DNA, 60 bp, Artificial Sequence
  Description of Artificial Sequence: Synthetic probe
acggtgctgtcaaggctgacaccatcactgagctgttgatccgcatgaagcgcgcggaaa

SEQ ID NO: 3897 - DNA, 60 bp, Artificial Sequence
  Description of Artificial Sequence: Synthetic probe
aggttcagcaaaagctcaagggggccgggcaatccagtccggcgaccggctcgcagaacc

SEQ ID NO: 3898 - DNA, 60 bp, Artificial Sequence
  Description of Artificial Sequence: Synthetic probe
gaacacgctgtgtttgcgtgtgtcacctccaacgggtggtacgcgattgacgacgacgac

SEQ ID NO: 3899 - DNA, 60 bp, Artificial Sequence
  Description of Artificial Sequence: Synthetic probe
gacaggaacacgctgtgtttgcgtgtgtcacctccaacgggtggtacgcgattgacgacg

SEQ ID NO: 3900 - DNA, 60 bp, Artificial Sequence
  Description of Artificial Sequence: Synthetic probe
ttttgatgctatcaagcagttgggaaaagtcaccggtcttgaactacacgaggggggacc

SEQ ID NO: 3901 - DNA, 55 bp, Artificial Sequence
  Description of Artificial Sequence: Synthetic probe
ttttgatgctatcaagcagttgggaaaagtcaccggtcttgaactacacgagggg

SEQ ID NO: 3902 - DNA, 60 bp, Artificial Sequence
  Description of Artificial Sequence: Synthetic probe
ggggtgaacaccatcctacagttgtttaggtatgtcgataaacctttcttcgacggggtc

SEQ ID NO: 3903 - DNA, 60 bp, Artificial Sequence
  Description of Artificial Sequence: Synthetic probe
tttggggtgaacaccatcctacagttgtttaggtatgtcgataaacctttcttcgacggg

SEQ ID NO: 3904 - DNA, 60 bp, Artificial Sequence
  Description of Artificial Sequence: Synthetic probe
agactttctactctagacccaataaccacgaaaactttggggtgaacaccatcctacagt

SEQ ID NO: 3905 - DNA, 60 bp, Artificial Sequence
  Description of Artificial Sequence: Synthetic probe
acaacggtgaaaataagactttctactctagacccaataaccacgaaaactttggggtga

SEQ ID NO: 3906 - DNA, 60 bp, Artificial Sequence
  Description of Artificial Sequence: Synthetic probe
gcactgttcctttcacgagacacaggaaagatggagttcactctctacaacggtgaaaat

SEQ ID NO: 3907 - DNA, 60 bp, Artificial Sequence
  Description of Artificial Sequence: Synthetic probe
taaagcactgttcctttcacgagacacaggaaagatggagttcactctctacaacggtga

SEQ ID NO: 3908 - DNA, 60 bp, Artificial Sequence
  Description of Artificial Sequence: Synthetic probe
tgttttatcgctttggtacacgctttccgagagtataaagcactgttcctttcacgagac

SEQ ID NO: 3909 - DNA, 60 bp, Artificial Sequence
  Description of Artificial Sequence: Synthetic probe
atgaacacaactgactgttttatcgctttggtacacgctttccgagagtataaagcactg

SEQ ID NO: 3910 - DNA, 60 bp, Artificial Sequence
  Description of Artificial Sequence: Synthetic probe
tgaccgcgctgtcctggcggcaaagtactctggaagacaacacacgctgccgtccacatt

SEQ ID NO: 3911 - DNA, 60 bp, Artificial Sequence
  Description of Artificial Sequence: Synthetic probe
actgctatccgcggtgaccgcgctgtcctggcggcaaagtactctggaagacaacacacg

SEQ ID NO: 3912 - DNA, 60 bp, Artificial Sequence
  Description of Artificial Sequence: Synthetic probe
taccgcaatccgcggtgaccgcgctgtcctggcggcaaagtactctggaaaacaacacac

SEQ ID NO: 3913 - DNA, 60 bp, Artificial Sequence
  Description of Artificial Sequence: Synthetic probe
cgggcggccacgtactacttctccgacctggaggttgtggtacgccatgaaggcaatcta

SEQ ID NO: 3914 - DNA, 60 bp, Artificial Sequence
  Description of Artificial Sequence: Synthetic probe
ggcgctctgctgcgggcggccacgtactacttctccgacctggaggttgtggtacgccat

SEQ ID NO: 3915 - DNA, 60 bp, Artificial Sequence
  Description of Artificial Sequence: Synthetic probe
tactaccggatgaagagggctgaactgtactgcccacgcccgctgttgccagcctacgaa

SEQ ID NO: 3916 - DNA, 60 bp, Artificial Sequence
  Description of Artificial Sequence: Synthetic probe
ctgataccatcactgagctcttgatccgcatgaaacgcgcggaaacatactgccccagac

SEQ ID NO: 3917 - DNA, 60 bp, Artificial Sequence
  Description of Artificial Sequence: Synthetic probe
tcccaattgatcccgttcgccaaaccacatcggcaggcgagggagcggatgtcgtgacga

SEQ ID NO: 3918 - DNA, 60 bp, Artificial Sequence
  Description of Artificial Sequence: Synthetic probe
gtcgcttgctcagacggttacggtggtttccagaacacagaccccaaagaggccgaccca

SEQ ID NO: 3919 - DNA, 60 bp, Artificial Sequence
  Description of Artificial Sequence: Synthetic probe
ctctacccacaccaatttatcaacccacgcaccaacacaacggcgcacatccaggtcccg

SEQ ID NO: 3920 - DNA, 60 bp, Artificial Sequence
  Description of Artificial Sequence: Synthetic probe
tgggtgtcacgtttgggtacgcggacgacgacaaatttcgggccggtcccaacacctccg

SEQ ID NO: 3921 - DNA, 60 bp, Artificial Sequence
  Description of Artificial Sequence: Synthetic probe
cgttgagaatgaaaccacaagatgcatacccacgacattcaacttcgggagattgttgtg

SEQ ID NO: 3922 - DNA, 60 bp, Artificial Sequence
  Description of Artificial Sequence: Synthetic probe
cacctccttcaactacggcgctgtaaaggctgaaaacatcactgagctcttgatccgcat

SEQ ID NO: 3923 - DNA, 60 bp, Artificial Sequence
  Description of Artificial Sequence: Synthetic probe
cgacatcttacaacggtgattgcaagtacaaacccaccggcacaaccccgcgtgacaaca

SEQ ID NO: 3924 - DNA, 60 bp, Artificial Sequence
  Description of Artificial Sequence: Synthetic probe
tgaccaatgtgagaggtgacctacaagtgttggcccagaaggcggcgagaccgctgccca

SEQ ID NO: 3925 - DNA, 60 bp, Artificial Sequence
  Description of Artificial Sequence: Synthetic probe
ctgccccaggccactgctggcggtggaggtgtcgtcgcaagacagacacaaacaaaagat

SEQ ID NO: 3926 - DNA, 60 bp, Artificial Sequence
  Description of Artificial Sequence: Synthetic probe
acggtgccatcaaagccactcgggtgactgaactgctttaccgcatgaagagggccgaaa

SEQ ID NO: 3927 - DNA, 60 bp, Artificial Sequence
  Description of Artificial Sequence: Synthetic probe
gtgtacaacgggacgagcaagtactcgacaactggtgggcacacacggggtgacttggga

SEQ ID NO: 3928 - DNA, 60 bp, Artificial Sequence
  Description of Artificial Sequence: Synthetic probe
cgcatgaagcgtgccgaactctactgccccagaccactgttggcggtggaggtctcgtct

SEQ ID NO: 3929 - DNA, 60 bp, Artificial Sequence
  Description of Artificial Sequence: Synthetic probe
ttgagtttgagattaaagtaaaaggacaggacatgctctcagacgccgcgctcatggtac

SEQ ID NO: 3930 - DNA, 60 bp, Artificial Sequence
  Description of Artificial Sequence: Synthetic probe
gtgtttgagtttgagattaaagtaaaaggacaggacatgctctcagacgccgcgctcatg

SEQ ID NO: 3931 - DNA, 60 bp, Artificial Sequence
  Description of Artificial Sequence: Synthetic probe
cagggtgtttgagtttgagattaaagtaaaaggacaggacatgctctcagacgccgctct

SEQ ID NO: 3932 - DNA, 60 bp, Artificial Sequence
  Description of Artificial Sequence: Synthetic probe
cgctgatgtcggaagactcatcttctcaggagatgccctcacgtacaaggacatcgtcgt

SEQ ID NO: 3933 - DNA, 60 bp, Artificial Sequence
  Description of Artificial Sequence: Synthetic probe
gtggtcaacaacgctgatgtcggaagactcatcttctcaggagatgccctcacgtacaag

SEQ ID NO: 3934 - DNA, 60 bp, Artificial Sequence
  Description of Artificial Sequence: Synthetic probe
ggcaacatcctacaatggtgactgtaagtacaaacccactggcacagccccgcgcgaacc

SEQ ID NO: 3935 - DNA, 60 bp, Artificial Sequence
  Description of Artificial Sequence: Synthetic probe
ataccacaaggcaccgctcacccggcttgcactgccttacacggcaccacaccgtgtatt

SEQ ID NO: 3936 - DNA, 60 bp, Artificial Sequence
  Description of Artificial Sequence: Synthetic probe
accaccacagccggggagtccgcagaccctgtcaccaccaccgttgagaactacggtggt

SEQ ID NO: 3937 - DNA, 60 bp, Artificial Sequence
  Description of Artificial Sequence: Synthetic probe
accaccaccgccggggagtccgcagaccctgtcaccaccaccgttgagaactacggtggt

SEQ ID NO: 3938 - DNA, 60 bp, Artificial Sequence
  Description of Artificial Sequence: Synthetic probe
ggcggagctctactgccccagaccactgttggcaatagaggtgtcttcgcaagacaggca

SEQ ID NO: 3939 - DNA, 60 bp, Artificial Sequence
  Description of Artificial Sequence: Synthetic probe
aggcccttacctacaaggacattgtagtgtgcatggatggagacaccatgcctggcctct

SEQ ID NO: 3940 - DNA, 60 bp, Artificial Sequence
  Description of Artificial Sequence: Synthetic probe
tgagtgggcagctgcccacctctttcaactacggcgctgtaaaggctgacaccatcactg

SEQ ID NO: 3941 - DNA, 60 bp, Artificial Sequence
  Description of Artificial Sequence: Synthetic probe
gtcgcaaaccaccaccgccggggagtctgcagaccctgtcaccaccaccgtcgagaacta

SEQ ID NO: 3942 - DNA, 60 bp, Artificial Sequence
  Description of Artificial Sequence: Synthetic probe
tacaacgggaagacgacatacggggaaacaacctcacggcgtggtgatatggcggccctc

SEQ ID NO: 3943 - DNA, 60 bp, Artificial Sequence
  Description of Artificial Sequence: Synthetic probe
cccacctctttcaactacggcgctgtaaaggctaacaccatcactgagcttttgatccgc

SEQ ID NO: 3944 - DNA, 60 bp, Artificial Sequence
  Description of Artificial Sequence: Synthetic probe
tatcttctcaggtgacgcactgacctacaaggacgtcgtcgtctgcatggacggtgacac

SEQ ID NO: 3945 - DNA, 60 bp, Artificial Sequence
  Description of Artificial Sequence: Synthetic probe
ctagtgggcgcgctattgcgtgcggccacctactacttctctgacttggaaattgtcgtg

SEQ ID NO: 3946 - DNA, 60 bp, Artificial Sequence
  Description of Artificial Sequence: Synthetic probe
gcaacactgtacaacggtgattgtaagtacaaacccgctgacacacccccgcgtgagaac

SEQ ID NO: 3947 - DNA, 52 bp, Artificial Sequence
  Description of Artificial Sequence: Synthetic probe
acgccggacccgtccgacgtcttggtatttgtcccgtacgatcaagaaccac

SEQ ID NO: 3948 - DNA, 60 bp, Artificial Sequence
  Description of Artificial Sequence: Synthetic probe
ttcggtctgcgacgtactacttctcagacctggaggttgcgcttgtacacacaggcccag

SEQ ID NO: 3949 - DNA, 60 bp, Artificial Sequence
  Description of Artificial Sequence: Synthetic probe
ccaccggcgagtcagcagacccggtaacaaccacggttgagaactacggaggagaaactc

SEQ ID NO: 3950 - DNA, 60 bp, Artificial Sequence
  Description of Artificial Sequence: Synthetic probe
gcaagtgttggcccagaaggcggcgagagcgctgcctacctccttcaactacggtgccat

SEQ ID NO: 3951 - DNA, 60 bp, Artificial Sequence
  Description of Artificial Sequence: Synthetic probe
tgcgcatgaagcgtgctgagctctactgccctagaccactactggcagtggaggtgacaa

SEQ ID NO: 3952 - DNA, 60 bp, Artificial Sequence
  Description of Artificial Sequence: Synthetic probe
gcctgctgtgtttacctgtgtcacatcggacgggtggtacgcgattgatgacgaggactt

SEQ ID NO: 3953 - DNA, 60 bp, Artificial Sequence
  Description of Artificial Sequence: Synthetic probe
atggacaccactgactgttttatcgctctgttacacgctattagagagatcaaaacactc

SEQ ID NO: 3954 - DNA, 60 bp, Artificial Sequence
  Description of Artificial Sequence: Synthetic probe
cgtcatcttttcgcagagaagtatgacaagatcatgctggacggccgcgccctgacagac

SEQ ID NO: 3955 - DNA, 60 bp, Artificial Sequence
  Description of Artificial Sequence: Synthetic probe
actgacgttgccttcgttcttgaccggtttgtgaaggtccatgtgttggacagacaacaa

SEQ ID NO: 3956 - DNA, 60 bp, Artificial Sequence
  Description of Artificial Sequence: Synthetic probe
aacttcggctacgtgaccgccgacaaaccagtcgacgtttactaccggatgaagagggcg

SEQ ID NO: 3957 - DNA, 60 bp, Artificial Sequence
  Description of Artificial Sequence: Synthetic probe
cggtggaggtctcgtcccaagacagacacaaacagaagatcattgcaccagcaaaacagc

SEQ ID NO: 3958 - DNA, 60 bp, Artificial Sequence
  Description of Artificial Sequence: Synthetic probe
ttcacgagacttgcgcttccctacactgcgccgcaccgcgtgttggcaacagtgtacaac

SEQ ID NO: 3959 - DNA, 57 bp, Artificial Sequence
  Description of Artificial Sequence: Synthetic probe
accactgccggggagtcagcagaccctgtcaccaccaccgttgagaactacggtggt

SEQ ID NO: 3960 - DNA, 60 bp, Artificial Sequence
  Description of Artificial Sequence: Synthetic probe
gatgtgtactacaggatgaagcgtgctgaactttactgccccaggccacttctcccggct

SEQ ID NO: 3961 - DNA, 60 bp, Artificial Sequence
  Description of Artificial Sequence: Synthetic probe
aaagccacttgggtgactgaactgctttaccgcatgaagagggccgaaacatactgcccc

SEQ ID NO: 3962 - DNA, 60 bp, Artificial Sequence
  Description of Artificial Sequence: Synthetic probe
tcaaagccacttgggtgactgaactgctttaccgcatgaagagggccgaaacatactgcc

SEQ ID NO: 3963 - DNA, 60 bp, Artificial Sequence
  Description of Artificial Sequence: Synthetic probe
tgggtgccctcctcagggcgtcaacctactacttctgtgatctggagattgcttgtgttg

SEQ ID NO: 3964 - DNA, 60 bp, Artificial Sequence
  Description of Artificial Sequence: Synthetic probe
gtctgcgacgtactacttctcagacctggaggttgcgattgtccacaccggcccagtcac

SEQ ID NO: 3965 - DNA, 60 bp, Artificial Sequence
  Description of Artificial Sequence: Synthetic probe
gcctctgctggcagtggaagtgtcgtcgcaggacagacacaagcaaaagatcattgcacc

SEQ ID NO: 3966 - DNA, 60 bp, Artificial Sequence
  Description of Artificial Sequence: Synthetic probe
actggtgggcgcaatcctgcgttctgccacgtactacttcgcagaccttgaggtggcgtg

SEQ ID NO: 3967 - DNA, 60 bp, Artificial Sequence
  Description of Artificial Sequence: Synthetic probe
cttgacctcatgcagatcccctcacacacgctggttggagcactgcttcggtctgcgacg

SEQ ID NO: 3968 - DNA, 60 bp, Artificial Sequence
  Description of Artificial Sequence: Synthetic probe
caggtttgccataccctacactgcaccgcaccggttgctcgcgaccgtgtacaacggtga

SEQ ID NO: 3969 - DNA, 60 bp, Artificial Sequence
  Description of Artificial Sequence: Synthetic probe
ccacggtggatcttcgttagatacactcacaccactgaccgctacaaagtgccgctcacc

SEQ ID NO: 3970 - DNA, 60 bp, Artificial Sequence
  Description of Artificial Sequence: Synthetic probe
agagttgtactgtccacggtggatcttcgttagatacactcacaccactgaccgctacaa

SEQ ID NO: 3971 - DNA, 60 bp, Artificial Sequence
  Description of Artificial Sequence: Synthetic probe
gcggaatctggcgaactctatcttcgcatgaagagagcagagttgtactgtccacggtgg

SEQ ID NO: 3972 - DNA, 60 bp, Artificial Sequence
  Description of Artificial Sequence: Synthetic probe
gggcgtctttacgcggaatctggcgaactctatcttcgcatgaagagagcagagttgtac

SEQ ID NO: 3973 - DNA, 60 bp, Artificial Sequence
  Description of Artificial Sequence: Synthetic probe
agagagagcggtgtatcccaacatcgttcaatttcgggcgtctttacgcggaatctggcg

SEQ ID NO: 3974 - DNA, 60 bp, Artificial Sequence
  Description of Artificial Sequence: Synthetic probe
cacgcgttgacgcagagagagagcggtgtatcccaacatcgttcaatttcgggcgtcttt

SEQ ID NO: 3975 - DNA, 58 bp, Artificial Sequence
  Description of Artificial Sequence: Synthetic probe
ggtttacaacggaacgtgtgtataccgcaagaacgccccggtgacacctcgccgcggt

SEQ ID NO: 3976 - DNA, 60 bp, Artificial Sequence
  Description of Artificial Sequence: Synthetic probe
caccaggtgttggctacggtttacaacggaacgtgtgtataccgcaagaacgccccggtg

SEQ ID NO: 3977 - DNA, 60 bp, Artificial Sequence
  Description of Artificial Sequence: Synthetic probe
gtgccctgaagtgagcagggttgaggataacccagtggtctttgccaagggcggactagc

SEQ ID NO: 3978 - DNA, 60 bp, Artificial Sequence
  Description of Artificial Sequence: Synthetic probe
tgcccaacgggtgccctgaagtgagcagggttgaggataacccagtggtctttgccaagg

SEQ ID NO: 3979 - DNA, 60 bp, Artificial Sequence
  Description of Artificial Sequence: Synthetic probe
tgggtgcccaacgggtgccctgaagtgagcagggttgaggataacccagtggtctttgcc

SEQ ID NO: 3980 - DNA, 60 bp, Artificial Sequence
  Description of Artificial Sequence: Synthetic probe
cctcatgcaaactcaccaacacgggctggtgggtgcgctgttgcgttcagccacctacta

SEQ ID NO: 3981 - DNA, 60 bp, Artificial Sequence
  Description of Artificial Sequence: Synthetic probe
ccacagaccggtacaagaccaaactagtggcgcctgacaaacaattgtacaacttcgacc

SEQ ID NO: 3982 - DNA, 60 bp, Artificial Sequence
  Description of Artificial Sequence: Synthetic probe
tgtgtgagtcgggcaacgtctactaccggatgaaacgtaccgagctgtactgcccgcgac

SEQ ID NO: 3983 - DNA, 60 bp, Artificial Sequence
  Description of Artificial Sequence: Synthetic probe
ggagattgttgtgtgagtcgggcaacgtctactaccggatgaaacgtaccgagctgtact

SEQ ID NO: 3984 - DNA, 60 bp, Artificial Sequence
  Description of Artificial Sequence: Synthetic probe
tgggtgcccaacggctgcccatacaccgatcgagtggaagacaacccagtcgttcacgcg

SEQ ID NO: 3985 - DNA, 60 bp, Artificial Sequence
  Description of Artificial Sequence: Synthetic probe
gaagcgggcggagctctactgcccacgccccctgttgacacactacgatcacggaggcaa

SEQ ID NO: 3986 - DNA, 60 bp, Artificial Sequence
  Description of Artificial Sequence: Synthetic probe
ccaccgcctacaacggcaactgcaagtacaaaccaacagatgaagccccgcggacgaacg

SEQ ID NO: 3987 - DNA, 60 bp, Artificial Sequence
  Description of Artificial Sequence: Synthetic probe
cacacagggttcttgccaccgcctacaacggcaactgcaagtacaaaccaacagatgaag

SEQ ID NO: 3988 - DNA, 60 bp, Artificial Sequence
  Description of Artificial Sequence: Synthetic probe
cgtgcgcatgaagcgtgctgagctctactgccccaggccactgctggcagtggaggtgtc

SEQ ID NO: 3989 - DNA, 60 bp, Artificial Sequence
  Description of Artificial Sequence: Synthetic probe
aacaagtactctacaactggtggtggtagaaggggtgacctgggacctcttgcggcgcgg

SEQ ID NO: 3990 - DNA, 60 bp, Artificial Sequence
  Description of Artificial Sequence: Synthetic probe
aagcaagtactctacaactggtggtggtagaaggggtgacctggggtctcttgcggcgcg

SEQ ID NO: 3991 - DNA, 60 bp, Artificial Sequence
  Description of Artificial Sequence: Synthetic probe
caacggcaccacccgctttgcgctgccctacactgcgccacacagatgtctggcaacaac

SEQ ID NO: 3992 - DNA, 60 bp, Artificial Sequence
  Description of Artificial Sequence: Synthetic probe
cttgatctcatgcaaattccctcacacacgctggttggagcactgcttcggtctgcgacg

SEQ ID NO: 3993 - DNA, 60 bp, Artificial Sequence
  Description of Artificial Sequence: Synthetic probe
gacattggacatgatcaaacaactttctgattacaccaaacttgacctttcagacggtgg

SEQ ID NO: 3994 - DNA, 60 bp, Artificial Sequence
  Description of Artificial Sequence: Synthetic probe
gccgctctttgagtctgagtatttgtcacctgagaacaagacattggacatgatcaaaca

SEQ ID NO: 3995 - DNA, 60 bp, Artificial Sequence
  Description of Artificial Sequence: Synthetic probe
agccgctctttgagtctgagtatttgtcacctgagaacaagacattggacatgatcaaac

SEQ ID NO: 3996 - DNA, 56 bp, Artificial Sequence
  Description of Artificial Sequence: Synthetic probe
agtacgccgacacaagacacacgctcccctccaccttcacctttggacacgtcact

SEQ ID NO: 3997 - DNA, 60 bp, Artificial Sequence
  Description of Artificial Sequence: Synthetic probe
gcactcccctacactgcaccacaccgtgtgttggcaacagtgtacaacgggacgagcaag

SEQ ID NO: 3998 - DNA, 60 bp, Artificial Sequence
  Description of Artificial Sequence: Synthetic probe
agtgacccacactgggaagctcacatgggtgcccaacggcgccccagtttctgcacttga

SEQ ID NO: 3999 - DNA, 60 bp, Artificial Sequence
  Description of Artificial Sequence: Synthetic probe
ccactcgggtgactgaactgctttaccgcatgaagagggccgaaacatactgtccccggc

SEQ ID NO: 4000 - DNA, 60 bp, Artificial Sequence
  Description of Artificial Sequence: Synthetic probe
aaggcaccgttcacgagactggcacttccctacactgcgccacaccgtgtgctggcaaca

SEQ ID NO: 4001 - DNA, 60 bp, Artificial Sequence
  Description of Artificial Sequence: Synthetic probe
ttgacacactacgaccacaatggactggatcgctacaagaccgcgataaccaaacctgcc

SEQ ID NO: 4002 - DNA, 60 bp, Artificial Sequence
  Description of Artificial Sequence: Synthetic probe
accactaccaccggcgagtcagcagacccggtaacaaccacggttgagaactacggagga

SEQ ID NO: 4003 - DNA, 60 bp, Artificial Sequence
  Description of Artificial Sequence: Synthetic probe
gagcgctgcctacctccttcaactacggtgccatcaaagccacccgggttactgaactgc

SEQ ID NO: 4004 - DNA, 60 bp, Artificial Sequence
  Description of Artificial Sequence: Synthetic probe
ctgagctcttgatccgcatgaaacgcgcggagacgtactgccccaggcctttactagctc

SEQ ID NO: 4005 - DNA, 60 bp, Artificial Sequence
  Description of Artificial Sequence: Synthetic probe
cccgtccaccttcaacttcggattcgtgaccgccgacgaaccagtcgacgtttactaccg

SEQ ID NO: 4006 - DNA, 60 bp, Artificial Sequence
  Description of Artificial Sequence: Synthetic probe
cctgaatcggccctgctgaacaccagcaaccccactgcctacaacaaggcaccgttcacg

SEQ ID NO: 4007 - DNA, 53 bp, Artificial Sequence
  Description of Artificial Sequence: Synthetic probe
actactgcaacaggggaatctgcagaccctgtcaccaccactgtggagaacta

SEQ ID NO: 4008 - DNA, 60 bp, Artificial Sequence
  Description of Artificial Sequence: Synthetic probe
aacaagtgctggagaaggtgccgacgtcgtcacgaccgacgcatccgcgcacggaggtaa

SEQ ID NO: 4009 - DNA, 60 bp, Artificial Sequence
  Description of Artificial Sequence: Synthetic probe
acaacaagtgctggagaaggtgccgacgtcgtcacgaccgacgcatccgcgcacggaggt

SEQ ID NO: 4010 - DNA, 60 bp, Artificial Sequence
  Description of Artificial Sequence: Synthetic probe
tggcaacaagctacaacggtgactgtaagtacaaacccactggcacagccccacgcgaaa

SEQ ID NO: 4011 - DNA, 60 bp, Artificial Sequence
  Description of Artificial Sequence: Synthetic probe
tgcgacgtactacttctcagacctggaggttgcgcttgttcacacaggcccagccacctg

SEQ ID NO: 4012 - DNA, 57 bp, Artificial Sequence
  Description of Artificial Sequence: Synthetic probe
gaccattcagaccgggacaggttcgacgcgcccatcggcgtcgagaaacaactgtgc

SEQ ID NO: 4013 - DNA, 60 bp, Artificial Sequence
  Description of Artificial Sequence: Synthetic probe
acttttacccctggacaccggacccgtccgacgtcctggtatttgtcccgtacgatcaag

SEQ ID NO: 4014 - DNA, 60 bp, Artificial Sequence
  Description of Artificial Sequence: Synthetic probe
cactctttcgttcacgagacacaggaaagatggaattcacactctacaacggtgagaaaa

SEQ ID NO: 4015 - DNA, 60 bp, Artificial Sequence
  Description of Artificial Sequence: Synthetic probe
cgcgattgatgacgaggacttttacccctggacgccggacccgtccgacgttttggtgtt

SEQ ID NO: 4016 - DNA, 60 bp, Artificial Sequence
  Description of Artificial Sequence: Synthetic probe
cgagtcgcctgagaacctcactcttgaggcgattaggcagctggaggaagttactggtct

SEQ ID NO: 4017 - DNA, 60 bp, Artificial Sequence
  Description of Artificial Sequence: Synthetic probe
gtctacgagtcgcctgagaacctcactcttgaggcgattaggcagctggaggaagttact

SEQ ID NO: 4018 - DNA, 60 bp, Artificial Sequence
  Description of Artificial Sequence: Synthetic probe
acggcgctgtaaaggctgacaccatcactgagcttttgatccgcatgaaacgcgcggaga

SEQ ID NO: 4019 - DNA, 60 bp, Artificial Sequence
  Description of Artificial Sequence: Synthetic probe
gggcccggggtttgagctccacgtctcccgccaacttgagtaggtcaaagttcatagcct

SEQ ID NO: 4020 - DNA, 60 bp, Artificial Sequence
  Description of Artificial Sequence: Synthetic probe
caggttatgaactttgacctactcaagttggcgggagacgtggagctcaaccccgggccc

SEQ ID NO: 4021 - DNA, 60 bp, Artificial Sequence
  Description of Artificial Sequence: Synthetic probe
gcccggggtttgagctccacgtctcccgccaacttgagtaggtcaaagttcatagcctgc

SEQ ID NO: 4022 - DNA, 60 bp, Artificial Sequence
  Description of Artificial Sequence: Synthetic probe
cacctgggaagcaggttatgaactttgacctactcaagttggcgggagacgtggagctca

SEQ ID NO: 4023 - DNA, 60 bp, Artificial Sequence
  Description of Artificial Sequence: Synthetic probe
ttgcacctgggaagcaggctctgaactttgacctactcaagttggcgggagacgtggagc

SEQ ID NO: 4024 - DNA, 60 bp, Artificial Sequence
  Description of Artificial Sequence: Synthetic probe
agaggattgcaggcgagacacacattccaaccactttcaactatggcaggatctacacag

SEQ ID NO: 4025 - DNA, 60 bp, Artificial Sequence
  Description of Artificial Sequence: Synthetic probe
acccatgttattgacctcatgcaaacccaccaacacggcctagtgggagcgctgctgcgc

SEQ ID NO: 4026 - DNA, 60 bp, Artificial Sequence
  Description of Artificial Sequence: Synthetic probe
aagcatcatcaacaactactacatgcagcagtaccagaactctatggacacacaacttgg

SEQ ID NO: 4027 - DNA, 60 bp, Artificial Sequence
  Description of Artificial Sequence: Synthetic probe
cggctgcccacctccttcaactacggcgctgtaaaggctgacaccatcactgagctcttg

SEQ ID NO: 4028 - DNA, 60 bp, Artificial Sequence
  Description of Artificial Sequence: Synthetic probe
tggacaataccaccaacccaacagcataccacaaggcgcccctcacccggcttgcactgc

SEQ ID NO: 4029 - DNA, 60 bp, Artificial Sequence
  Description of Artificial Sequence: Synthetic probe
ccgtctaccttcaacttcggctacgtgaccgccgacgaaccagtcgacgtttactaccgg

SEQ ID NO: 4030 - DNA, 60 bp, Artificial Sequence
  Description of Artificial Sequence: Synthetic probe
atcttttcgcagagaagtatgacaagatcatgattgacggcagagccatgacagaccgtg

SEQ ID NO: 4031 - DNA, 60 bp, Artificial Sequence
  Description of Artificial Sequence: Synthetic probe
gcatggttgacggtacggggatgtgtcttgctgacttccacgcaggaatcttccccaaag

SEQ ID NO: 4032 - DNA, 60 bp, Artificial Sequence
  Description of Artificial Sequence: Synthetic probe
ggcaggatatacactgaagccgaggttgacgtgtacgtaaggatgaaacgcgcggagctc

SEQ ID NO: 4033 - DNA, 60 bp, Artificial Sequence
  Description of Artificial Sequence: Synthetic probe
ttctactctagacccaacaaccatgacaactgctggttgaacaccatgggcggatccagt

SEQ ID NO: 4034 - DNA, 60 bp, Artificial Sequence
  Description of Artificial Sequence: Synthetic probe
cgagcacaagcgaaaatggagttcacactttacaacggtgagaagaagactttctactct

SEQ ID NO: 4035 - DNA, 60 bp, Artificial Sequence
  Description of Artificial Sequence: Synthetic probe
cactgtttctatcacgagcacaagcgaaaatggagttcacactttacaacggtgagaaga

SEQ ID NO: 4036 - DNA, 60 bp, Artificial Sequence
  Description of Artificial Sequence: Synthetic probe
acaggctccggatgcccttcaggtaccccgaggtaacacgcgacactcgggatctgagaa

SEQ ID NO: 4037 - DNA, 60 bp, Artificial Sequence
  Description of Artificial Sequence: Synthetic probe
ccactggcgacaggctccggatgcccttcaggtaccccgaggtaacacgcgacactcggg

SEQ ID NO: 4038 - DNA, 60 bp, Artificial Sequence
  Description of Artificial Sequence: Synthetic probe
cgggaactcctccttggtaacgaggacccgcggggccgaaagccacgtccttacggaccc

SEQ ID NO: 4039 - DNA, 60 bp, Artificial Sequence
  Description of Artificial Sequence: Synthetic probe
ggagcatggtggccgcgggaactcctccttggtaacgaggacccgcggggccgaaagcca

SEQ ID NO: 4040 - DNA, 60 bp, Artificial Sequence
  Description of Artificial Sequence: Synthetic probe
ttgcgggtgttagtaacagcactgatgcttcgtagcggagcatggtggccgcgggaactc

SEQ ID NO: 4041 - DNA, 60 bp, Artificial Sequence
  Description of Artificial Sequence: Synthetic probe
cacgctcggtccacttgcgggtgttagtaacagcactgatgcttcgtagcggagcatggt

SEQ ID NO: 4042 - DNA, 60 bp, Artificial Sequence
  Description of Artificial Sequence: Synthetic probe
cctggtctttccaggtctagaggggtgacattttgtactgtgcttgactccacgctcggt

SEQ ID NO: 4043 - DNA, 60 bp, Artificial Sequence
  Description of Artificial Sequence: Synthetic probe
tcattcagttttgcccgttttcaagagaaatgggacgtctgcgcacgaaacgcgccgtcc

SEQ ID NO: 4044 - DNA, 60 bp, Artificial Sequence
  Description of Artificial Sequence: Synthetic probe
agcaaaacggcaagttcattcagttttgcccgttttcaagagaaatgggacgtctgcgca

SEQ ID NO: 4045 - DNA, 60 bp, Artificial Sequence
  Description of Artificial Sequence: Synthetic probe
cccggcgataacgggatgtaaccacaagatgaaccttcacccggaagcaaaacggcaagt

SEQ ID NO: 4046 - DNA, 60 bp, Artificial Sequence
  Description of Artificial Sequence: Synthetic probe
gctttcccggcgataacgggatgtaaccacaagatgaaccttcacccggaagcaaaacgg

SEQ ID NO: 4047 - DNA, 60 bp, Artificial Sequence
  Description of Artificial Sequence: Synthetic probe
cccgatgttaaagggctgtaaccgcaagattgtaccggctttcccggcgataacgggatg

SEQ ID NO: 4048 - DNA, 60 bp, Artificial Sequence
  Description of Artificial Sequence: Synthetic probe
ttttaccgtcttccccgatgttaaagggctgtaaccgcaagattgtaccggctttcccgg

SEQ ID NO: 4049 - DNA, 60 bp, Artificial Sequence
  Description of Artificial Sequence: Synthetic probe
acggtgccattaaggccacccgggtgactgaactgctttaccgcatgaagagggccgaga

SEQ ID NO: 4050 - DNA, 58 bp, Artificial Sequence
  Description of Artificial Sequence: Synthetic probe
gctggctcaattcattgctgcagctctttcgatacgtcgatgagccgctctttgaatc

SEQ ID NO: 4051 - DNA, 60 bp, Artificial Sequence
  Description of Artificial Sequence: Synthetic probe
gcgttgatgtgtactacaggatgaagcgtgctgaactttactgccccaggccacttctcc

SEQ ID NO: 4052 - DNA, 60 bp, Artificial Sequence
  Description of Artificial Sequence: Synthetic probe
cggtgccattaaggctacttgggtgactgaactgctttaccgcatgaagagggccgaaac

SEQ ID NO: 4053 - DNA, 60 bp, Artificial Sequence
  Description of Artificial Sequence: Synthetic probe
gccacgtactacttctccgacctggagattgtggttcgtcacgacggcaacctgacgtgg

SEQ ID NO: 4054 - DNA, 60 bp, Artificial Sequence
  Description of Artificial Sequence: Synthetic probe
gcagaggattgcaagtgagacacacattccaaccactttcaactacggcaggatttacac

SEQ ID NO: 4055 - DNA, 60 bp, Artificial Sequence
  Description of Artificial Sequence: Synthetic probe
gcgatcaaagcaactcgggtgactgaactgctttaccgcatgaagagggctgagacgtac

SEQ ID NO: 4056 - DNA, 53 bp, Artificial Sequence
  Description of Artificial Sequence: Synthetic probe
gcgatctagcggtgctggcacaacgtgttgagaatgaaaccacaagatgcata

SEQ ID NO: 4057 - DNA, 51 bp, Artificial Sequence
  Description of Artificial Sequence: Synthetic probe
gggccgagctttactgtccaagaccccttctccctgcttacgaccacggca

SEQ ID NO: 4058 - DNA, 60 bp, Artificial Sequence
  Description of Artificial Sequence: Synthetic probe
cgacgagccagtcgacgcttactaccgcatgaagagggccgagctttactgtccaagacc

SEQ ID NO: 4059 - DNA, 60 bp, Artificial Sequence
  Description of Artificial Sequence: Synthetic probe
cggtttcgtaaccgccgacgagccagtcgacgcttactaccgcatgaagagggccgagct

SEQ ID NO: 4060 - DNA, 60 bp, Artificial Sequence
  Description of Artificial Sequence: Synthetic probe
aacacaaaacacgagcttccgtccacttttaatttcggtttcgtaaccgccgacgagcca

SEQ ID NO: 4061 - DNA, 60 bp, Artificial Sequence
  Description of Artificial Sequence: Synthetic probe
gcagccaagtatgcaaacacaaaacacgagcttccgtccacttttaatttcggtttcgta

SEQ ID NO: 4062 - DNA, 60 bp, Artificial Sequence
  Description of Artificial Sequence: Synthetic probe
cagacctccggagccatccgtggtgaccgagctgtgttggcagccaagtatgcaaacaca

SEQ ID NO: 4063 - DNA, 60 bp, Artificial Sequence
  Description of Artificial Sequence: Synthetic probe
gcaagtacacacagacctccggagccatccgtggtgaccgagctgtgttggcagccaagt

SEQ ID NO: 4064 - DNA, 60 bp, Artificial Sequence
  Description of Artificial Sequence: Synthetic probe
gccgcaccgactcctgtcaaccaggtacaatggtgagtgcaagtacacacagacctccgg

SEQ ID NO: 4065 - DNA, 60 bp, Artificial Sequence
  Description of Artificial Sequence: Synthetic probe
gccatacactgcgccgcaccgactcctgtcaaccaggtacaatggtgagtgcaagtacac

SEQ ID NO: 4066 - DNA, 60 bp, Artificial Sequence
  Description of Artificial Sequence: Synthetic probe
gtgttttcacacaacaacgtcacgcgcttcgctctgccatacactgcgccgcaccgactc

SEQ ID NO: 4067 - DNA, 60 bp, Artificial Sequence
  Description of Artificial Sequence: Synthetic probe
cgcgacaacccaatggtgttttcacacaacaacgtcacgcgcttcgctctgccatacact

SEQ ID NO: 4068 - DNA, 60 bp, Artificial Sequence
  Description of Artificial Sequence: Synthetic probe
acgcacgtgtatggtggcagcccaacggcgcgccgcggacaacccagctccgcgacaacc

SEQ ID NO: 4069 - DNA, 60 bp, Artificial Sequence
  Description of Artificial Sequence: Synthetic probe
cttctgtgacctggaaattgcatgtcttggtaagcacgcacgtgtatggtggcagcccaa

SEQ ID NO: 4070 - DNA, 60 bp, Artificial Sequence
  Description of Artificial Sequence: Synthetic probe
cgcttccacctactacttctgtgacctggaaattgcatgtcttggtaagcacgcacgtgt

SEQ ID NO: 4071 - DNA, 60 bp, Artificial Sequence
  Description of Artificial Sequence: Synthetic probe
ggacaccaatgagaggaccttagtgggtgcgttgctccgcgcttccacctactacttctg

SEQ ID NO: 4072 - DNA, 60 bp, Artificial Sequence
  Description of Artificial Sequence: Synthetic probe
gttgatctgatggacaccaatgagaggaccttagtgggtgcgttgctccgcgcttccacc

SEQ ID NO: 4073 - DNA, 59 bp, Artificial Sequence
  Description of Artificial Sequence: Synthetic probe
tcgtcttggacaggttcactcacgttcacaccaacaaaacatcctttgtggttgatctg

SEQ ID NO: 4074 - DNA, 60 bp, Artificial Sequence
  Description of Artificial Sequence: Synthetic probe
tcgtcttggacaggttcactcacgttcacaccaacaaaacatcctttgtggttgatctga

SEQ ID NO: 4075 - DNA, 56 bp, Artificial Sequence
  Description of Artificial Sequence: Synthetic probe
ccacggtgggtctgtggtggagaaaagacgcatgcacactgacgttgccttcgtct

SEQ ID NO: 4076 - DNA, 60 bp, Artificial Sequence
  Description of Artificial Sequence: Synthetic probe
ccacggtgggtctgtggtggagaaaagacgcatgcacactgacgttgccttcgtcttgga

SEQ ID NO: 4077 - DNA, 56 bp, Artificial Sequence
  Description of Artificial Sequence: Synthetic probe
gagcagacgtgattacgactgatccctccacccacggtgggtctgtggtggagaaa

SEQ ID NO: 4078 - DNA, 60 bp, Artificial Sequence
  Description of Artificial Sequence: Synthetic probe
actacatcgtcgggcgagggagcagacgtgattacgactgatccctccacccacggtggg

SEQ ID NO: 4079 - DNA, 60 bp, Artificial Sequence
  Description of Artificial Sequence: Synthetic probe
cctgcgcgctgccacgtactacttctcggacttggaggtggcatgtgttggcgtgaacaa

SEQ ID NO: 4080 - DNA, 60 bp, Artificial Sequence
  Description of Artificial Sequence: Synthetic probe
cccacctccttcaactacggggctgtgaaggctgacaccatcactgagctgttgatccgc

SEQ ID NO: 4081 - DNA, 60 bp, Artificial Sequence
  Description of Artificial Sequence: Synthetic probe
ccacgctggctctttgtccgctacacacacacagcggaccgctacaaagtgccacttacc

SEQ ID NO: 4082 - DNA, 60 bp, Artificial Sequence
  Description of Artificial Sequence: Synthetic probe
ctgtactgcccacgctggctctttgtccgctacacacacacagcggaccgctacaaagtg

SEQ ID NO: 4083 - DNA, 60 bp, Artificial Sequence
  Description of Artificial Sequence: Synthetic probe
cttgctaggcgggtggagacggagagagagcggtgtatcccaacatcgttcaatttcggg

SEQ ID NO: 4084 - DNA, 60 bp, Artificial Sequence
  Description of Artificial Sequence: Synthetic probe
aggcttgctaggcgggtggagacggagagagagcggtgtatcccaacatcgttcaatttc

SEQ ID NO: 4085 - DNA, 60 bp, Artificial Sequence
  Description of Artificial Sequence: Synthetic probe
cgctacaaggtggcgataaccaaacctgccaaacaacttggaaactttgaactgttaaag

SEQ ID NO: 4086 - DNA, 60 bp, Artificial Sequence
  Description of Artificial Sequence: Synthetic probe
tcgctacaaggtggcgataaccaaacctgccaaacaacttggaaactttgaactgttaaa

SEQ ID NO: 4087 - DNA, 60 bp, Artificial Sequence
  Description of Artificial Sequence: Synthetic probe
cgcgagaacatacgcggagacctcgcgactttagcgcagaggattgctagcgagacacac

SEQ ID NO: 4088 - DNA, 60 bp, Artificial Sequence
  Description of Artificial Sequence: Synthetic probe
gcacggccctgcgcgagaacatacgcggagacctcgcgactttagcgcagaggattgcta

SEQ ID NO: 4089 - DNA, 60 bp, Artificial Sequence
  Description of Artificial Sequence: Synthetic probe
gcaacaacttacaatggtgattgcaagtacaagcccgctggcacggccctgcgcgagaac

SEQ ID NO: 4090 - DNA, 53 bp, Artificial Sequence
  Description of Artificial Sequence: Synthetic probe
tggactcccaacggagcaccagagtttgacgaggttggcgacaatccagtcgt

SEQ ID NO: 4091 - DNA, 60 bp, Artificial Sequence
  Description of Artificial Sequence: Synthetic probe
gaaacagctcctgaactttgacctgcttaagttggcgggagacgttgagtccaaccctgg

SEQ ID NO: 4092 - DNA, 60 bp, Artificial Sequence
  Description of Artificial Sequence: Synthetic probe
gtgacccacactgggaagctcacatgggtgcccaacggtgcaccagtttctgcacttgac

SEQ ID NO: 4093 - DNA, 51 bp, Artificial Sequence
  Description of Artificial Sequence: Synthetic probe
ggcactcccctacaccgccccccaccgtgtgctggcaacagtgtacaacgg

SEQ ID NO: 4094 - DNA, 60 bp, Artificial Sequence
  Description of Artificial Sequence: Synthetic probe
gacagattcgacgcccccatcggcgttgaaaaacagctgcacaacttcgacctgttaaag

SEQ ID NO: 4095 - DNA, 60 bp, Artificial Sequence
  Description of Artificial Sequence: Synthetic probe
ggacagatttgtgaagattaacaacaccagccccatacacgtcattgacctcatgcaaac

SEQ ID NO: 4096 - DNA, 60 bp, Artificial Sequence
  Description of Artificial Sequence: Synthetic probe
ggacagatttgtgaagattaacaacaccagccccacacacgtcattgatctcatgcaaac

SEQ ID NO: 4097 - DNA, 60 bp, Artificial Sequence
  Description of Artificial Sequence: Synthetic probe
ccactgctggcagtagaggtgtcaacgcaagacagacacaaacagaagatcattgcacct

SEQ ID NO: 4098 - DNA, 60 bp, Artificial Sequence
  Description of Artificial Sequence: Synthetic probe
tcccctacactgcgccgcaccgcgtgttggcgacggtgtacaacgggacgagcaagtact

SEQ ID NO: 4099 - DNA, 60 bp, Artificial Sequence
  Description of Artificial Sequence: Synthetic probe
gctggcggtggaggtgtcgtcgcaagacagacacaaacaaaagatcattgcacctgcaaa

SEQ ID NO: 4100 - DNA, 60 bp, Artificial Sequence
  Description of Artificial Sequence: Synthetic probe
agcactcccctacactgcgccgcaccgcgtgttggcgacggtgtacaacgggacgagcaa

SEQ ID NO: 4101 - DNA, 60 bp, Artificial Sequence
  Description of Artificial Sequence: Synthetic probe
ggctagcactcccctacactgcgccgcaccgcgtgttggcgacggtgtacaatgggacga

SEQ ID NO: 4102 - DNA, 60 bp, Artificial Sequence
  Description of Artificial Sequence: Synthetic probe
ttacgagactagcactcccctacactgcgccgcaccgcgtgttggcgacagtgtacaacg

SEQ ID NO: 4103 - DNA, 60 bp, Artificial Sequence
  Description of Artificial Sequence: Synthetic probe
accactgcaacgggggaatctgcagaccctgtcaccaccactgtggaaaactacggtggt

SEQ ID NO: 4104 - DNA, 60 bp, Artificial Sequence
  Description of Artificial Sequence: Synthetic probe
ggtgggtgccctgttacgtgctgccacgtactacttctccgacctggagattgtggttcg

SEQ ID NO: 4105 - DNA, 60 bp, Artificial Sequence
  Description of Artificial Sequence: Synthetic probe
ttacgagactagcactcccctacactgcgccgcaccgcgtgttggcgacggtgtacaacg

SEQ ID NO: 4106 - DNA, 60 bp, Artificial Sequence
  Description of Artificial Sequence: Synthetic probe
tcacgaggctagcactcccctacactgcgccgcaccgcgtgttggcgacggtgtacaacg

SEQ ID NO: 4107 - DNA, 60 bp, Artificial Sequence
  Description of Artificial Sequence: Synthetic probe
tgcccacacaccgaccgcgtggaagacaacccagtcgttcatgcgaaaaacggtgctgct

SEQ ID NO: 4108 - DNA, 60 bp, Artificial Sequence
  Description of Artificial Sequence: Synthetic probe
tgactcttctggcaaacatagtgatcatgatccgcgagactcacaagaggcagcagatgg

SEQ ID NO: 4109 - DNA, 53 bp, Artificial Sequence
  Description of Artificial Sequence: Synthetic probe
ccccaccgtgtgctggcaacagtgtacaacgggaagacaacgtacggggaaac

SEQ ID NO: 4110 - DNA, 60 bp, Artificial Sequence
  Description of Artificial Sequence: Synthetic probe
caccattcacgagactcgcgcttccctacactgcgccacaccgcgtgctggcaacagtgt

SEQ ID NO: 4111 - DNA, 60 bp, Artificial Sequence
  Description of Artificial Sequence: Synthetic probe
tctggagactagtggtgccagcactgttggcttcagagagagaactctcccgggtcacac

SEQ ID NO: 4112 - DNA, 60 bp, Artificial Sequence
  Description of Artificial Sequence: Synthetic probe
aagagcgctgcctacctccttcaactacggtgccatcaaagccacccgggttactgaact

SEQ ID NO: 4113 - DNA, 60 bp, Artificial Sequence
  Description of Artificial Sequence: Synthetic probe
ggccgacaccatccacgagcttctcgtgcgcatgaaacgggcagagctctactgccccag

SEQ ID NO: 4114 - DNA, 60 bp, Artificial Sequence
  Description of Artificial Sequence: Synthetic probe
gctgatggtcaggtacactcacaccacagacagatacaaagttgcgcttgtgtcaccagc

SEQ ID NO: 4115 - DNA, 60 bp, Artificial Sequence
  Description of Artificial Sequence: Synthetic probe
aacttcggtcgattgttgtgtgattcgggtgacgtgtactaccgaatgaagcgggccgag

SEQ ID NO: 4116 - DNA, 60 bp, Artificial Sequence
  Description of Artificial Sequence: Synthetic probe
accgcgtggaagacaacccagtcgttcacgccaaggggaatgttacccgctttgcactgc

SEQ ID NO: 4117 - DNA, 60 bp, Artificial Sequence
  Description of Artificial Sequence: Synthetic probe
tactgccccagaccacttctcccggcctacgatcacgcaaaccgggatagatttgacgcc

SEQ ID NO: 4118 - DNA, 57 bp, Artificial Sequence
  Description of Artificial Sequence: Synthetic probe
gtgctgaactttactgccccagaccacttctcccggcctacgatcacgcagaccggg

SEQ ID NO: 4119 - DNA, 60 bp, Artificial Sequence
  Description of Artificial Sequence: Synthetic probe
tgagctacacgagggtgggccacccgctctcgtcatttggaacatcaagcacctgctcca

SEQ ID NO: 4120 - DNA, 60 bp, Artificial Sequence
  Description of Artificial Sequence: Synthetic probe
cttaccttgtacctcgtcatcttttcgcagagaagtatgacaagatcatgttggacggcc

SEQ ID NO: 4121 - DNA, 60 bp, Artificial Sequence
  Description of Artificial Sequence: Synthetic probe
acatggaaccgttcaacggaaacgcgattgcgaaagcgaccgcgtacgtgaagggagccg

SEQ ID NO: 4122 - DNA, 60 bp, Artificial Sequence
  Description of Artificial Sequence: Synthetic probe
cgtacgacatggaaccgttcaacggaaacgcgattgcgaaagcgaccgcgtacgtgaagg

SEQ ID NO: 4123 - DNA, 60 bp, Artificial Sequence
  Description of Artificial Sequence: Synthetic probe
caacggatggtacgccatcgacgacgaggacttttacccatggactccggatccgtccga

SEQ ID NO: 4124 - DNA, 60 bp, Artificial Sequence
  Description of Artificial Sequence: Synthetic probe
tccaacggatggtacgccatcgacgacgaggacttttacccatggactccggatccgtcc

SEQ ID NO: 4125 - DNA, 51 bp, Artificial Sequence
  Description of Artificial Sequence: Synthetic probe
aacacgccgtgttcgcctgtttgacctccaacggatggtacgccatcgacg

SEQ ID NO: 4126 - DNA, 60 bp, Artificial Sequence
  Description of Artificial Sequence: Synthetic probe
caggaatcttcctcaagggtgctgaacacgccgtgttcgcctgtttgacctccaacggat

SEQ ID NO: 4127 - DNA, 60 bp, Artificial Sequence
  Description of Artificial Sequence: Synthetic probe
tcacaggcctcagcctacacgagggtgggccccccgctctcgtgatttggaacatcaaac

SEQ ID NO: 4128 - DNA, 60 bp, Artificial Sequence
  Description of Artificial Sequence: Synthetic probe
cgtcgatgagccattcttcgactgggtctacaattcacctgaaaacctcacgctccaggc

SEQ ID NO: 4129 - DNA, 60 bp, Artificial Sequence
  Description of Artificial Sequence: Synthetic probe
aggtacgtcgatgagccattcttcgactgggtctacaattcacctgaaaacctcacgctc

SEQ ID NO: 4130 - DNA, 60 bp, Artificial Sequence
  Description of Artificial Sequence: Synthetic probe
ggcccaaccgccacgataactgctggctaaacaccatcctgcaattgttcaggtacgtcg

SEQ ID NO: 4131 - DNA, 60 bp, Artificial Sequence
  Description of Artificial Sequence: Synthetic probe
aaagatggagttcacgctgcacaacggcgagaaaaagactttctactcaaggcccaaccg

SEQ ID NO: 4132 - DNA, 60 bp, Artificial Sequence
  Description of Artificial Sequence: Synthetic probe
tgatgatgaggtgttctacccatggacacccgaccctgcaaacgtgctcgcgtacgtacc

SEQ ID NO: 4133 - DNA, 60 bp, Artificial Sequence
  Description of Artificial Sequence: Synthetic probe
gccccttcttgccattcacccgagtgaagctagacacaagcagaagattgtggcacccac

SEQ ID NO: 4134 - DNA, 60 bp, Artificial Sequence
  Description of Artificial Sequence: Synthetic probe
caggccccttcttgccattcacccgagtgaagctagacacaagcagaagattgtggcacc

SEQ ID NO: 4135 - DNA, 59 bp, Artificial Sequence
  Description of Artificial Sequence: Synthetic probe
cgggtgattgagctgctttaccgcatgaaacgggccgagacatactgtcccaggcccct

SEQ ID NO: 4136 - DNA, 60 bp, Artificial Sequence
  Description of Artificial Sequence: Synthetic probe
cgggtgattgagctgctttaccgcatgaaacgggccgagacatactgtcccaggcccctt

SEQ ID NO: 4137 - DNA, 60 bp, Artificial Sequence
  Description of Artificial Sequence: Synthetic probe
aggggacctccaagtactggcccagaaagcagcgcgaacgctgcccacctccttcaacta

SEQ ID NO: 4138 - DNA, 60 bp, Artificial Sequence
  Description of Artificial Sequence: Synthetic probe
gtgagaggggacctccaagtactggcccagaaagcagcgcgaacgctgcccacctccttc

SEQ ID NO: 4139 - DNA, 60 bp, Artificial Sequence
  Description of Artificial Sequence: Synthetic probe
cgtacaacggggaatgcaggtacggtacatacaccacgaccaacgtgagaggggacctcc

SEQ ID NO: 4140 - DNA, 60 bp, Artificial Sequence
  Description of Artificial Sequence: Synthetic probe
cgactgcgtacaacggggaatgcaggtacggtacatacaccacgaccaacgtgagagggg

SEQ ID NO: 4141 - DNA, 60 bp, Artificial Sequence
  Description of Artificial Sequence: Synthetic probe
ttgccctgccctatacagcgccgcaccgcgtgctggcgactgcgtacaacggggaatgca

SEQ ID NO: 4142 - DNA, 60 bp, Artificial Sequence
  Description of Artificial Sequence: Synthetic probe
acctctcacgcgacttgccctgccctatacagcgccgcaccgcgtgctggcgactgcgta

SEQ ID NO: 4143 - DNA, 60 bp, Artificial Sequence
  Description of Artificial Sequence: Synthetic probe
aataactccaccaacccaacagcctaccacaaggcacctctcacgcgacttgccctgccc

SEQ ID NO: 4144 - DNA, 60 bp, Artificial Sequence
  Description of Artificial Sequence: Synthetic probe
ccagaggcggccctgaataactccaccaacccaacagcctaccacaaggcacctctcacg

SEQ ID NO: 4145 - DNA, 60 bp, Artificial Sequence
  Description of Artificial Sequence: Synthetic probe
tacacgagggaaacctcacctgggttccaaatggggccccagaggcggccctgaataact

SEQ ID NO: 4146 - DNA, 60 bp, Artificial Sequence
  Description of Artificial Sequence: Synthetic probe
agctagcggtggtacacgagggaaacctcacctgggttccaaatggggccccagaggcgg

SEQ ID NO: 4147 - DNA, 60 bp, Artificial Sequence
  Description of Artificial Sequence: Synthetic probe
aaacagtttgagccccacacatgtcattgacctcatgcaaacccaccaacacgggttggt

SEQ ID NO: 4148 - DNA, 60 bp, Artificial Sequence
  Description of Artificial Sequence: Synthetic probe
ctttgctagctctcgacaccactcaggaccgccgtaaacaggagatcattgcacctgaga

SEQ ID NO: 4149 - DNA, 60 bp, Artificial Sequence
  Description of Artificial Sequence: Synthetic probe
gcgcatgaaacgggccgaactctactgccccagaccactgctggcaatagaggtgtcttc

SEQ ID NO: 4150 - DNA, 60 bp, Artificial Sequence
  Description of Artificial Sequence: Synthetic probe
gggaactgcaagtatggcagagctcctgagaccaacgtgagaggtgacctacaagtgttg

SEQ ID NO: 4151 - DNA, 60 bp, Artificial Sequence
  Description of Artificial Sequence: Synthetic probe
aaccctacagcctacaacaaagcgccgttcacgaggcttgcgcttccctacactgcacca

SEQ ID NO: 4152 - DNA, 60 bp, Artificial Sequence
  Description of Artificial Sequence: Synthetic probe
agtgttggcccagaaggcggcgagaacgctgcctacctccttcaactacggcgccatcaa

SEQ ID NO: 4153 - DNA, 60 bp, Artificial Sequence
  Description of Artificial Sequence: Synthetic probe
cctacaagtgttggcccagaaggcggcgagaacgctgcctacctccttcaactacggcgc

SEQ ID NO: 4154 - DNA, 60 bp, Artificial Sequence
  Description of Artificial Sequence: Synthetic probe
gatccgtccgacgttttggtgtttgttccgtacgatcaagaaccactcaacggagaatgg

SEQ ID NO: 4155 - DNA, 60 bp, Artificial Sequence
  Description of Artificial Sequence: Synthetic probe
cttcagaatgaagaggaccgagctctactgtccaaggccactcctccctgcctacgacca

SEQ ID NO: 4156 - DNA, 60 bp, Artificial Sequence
  Description of Artificial Sequence: Synthetic probe
cactgcttcgcgcatccacctactacttctgtgacttggaaatcgcttgcatcggcgacc

SEQ ID NO: 4157 - DNA, 60 bp, Artificial Sequence
  Description of Artificial Sequence: Synthetic probe
tccgttgcagagaagaggagaatgcacactgatgttgcctttgtcatggacaggttcacc

SEQ ID NO: 4158 - DNA, 60 bp, Artificial Sequence
  Description of Artificial Sequence: Synthetic probe
acgttcgctgtgccctacgtctctgccagtgatttctcctacacccacacagacacaccc

SEQ ID NO: 4159 - DNA, 60 bp, Artificial Sequence
  Description of Artificial Sequence: Synthetic probe
gttcatggtggcctacatcccacctggcacggcaacagacaaactgcccaagacgcccga

SEQ ID NO: 4160 - DNA, 60 bp, Artificial Sequence
  Description of Artificial Sequence: Synthetic probe
agttgcctgctctgatggctacggcggattccaaaacactgacccgaagaccgcagatcc

SEQ ID NO: 4161 - DNA, 60 bp, Artificial Sequence
  Description of Artificial Sequence: Synthetic probe
cttaccaccgaggcgcaaatgaactccgggactgttgaggtttacgccaacatcgccccg

SEQ ID NO: 4162 - DNA, 60 bp, Artificial Sequence
  Description of Artificial Sequence: Synthetic probe
actgtctctctatccccaccagttcatcaacccacggaccaacaccactgcacacatcca

SEQ ID NO: 4163 - DNA, 60 bp, Artificial Sequence
  Description of Artificial Sequence: Synthetic probe
gctcttcggagctttgttggctgacaagaagaccgaggagacgacgctgcttgaggaccg

SEQ ID NO: 4164 - DNA, 60 bp, Artificial Sequence
  Description of Artificial Sequence: Synthetic probe
cggtgagacacaagtccagagacgccaccacacggacgtcggcttcatcatggaccgatt

SEQ ID NO: 4165 - DNA, 60 bp, Artificial Sequence
  Description of Artificial Sequence: Synthetic probe
ctacggcggtgagacacaagtccagagacgccaccacacggacgtcggcttcatcatgga

SEQ ID NO: 4166 - DNA, 60 bp, Artificial Sequence
  Description of Artificial Sequence: Synthetic probe
ccaggcctctgctggcagtggaagtgtcgtcgcaggacagacacaagcaaaagatcattg

SEQ ID NO: 4167 - DNA, 60 bp, Artificial Sequence
  Description of Artificial Sequence: Synthetic probe
gcgctgtgctgcgcgactggagtgtttgggaccgcctacctcgtgcctcgtcaccttttc

SEQ ID NO: 4168 - DNA, 60 bp, Artificial Sequence
  Description of Artificial Sequence: Synthetic probe
cgcaggacagacacaagcaaaagatcattgcacctgcaaagcaactcttgaactttcgac

SEQ ID NO: 4169 - DNA, 60 bp, Artificial Sequence
  Description of Artificial Sequence: Synthetic probe
ctgtgtcacatcggacgggtggtacgcgattgatgacgaggacttttacccttggacgcc

SEQ ID NO: 4170 - DNA, 60 bp, Artificial Sequence
  Description of Artificial Sequence: Synthetic probe
tagctcttgacaccacccacgaccgccgtaagcaggagatcattgcacctgagaagcagc

SEQ ID NO: 4171 - DNA, 60 bp, Artificial Sequence
  Description of Artificial Sequence: Synthetic probe
acgtactacttctcagacctggaggttgcgcttgtccacacaggcccagccacctgggtg

SEQ ID NO: 4172 - DNA, 60 bp, Artificial Sequence
  Description of Artificial Sequence: Synthetic probe
ctggtgggtgcgttgttgcgtgcagccacgtactacttctccgacttggagattgttgtg

SEQ ID NO: 4173 - DNA, 60 bp, Artificial Sequence
  Description of Artificial Sequence: Synthetic probe
cacaaacacgggatcgtgggtgcgttactgcgtgcagccacgtactacttctccgacttg

SEQ ID NO: 4174 - DNA, 54 bp, Artificial Sequence
  Description of Artificial Sequence: Synthetic probe
ccccaccgtgtgctggcaacagtgtacaacgggaagacaacgtacggggaacaa

SEQ ID NO: 4175 - DNA, 54 bp, Artificial Sequence
  Description of Artificial Sequence: Synthetic probe
ggggcgagggtcgccgcgcagcttcctgcttcctttaacataggtgcaattcaa

SEQ ID NO: 4176 - DNA, 60 bp, Artificial Sequence
  Description of Artificial Sequence: Synthetic probe
ctacggcaggatttacacagaagctgaggttgacgtgtacgtcaggatgaagcgcgcaga

SEQ ID NO: 4177 - DNA, 60 bp, Artificial Sequence
  Description of Artificial Sequence: Synthetic probe
acactgcgccgcaccgcgtgttggcgacggtgtacaatgggacgagcaagtactcgacaa

SEQ ID NO: 4178 - DNA, 60 bp, Artificial Sequence
  Description of Artificial Sequence: Synthetic probe
acgtacggggaaacaacctcacggcgtggtgatatggcggcccttgcacaaaggctgagt

SEQ ID NO: 4179 - DNA, 60 bp, Artificial Sequence
  Description of Artificial Sequence: Synthetic probe
cccacctctttcaactacggcgctgtaaaggctgaagccatcactgagctcttgatccgc

SEQ ID NO: 4180 - DNA, 60 bp, Artificial Sequence
  Description of Artificial Sequence: Synthetic probe
accgtgtgctggcaacagtgtacaacgggacgagcaagtactcaacgggtgcctcaccca

SEQ ID NO: 4181 - DNA, 60 bp, Artificial Sequence
  Description of Artificial Sequence: Synthetic probe
gccacaccgtgtgctggcaacagtgtacaacgggacgagcaagtactcaacgggtgcctc

SEQ ID NO: 4182 - DNA, 60 bp, Artificial Sequence
  Description of Artificial Sequence: Synthetic probe
acaccggatccctccgacgtcctggtgtttgtcccgtacgatcaagaaccactcaacggg

SEQ ID NO: 4183 - DNA, 60 bp, Artificial Sequence
  Description of Artificial Sequence: Synthetic probe
tctactgccccagaccactgttggcggtggaggtgtcgtcacaagacagacacaaacaga

SEQ ID NO: 4184 - DNA, 59 bp, Artificial Sequence
  Description of Artificial Sequence: Synthetic probe
tcagacgccgcgctcatggtgctccaccgtgggaaccgcgtgagagacatcacgaaaca

SEQ ID NO: 4185 - DNA, 60 bp, Artificial Sequence
  Description of Artificial Sequence: Synthetic probe
atccaagccacgaccatccacgagctcctcgtgcgcatgaagcgtgctgagctctactgc

SEQ ID NO: 4186 - DNA, 60 bp, Artificial Sequence
  Description of Artificial Sequence: Synthetic probe
atggacacaactgactgttttatcgctttgctgcacgccaccagagagatcaaaacactg

SEQ ID NO: 4187 - DNA, 60 bp, Artificial Sequence
  Description of Artificial Sequence: Synthetic probe
gctgcctacatccttcaactacggtgccatcaaggctacccgagtgactgaactgctcta

SEQ ID NO: 4188 - DNA, 60 bp, Artificial Sequence
  Description of Artificial Sequence: Synthetic probe
acccacgacattcaacttcggtcgattgttgtgtgactcgggtgacgtgtactaccggat

SEQ ID NO: 4189 - DNA, 60 bp, Artificial Sequence
  Description of Artificial Sequence: Synthetic probe
gctgcgcaacaggagtgttcgggacggcttacctcgtgcctcgtcatcttttcgcagaga

SEQ ID NO: 4190 - DNA, 57 bp, Artificial Sequence
  Description of Artificial Sequence: Synthetic probe
gcattgcctcgcgacccagcgaggtgtgtatggttgacggtacggacatgtgcctgg

SEQ ID NO: 4191 - DNA, 60 bp, Artificial Sequence
  Description of Artificial Sequence: Synthetic probe
tacaggatgaagcgtgctgaactgtactgccccaggccacttctcccggcttacgaccac

SEQ ID NO: 4192 - DNA, 60 bp, Artificial Sequence
  Description of Artificial Sequence: Synthetic probe
aacggtgattgtaagtacaaacccgctggcacaaccccgcgcacgaacatccgcggggat

SEQ ID NO: 4193 - DNA, 60 bp, Artificial Sequence
  Description of Artificial Sequence: Synthetic probe
gagtccgcagaccctgtcaccaccaccgtggagaactacggcggtgagacacaagtgcag

SEQ ID NO: 4194 - DNA, 60 bp, Artificial Sequence
  Description of Artificial Sequence: Synthetic probe
gcagttaaagcagaaacaattacagaattgctcgtgcgcatgaagcgtgctgaactctac

SEQ ID NO: 4195 - DNA, 60 bp, Artificial Sequence
  Description of Artificial Sequence: Synthetic probe
ctacaccgctccccaccgtgtgctggcaacagtgtacaacgggaagacgacgtatgggga

SEQ ID NO: 4196 - DNA, 60 bp, Artificial Sequence
  Description of Artificial Sequence: Synthetic probe
aaacaactccacggcgtggtgatatggcggcccttgcacaaagactgatggggcagctgc

SEQ ID NO: 4197 - DNA, 60 bp, Artificial Sequence
  Description of Artificial Sequence: Synthetic probe
agtgttggcacggaaggcggcgagaacgctgcccacctccttcaactacggtgctatcaa

SEQ ID NO: 4198 - DNA, 60 bp, Artificial Sequence
  Description of Artificial Sequence: Synthetic probe
acaagtgttggcccggaaggcggcgagaacgctgcccacctccttcaactacggtgctat

SEQ ID NO: 4199 - DNA, 60 bp, Artificial Sequence
  Description of Artificial Sequence: Synthetic probe
acaagtgttggcacggaaggcggcgagaacgctgcccacctccttcaactacggtgctat

SEQ ID NO: 4200 - DNA, 60 bp, Artificial Sequence
  Description of Artificial Sequence: Synthetic probe
aactacggcaggatctacacagaggcggaagtcgatgtgtacgtgagaatgaagcgggcg

SEQ ID NO: 4201 - DNA, 60 bp, Artificial Sequence
  Description of Artificial Sequence: Synthetic probe
ctgcctacctccttcaactacggtgccatcaaggctacccgggtgacagaactgctttat

SEQ ID NO: 4202 - DNA, 60 bp, Artificial Sequence
  Description of Artificial Sequence: Synthetic probe
cagattcttgatctcatgcagatcccctcacacacgctggttggagcactgcttcggtct

SEQ ID NO: 4203 - DNA, 60 bp, Artificial Sequence
  Description of Artificial Sequence: Synthetic probe
acggtgccattaaggctacttgggtgactgaactgctttaccgcatgaagagggccgaaa

SEQ ID NO: 4204 - DNA, 60 bp, Artificial Sequence
  Description of Artificial Sequence: Synthetic probe
ggctgcgaaggctgacaccatcacggagctgttgatccgtatgaagcgtgcggagacata

SEQ ID NO: 4205 - DNA, 60 bp, Artificial Sequence
  Description of Artificial Sequence: Synthetic probe
cccacctccttcaactacggcgctgtaaaggctgacaccattactgagcttctgatccgc

SEQ ID NO: 4206 - DNA, 60 bp, Artificial Sequence
  Description of Artificial Sequence: Synthetic probe
ccaaccactttcaactatggcaggatttacacagaagctgaggttgacgtgtacgttagg

SEQ ID NO: 4207 - DNA, 60 bp, Artificial Sequence
  Description of Artificial Sequence: Synthetic probe
cactccattaccgatgtcactttcctcaaaagacacttccacatggactatggaactggg

SEQ ID NO: 4208 - DNA, 60 bp, Artificial Sequence
  Description of Artificial Sequence: Synthetic probe
ttcgagattccaagctacagatcactttacctgcgttgggtgaacgccgtgtgcggcgac

SEQ ID NO: 4209 - DNA, 60 bp, Artificial Sequence
  Description of Artificial Sequence: Synthetic probe
ctttgagattccgagctacagatcactttacctgcgttgggtgaacgccgtgtgcggtga

SEQ ID NO: 4210 - DNA, 60 bp, Artificial Sequence
  Description of Artificial Sequence: Synthetic probe
cctctttgagattccaagctacagatcactttacctgcgttgggtgaacgccgtgtgcgg

SEQ ID NO: 4211 - DNA, 60 bp, Artificial Sequence
  Description of Artificial Sequence: Synthetic probe
cccatgtcattgacctcatgcaaacccaccaacacggcttagtgggtgcgttgctgcgtg

SEQ ID NO: 4212 - DNA, 60 bp, Artificial Sequence
  Description of Artificial Sequence: Synthetic probe
agtaggtgcccttcttagggcgtccacctactacttctgtgacctggaaatcgcatgtgt

SEQ ID NO: 4213 - DNA, 53 bp, Artificial Sequence
  Description of Artificial Sequence: Synthetic probe
ccactcaggaccgccgtaaacaggagatcattgcacctgagaaacaggtgctg

SEQ ID NO: 4214 - DNA, 54 bp, Artificial Sequence
  Description of Artificial Sequence: Synthetic probe
cacgcggggatttggctcacctaacggcgacgcatgctcggcacttgccgacat

SEQ ID NO: 4215 - DNA, 60 bp, Artificial Sequence
  Description of Artificial Sequence: Synthetic probe
aacggagaatggaaagcaaaggttcaaaaacgactcaagggagccggacaatctagcccg

SEQ ID NO: 4216 - DNA, 60 bp, Artificial Sequence
  Description of Artificial Sequence: Synthetic probe
cgctcccttacaccgcgccgcaccgagtgttggcaacagtgtacaacggagtaagcaagt

SEQ ID NO: 4217 - DNA, 60 bp, Artificial Sequence
  Description of Artificial Sequence: Synthetic probe
cccgttttgcgctgccctacaccgcgccacacagatgcttggcaacatcttacaacggtg

SEQ ID NO: 4218 - DNA, 60 bp, Artificial Sequence
  Description of Artificial Sequence: Synthetic probe
cactgcgccacaccgcgtgttggcaacagtgtacaacgggacgaacaagtactccgcgga

SEQ ID NO: 4219 - DNA, 60 bp, Artificial Sequence
  Description of Artificial Sequence: Synthetic probe
ttggtgggtgccctgttacgcgctgccacgtactacttctccgacctggagattgtggtg

SEQ ID NO: 4220 - DNA, 60 bp, Artificial Sequence
  Description of Artificial Sequence: Synthetic probe
ccgtggacgcctgacccatcggacgtcttggtatttgtcccgtacgatcaagaaccactc

SEQ ID NO: 4221 - DNA, 60 bp, Artificial Sequence
  Description of Artificial Sequence: Synthetic probe
cggcggctgcccacctccttcaactacggcgctgtaaaggctgaaaccatcactgagctt

SEQ ID NO: 4222 - DNA, 60 bp, Artificial Sequence
  Description of Artificial Sequence: Synthetic probe
ctgaccctgttaccactaccgttgagaactacggaggcgagacgcaagtccaacgtcgcc

SEQ ID NO: 4223 - DNA, 60 bp, Artificial Sequence
  Description of Artificial Sequence: Synthetic probe
ccactggtgaatctgccgaccctgttaccactaccgttgagaactacggaggggagacgc

SEQ ID NO: 4224 - DNA, 60 bp, Artificial Sequence
  Description of Artificial Sequence: Synthetic probe
actacgaccactggtgaatctgccgaccctgttaccactaccgttgagaactacggaggg

SEQ ID NO: 4225 - DNA, 60 bp, Artificial Sequence
  Description of Artificial Sequence: Synthetic probe
actacgaccactggtgaatctgccgaccctgttaccactaccgttgagaactacggagga

SEQ ID NO: 4226 - DNA, 60 bp, Artificial Sequence
  Description of Artificial Sequence: Synthetic probe
ctcgtgcgcatgaaacgtgctgagctttactgccccaggccactgctggcagtggaggtg

SEQ ID NO: 4227 - DNA, 60 bp, Artificial Sequence
  Description of Artificial Sequence: Synthetic probe
gctgtgctaccggagtgttcagcactgcctacctcgtgcctcgtcatcttttcgcagaga

SEQ ID NO: 4228 - DNA, 60 bp, Artificial Sequence
  Description of Artificial Sequence: Synthetic probe
gaagagggcggagctctactgtccaagacctctcctccctggttatgaccacgcaaacag

SEQ ID NO: 4229 - DNA, 60 bp, Artificial Sequence
  Description of Artificial Sequence: Synthetic probe
ggatgaagagggcggagctctactgtccaagacctctcctccctggctacgaccacgcag

SEQ ID NO: 4230 - DNA, 60 bp, Artificial Sequence
  Description of Artificial Sequence: Synthetic probe
caccactgtagagaactacggcggtgagacacaagtccagagacgccaccacaccgacgt

SEQ ID NO: 4231 - DNA, 60 bp, Artificial Sequence
  Description of Artificial Sequence: Synthetic probe
gcaccacccgctttgcgctgccctacaccgcgccacacagatgcctggcgacatcttaca

SEQ ID NO: 4232 - DNA, 60 bp, Artificial Sequence
  Description of Artificial Sequence: Synthetic probe
cggcaccacccgctttgcgctgccctacaccgcgccacacagatgcctggcgacatctta

SEQ ID NO: 4233 - DNA, 60 bp, Artificial Sequence
  Description of Artificial Sequence: Synthetic probe
gggcagctgcccacctctttcaactacggcgctgtaaaggctgacaccatcactgagcct

SEQ ID NO: 4234 - DNA, 52 bp, Artificial Sequence
  Description of Artificial Sequence: Synthetic probe
agctcctcgtgcgtatgaagcgggccgaactctactgccctaggccactcct

SEQ ID NO: 4235 - DNA, 60 bp, Artificial Sequence
  Description of Artificial Sequence: Synthetic probe
gactatagagtgtttgagtttgagattaaagtaaaaggacaggacatgctctcagacgcc

SEQ ID NO: 4236 - DNA, 60 bp, Artificial Sequence
  Description of Artificial Sequence: Synthetic probe
gcggtgaaggtctcgtcgcaagacagacacaaacagaagatcattgcaccagcaaaacag

SEQ ID NO: 4237 - DNA, 60 bp, Artificial Sequence
  Description of Artificial Sequence: Synthetic probe
tacgtgaggatgaaacgggcggagctttactgcccccgcccactgctcaccacgtatgag

SEQ ID NO: 4238 - DNA, 60 bp, Artificial Sequence
  Description of Artificial Sequence: Synthetic probe
cggagctttattgtccccgcccggtgctgactcactatgaccaccaaggtaaggaccgct

SEQ ID NO: 4239 - DNA, 60 bp, Artificial Sequence
  Description of Artificial Sequence: Synthetic probe
tcggtgaccaacgtgagaggtgacctacaagtgttggcccagaaggcggcgagagcgctg

SEQ ID NO: 4240 - DNA, 60 bp, Artificial Sequence
  Description of Artificial Sequence: Synthetic probe
ctgtgaccaatgtgagaggtgacctacaagtgttggcccagaaggcggcgagaccgctgc

SEQ ID NO: 4241 - DNA, 60 bp, Artificial Sequence
  Description of Artificial Sequence: Synthetic probe
agacacacattccaaccactttcaactacggcaggatttacacagaggctgaggtcgacg

SEQ ID NO: 4242 - DNA, 60 bp, Artificial Sequence
  Description of Artificial Sequence: Synthetic probe
taaaggctgacaccatcactgagcttttgatccgcatgaaacgcgcggagacatactgcc

SEQ ID NO: 4243 - DNA, 60 bp, Artificial Sequence
  Description of Artificial Sequence: Synthetic probe
gcgagacacacattccaaccaccttcaactacggtaggctctacacacaagccgaagtcg

SEQ ID NO: 4244 - DNA, 60 bp, Artificial Sequence
  Description of Artificial Sequence: Synthetic probe
tgcgcatgaagcgtgccgagctctactgccccaggccactgctggcagtagaggtgtcat

SEQ ID NO: 4245 - DNA, 60 bp, Artificial Sequence
  Description of Artificial Sequence: Synthetic probe
gagcggctgcccacctccttcaactacggcgctgtaaaggctgacaccatcactgagctc

SEQ ID NO: 4246 - DNA, 60 bp, Artificial Sequence
  Description of Artificial Sequence: Synthetic probe
tcaactatggaatcattctgactgaagcagaagtggacgtctacgtgcgcatgaagcggg

SEQ ID NO: 4247 - DNA, 60 bp, Artificial Sequence
  Description of Artificial Sequence: Synthetic probe
aggacaggacatgctctcagacgccgcactcatggtgcttcaccgtgggaatcgcgtgcg

SEQ ID NO: 4248 - DNA, 60 bp, Artificial Sequence
  Description of Artificial Sequence: Synthetic probe
aaaggctgacaccatcacggagctgttgatccgcatgaaacgcgcggagacatactgccc

SEQ ID NO: 4249 - DNA, 60 bp, Artificial Sequence
  Description of Artificial Sequence: Synthetic probe
tgagaactacggtggtgagacacaggcccagcgacgtcaccacactgatgtcggcttcat

SEQ ID NO: 4250 - DNA, 57 bp, Artificial Sequence
  Description of Artificial Sequence: Synthetic probe
tacgatcaagaaccacttaacggagaatggaaggcaaaggttcaaaagcgactcaag

SEQ ID NO: 4251 - DNA, 60 bp, Artificial Sequence
  Description of Artificial Sequence: Synthetic probe
tacgatcaagaaccacttaacggagaatggaaggcaaaggttcaaaagcgactcaaggga

SEQ ID NO: 4252 - DNA, 60 bp, Artificial Sequence
  Description of Artificial Sequence: Synthetic probe
gctggcattttcctgaaaggacaagagcatgctgtgttcgcctgtgtcacctccaacggg

SEQ ID NO: 4253 - DNA, 60 bp, Artificial Sequence
  Description of Artificial Sequence: Synthetic probe
acgctggcattttcctgaaaggacaagagcatgctgtgttcgcctgtgtcacctccaacg

SEQ ID NO: 4254 - DNA, 60 bp, Artificial Sequence
  Description of Artificial Sequence: Synthetic probe
acttccacgctggcattttcctgaaaggacaagagcatgctgtgttcgcctgtgtcacct

SEQ ID NO: 4255 - DNA, 60 bp, Artificial Sequence
  Description of Artificial Sequence: Synthetic probe
tccacaacgggatcggcactgcctcgcgccccagcgaggtgtgtatggtggacggaacgg

SEQ ID NO: 4256 - DNA, 60 bp, Artificial Sequence
  Description of Artificial Sequence: Synthetic probe
acaactggctgttttatcgctctgttacacgctatcagagagatcaggacactgtttcta

SEQ ID NO: 4257 - DNA, 60 bp, Artificial Sequence
  Description of Artificial Sequence: Synthetic probe
ggacacagcgggctgttttatcgctctgttacacgctatcagagagatcaggacactgtt

SEQ ID NO: 4258 - DNA, 60 bp, Artificial Sequence
  Description of Artificial Sequence: Synthetic probe
ggacacaactggctgttttatcgctctgttacacgctatcagagagatcaggacactgtt

SEQ ID NO: 4259 - DNA, 60 bp, Artificial Sequence
  Description of Artificial Sequence: Synthetic probe
atggacacaactggctgttttatcgctctgttacacgctatcagagagatcaggacactg

SEQ ID NO: 4260 - DNA, 60 bp, Artificial Sequence
  Description of Artificial Sequence: Synthetic probe
atgaatacaactggctgttttatcgctctgttacacgctatcagagagatcaggacactg

SEQ ID NO: 4261 - DNA, 60 bp, Artificial Sequence
  Description of Artificial Sequence: Synthetic probe
atggacacagcgggctgttttatcgctctgttacacgctatcagagagatcaggacactg

SEQ ID NO: 4262 - DNA, 60 bp, Artificial Sequence
  Description of Artificial Sequence: Synthetic probe
cccacctccttcaactacggtgctgtgaaggctgacaccatcacggagctgttgatccgc

SEQ ID NO: 4263 - DNA, 60 bp, Artificial Sequence
  Description of Artificial Sequence: Synthetic probe
ggcggcccttgcacaaaggctgagtgggcagctgcccacctcttttaactacggcgctgt

SEQ ID NO: 4264 - DNA, 60 bp, Artificial Sequence
  Description of Artificial Sequence: Synthetic probe
gatgaagcgcgcagaactctactgcccgcgccctctcttgacacactacgaccacaatgg

SEQ ID NO: 4265 - DNA, 60 bp, Artificial Sequence
  Description of Artificial Sequence: Synthetic probe
atccgagccacgaccatccacgagcttctcgtgcgcatgaagcgtgctgagctctactgt

SEQ ID NO: 4266 - DNA, 60 bp, Artificial Sequence
  Description of Artificial Sequence: Synthetic probe
gcgccacaccgcgtgttggcaacagtgtacaacgggaccagcaagtactccgctcccggt

SEQ ID NO: 4267 - DNA, 60 bp, Artificial Sequence
  Description of Artificial Sequence: Synthetic probe
tgctcgtgcgcatgaagcgtgccgaactctactgccccagaccactgttggcggtggagg

SEQ ID NO: 4268 - DNA, 60 bp, Artificial Sequence
  Description of Artificial Sequence: Synthetic probe
tcttgtgcgcatgaagcgtgccgaactctactgccccagaccactgttggcggtggaggt

SEQ ID NO: 4269 - DNA, 60 bp, Artificial Sequence
  Description of Artificial Sequence: Synthetic probe
tctttcaactacggcgctgtaaaggctgacaccatcactgagcttttgatccgcatgaaa

SEQ ID NO: 4270 - DNA, 60 bp, Artificial Sequence
  Description of Artificial Sequence: Synthetic probe
ggacggctgcccacctccttcaactacggcgctgtaaaggctgaaaccatcactgagctt

SEQ ID NO: 4271 - DNA, 60 bp, Artificial Sequence
  Description of Artificial Sequence: Synthetic probe
ggcgctcccctacaccgctccccaccgtgtgctggcaacagtgtacaacgggaagacaac

SEQ ID NO: 4272 - DNA, 60 bp, Artificial Sequence
  Description of Artificial Sequence: Synthetic probe
actcccacacatgtcatagacctcatgcaaactcaccaacacgggctggtgggtgcgctg

SEQ ID NO: 4273 - DNA, 60 bp, Artificial Sequence
  Description of Artificial Sequence: Synthetic probe
acagttctactcccacacatgtcatagacctcatgcaaactcaccaacacgggctggtag

SEQ ID NO: 4274 - DNA, 60 bp, Artificial Sequence
  Description of Artificial Sequence: Synthetic probe
acatactacttctcagacctggaggttgcgcttgtccacacgggcccagccacctgggtg

SEQ ID NO: 4275 - DNA, 60 bp, Artificial Sequence
  Description of Artificial Sequence: Synthetic probe
cgcggccacgtactacttctctgacctagagattgtggtgcgacacacaggcaacctgac

SEQ ID NO: 4276 - DNA, 60 bp, Artificial Sequence
  Description of Artificial Sequence: Synthetic probe
gcccagaaggcagcaagagcgctgcccacctccttcaactacggtgccattaaggctact

SEQ ID NO: 4277 - DNA, 60 bp, Artificial Sequence
  Description of Artificial Sequence: Synthetic probe
ggctgacaccatcactgagcttttgatccgcatgaaacgtgcggagacatactgccctag

SEQ ID NO: 4278 - DNA, 60 bp, Artificial Sequence
  Description of Artificial Sequence: Synthetic probe
gagacacaggtccagcggcgtcaccacactgatgtcggcttcataatggacagatttgtg

SEQ ID NO: 4279 - DNA, 60 bp, Artificial Sequence
  Description of Artificial Sequence: Synthetic probe
atcacccgcctggcgctcccttacacggccccccaccgtgtgctggcgacagtgtacaac

SEQ ID NO: 4280 - DNA, 60 bp, Artificial Sequence
  Description of Artificial Sequence: Synthetic probe
tcacgttcgctgtgccctacgtctctgccagtgacttctcctacacccacacagacacgc

SEQ ID NO: 4281 - DNA, 60 bp, Artificial Sequence
  Description of Artificial Sequence: Synthetic probe
ggtgcaattcaggccactaccatccacgagcttctcgtgcgcatgaaacgtgccgaactc

SEQ ID NO: 4282 - DNA, 60 bp, Artificial Sequence
  Description of Artificial Sequence: Synthetic probe
ctgacaccatcactgagcttttgatccgcatgaaacgcgcggagacatactgccccaggc

SEQ ID NO: 4283 - DNA, 60 bp, Artificial Sequence
  Description of Artificial Sequence: Synthetic probe
acgtactacttctcagacctggaggttgcgcttgttcacacaggcccggtcacctgggtg

SEQ ID NO: 4284 - DNA, 60 bp, Artificial Sequence
  Description of Artificial Sequence: Synthetic probe
aacggggcaccgcggaccacccaacttggtgataatcccatggttttcgccaagggcggt

SEQ ID NO: 4285 - DNA, 60 bp, Artificial Sequence
  Description of Artificial Sequence: Synthetic probe
gacctcatgcaaattccctcacacacgctggttggagcactgcttcggtctgcgacgtac

SEQ ID NO: 4286 - DNA, 60 bp, Artificial Sequence
  Description of Artificial Sequence: Synthetic probe
acccgcttggcgctcccatacaccgctccccaccgtgtgctggcaacagtgtacaacggg

SEQ ID NO: 4287 - DNA, 60 bp, Artificial Sequence
  Description of Artificial Sequence: Synthetic probe
cggtgccatcaaagccacttgggtgactgaactgctttaccgcatgaagagggccgaaac

SEQ ID NO: 4288 - DNA, 60 bp, Artificial Sequence
  Description of Artificial Sequence: Synthetic probe
tttggaacatcaaacacttgctcaacaccggaatcggcactgcttcgcgacccagcgagg

SEQ ID NO: 4289 - DNA, 60 bp, Artificial Sequence
  Description of Artificial Sequence: Synthetic probe
ccagcacgaggctgcaattgagttctttgaggggatggtgcacgactccatcaaggaaga

SEQ ID NO: 4290 - DNA, 54 bp, Artificial Sequence
  Description of Artificial Sequence: Synthetic probe
agcggatgccctccgactgacttgcaaaagatggtcatggcaaacgtgaagccc

SEQ ID NO: 4291 - DNA, 60 bp, Artificial Sequence
  Description of Artificial Sequence: Synthetic probe
aatcggcaccgcctcgcgacccagcgaggtgtgtatggttgatggtacggacatgtgctt

SEQ ID NO: 4292 - DNA, 60 bp, Artificial Sequence
  Description of Artificial Sequence: Synthetic probe
tgacctacaaagacctggtcgtttgtatggacggtgacaccatgcctggactcttcgcat

SEQ ID NO: 4293 - DNA, 60 bp, Artificial Sequence
  Description of Artificial Sequence: Synthetic probe
aaccactttaaggtgacactgatactggtactcaaccactggcgacaggctccggatgcc

SEQ ID NO: 4294 - DNA, 60 bp, Artificial Sequence
  Description of Artificial Sequence: Synthetic probe
caactttactgtgaaaaccactttaaggtgacactgatactggtactcaaccactggcga

SEQ ID NO: 4295 - DNA, 60 bp, Artificial Sequence
  Description of Artificial Sequence: Synthetic probe
ggtctagaggggtgacattttgtactgtgcttgactccacgctcggtccacttgcgggtg

SEQ ID NO: 4296 - DNA, 60 bp, Artificial Sequence
  Description of Artificial Sequence: Synthetic probe
gcgtacgggacggagaccccaaggcgcggtgatcttgcgaccgttgcacaaagggtgaac

SEQ ID NO: 4297 - DNA, 60 bp, Artificial Sequence
  Description of Artificial Sequence: Synthetic probe
tacaacgggaagacggcgtacgggacggagaccccaaggcgcggtgatcttgcggccatt

SEQ ID NO: 4298 - DNA, 60 bp, Artificial Sequence
  Description of Artificial Sequence: Synthetic probe
tacaacgggaagacggcgtacgggacggagaccccaaggcgcggtgatcttgcgaccgtt

SEQ ID NO: 4299 - DNA, 60 bp, Artificial Sequence
  Description of Artificial Sequence: Synthetic probe
catccgagggctggtacgccattgatgacgaggtgttctacccatggactcctgaccctg

SEQ ID NO: 4300 - DNA, 60 bp, Artificial Sequence
  Description of Artificial Sequence: Synthetic probe
cagatgacaagactcttgacgaggcggaaaagaaccctcaggagacaaacagtgccagca

SEQ ID NO: 4301 - DNA, 60 bp, Artificial Sequence
  Description of Artificial Sequence: Synthetic probe
acggtgccatcaaagctacccgggtgactgaactgctttaccgcatgaagagggccgaaa

SEQ ID NO: 4302 - DNA, 60 bp, Artificial Sequence
  Description of Artificial Sequence: Synthetic probe
caacgtggacatcatggacaccaaggaaaagaccctagtaggtgccctccttcgggcgtc

SEQ ID NO: 4303 - DNA, 60 bp, Artificial Sequence
  Description of Artificial Sequence: Synthetic probe
tgcttgtgtcacctccaacgggtggtacgcgattgatgacgaagacttttacccctggac

SEQ ID NO: 4304 - DNA, 60 bp, Artificial Sequence
  Description of Artificial Sequence: Synthetic probe
tgtttgcctgtgtcacctccaacgggtggtacgcgattgatgacgaagacttctacccct

SEQ ID NO: 4305 - DNA, 60 bp, Artificial Sequence
  Description of Artificial Sequence: Synthetic probe
taacaactactacatgcaacagtaccaaaactccatggacacccaacctggcgacaacgc

SEQ ID NO: 4306 - DNA, 60 bp, Artificial Sequence
  Description of Artificial Sequence: Synthetic probe
cgaggttgacgtgtacgtcaggatgaagcgcgcggaactctactgtccgaggcctatcct

SEQ ID NO: 4307 - DNA, 60 bp, Artificial Sequence
  Description of Artificial Sequence: Synthetic probe
acacaagccgaggttgacgtgtacgtcaggatgaagcgcgcggaactctactgtccgagg

SEQ ID NO: 4308 - DNA, 60 bp, Artificial Sequence
  Description of Artificial Sequence: Synthetic probe
tacttctcagacctggagattgtggtgcgccacgaaggcaacctgacgtgggtgcccaac

SEQ ID NO: 4309 - DNA, 60 bp, Artificial Sequence
  Description of Artificial Sequence: Synthetic probe
taccacaaagcaccgttcacgaggcttgcacttccctacaccgcaccacaccgcgtgttg

SEQ ID NO: 4310 - DNA, 60 bp, Artificial Sequence
  Description of Artificial Sequence: Synthetic probe
gtctaccacaaagcaccatttacgagacttgcacttccctacaccgcaccacaccgcgtg

SEQ ID NO: 4311 - DNA, 60 bp, Artificial Sequence
  Description of Artificial Sequence: Synthetic probe
ctacagttgttcaggtacgtcgatgaaccattcttcgactgggtttacaactcgcccgag

SEQ ID NO: 4312 - DNA, 60 bp, Artificial Sequence
  Description of Artificial Sequence: Synthetic probe
ggtgcaattagagccacgaccatccacgagcttctcgtgcgcatgaagcgggccgagctc

SEQ ID NO: 4313 - DNA, 60 bp, Artificial Sequence
  Description of Artificial Sequence: Synthetic probe
cggtgcaattagagccacgaccatccacgagcttctcgtgcgcatgaagcgggccgagct

SEQ ID NO: 4314 - DNA, 60 bp, Artificial Sequence
  Description of Artificial Sequence: Synthetic probe
gcggaactttactgcccgcgtcctctcctgacacactacgaccacaatggcaaggatcgc

SEQ ID NO: 4315 - DNA, 60 bp, Artificial Sequence
  Description of Artificial Sequence: Synthetic probe
tgaaacgcgcggaactttactgcccgcgtcctctcctgacacactacgaccacaatggca

SEQ ID NO: 4316 - DNA, 60 bp, Artificial Sequence
  Description of Artificial Sequence: Synthetic probe
gtcctcgcacagaggatcgccagcgagacacacattccaaccacttttaactacggcagg

SEQ ID NO: 4317 - DNA, 60 bp, Artificial Sequence
  Description of Artificial Sequence: Synthetic probe
gcagtcctcgcacagaggatcgccagcgagacacacattccaaccacttttaactacggc

SEQ ID NO: 4318 - DNA, 60 bp, Artificial Sequence
  Description of Artificial Sequence: Synthetic probe
tgtgtgattcaggtgacgtctactaccggatgaagcgtactgagctttactgcccacgac

SEQ ID NO: 4319 - DNA, 60 bp, Artificial Sequence
  Description of Artificial Sequence: Synthetic probe
gattgttgtgtgattcaggtgacgtctactaccggatgaaacgcactgagctgtactgcc

SEQ ID NO: 4320 - DNA, 60 bp, Artificial Sequence
  Description of Artificial Sequence: Synthetic probe
caggtccaaaggcggcaccacacggatgtcggcttcataatggacagatttgtgaaagtg

SEQ ID NO: 4321 - DNA, 54 bp, Artificial Sequence
  Description of Artificial Sequence: Synthetic probe
tcgtctcaggacagacacaaacacaagatcattgcacctgcaaaacaactcctg

SEQ ID NO: 4322 - DNA, 60 bp, Artificial Sequence
  Description of Artificial Sequence: Synthetic probe
accaccactgtcggggagtctgcagaccccgtcactaccactgttgaaaactacggcggt

SEQ ID NO: 4323 - DNA, 60 bp, Artificial Sequence
  Description of Artificial Sequence: Synthetic probe
gaccgccgaccagccagtcgacgtttactacaggatgaagcgggcagagttgtactgtcc

SEQ ID NO: 4324 - DNA, 60 bp, Artificial Sequence
  Description of Artificial Sequence: Synthetic probe
ggagacaacccgatggttttctcgaacaaaggtgtcaccaggttcgctgtgccatacact

SEQ ID NO: 4325 - DNA, 60 bp, Artificial Sequence
  Description of Artificial Sequence: Synthetic probe
ccttcacacacactggttggagcgctgcttcggtctgcgacgtactacttctcagacctg

SEQ ID NO: 4326 - DNA, 60 bp, Artificial Sequence
  Description of Artificial Sequence: Synthetic probe
aggcggcaaaacgctgcccacctccttcaactacggtgccatcaaggccacccgggtgac

SEQ ID NO: 4327 - DNA, 60 bp, Artificial Sequence
  Description of Artificial Sequence: Synthetic probe
ggccactgctggcggtggaggtgacgtcgcaagacagacacaaacagaggatcattgcac

SEQ ID NO: 4328 - DNA, 60 bp, Artificial Sequence
  Description of Artificial Sequence: Synthetic probe
agcttcccgcttctttcaacttcggtgcgattcgagccactgtcatccacgagctcctcg

SEQ ID NO: 4329 - DNA, 60 bp, Artificial Sequence
  Description of Artificial Sequence: Synthetic probe
agcttcccgcttctttcaacttcggtgcgattcgagccactgtgatccacgagctcctcg

SEQ ID NO: 4330 - DNA, 60 bp, Artificial Sequence
  Description of Artificial Sequence: Synthetic probe
ccgcaaaacagcttcccgcttctttcaacttcggtgcgattcgagccactgtgatccacg

SEQ ID NO: 4331 - DNA, 60 bp, Artificial Sequence
  Description of Artificial Sequence: Synthetic probe
tcgcaaaacagcttcccgcttctttcaacttcggtgcgattcgagccactgtcatccacg

SEQ ID NO: 4332 - DNA, 60 bp, Artificial Sequence
  Description of Artificial Sequence: Synthetic probe
ctggcgacagtgtacaacgggacaacccagtactccacaggtaatgcaggcagacggggt

SEQ ID NO: 4333 - DNA, 60 bp, Artificial Sequence
  Description of Artificial Sequence: Synthetic probe
gcgccacaccgcgtgctggcgacagtgtacaacgggacaaccaagtactccacaggtaat

SEQ ID NO: 4334 - DNA, 60 bp, Artificial Sequence
  Description of Artificial Sequence: Synthetic probe
gcgccacaccgcgtgctggcgacagtgtacaacgggacaacccagtactccacaggtaat

SEQ ID NO: 4335 - DNA, 60 bp, Artificial Sequence
  Description of Artificial Sequence: Synthetic probe
ataccacaaggggcctttcacgaggctcgcactcccctacaccgcgccacaccgcgtgct

SEQ ID NO: 4336 - DNA, 60 bp, Artificial Sequence
  Description of Artificial Sequence: Synthetic probe
ccactgcataccacaaggggcctttcacgaggctcgcactcccctacaccgcgccacacc

SEQ ID NO: 4337 - DNA, 60 bp, Artificial Sequence
  Description of Artificial Sequence: Synthetic probe
gagcagctgagacagcccttcacaacacgagcaaccccactgcataccacaaggggcctt

SEQ ID NO: 4338 - DNA, 60 bp, Artificial Sequence
  Description of Artificial Sequence: Synthetic probe
ctgggtacccaatggagcagctgagacagcccttcacaacacgagcaaccccactgcata

SEQ ID NO: 4339 - DNA, 60 bp, Artificial Sequence
  Description of Artificial Sequence: Synthetic probe
ttggagattgtggtgcgtcacgatgacaacttgacctgggtacccaatggagcacctgag

SEQ ID NO: 4340 - DNA, 60 bp, Artificial Sequence
  Description of Artificial Sequence: Synthetic probe
ttggagattgtggtgcgtcacgatgacaacttgacctgggtacccaatggagcagctgag

SEQ ID NO: 4341 - DNA, 51 bp, Artificial Sequence
  Description of Artificial Sequence: Synthetic probe
gggtgaccgagctgctttaccgcatgaagagggctgagacatactgtcccc

SEQ ID NO: 4342 - DNA, 60 bp, Artificial Sequence
  Description of Artificial Sequence: Synthetic probe
tgaagcgtgctgagctctactgccccaggccactgctggcagtagaggtgtcatcacaag

SEQ ID NO: 4343 - DNA, 60 bp, Artificial Sequence
  Description of Artificial Sequence: Synthetic probe
tgacctccgacggttggtacgccattgacgacgaggacttctacccatggactccggacc

SEQ ID NO: 4344 - DNA, 60 bp, Artificial Sequence
  Description of Artificial Sequence: Synthetic probe
tgcctgacctccgacggttggtacgccattgacgacgaggacttctacccatggactccg

SEQ ID NO: 4345 - DNA, 60 bp, Artificial Sequence
  Description of Artificial Sequence: Synthetic probe
ctctaacgggtggtacgcgattgatgacgaggacttttacccttggacgccggatccgtc

SEQ ID NO: 4346 - DNA, 60 bp, Artificial Sequence
  Description of Artificial Sequence: Synthetic probe
cccctgctggcaatccacccaactgacgccagacacaaacggaaaattgtggcaccggtg

SEQ ID NO: 4347 - DNA, 60 bp, Artificial Sequence
  Description of Artificial Sequence: Synthetic probe
cccaggcccctgctggcaatccacccaactgacgccagacacaaacggaaaattgtggca

SEQ ID NO: 4348 - DNA, 60 bp, Artificial Sequence
  Description of Artificial Sequence: Synthetic probe
ggcggcacggatgctgcctgcttacttcaactacggtgccatcaaagcaactcgggtcac

SEQ ID NO: 4349 - DNA, 60 bp, Artificial Sequence
  Description of Artificial Sequence: Synthetic probe
cccaacggcttactacaagaaaccgctcactcgacttgccctgccctacacggcaccgta

SEQ ID NO: 4350 - DNA, 60 bp, Artificial Sequence
  Description of Artificial Sequence: Synthetic probe
cacgagggagacctcacttgggttccgaacggggcgcctgtaaaggcgttgggaaacacc

SEQ ID NO: 4351 - DNA, 60 bp, Artificial Sequence
  Description of Artificial Sequence: Synthetic probe
tcatcatggacagatttgtgaaagtgacaccgcaaagctcaatcaacactttggacctca

SEQ ID NO: 4352 - DNA, 60 bp, Artificial Sequence
  Description of Artificial Sequence: Synthetic probe
tatgggcgaatcagcggatcccgtcaccgccactgttgagaactacggcggcgatacaca

SEQ ID NO: 4353 - DNA, 60 bp, Artificial Sequence
  Description of Artificial Sequence: Synthetic probe
ctttactagctcttgacaccactcaggaccgccgtaaacaggagattatagcacctgaaa

SEQ ID NO: 4354 - DNA, 53 bp, Artificial Sequence
  Description of Artificial Sequence: Synthetic probe
ctgccccacacaggtgcttggcaacactgtacaacggtgattgtaagtacaaa

SEQ ID NO: 4355 - DNA, 60 bp, Artificial Sequence
  Description of Artificial Sequence: Synthetic probe
gaccctgtcaccaccaccgtggagaactacggcggtgagacacaaacccagagacggcac

SEQ ID NO: 4356 - DNA, 60 bp, Artificial Sequence
  Description of Artificial Sequence: Synthetic probe
gggtggtatgcgattgatgacgaggacttttacccttggacgccggatccgtccgacgtt

SEQ ID NO: 4357 - DNA, 60 bp, Artificial Sequence
  Description of Artificial Sequence: Synthetic probe
ccctgaaaacgtactcgcgtacgtgccctacgaccaggaacccctggacgtagactggca

SEQ ID NO: 4358 - DNA, 57 bp, Artificial Sequence
  Description of Artificial Sequence: Synthetic probe
aacaggtgaccggaggccggcacctttctctacaaccactgatattatgaatacaac

SEQ ID NO: 4359 - DNA, 60 bp, Artificial Sequence
  Description of Artificial Sequence: Synthetic probe
ttctacgcctgaacaggtgaccggaggccggcacctttctctacaaccactgatattatg

SEQ ID NO: 4360 - DNA, 60 bp, Artificial Sequence
  Description of Artificial Sequence: Synthetic probe
gatctgagaaggggactgaggcttctttaaaagcgctcggtttaaaaagcttctacgcct

SEQ ID NO: 4361 - DNA, 60 bp, Artificial Sequence
  Description of Artificial Sequence: Synthetic probe
gacttgcgcttccctacactgcgccgcaccgcgtgttggcaacagtgtacaacgggacga

SEQ ID NO: 4362 - DNA, 60 bp, Artificial Sequence
  Description of Artificial Sequence: Synthetic probe
aacggcataccacaaggcaccgctcacccggcttgcactgccatacacagcaccacaccg

SEQ ID NO: 4363 - DNA, 60 bp, Artificial Sequence
  Description of Artificial Sequence: Synthetic probe
atgaggtgttttacccatggacacctgaccctgagaacgtactcgcgtacgtgccctacg

SEQ ID NO: 4364 - DNA, 60 bp, Artificial Sequence
  Description of Artificial Sequence: Synthetic probe
cgcgcagccacatactacttctctgacttggaaattgcagtgacccacaccggaaagctc

SEQ ID NO: 4365 - DNA, 60 bp, Artificial Sequence
  Description of Artificial Sequence: Synthetic probe
ctccttcgcgcagccacatactacttctctgacttggaaattgcagtgacccacaccgga

SEQ ID NO: 4366 - DNA, 60 bp, Artificial Sequence
  Description of Artificial Sequence: Synthetic probe
gtctgcgacgtactacttctcagacctggaggttgcgcttgtacacacgggcccagccac

SEQ ID NO: 4367 - DNA, 50 bp, Artificial Sequence
  Description of Artificial Sequence: Synthetic probe
cacaagaccgacacaaacagaagattattgcacctgcaaaacagcttctg

SEQ ID NO: 4368 - DNA, 60 bp, Artificial Sequence
  Description of Artificial Sequence: Synthetic probe
tcgtcatcttttcgcagagaagtatgacaagatcatgctggacggccgcgccctgacaga

SEQ ID NO: 4369 - DNA, 60 bp, Artificial Sequence
  Description of Artificial Sequence: Synthetic probe
gctccggtctgcgacgtactacttctcagacctggaggttgcgcttgttcacacaggccc

SEQ ID NO: 4370 - DNA, 60 bp, Artificial Sequence
  Description of Artificial Sequence: Synthetic probe
ccaacacgaagcagcaattgaattctttgaggggatggtgcacgactccatcaaggagga

SEQ ID NO: 4371 - DNA, 56 bp, Artificial Sequence
  Description of Artificial Sequence: Synthetic probe
ccaacacgaagcagcaattgaattctttgaggggatggtgcacgactccatcaagg

SEQ ID NO: 4372 - DNA, 60 bp, Artificial Sequence
  Description of Artificial Sequence: Synthetic probe
ctcgacaggtttgtgaaactcactgcacccaagaacacccagattcttgatctcatgcag

SEQ ID NO: 4373 - DNA, 60 bp, Artificial Sequence
  Description of Artificial Sequence: Synthetic probe
ttcctttaactacggtgcaatccaaggcacagccatccacgagctcctcgtgcgcatgaa

SEQ ID NO: 4374 - DNA, 60 bp, Artificial Sequence
  Description of Artificial Sequence: Synthetic probe
cgacgccctcgatgagtacattgagaaggcgaacatcaccactgacgacaaaacgcttga

SEQ ID NO: 4375 - DNA, 60 bp, Artificial Sequence
  Description of Artificial Sequence: Synthetic probe
gatggttgacgacgccctcgatgagtacattgagaaggcgaacatcaccactgacgacaa

SEQ ID NO: 4376 - DNA, 60 bp, Artificial Sequence
  Description of Artificial Sequence: Synthetic probe
tcaaggaagagctcaagcccttgttggagcaaaccagcttcgccaagcgtgctttcaagc

SEQ ID NO: 4377 - DNA, 60 bp, Artificial Sequence
  Description of Artificial Sequence: Synthetic probe
gacagcgagacggcttcacactgacgttgccttcgttcttgacaggtttgtgaaactcac

SEQ ID NO: 4378 - DNA, 60 bp, Artificial Sequence
  Description of Artificial Sequence: Synthetic probe
agcggatgcccaccgaccgacttgcaaaagatggtcatggcaaacgtgaagcccgtcgag

SEQ ID NO: 4379 - DNA, 60 bp, Artificial Sequence
  Description of Artificial Sequence: Synthetic probe
ccgggccactaccatccatgagcttctcgtgcgcatgaagcgtgccgagctctactgccc

SEQ ID NO: 4380 - DNA, 60 bp, Artificial Sequence
  Description of Artificial Sequence: Synthetic probe
gggcaactgcccacctccttcaactacggcgctgtaaaggctgacaccattactgagctt

SEQ ID NO: 4381 - DNA, 60 bp, Artificial Sequence
  Description of Artificial Sequence: Synthetic probe
taactatggcaggatctacacgcaggcggaagtcgacgtgtacgtgaggatgaagcgagc

SEQ ID NO: 4382 - DNA, 60 bp, Artificial Sequence
  Description of Artificial Sequence: Synthetic probe
ggatgaagcgtgcggaactttactgccccagaccactcctaccggcttatgaccattcag

SEQ ID NO: 4383 - DNA, 60 bp, Artificial Sequence
  Description of Artificial Sequence: Synthetic probe
agtgtacaacggtgactgcaagtacaaacccactggcaccgcgccccgcgaaaacatccg

SEQ ID NO: 4384 - DNA, 60 bp, Artificial Sequence
  Description of Artificial Sequence: Synthetic probe
tgtcttctccgctaatggcaccacccgttttgcactgccctacaccgcaccgcacagatg

SEQ ID NO: 4385 - DNA, 60 bp, Artificial Sequence
  Description of Artificial Sequence: Synthetic probe
tactgccccaggccactgctggcagtggaggtgtcgtcgcaagacagacacaaacaaaag

SEQ ID NO: 4386 - DNA, 60 bp, Artificial Sequence
  Description of Artificial Sequence: Synthetic probe
ctttgcgctgccctacaccgctccacacaggtgcttggcaacaagctacaacggtgactg

SEQ ID NO: 4387 - DNA, 51 bp, Artificial Sequence
  Description of Artificial Sequence: Synthetic probe
tgtacaacccgtcccggaacgactgtcacggcaggtactccaacctgttgg

SEQ ID NO: 4388 - DNA, 60 bp, Artificial Sequence
  Description of Artificial Sequence: Synthetic probe
aaccctaccgcctacaacaaagcgccgttcacgaggcttgcactcccctacactgcgcca

SEQ ID NO: 4389 - DNA, 60 bp, Artificial Sequence
  Description of Artificial Sequence: Synthetic probe
aaccctaccgcctacaacaaagcgccgttcacgaggcttgcgttcccctacaccgcgcca

SEQ ID NO: 4390 - DNA, 60 bp, Artificial Sequence
  Description of Artificial Sequence: Synthetic probe
acgtgtacgtgaggatgaagcgggcggagctctactgcccgcgcccgttgctcaccaggt

SEQ ID NO: 4391 - DNA, 60 bp, Artificial Sequence
  Description of Artificial Sequence: Synthetic probe
cacaagctgaggtcgacgtgtatgttaggatgaagcgcgcagaactctactgcccgcgcc

SEQ ID NO: 4392 - DNA, 60 bp, Artificial Sequence
  Description of Artificial Sequence: Synthetic probe
gagtcggcggaccccgtcaccaccactgtagagaactacggcggtgagacacaagtccac

SEQ ID NO: 4393 - DNA, 60 bp, Artificial Sequence
  Description of Artificial Sequence: Synthetic probe
tggcaccagcactcgccccagcgagatctgtgtgatcaacggggtcaccatgaccctggc

SEQ ID NO: 4394 - DNA, 60 bp, Artificial Sequence
  Description of Artificial Sequence: Synthetic probe
gggtgcgcgatctcacgggacacttccgtgacaccatgaaactgtcgaaaggcagtccca

SEQ ID NO: 4395 - DNA, 60 bp, Artificial Sequence
  Description of Artificial Sequence: Synthetic probe
tggtaggatctacactgaggcggaagccgacgtgtacgtgaggatgaaacgggcggagct

SEQ ID NO: 4396 - DNA, 60 bp, Artificial Sequence
  Description of Artificial Sequence: Synthetic probe
caatttcggagcaatacgggctacgaacatccacgagcttctcgtgcgcatgaagcgtgc

SEQ ID NO: 4397 - DNA, 60 bp, Artificial Sequence
  Description of Artificial Sequence: Synthetic probe
cgtgctgccacgtactacttctctgacctggagattgtggtgcgccacacagacaaccta

SEQ ID NO: 4398 - DNA, 60 bp, Artificial Sequence
  Description of Artificial Sequence: Synthetic probe
gagtgtttgagtttgaggtgaaagtaaagggacaggacatgctctcagatgccgcgctaa

SEQ ID NO: 4399 - DNA, 60 bp, Artificial Sequence
  Description of Artificial Sequence: Synthetic probe
gaaggggcagacgtggtgaccgtcgacaccgctgcacacggtggtaaccagagacgtaca

SEQ ID NO: 4400 - DNA, 50 bp, Artificial Sequence
  Description of Artificial Sequence: Synthetic probe
cacacaggtgcctggcaacatcgtacaacggtgactgcaagtacaagccc

SEQ ID NO: 4401 - DNA, 60 bp, Artificial Sequence
  Description of Artificial Sequence: Synthetic probe
cctccttcaactacggcgctgtaaaggctgacaccatcactgagctgttgatccgcatga

SEQ ID NO: 4402 - DNA, 60 bp, Artificial Sequence
  Description of Artificial Sequence: Synthetic probe
gagtctgcagacccagtcaccgccactgttgagaactacggtggtgagacacaggtccag

SEQ ID NO: 4403 - DNA, 50 bp, Artificial Sequence
  Description of Artificial Sequence: Synthetic probe
tgcgcatgaagcgtgccgagctctactgccccaggccactgctggcagta

SEQ ID NO: 4404 - DNA, 55 bp, Artificial Sequence
  Description of Artificial Sequence: Synthetic probe
cactgcgccacaccgcgtgctggcaacagtgtacaacgggacgaacaagtactcc

SEQ ID NO: 4405 - DNA, 60 bp, Artificial Sequence
  Description of Artificial Sequence: Synthetic probe
gcatgaaacgtgctgaactctactgccccaggccactgctggcggtggaggtgtcgtcac

SEQ ID NO: 4406 - DNA, 60 bp, Artificial Sequence
  Description of Artificial Sequence: Synthetic probe
cctgcctctttcaactacggtgcaattaaggcccagaacatacacgagcttctcgtgcgc

SEQ ID NO: 4407 - DNA, 60 bp, Artificial Sequence
  Description of Artificial Sequence: Synthetic probe
aaggcactccctgcctctttcaactacggtgcaattaaggcccagaacatacacgagctt

SEQ ID NO: 4408 - DNA, 60 bp, Artificial Sequence
  Description of Artificial Sequence: Synthetic probe
ctttgctttgccttacactgccccacacaggtgtcttgccaccgcctacaacggcgactg

SEQ ID NO: 4409 - DNA, 60 bp, Artificial Sequence
  Description of Artificial Sequence: Synthetic probe
ccgatttgcactgccatacactgctccacacaggtgtcttgccaccgcctacaacggcga

SEQ ID NO: 4410 - DNA, 60 bp, Artificial Sequence
  Description of Artificial Sequence: Synthetic probe
cgcacactttgccgtcaaccttcaacttcgggtttgtaaccgtcgacagcccagtcgatg

SEQ ID NO: 4411 - DNA, 60 bp, Artificial Sequence
  Description of Artificial Sequence: Synthetic probe
cgtggtgaccgtgctgtcctggcagcaaagtactccaacatcaagcacacgcttccgtcc

SEQ ID NO: 4412 - DNA, 60 bp, Artificial Sequence
  Description of Artificial Sequence: Synthetic probe
atccgtggtgaccgtgctgtcctggcagcaaagtactccaacatcaagcacacgcttccg

SEQ ID NO: 4413 - DNA, 59 bp, Artificial Sequence
  Description of Artificial Sequence: Synthetic probe
attgtctcaacactggcgttggcaccagcactcgccccagcgagatctgtgtgatcaac

SEQ ID NO: 4414 - DNA, 60 bp, Artificial Sequence
  Description of Artificial Sequence: Synthetic probe
accaccgccaccggggaatcagcagaccctgtcacaaccaccgtcgagaactacggtggt

SEQ ID NO: 4415 - DNA, 60 bp, Artificial Sequence
  Description of Artificial Sequence: Synthetic probe
tacctgaggatgaagagagcggaactctactgccctcggcccctcctcacgcactacgac

SEQ ID NO: 4416 - DNA, 60 bp, Artificial Sequence
  Description of Artificial Sequence: Synthetic probe
taccgcgcagggaccaaagttggatactgcggagctgctgttctcgcgaaggacggcgcc

SEQ ID NO: 4417 - DNA, 60 bp, Artificial Sequence
  Description of Artificial Sequence: Synthetic probe
acgtgtacctgaggatgaagagagcggaactctactgccctcggcccctcctcacgcact

SEQ ID NO: 4418 - DNA, 60 bp, Artificial Sequence
  Description of Artificial Sequence: Synthetic probe
agtccagtgttgggcgaggtgggcgacaacccagtcgtcttctcacacaacaacaccacc

SEQ ID NO: 4419 - DNA, 59 bp, Artificial Sequence
  Description of Artificial Sequence: Synthetic probe
ggggaatctgcagaccctgtcacaaccactgttgagaactacggtggtgagacacaggt

SEQ ID NO: 4420 - DNA, 60 bp, Artificial Sequence
  Description of Artificial Sequence: Synthetic probe
ccggggagtctgcagacccagttaccaccactgttgagaactacggtggtgagacacagg

SEQ ID NO: 4421 - DNA, 60 bp, Artificial Sequence
  Description of Artificial Sequence: Synthetic probe
ggggacaacccgatggttttctccaacaacggtgttaccaggtttgccgtgccgtacacc

SEQ ID NO: 4422 - DNA, 60 bp, Artificial Sequence
  Description of Artificial Sequence: Synthetic probe
gcctcggaccacccagcttggggacaacccgatggttttctccaacaacggtgtcaccag

SEQ ID NO: 4423 - DNA, 60 bp, Artificial Sequence
  Description of Artificial Sequence: Synthetic probe
ttggcactcccctacaccgccccccaccgtgtgctggcaacagtgtacaacgggaagaca

SEQ ID NO: 4424 - DNA, 58 bp, Artificial Sequence
  Description of Artificial Sequence: Synthetic probe
tggcaacccaacggagcgccgcggacaacccagcttcgcgacaaccccatggtgttct

SEQ ID NO: 4425 - DNA, 60 bp, Artificial Sequence
  Description of Artificial Sequence: Synthetic probe
ccctacactgcaccacaccgcgtgttggcaacagtgtacaacgggacgagcaagtactcg

SEQ ID NO: 4426 - DNA, 60 bp, Artificial Sequence
  Description of Artificial Sequence: Synthetic probe
tcagcagaccctgtcaccaccactgtagagaactacggcggtgagacacaagttcagaga

SEQ ID NO: 4427 - DNA, 60 bp, Artificial Sequence
  Description of Artificial Sequence: Synthetic probe
ggccgatgccatccacgagcttctcgtgcgcatgaagcgtgccgaactctactgccccag

SEQ ID NO: 4428 - DNA, 60 bp, Artificial Sequence
  Description of Artificial Sequence: Synthetic probe
tacaacgggaagacaacgtacggggaaacaacctcacgccgtggtgacacggcggcccta

SEQ ID NO: 4429 - DNA, 60 bp, Artificial Sequence
  Description of Artificial Sequence: Synthetic probe
ccggaatcggcaccgcctcgcgacccagcgaggtgtgtatggttgatggtacggacatgt

SEQ ID NO: 4430 - DNA, 60 bp, Artificial Sequence
  Description of Artificial Sequence: Synthetic probe
cttctctgacctagagattgtggtgcgccacacaggcaacctgacatgggtgcccaatgg

SEQ ID NO: 4431 - DNA, 60 bp, Artificial Sequence
  Description of Artificial Sequence: Synthetic probe
cctgttaccactaccgtcgagaactacggaggagagacgcaagtccaacgtcgccaccac

SEQ ID NO: 4432 - DNA, 60 bp, Artificial Sequence
  Description of Artificial Sequence: Synthetic probe
atgaccacggagaccgggacaggttcgacgcccccattggcgttgaaaaacaattgtgca

SEQ ID NO: 4433 - DNA, 51 bp, Artificial Sequence
  Description of Artificial Sequence: Synthetic probe
caaatacgccaacacacgccacgcgcttccttccaccttcaactttgggca

SEQ ID NO: 4434 - DNA, 60 bp, Artificial Sequence
  Description of Artificial Sequence: Synthetic probe
tcgcctccgtccgtggtgatcgcgccgtgctggcggccaaatacgccaacacacgccacg

SEQ ID NO: 4435 - DNA, 60 bp, Artificial Sequence
  Description of Artificial Sequence: Synthetic probe
tacaacacgcgcgtcgcctccgtccgtggtgatcgcgccgtgctggcggccaaatacgcc

SEQ ID NO: 4436 - DNA, 60 bp, Artificial Sequence
  Description of Artificial Sequence: Synthetic probe
aggtgacctacaggtgttggcccagaaggcggcgagagcgctgcctacctccttcaacta

SEQ ID NO: 4437 - DNA, 60 bp, Artificial Sequence
  Description of Artificial Sequence: Synthetic probe
ccaacataagaggtgacctacaggtgttggcccagaaggcggcgagagcgctgcctacct

SEQ ID NO: 4438 - DNA, 60 bp, Artificial Sequence
  Description of Artificial Sequence: Synthetic probe
cggcgctgttaaggctgacaccatcactgagcttttgatccgcatgaaacgcgcggagac

SEQ ID NO: 4439 - DNA, 60 bp, Artificial Sequence
  Description of Artificial Sequence: Synthetic probe
ctgcgacgtactacttctcagacctggaggttgcgcttgttcacacaggcccggtcacct

SEQ ID NO: 4440 - DNA, 60 bp, Artificial Sequence
  Description of Artificial Sequence: Synthetic probe
gtctgcgacatactacttctcagacctggaggttgcgcttgtccacacgggcccagccac

SEQ ID NO: 4441 - DNA, 60 bp, Artificial Sequence
  Description of Artificial Sequence: Synthetic probe
accaccgccaccggggaatcagcagaccctgtcaccaccaccgttgagaactacggtggc

SEQ ID NO: 4442 - DNA, 60 bp, Artificial Sequence
  Description of Artificial Sequence: Synthetic probe
cgctcccgtccactttcaatttcgggtacgtgaccgccgacgcaccagtcgacgtttact

SEQ ID NO: 4443 - DNA, 60 bp, Artificial Sequence
  Description of Artificial Sequence: Synthetic probe
atgaacacaactgactgttttatcgctctgttacacgctctcagagagattaaaacactg

SEQ ID NO: 4444 - DNA, 60 bp, Artificial Sequence
  Description of Artificial Sequence: Synthetic probe
ctcgtttcgcactgccctacactgccccacacaggtgcttggcaacactgtacaacggtg

SEQ ID NO: 4445 - DNA, 54 bp, Artificial Sequence
  Description of Artificial Sequence: Synthetic probe
caactctcgcggcgaggattgcaagtgagacacacattccaactactttcaact

SEQ ID NO: 4446 - DNA, 60 bp, Artificial Sequence
  Description of Artificial Sequence: Synthetic probe
cacaggcccagcgacgtcaccacactgacgtcagcttcataatggacaggttcgtgaagg

SEQ ID NO: 4447 - DNA, 60 bp, Artificial Sequence
  Description of Artificial Sequence: Synthetic probe
ggcggcaagaacgctgcctacctccttcaactacggtgccatcaaagccactctggtgac

SEQ ID NO: 4448 - DNA, 60 bp, Artificial Sequence
  Description of Artificial Sequence: Synthetic probe
ggagcactgcttcggtctgcgacgtactacttctcagacctggaggttgcgcttgtccac

SEQ ID NO: 4449 - DNA, 60 bp, Artificial Sequence
  Description of Artificial Sequence: Synthetic probe
agcggtgcgccaccgaccgacttgcaaaagatggtcatggccaacgtcaagcccgttgag

SEQ ID NO: 4450 - DNA, 60 bp, Artificial Sequence
  Description of Artificial Sequence: Synthetic probe
ccacaagatgcatacccacgacattcaacttcgggagattgttgtgtgattcaggtgacg

SEQ ID NO: 4451 - DNA, 60 bp, Artificial Sequence
  Description of Artificial Sequence: Synthetic probe
actgacgttgccttcgttcttgaccggtttgtgaaggtccaagtgtcgggtaaccagcac

SEQ ID NO: 4452 - DNA, 60 bp, Artificial Sequence
  Description of Artificial Sequence: Synthetic probe
gaagctgaggtcgacgtgtacgttaggatgaagcgcgcagagctttactgcccgcgcccc

SEQ ID NO: 4453 - DNA, 60 bp, Artificial Sequence
  Description of Artificial Sequence: Synthetic probe
tctccgctaacggcaccacccgttttgcactgccttacactgcgccacacaggtgtctag

SEQ ID NO: 4454 - DNA, 60 bp, Artificial Sequence
  Description of Artificial Sequence: Synthetic probe
gttggacggtcgagccctgacagacagtgacttcagagtgtttgagtttgaggtgaaagt

SEQ ID NO: 4455 - DNA, 60 bp, Artificial Sequence
  Description of Artificial Sequence: Synthetic probe
cggcatttgccgacatcgttcaactttggtgcagttaaagcagaaacaatcactgagttg

SEQ ID NO: 4456 - DNA, 60 bp, Artificial Sequence
  Description of Artificial Sequence: Synthetic probe
ggaggagagacgcaaatccaacgtcgtcaccacactgacgttgccttcgttcttgaccgg

SEQ ID NO: 4457 - DNA, 60 bp, Artificial Sequence
  Description of Artificial Sequence: Synthetic probe
ggtatgtcgacgagccgttcttcgactgggtctacaactcacccgagaacctcacgctcc

SEQ ID NO: 4458 - DNA, 60 bp, Artificial Sequence
  Description of Artificial Sequence: Synthetic probe
ggaccgcccgctctcgtcatctggaacatcaaacacttgctcaacaccgggatcggcact

SEQ ID NO: 4459 - DNA, 60 bp, Artificial Sequence
  Description of Artificial Sequence: Synthetic probe
cggtgcagtgaaggctgaaaccatcactgagctgttgatccgcatgaagcgcgcggagac

SEQ ID NO: 4460 - DNA, 60 bp, Artificial Sequence
  Description of Artificial Sequence: Synthetic probe
tacaccgctccccaccgtgtgctggcaacagtgtacaacggggagacaacgtacggggaa

SEQ ID NO: 4461 - DNA, 60 bp, Artificial Sequence
  Description of Artificial Sequence: Synthetic probe
tacgtactacttctccgacttggagattgtggtgagacacgagggcaacttgacgtgggt

SEQ ID NO: 4462 - DNA, 60 bp, Artificial Sequence
  Description of Artificial Sequence: Synthetic probe
agagtgggcagctgcccacctctttcaactacggcgctgtgaaggctgacaccattaccg

SEQ ID NO: 4463 - DNA, 60 bp, Artificial Sequence
  Description of Artificial Sequence: Synthetic probe
tacacggaggcggaagtcgacgtgtatgtgaggatgaaacgggcggagctttattgcccc

SEQ ID NO: 4464 - DNA, 60 bp, Artificial Sequence
  Description of Artificial Sequence: Synthetic probe
cccttctcgccatccaaccgagtgccgccagacacaaacagaagattgtggcacccgcaa

SEQ ID NO: 4465 - DNA, 60 bp, Artificial Sequence
  Description of Artificial Sequence: Synthetic probe
cccaggccccttctcgccatccaaccgagtgccgccagacacaaacagaagattgtggca

SEQ ID NO: 4466 - DNA, 58 bp, Artificial Sequence
  Description of Artificial Sequence: Synthetic probe
cttctcgtgcgcatgaaacgggccgagctctactgccccagaccattgttggcaatat

SEQ ID NO: 4467 - DNA, 60 bp, Artificial Sequence
  Description of Artificial Sequence: Synthetic probe
acggtgctgtaaaggctgacaccatcactgagcttttgatccgcatgaaacgcgcggaga

SEQ ID NO: 4468 - DNA, 60 bp, Artificial Sequence
  Description of Artificial Sequence: Synthetic probe
ggttagcgccggtaaggactttgagttgcgcctcccaattgacccccggcaacaaactac

SEQ ID NO: 4469 - DNA, 60 bp, Artificial Sequence
  Description of Artificial Sequence: Synthetic probe
tgccgccacgtactacttctccgacttggagattgtggttcgtcacgacggcaacctgac

SEQ ID NO: 4470 - DNA, 60 bp, Artificial Sequence
  Description of Artificial Sequence: Synthetic probe
tgaaaataaacagcccaaaatccacccatgtcattgacctcatgcaaacccaccaacacg

SEQ ID NO: 4471 - DNA, 60 bp, Artificial Sequence
  Description of Artificial Sequence: Synthetic probe
gggcagctgcccacctctttcaactacggcgctgtaaaggctgacaccatcactgaactt

SEQ ID NO: 4472 - DNA, 60 bp, Artificial Sequence
  Description of Artificial Sequence: Synthetic probe
cggcggtgagacacaagttcagagacgccaccacaccgacgttggcttcatcatggacag

SEQ ID NO: 4473 - DNA, 60 bp, Artificial Sequence
  Description of Artificial Sequence: Synthetic probe
ggcggcccttgcacaaagactgagcgggcagctgcccacctctttcaactacggcgctgt

SEQ ID NO: 4474 - DNA, 60 bp, Artificial Sequence
  Description of Artificial Sequence: Synthetic probe
tacaccgctccccaccgtgtgctggcaacagtgtacaacgggaagacaacgtacgggaaa

SEQ ID NO: 4475 - DNA, 60 bp, Artificial Sequence
  Description of Artificial Sequence: Synthetic probe
cacacagatgcctggcgacatcttacaacggtgattgcaagtacaaacccactagcacac

SEQ ID NO: 4476 - DNA, 60 bp, Artificial Sequence
  Description of Artificial Sequence: Synthetic probe
accgcctacaacaaggcaccgttcacgagacttgccctcccctacaccgcgccacaccgc

SEQ ID NO: 4477 - DNA, 60 bp, Artificial Sequence
  Description of Artificial Sequence: Synthetic probe
gggatgatttacacacaggcagaagtggacgtttacctgaggatgaagagagcagaactc

SEQ ID NO: 4478 - DNA, 60 bp, Artificial Sequence
  Description of Artificial Sequence: Synthetic probe
attacgggatgatttacacacaggcagaagtggacgtttacctgaggatgaagagagcag

SEQ ID NO: 4479 - DNA, 60 bp, Artificial Sequence
  Description of Artificial Sequence: Synthetic probe
aactacgggatgatatacacacaggcagaagtggacgtttacctgaggatgaagagagca

SEQ ID NO: 4480 - DNA, 60 bp, Artificial Sequence
  Description of Artificial Sequence: Synthetic probe
tacggtggtgtgaaggctgacaccatcacggagctgttgatccgcatgaaccgtgcggaa

SEQ ID NO: 4481 - DNA, 60 bp, Artificial Sequence
  Description of Artificial Sequence: Synthetic probe
ccacgagcttctcgtgcgcatgaaacgggccgagctctactgtcccagaccgctgttggc

SEQ ID NO: 4482 - DNA, 60 bp, Artificial Sequence
  Description of Artificial Sequence: Synthetic probe
gcacggcggaagtgtagtggagaagagacggatgcacacagatgttgcgttcgtgcttga

SEQ ID NO: 4483 - DNA, 60 bp, Artificial Sequence
  Description of Artificial Sequence: Synthetic probe
cagctgacaaaagcgacaaaggttttgttcttggtcattccatcaccgatgtcactttcc

SEQ ID NO: 4484 - DNA, 60 bp, Artificial Sequence
  Description of Artificial Sequence: Synthetic probe
gtgtcttttgaggaaagtgacatcggtgatggagtgaccaagaacaaaacctttgtcgct

SEQ ID NO: 4485 - DNA, 60 bp, Artificial Sequence
  Description of Artificial Sequence: Synthetic probe
ctcctgaactttgacctgctcaagttggcgggagacgttgagtccaaccctgggcccttc

SEQ ID NO: 4486 - DNA, 60 bp, Artificial Sequence
  Description of Artificial Sequence: Synthetic probe
aaacacttgctgcacaccggaatcggcactgcctcgcgacccagcgaggtgtgcatggtt

SEQ ID NO: 4487 - DNA, 60 bp, Artificial Sequence
  Description of Artificial Sequence: Synthetic probe
atcaaacacctgctctacaccgggatcggcactgcctcgcgacccagcgaggtgtgcatg

SEQ ID NO: 4488 - DNA, 60 bp, Artificial Sequence
  Description of Artificial Sequence: Synthetic probe
ggtgccatcaaagcagagaccatcactgagctgttagtgcgcatgaaacgcgcggagctt

SEQ ID NO: 4489 - DNA, 60 bp, Artificial Sequence
  Description of Artificial Sequence: Synthetic probe
ggtgccatcaaagcagagaccatcactgagctgttagtgcggatgaaacgggcggagctt

SEQ ID NO: 4490 - DNA, 60 bp, Artificial Sequence
  Description of Artificial Sequence: Synthetic probe
ggtgccatcaaagcagagaccatcactgagctgttagtgcgcatgaaatgcgcggagctt

SEQ ID NO: 4491 - DNA, 60 bp, Artificial Sequence
  Description of Artificial Sequence: Synthetic probe
cgggagtgtttgggaccgcctacctcgtgcctcgtcatcttttcgctgagaagtatgaca

SEQ ID NO: 4492 - DNA, 60 bp, Artificial Sequence
  Description of Artificial Sequence: Synthetic probe
ccgcaagatgcattcccacgacattcaacttcgggagattgttgtgtgatggtggtgaag

SEQ ID NO: 4493 - DNA, 60 bp, Artificial Sequence
  Description of Artificial Sequence: Synthetic probe
ccacgccgtggcgacatggccgtgttgtcacaacgcgttgagaatgaaaccacaagatgc

SEQ ID NO: 4494 - DNA, 60 bp, Artificial Sequence
  Description of Artificial Sequence: Synthetic probe
ccacgccgtggtgacttggccgcactggcacaacgcgttgagaatgaaaccacaagatgc

SEQ ID NO: 4495 - DNA, 60 bp, Artificial Sequence
  Description of Artificial Sequence: Synthetic probe
cagttaaagcagaaacaatcactgagttgctcgtgcgcatgaagcgtgctgaactctatt

SEQ ID NO: 4496 - DNA, 60 bp, Artificial Sequence
  Description of Artificial Sequence: Synthetic probe
acggccctcgtcaaacctgccaaacaattgtgcaacttcgacctgctaaagttggccgga

SEQ ID NO: 4497 - DNA, 60 bp, Artificial Sequence
  Description of Artificial Sequence: Synthetic probe
ggcaggatatacactgaagccgaggttgacgtgtatgtgaggatgaaacgcgcggagctc

SEQ ID NO: 4498 - DNA, 60 bp, Artificial Sequence
  Description of Artificial Sequence: Synthetic probe
accactttcaattacggcaggatatacactgaagccgaggttgacgtgtacgtaaggatg

SEQ ID NO: 4499 - DNA, 60 bp, Artificial Sequence
  Description of Artificial Sequence: Synthetic probe
accacttttaactatggcaggatatacactgaagccgaggttgacgtgtatgtgaggatg

SEQ ID NO: 4500 - DNA, 60 bp, Artificial Sequence
  Description of Artificial Sequence: Synthetic probe
caaactcaccaacacgggctggtaggtgcgctgttgcgttcagccacctactatttctct

SEQ ID NO: 4501 - DNA, 60 bp, Artificial Sequence
  Description of Artificial Sequence: Synthetic probe
gtgtcggctctggagaacaccagcaaccccactgcctacaacaaggcaccattcacgaga

SEQ ID NO: 4502 - DNA, 60 bp, Artificial Sequence
  Description of Artificial Sequence: Synthetic probe
ttcggtagcccgcttcgcactgccctacaccgcaccacacggtgttttggcaactgtgta

SEQ ID NO: 4503 - DNA, 60 bp, Artificial Sequence
  Description of Artificial Sequence: Synthetic probe
ggttcggttgctcgctttgcactgccctacaccgcaccacacggtgttttggcaactgtc

SEQ ID NO: 4504 - DNA, 60 bp, Artificial Sequence
  Description of Artificial Sequence: Synthetic probe
cccaggacaaaagactgacgaggaagtgaacactgagccagtcaggccctcggaacaacc

SEQ ID NO: 4505 - DNA, 60 bp, Artificial Sequence
  Description of Artificial Sequence: Synthetic probe
ccgcgagagaaagctcccaggacaaaagactgacgaggaagtgaacactgagccagtcag

SEQ ID NO: 4506 - DNA, 60 bp, Artificial Sequence
  Description of Artificial Sequence: Synthetic probe
aacaaccctcacgaggtgtcgacaaacccactgtcgggcttccgcgagagaaagctccca

SEQ ID NO: 4507 - DNA, 60 bp, Artificial Sequence
  Description of Artificial Sequence: Synthetic probe
gaggcggaaaacaaccctcacgaggtgtcgacaaacccactgtcgggcttccgcgagaga

SEQ ID NO: 4508 - DNA, 60 bp, Artificial Sequence
  Description of Artificial Sequence: Synthetic probe
agccgcttctggagcaaaccagcttcgcgaaacgcgccttcaagcgcctcaaagagaact

SEQ ID NO: 4509 - DNA, 60 bp, Artificial Sequence
  Description of Artificial Sequence: Synthetic probe
tcaaagaggaacttaagccgcttctggagcaaaccagcttcgcgaaacgcgccttcaagc

SEQ ID NO: 4510 - DNA, 60 bp, Artificial Sequence
  Description of Artificial Sequence: Synthetic probe
cagcaattgaattttatgaaggaatggtacacgacagcatcaaagaggaacttaagccgc

SEQ ID NO: 4511 - DNA, 60 bp, Artificial Sequence
  Description of Artificial Sequence: Synthetic probe
acagcatgaagcagcaattgaattttatgaaggaatggtacacgacagcatcaaagagga

SEQ ID NO: 4512 - DNA, 60 bp, Artificial Sequence
  Description of Artificial Sequence: Synthetic probe
atttccattccatcccaaaagactgtgctttacttcctcattgagaagggacagcatgaa

SEQ ID NO: 4513 - DNA, 55 bp, Artificial Sequence
  Description of Artificial Sequence: Synthetic probe
atttccattccatcccaaaagactgtgctttacttcctcattgagaagggacagc

SEQ ID NO: 4514 - DNA, 60 bp, Artificial Sequence
  Description of Artificial Sequence: Synthetic probe
cctcgtgcctcgtcatcttttcgcagagaagtatgacaagatcatgctggacggccgcgc

SEQ ID NO: 4515 - DNA, 60 bp, Artificial Sequence
  Description of Artificial Sequence: Synthetic probe
acttttacccctggacgccggacccgtccgacgttttggtgtttgtcccgtacgatcaag

SEQ ID NO: 4516 - DNA, 60 bp, Artificial Sequence
  Description of Artificial Sequence: Synthetic probe
gacttttacccctggacgccggacccgtccgacgttttggtgtttgtcccgtacgatcaa

SEQ ID NO: 4517 - DNA, 60 bp, Artificial Sequence
  Description of Artificial Sequence: Synthetic probe
aaaacatccgcggcgacctcgcaaccttggctgcgcggattgctagtgagacccacatcc

SEQ ID NO: 4518 - DNA, 60 bp, Artificial Sequence
  Description of Artificial Sequence: Synthetic probe
tgcgacgtactacttctcagacctagaggttgcgcttgttcacacaggccccgttacctg

SEQ ID NO: 4519 - DNA, 60 bp, Artificial Sequence
  Description of Artificial Sequence: Synthetic probe
ggccacttctcccggcttatgaacacaatagccgagacagatttgacgcacccattggcg

SEQ ID NO: 4520 - DNA, 60 bp, Artificial Sequence
  Description of Artificial Sequence: Synthetic probe
cgacgcggtggtcgacgtgtactacagaatgaaacgtgcggaattgtactgccctaggcc

SEQ ID NO: 4521 - DNA, 60 bp, Artificial Sequence
  Description of Artificial Sequence: Synthetic probe
gccgacgcggtggtcgacgtgtactacagaatgaaacgtgcggaattgtactgccctagg

SEQ ID NO: 4522 - DNA, 60 bp, Artificial Sequence
  Description of Artificial Sequence: Synthetic probe
gctgtcaaccgtgtacaacggtgagtgtgggtacacacggaaagcacaagccatccgtgg

SEQ ID NO: 4523 - DNA, 60 bp, Artificial Sequence
  Description of Artificial Sequence: Synthetic probe
tggcagcctaacggcgcgccccggacaactgtgttgggagacaacccgatggttttctca

SEQ ID NO: 4524 - DNA, 60 bp, Artificial Sequence
  Description of Artificial Sequence: Synthetic probe
ctggtcgtgtcggttagcgccggtaaagactttgagttgcgcctcccggttgacccccgg

SEQ ID NO: 4525 - DNA, 60 bp, Artificial Sequence
  Description of Artificial Sequence: Synthetic probe
tcaactttggtgcaatccgagccacgaccatccacgagcttctcgtgcgcatgaagcgtg

SEQ ID NO: 4526 - DNA, 60 bp, Artificial Sequence
  Description of Artificial Sequence: Synthetic probe
tccagaccaaggagaaagcactggtgggcgcaatcctgcgcgctgccacgtactacttct

SEQ ID NO: 4527 - DNA, 60 bp, Artificial Sequence
  Description of Artificial Sequence: Synthetic probe
taccatccacgagcttctcgtgcgcatgaagcgtgccgaactctactgccccaggccact

SEQ ID NO: 4528 - DNA, 60 bp, Artificial Sequence
  Description of Artificial Sequence: Synthetic probe
gaggtgtcgtcacaagacagacacaaacagaagatcattgcaccagcaaaacagctcctg

SEQ ID NO: 4529 - DNA, 60 bp, Artificial Sequence
  Description of Artificial Sequence: Synthetic probe
ggcatttgccgacatcgttcaactttggtgcagttaaagcagaaacaatcactgagttgc

SEQ ID NO: 4530 - DNA, 60 bp, Artificial Sequence
  Description of Artificial Sequence: Synthetic probe
ccgcttagagtgaggtacacgcacacgactgacaggtacaagaccccactggtcggacct

SEQ ID NO: 4531 - DNA, 60 bp, Artificial Sequence
  Description of Artificial Sequence: Synthetic probe
ctttactgcccacgcccgcttagagtgaggtacacgcacacgactgacaggtacaagacc

SEQ ID NO: 4532 - DNA, 60 bp, Artificial Sequence
  Description of Artificial Sequence: Synthetic probe
acgggtgaggtgtactaccgcatgaagcgtgctgagctttactgcccacgcccgcttaga

SEQ ID NO: 4533 - DNA, 60 bp, Artificial Sequence
  Description of Artificial Sequence: Synthetic probe
cgtgactccacgccgaggtgacttggctgtgttgagtcgacgcgttgagaatgaaaccac

SEQ ID NO: 4534 - DNA, 60 bp, Artificial Sequence
  Description of Artificial Sequence: Synthetic probe
acccaacacgtgactccacgccgaggtgacttggctgtgttgagtcgacgcgttgagaat

SEQ ID NO: 4535 - DNA, 60 bp, Artificial Sequence
  Description of Artificial Sequence: Synthetic probe
ggcaaccgtctacaatggtaactgcaggtacaagaaaacccaacacgtgactccacgccg

SEQ ID NO: 4536 - DNA, 60 bp, Artificial Sequence
  Description of Artificial Sequence: Synthetic probe
cacacggtgttctggcaaccgtctacaatggtaactgcaggtacaagaaaacccaacacg

SEQ ID NO: 4537 - DNA, 60 bp, Artificial Sequence
  Description of Artificial Sequence: Synthetic probe
tcattcaaaaggttcggtcgcccgctttgcgctgccctacaccgcgccacacggtgttct

SEQ ID NO: 4538 - DNA, 60 bp, Artificial Sequence
  Description of Artificial Sequence: Synthetic probe
cgttcattcaaaaggttcggtcgcccgctttgcgctgccctacaccgcgccacacggtgt

SEQ ID NO: 4539 - DNA, 60 bp, Artificial Sequence
  Description of Artificial Sequence: Synthetic probe
tgcccgctcaccgacagagtggaggacaacccagtcgttcattcaaaaggttcggtcgcc

SEQ ID NO: 4540 - DNA, 60 bp, Artificial Sequence
  Description of Artificial Sequence: Synthetic probe
tgggtacctaatgggtgcccgctcaccgacagagtggaggacaacccagtcgttcattca

SEQ ID NO: 4541 - DNA, 60 bp, Artificial Sequence
  Description of Artificial Sequence: Synthetic probe
cccgtacaccgcaccacaccgcgtgctggcaacggtgtacaacgggacgaccaagtacgc

SEQ ID NO: 4542 - DNA, 60 bp, Artificial Sequence
  Description of Artificial Sequence: Synthetic probe
aaagcaccattcacgagacttgcacttccctacaccgcgccacaccgcgtgttggcaacg

SEQ ID NO: 4543 - DNA, 60 bp, Artificial Sequence
  Description of Artificial Sequence: Synthetic probe
ccgacgtcgttcaactttggtgcagttaaagcagaaacagtcactgagctgctggtgcgc

SEQ ID NO: 4544 - DNA, 60 bp, Artificial Sequence
  Description of Artificial Sequence: Synthetic probe
ggcggtggaggtgtcgtcgcaagacagacacaagcagaagatcattgcccctgcaaagca

SEQ ID NO: 4545 - DNA, 60 bp, Artificial Sequence
  Description of Artificial Sequence: Synthetic probe
tgttggcggtggaggtgtcgtcgcaagacagacacaagcagaagatcattgcccctgcaa

SEQ ID NO: 4546 - DNA, 60 bp, Artificial Sequence
  Description of Artificial Sequence: Synthetic probe
catcgttcaactttggtgcagttaaagcagaaacaattactgagctgctcgtgcgcatga

SEQ ID NO: 4547 - DNA, 56 bp, Artificial Sequence
  Description of Artificial Sequence: Synthetic probe
accaacacgggttggtgggtgccctgttacgtgctgccacgtactacttctccgat

SEQ ID NO: 4548 - DNA, 51 bp, Artificial Sequence
  Description of Artificial Sequence: Synthetic probe
ggggaatctgcagaccctgtcaccaccacggttgagaactacggaggtgac

SEQ ID NO: 4549 - DNA, 60 bp, Artificial Sequence
  Description of Artificial Sequence: Synthetic probe
gcttggcaacaacctacaacggtgattgtaagtacaaacccactggcacagctccacgcg

SEQ ID NO: 4550 - DNA, 60 bp, Artificial Sequence
  Description of Artificial Sequence: Synthetic probe
tgggtgccctgttacgtgcggccacgtactacttctccgacctggagattgtggtacacc

SEQ ID NO: 4551 - DNA, 60 bp, Artificial Sequence
  Description of Artificial Sequence: Synthetic probe
accaccgctactggggaatcagcagaccctgtcaccaccactgtagagaactacggcggt

SEQ ID NO: 4552 - DNA, 60 bp, Artificial Sequence
  Description of Artificial Sequence: Synthetic probe
ttgacgtgtacgtcaggatgaagcgtgcggaactctactgtccgcgacccatcctcacgc

SEQ ID NO: 4553 - DNA, 60 bp, Artificial Sequence
  Description of Artificial Sequence: Synthetic probe
aggctgaggttgacgtgtacgtcaggatgaagcgtgcggaactctactgtccgcgaccca

SEQ ID NO: 4554 - DNA, 60 bp, Artificial Sequence
  Description of Artificial Sequence: Synthetic probe
aagcgcgcggagctctactgtccgcgacctctcctgacacactacgaccacggtgggaaa

SEQ ID NO: 4555 - DNA, 60 bp, Artificial Sequence
  Description of Artificial Sequence: Synthetic probe
gacctcatgcaaatccctgcacacacgctggttggagcactgcttcggtctgcgacgtac

SEQ ID NO: 4556 - DNA, 60 bp, Artificial Sequence
  Description of Artificial Sequence: Synthetic probe
cccctacactgcgccacaccgcgtgttggcaacagtgtacaacgggacgaacaagtactc

SEQ ID NO: 4557 - DNA, 60 bp, Artificial Sequence
  Description of Artificial Sequence: Synthetic probe
tctactgccccaggccactgctggcggtggaggtgtcgtcgcaagacagacacaaacaaa

SEQ ID NO: 4558 - DNA, 60 bp, Artificial Sequence
  Description of Artificial Sequence: Synthetic probe
gtgggcagttgcccacctctttcaactacggcgctgtaaaggctgacaccatcactgagc

SEQ ID NO: 4559 - DNA, 60 bp, Artificial Sequence
  Description of Artificial Sequence: Synthetic probe
agagagagaacccttccggggcacaaggcgggtggtgacgtgaactcggagcccgccaaa

SEQ ID NO: 4560 - DNA, 60 bp, Artificial Sequence
  Description of Artificial Sequence: Synthetic probe
ggtttcagagagagaacccttccggggcacaaggcgggtggtgacgtgaactcggagccc

SEQ ID NO: 4561 - DNA, 60 bp, Artificial Sequence
  Description of Artificial Sequence: Synthetic probe
ttgacgaggcggaaaagaaccctcttgagactagcggtgccagcaccgtcggtttcagag

SEQ ID NO: 4562 - DNA, 59 bp, Artificial Sequence
  Description of Artificial Sequence: Synthetic probe
ttgacgaggcggaaaagaaccctcttgagactagcggtgccagcaccgtcggtttcaga

SEQ ID NO: 4563 - DNA, 60 bp, Artificial Sequence
  Description of Artificial Sequence: Synthetic probe
gctttcaagcgcctgaaggagaactttgagatcgttgccctatgtttgactcttctagca

SEQ ID NO: 4564 - DNA, 60 bp, Artificial Sequence
  Description of Artificial Sequence: Synthetic probe
ctccggccccttatccaacagacctcgtttgtaaaacgcgctttcaagcgcctgaaggag

SEQ ID NO: 4565 - DNA, 60 bp, Artificial Sequence
  Description of Artificial Sequence: Synthetic probe
tcaaggaggaactccggccccttatccaacagacctcgtttgtaaaacgcgctttcaagc

SEQ ID NO: 4566 - DNA, 52 bp, Artificial Sequence
  Description of Artificial Sequence: Synthetic probe
ccgcgtgaaaacatccgcggagacttcgcgaccctcgcggccaggatagcca

SEQ ID NO: 4567 - DNA, 60 bp, Artificial Sequence
  Description of Artificial Sequence: Synthetic probe
ggaggtctcgtcgcaagacagacacaaacagaagatcattgcaccagcaaaacagctcct

SEQ ID NO: 4568 - DNA, 60 bp, Artificial Sequence
  Description of Artificial Sequence: Synthetic probe
cactaccatccacgagcttctcgtgcgcatgaagcgtgccgaactctactgccccagacc

SEQ ID NO: 4569 - DNA, 60 bp, Artificial Sequence
  Description of Artificial Sequence: Synthetic probe
tgcgcatgaagcgtgccgaactctactgccccagaccattgttggcggtgaaggtctcgt

SEQ ID NO: 4570 - DNA, 60 bp, Artificial Sequence
  Description of Artificial Sequence: Synthetic probe
cccttacactgcgccacaccgcgtgttggcaacagtgtacaatgggactagcaagtattc

SEQ ID NO: 4571 - DNA, 60 bp, Artificial Sequence
  Description of Artificial Sequence: Synthetic probe
actaccgcaacgggggaatctgcagaccctgtcaccaccactgtggaaaactacggcggt

SEQ ID NO: 4572 - DNA, 60 bp, Artificial Sequence
  Description of Artificial Sequence: Synthetic probe
tggactcccaacggagctccagagcttgcggaagtgggcgacaacccagtcgtcttttcc

SEQ ID NO: 4573 - DNA, 60 bp, Artificial Sequence
  Description of Artificial Sequence: Synthetic probe
ctcacacaacaacgtcacccggtttgccgtgccatacaccgcaccacaccgtttgttgtc

SEQ ID NO: 4574 - DNA, 60 bp, Artificial Sequence
  Description of Artificial Sequence: Synthetic probe
ggttttctcgcacaacggggtcacccgttttgccgtgccatacaccgcaccacaccgttt

SEQ ID NO: 4575 - DNA, 60 bp, Artificial Sequence
  Description of Artificial Sequence: Synthetic probe
ctttgagattgttgccctatgtttgactcttctggcaaacatagtgatcatgatccgcga

SEQ ID NO: 4576 - DNA, 60 bp, Artificial Sequence
  Description of Artificial Sequence: Synthetic probe
ctcttgacaccactcaggaccgccgtaaacaggagatcattgcacctgagaagcaggaac

SEQ ID NO: 4577 - DNA, 60 bp, Artificial Sequence
  Description of Artificial Sequence: Synthetic probe
accactgcaacgggggaatctgcagaccctgtcaccaccacggttgagaactacggaggt

SEQ ID NO: 4578 - DNA, 60 bp, Artificial Sequence
  Description of Artificial Sequence: Synthetic probe
gctgccacgtactacttctcggacctggaagtggcgtgtgttggcacaaacaagtgggtt

SEQ ID NO: 4579 - DNA, 60 bp, Artificial Sequence
  Description of Artificial Sequence: Synthetic probe
ccgtcaaccttcaacttcgggttcgtgaccgtcgacaaaccagtcgatgtttactaccgg

SEQ ID NO: 4580 - DNA, 60 bp, Artificial Sequence
  Description of Artificial Sequence: Synthetic probe
gcgagacacacatcccaaccactttcaactatggtaggatttacactgaagctgaagtgg

SEQ ID NO: 4581 - DNA, 60 bp, Artificial Sequence
  Description of Artificial Sequence: Synthetic probe
gcgagacacacatcccaaccactttcaactatggcaggatttacactgaagccgacgttg

SEQ ID NO: 4582 - DNA, 60 bp, Artificial Sequence
  Description of Artificial Sequence: Synthetic probe
aggattgctagcgagacacacatcccaaccactttcaactatggtaggatttacactgaa

SEQ ID NO: 4583 - DNA, 60 bp, Artificial Sequence
  Description of Artificial Sequence: Synthetic probe
cgggcagccacgtactacttctccgacctggaggttgtggtgcgtcatgaaggcaaccta

SEQ ID NO: 4584 - DNA, 60 bp, Artificial Sequence
  Description of Artificial Sequence: Synthetic probe
tgcgggcagccacgtactacttctccgacctggaggttgtggtgcgtcatgaaggcaacc

SEQ ID NO: 4585 - DNA, 60 bp, Artificial Sequence
  Description of Artificial Sequence: Synthetic probe
gatgtttactaccggatgaagagggctgaactgtactgcccacgcccgctgttgccagcc

SEQ ID NO: 4586 - DNA, 60 bp, Artificial Sequence
  Description of Artificial Sequence: Synthetic probe
tcgatgtttactaccggatgaagagggctgaactgtactgtccacgcccgctgctgccag

SEQ ID NO: 4587 - DNA, 60 bp, Artificial Sequence
  Description of Artificial Sequence: Synthetic probe
tccagtcgatgtttactaccggatgaagagggctgaactgtactgcccacgcccgctgtt

SEQ ID NO: 4588 - DNA, 53 bp, Artificial Sequence
  Description of Artificial Sequence: Synthetic probe
ccactcaagaccgccgtaaacaggagatcattgcacctgagaagcagatgctg

SEQ ID NO: 4589 - DNA, 60 bp, Artificial Sequence
  Description of Artificial Sequence: Synthetic probe
gcaacggcgtgggctactgctcttgcgtctcgaaatcgatgctcgaccagatgaaagccc

SEQ ID NO: 4590 - DNA, 60 bp, Artificial Sequence
  Description of Artificial Sequence: Synthetic probe
ttcgcgtaccgcgctgggactaaggtaggatactgcggggcagccgtgctgaccaagagt

SEQ ID NO: 4591 - DNA, 60 bp, Artificial Sequence
  Description of Artificial Sequence: Synthetic probe
tgaaagtaaagggacaggacatgctctcggacgctgcactcatggttctgaaccgtgggc

SEQ ID NO: 4592 - DNA, 60 bp, Artificial Sequence
  Description of Artificial Sequence: Synthetic probe
cgacgggagtgttcgggaccgcctacctcgtgcctcgtcatcttttcgctgagaagtatg

SEQ ID NO: 4593 - DNA, 60 bp, Artificial Sequence
  Description of Artificial Sequence: Synthetic probe
cctcttttggccatacacccgagcgaggcaagacacaaacaaaagattgtggcacctgtg

SEQ ID NO: 4594 - DNA, 60 bp, Artificial Sequence
  Description of Artificial Sequence: Synthetic probe
cccggtgaccaatacaagaggtgacctccaagtactggcccagaaggcggcgagaacgct

SEQ ID NO: 4595 - DNA, 60 bp, Artificial Sequence
  Description of Artificial Sequence: Synthetic probe
cgtaccacaaggcaccactcacccggcttgctttgccgtacacggcgccacaccgcgtgt

SEQ ID NO: 4596 - DNA, 60 bp, Artificial Sequence
  Description of Artificial Sequence: Synthetic probe
tgaaggagcgctggacaacaccaccaacccaacagcgtaccacaaggcaccactcacccg

SEQ ID NO: 4597 - DNA, 60 bp, Artificial Sequence
  Description of Artificial Sequence: Synthetic probe
ttgagaactacggtggtgagacacatgtccagagacgccaacacacggacgtctcgttca

SEQ ID NO: 4598 - DNA, 60 bp, Artificial Sequence
  Description of Artificial Sequence: Synthetic probe
ctacggaggagaaactcagacagccagacggcttcacactgatgttgccttcgttcttga

SEQ ID NO: 4599 - DNA, 60 bp, Artificial Sequence
  Description of Artificial Sequence: Synthetic probe
gaggctgagcgggcaactgcccacctccttcaactacggcgctgtaaaggctgacaacat

SEQ ID NO: 4600 - DNA, 60 bp, Artificial Sequence
  Description of Artificial Sequence: Synthetic probe
gaccgccgaccaaccggtcgacgtttactacaggatgaagcgggcagagctatactgtcc

SEQ ID NO: 4601 - DNA, 60 bp, Artificial Sequence
  Description of Artificial Sequence: Synthetic probe
ggtagacggtactgacatgtgtcttgctgatttccacgcaggaattttcctgaagggtac

SEQ ID NO: 4602 - DNA, 60 bp, Artificial Sequence
  Description of Artificial Sequence: Synthetic probe
ggttgacggtactgacatgtgtcttgctgatttccacgcaggaatcttcctcaagggtgc

SEQ ID NO: 4603 - DNA, 60 bp, Artificial Sequence
  Description of Artificial Sequence: Synthetic probe
attcgggccacgaccatccacgagctcctcgtgcgcatgaaacgtgccgagctctactgt

SEQ ID NO: 4604 - DNA, 60 bp, Artificial Sequence
  Description of Artificial Sequence: Synthetic probe
ccgctcttgcctgcgtacgaccaccagtcacgcgacagggttgacgcacctattggggta

SEQ ID NO: 4605 - DNA, 60 bp, Artificial Sequence
  Description of Artificial Sequence: Synthetic probe
tccactgtttacaacggtgagtgtaagtataacacaactgtacaaccaatacgtggagac

SEQ ID NO: 4606 - DNA, 60 bp, Artificial Sequence
  Description of Artificial Sequence: Synthetic probe
cggtactacccgctttgcactgccctacaccgctccacacaggtgcttggcaacaaccta

SEQ ID NO: 4607 - DNA, 60 bp, Artificial Sequence
  Description of Artificial Sequence: Synthetic probe
ttggaagaactcactggccttgaactgcatgagggtggaccacctgctctcgtcatctgg

SEQ ID NO: 4608 - DNA, 60 bp, Artificial Sequence
  Description of Artificial Sequence: Synthetic probe
ggaggagaaactcagacagccagacggcttcacactgatgttgccttcgttcttgacagg

SEQ ID NO: 4609 - DNA, 58 bp, Artificial Sequence
  Description of Artificial Sequence: Synthetic probe
attcgatgccccaattggtgtcgagaaacaactgtgcaacttcgacctgttaaagttg

SEQ ID NO: 4610 - DNA, 60 bp, Artificial Sequence
  Description of Artificial Sequence: Synthetic probe
gcgggtgcccaccgactgacttgcaaaagatggtcatggcaaacgtgaagcctgttgagc

SEQ ID NO: 4611 - DNA, 60 bp, Artificial Sequence
  Description of Artificial Sequence: Synthetic probe
gcggatgcccgccgactgacttgcaaaagatggtcatggcaaacgtgaagcctgttgagc

SEQ ID NO: 4612 - DNA, 60 bp, Artificial Sequence
  Description of Artificial Sequence: Synthetic probe
gcggatgcccaccgactgacttgcaaaagatggtcatggcaaacgtgaagcctgttgagc

SEQ ID NO: 4613 - DNA, 60 bp, Artificial Sequence
  Description of Artificial Sequence: Synthetic probe
atgaatcacctgagaacctcactcttgaggcaatcaggcagttggaagaggttactggcc

SEQ ID NO: 4614 - DNA, 53 bp, Artificial Sequence
  Description of Artificial Sequence: Synthetic probe
ccactcaggaccgccgtaaacaggagatcattgcacctgagaaacaggtactg

SEQ ID NO: 4615 - DNA, 60 bp, Artificial Sequence
  Description of Artificial Sequence: Synthetic probe
gcaaattccctcacacacgctggttggagcactgcttcggtctgcgacgtactacttctc

SEQ ID NO: 4616 - DNA, 60 bp, Artificial Sequence
  Description of Artificial Sequence: Synthetic probe
cggtggaggtctcgtcgcaagacagacacaaacagaagatcattgcaccagcaaaacagc

SEQ ID NO: 4617 - DNA, 60 bp, Artificial Sequence
  Description of Artificial Sequence: Synthetic probe
tcaactacggcaggatctacacggaggcggaagtcgacgtgtacgtgaggatgaagcggg

SEQ ID NO: 4618 - DNA, 60 bp, Artificial Sequence
  Description of Artificial Sequence: Synthetic probe
tggagattgtggtgcgtcacgacggcaacctgacatgggtacccaatggagcgcccgagg

SEQ ID NO: 4619 - DNA, 60 bp, Artificial Sequence
  Description of Artificial Sequence: Synthetic probe
gcgcggagctttattgccctaggcccattcttccattccagcctacgggtgacaggcaca

SEQ ID NO: 4620 - DNA, 60 bp, Artificial Sequence
  Description of Artificial Sequence: Synthetic probe
aacgcgcggagctttattgccctaggcccattcttccattccagcctacgggtgacaggc

SEQ ID NO: 4621 - DNA, 60 bp, Artificial Sequence
  Description of Artificial Sequence: Synthetic probe
cttggctcacttggtagcaacacacagccggcgtcttcctacttcgttcaactttggtgc

SEQ ID NO: 4622 - DNA, 60 bp, Artificial Sequence
  Description of Artificial Sequence: Synthetic probe
ggacttggctcacttggtagcaacacacagccggcgtcttcctacttcgttcaactttgg

SEQ ID NO: 4623 - DNA, 60 bp, Artificial Sequence
  Description of Artificial Sequence: Synthetic probe
gaggggacttggctcacttggtagcaacacacagccggcgtcttcctacttcgttcaact

SEQ ID NO: 4624 - DNA, 60 bp, Artificial Sequence
  Description of Artificial Sequence: Synthetic probe
ccttcgttcttgacaggtttgtgaaactcactgcacccaagaacactcagatccttgacc

SEQ ID NO: 4625 - DNA, 60 bp, Artificial Sequence
  Description of Artificial Sequence: Synthetic probe
ctcacgcactacgaccacggcggaaaggaccgttatcagacggccctcatccgacctgcc

SEQ ID NO: 4626 - DNA, 60 bp, Artificial Sequence
  Description of Artificial Sequence: Synthetic probe
aatggtgactgtaagtacaagcccactggcactcctccccgcacgaacattcgcggggac

SEQ ID NO: 4627 - DNA, 60 bp, Artificial Sequence
  Description of Artificial Sequence: Synthetic probe
tcccaacggcagccctgtgttcagtgaggtgggcgacaacccagtcgtcttctcacacaa

SEQ ID NO: 4628 - DNA, 60 bp, Artificial Sequence
  Description of Artificial Sequence: Synthetic probe
tgggtaggttgggctcccaacggcagccctgtgttcagtgaggtgggcgacaacccagtc

SEQ ID NO: 4629 - DNA, 60 bp, Artificial Sequence
  Description of Artificial Sequence: Synthetic probe
ctgcctcgcgacccagcgaggtgtgcatggtggacggcacggacatgtgcttggctgact

SEQ ID NO: 4630 - DNA, 53 bp, Artificial Sequence
  Description of Artificial Sequence: Synthetic probe
accaccacggccggggagtccgcagaccctgtcaccaccaccgtggagaacta

SEQ ID NO: 4631 - DNA, 60 bp, Artificial Sequence
  Description of Artificial Sequence: Synthetic probe
gctctagacaccactcaggaccgccgtaaacaggagatcattgcacctgagaagcagatg

SEQ ID NO: 4632 - DNA, 60 bp, Artificial Sequence
  Description of Artificial Sequence: Synthetic probe
tggtgggtgccctgttacgtgctgccacgtactacttctccgacctggagattgtggttc

SEQ ID NO: 4633 - DNA, 60 bp, Artificial Sequence
  Description of Artificial Sequence: Synthetic probe
accgagtgcgcgatctcacgggacacttccgtgacaccatgaaactgtcgaaaggcagcc

SEQ ID NO: 4634 - DNA, 60 bp, Artificial Sequence
  Description of Artificial Sequence: Synthetic probe
cggtgtgacccgctttgccatcccgttcacggccccacacaggctgctgtccactgtcta

SEQ ID NO: 4635 - DNA, 60 bp, Artificial Sequence
  Description of Artificial Sequence: Synthetic probe
actcgccccagcgagatctgtgtgatcaacggggtcaccatgaccctggccgatttccac

SEQ ID NO: 4636 - DNA, 60 bp, Artificial Sequence
  Description of Artificial Sequence: Synthetic probe
cacttctagcaatagaggtgtcttcgcaagacaggcacaagcaaaagattattgcgcccg

SEQ ID NO: 4637 - DNA, 60 bp, Artificial Sequence
  Description of Artificial Sequence: Synthetic probe
ataccacaagggaccgctgactcgactggctctcccatacaccgcgccacaccgcgtgtt

SEQ ID NO: 4638 - DNA, 60 bp, Artificial Sequence
  Description of Artificial Sequence: Synthetic probe
agaatgaagagagccgagacgtactgccccaggcctcttctcgccattcaaccgagtgac

SEQ ID NO: 4639 - DNA, 60 bp, Artificial Sequence
  Description of Artificial Sequence: Synthetic probe
gtgagaggtgaccttcaagtgttggcccagaaggcagaaagaactctgcctacctccttc

SEQ ID NO: 4640 - DNA, 60 bp, Artificial Sequence
  Description of Artificial Sequence: Synthetic probe
ctaacaacgtgagaggtgaccttcaagtgttggcccagaaggcagaaagaactctgccta

SEQ ID NO: 4641 - DNA, 60 bp, Artificial Sequence
  Description of Artificial Sequence: Synthetic probe
acgagggcgatctcacctgggtcccaaacggcgcccctgagacagcactggacaacacta

SEQ ID NO: 4642 - DNA, 60 bp, Artificial Sequence
  Description of Artificial Sequence: Synthetic probe
actggctgtcaagcacgagggcgatctcacctgggtcccaaacggcgcccctgagacagc

SEQ ID NO: 4643 - DNA, 60 bp, Artificial Sequence
  Description of Artificial Sequence: Synthetic probe
ctgcgaacggccacctactacttctctgacctggaactggctgtcaagcacgagggcgat

SEQ ID NO: 4644 - DNA, 60 bp, Artificial Sequence
  Description of Artificial Sequence: Synthetic probe
ctggtaggggcgctcctgcgaacggccacctactacttctctgacctggaactggctgtc

SEQ ID NO: 4645 - DNA, 60 bp, Artificial Sequence
  Description of Artificial Sequence: Synthetic probe
ttaatgtgttggacctgatgcagattccggcccacaccctggtaggggcgctcctgcgaa

SEQ ID NO: 4646 - DNA, 53 bp, Artificial Sequence
  Description of Artificial Sequence: Synthetic probe
accacctctgcgggtgagtctgcggaccccgtgactgccaccgtcgagaacta

SEQ ID NO: 4647 - DNA, 60 bp, Artificial Sequence
  Description of Artificial Sequence: Synthetic probe
cgtgctgccacgtactacttctccgacctggagattgtggttcgacacgacggcaacctg

SEQ ID NO: 4648 - DNA, 60 bp, Artificial Sequence
  Description of Artificial Sequence: Synthetic probe
cttcaactacggtgccatgaaagccacttgggtgactgaactgctttaccgcatgaagag

SEQ ID NO: 4649 - DNA, 60 bp, Artificial Sequence
  Description of Artificial Sequence: Synthetic probe
agcaccattcacaagacttgcacttccctacaccgcgccacaccgcgtgttggcaacggt

SEQ ID NO: 4650 - DNA, 60 bp, Artificial Sequence
  Description of Artificial Sequence: Synthetic probe
cataatcaacaactactacatgcaacagtaccaaaattccatggacacacagctgggtga

SEQ ID NO: 4651 - DNA, 60 bp, Artificial Sequence
  Description of Artificial Sequence: Synthetic probe
acgcaaacagggacaggtttgacagccccattggtgttgagaagcaactgtgcaacttcg

SEQ ID NO: 4652 - DNA, 60 bp, Artificial Sequence
  Description of Artificial Sequence: Synthetic probe
gcttgcgctcccctacaccgcgccacaccgcgtgctggcaacagtgtacaacgggacgag

SEQ ID NO: 4653 - DNA, 60 bp, Artificial Sequence
  Description of Artificial Sequence: Synthetic probe
cacgtactacttttctgatttggaaatagcagtgacccacactggcaagctcacatgggt

SEQ ID NO: 4654 - DNA, 60 bp, Artificial Sequence
  Description of Artificial Sequence: Synthetic probe
aagcgagacacacatcccaaccacttttaactatggcaggatttacactcaggccgaggt

SEQ ID NO: 4655 - DNA, 60 bp, Artificial Sequence
  Description of Artificial Sequence: Synthetic probe
ctggagtgtttggtactgcctatctcgtgcctcgtcatcttttcgctgagaagtatgaca

SEQ ID NO: 4656 - DNA, 60 bp, Artificial Sequence
  Description of Artificial Sequence: Synthetic probe
cgcgagaacattcgcggggacctcgcgactcttgcggcgaggatcgcgagcgagacacac

SEQ ID NO: 4657 - DNA, 60 bp, Artificial Sequence
  Description of Artificial Sequence: Synthetic probe
ccgcgcgagaacattcgcggggacctcgcgactcttgcgcagaggattgcaagcgagact

SEQ ID NO: 4658 - DNA, 60 bp, Artificial Sequence
  Description of Artificial Sequence: Synthetic probe
ggtgcccaacggtgcacccgaggcagccctgtcaaacaccagcaaccccactgcctacaa

SEQ ID NO: 4659 - DNA, 60 bp, Artificial Sequence
  Description of Artificial Sequence: Synthetic probe
ggcacacactctgccggaggcaacggagtaggctactgctcctgcgtctcacgatccatg

SEQ ID NO: 4660 - DNA, 60 bp, Artificial Sequence
  Description of Artificial Sequence: Synthetic probe
ggacccctccgacgtcctgtgttttgtcccgtacgatatggaaccattcaacggagacgc

SEQ ID NO: 4661 - DNA, 60 bp, Artificial Sequence
  Description of Artificial Sequence: Synthetic probe
atggactccggacccctccgacgtcctgtgttttgtcccgtacgatatggaaccattcaa

SEQ ID NO: 4662 - DNA, 60 bp, Artificial Sequence
  Description of Artificial Sequence: Synthetic probe
cctcgcggcccagcgaggtttgtatggtggatggaactgagatgtgtcttgctgatttcc

SEQ ID NO: 4663 - DNA, 60 bp, Artificial Sequence
  Description of Artificial Sequence: Synthetic probe
acagcctcgcggcccagcgaggtttgtatggtggatggaactgagatgtgtcttgctgat

SEQ ID NO: 4664 - DNA, 60 bp, Artificial Sequence
  Description of Artificial Sequence: Synthetic probe
ggaacatcaaacacttgctctacaccggcatcggtacagcctcgcggcccagcgaggttt

SEQ ID NO: 4665 - DNA, 60 bp, Artificial Sequence
  Description of Artificial Sequence: Synthetic probe
tgagcagcttgaggaactcactgggctcgagttacacgaaggcggaccccccgctctcgt

SEQ ID NO: 4666 - DNA, 50 bp, Artificial Sequence
  Description of Artificial Sequence: Synthetic probe
tgagcagcttgaggaactcactgggctcgagttacacgaaggcggacccc

SEQ ID NO: 4667 - DNA, 60 bp, Artificial Sequence
  Description of Artificial Sequence: Synthetic probe
cgactgggtctacaactcacccgagaacctcactctccaagcaattgagcagcttgagga

SEQ ID NO: 4668 - DNA, 60 bp, Artificial Sequence
  Description of Artificial Sequence: Synthetic probe
ttcttcgactgggtctacaactcacccgagaacctcactctccaagcaattgagcagctt

SEQ ID NO: 4669 - DNA, 60 bp, Artificial Sequence
  Description of Artificial Sequence: Synthetic probe
gctggctgaacaccatcctccagttgttcaggtatgtcgacgaaccattcttcgactggg

SEQ ID NO: 4670 - DNA, 60 bp, Artificial Sequence
  Description of Artificial Sequence: Synthetic probe
actgctggctgaacaccatcctccagttgttcaggtatgtcgacgaaccattcttcgact

SEQ ID NO: 4671 - DNA, 60 bp, Artificial Sequence
  Description of Artificial Sequence: Synthetic probe
caaaggtatcaagaagatggaattcacactctacaacggtgagaagaagaccttctactc

SEQ ID NO: 4672 - DNA, 60 bp, Artificial Sequence
  Description of Artificial Sequence: Synthetic probe
caaactactgttcaaaggtatcaagaagatggaattcacactctacaacggtgagaagaa

SEQ ID NO: 4673 - DNA, 58 bp, Artificial Sequence
  Description of Artificial Sequence: Synthetic probe
ttttatcgctttagtgcaggccattagagagatcaaactactgttcaaaggtatcaag

SEQ ID NO: 4674 - DNA, 60 bp, Artificial Sequence
  Description of Artificial Sequence: Synthetic probe
atgaacacaactgactgttttatcgctttagtgcaggccattagagagatcaaactactg

SEQ ID NO: 4675 - DNA, 60 bp, Artificial Sequence
  Description of Artificial Sequence: Synthetic probe
gagctgccgtccactttcaacttcggttacgtgaccgccgacaagccagtcgacgtttac

SEQ ID NO: 4676 - DNA, 60 bp, Artificial Sequence
  Description of Artificial Sequence: Synthetic probe
cacagaggctgatggggcaactgcccacctccttcaactacggcgctgtaaaggctgaca

SEQ ID NO: 4677 - DNA, 60 bp, Artificial Sequence
  Description of Artificial Sequence: Synthetic probe
ccgcgtgagagacatcacgaaacactttcgtgacacagcaagaatgaagaaaggcacccc

SEQ ID NO: 4678 - DNA, 60 bp, Artificial Sequence
  Description of Artificial Sequence: Synthetic probe
gaggtgtcttctcaagacagacacaaacagaagatcattgcacccgcgaagcagcttttg

SEQ ID NO: 4679 - DNA, 60 bp, Artificial Sequence
  Description of Artificial Sequence: Synthetic probe
gaggggaacctcacctgggtcccgaatggggcgcccgagaaagcgttggacaacaccacc

SEQ ID NO: 4680 - DNA, 60 bp, Artificial Sequence
  Description of Artificial Sequence: Synthetic probe
tacacggaggcggaagtcgacgtgtacgtgagaatgaaaagggcggagctctactgcccc

SEQ ID NO: 4681 - DNA, 60 bp, Artificial Sequence
  Description of Artificial Sequence: Synthetic probe
catccacgaacttctcgtgcgcatgaaacgggccgaactctactgtcctaggccactact

SEQ ID NO: 4682 - DNA, 60 bp, Artificial Sequence
  Description of Artificial Sequence: Synthetic probe
tacgaacacgcgggacgggacaggttcgatgccccaattggtgtcgagaaacaactgtgc

SEQ ID NO: 4683 - DNA, 60 bp, Artificial Sequence
  Description of Artificial Sequence: Synthetic probe
gatggtgcacgacagcatcaaggaagagcttaagcccttgttggagcaaaccagcttcgc

SEQ ID NO: 4684 - DNA, 60 bp, Artificial Sequence
  Description of Artificial Sequence: Synthetic probe
cggtggtgagacacaggtccaaaggcggcaccacacggatgttggcttcatcatggacag

SEQ ID NO: 4685 - DNA, 60 bp, Artificial Sequence
  Description of Artificial Sequence: Synthetic probe
ctacggtggtgagacacaggtccaaaggcggcaccacacggatgttggcttcatcatgga

SEQ ID NO: 4686 - DNA, 60 bp, Artificial Sequence
  Description of Artificial Sequence: Synthetic probe
gtctgcgacctactacttctcagacctggaggttgcgcttgtccacacgggtcccgtcac

SEQ ID NO: 4687 - DNA, 56 bp, Artificial Sequence
  Description of Artificial Sequence: Synthetic probe
ccactcgggtgaccgaattgctttaccgcatgaagagggctgagacatactgcccc

SEQ ID NO: 4688 - DNA, 60 bp, Artificial Sequence
  Description of Artificial Sequence: Synthetic probe
agcaaaagatcattgcacctgcaaagcaactcttgaactttcgacctgctcaagttggcg

SEQ ID NO: 4689 - DNA, 60 bp, Artificial Sequence
  Description of Artificial Sequence: Synthetic probe
tgcagttcgagccacgaccatccacgagcttctcgtgcgcatgaagcgtgctgagctcta

SEQ ID NO: 4690 - DNA, 60 bp, Artificial Sequence
  Description of Artificial Sequence: Synthetic probe
cgtgctgccacgtactacttctccgacctggagattgtggttcgtcacgacggcaacctg

SEQ ID NO: 4691 - DNA, 60 bp, Artificial Sequence
  Description of Artificial Sequence: Synthetic probe
cacacggtgttttggcaactgtgtacaatggtaactgcaagtacaacaaaacccaacgcg

SEQ ID NO: 4692 - DNA, 60 bp, Artificial Sequence
  Description of Artificial Sequence: Synthetic probe
cacacggtgttttggcaactgtgtacaatggtaattgcaagtacaacaaaacccaacgca

SEQ ID NO: 4693 - DNA, 60 bp, Artificial Sequence
  Description of Artificial Sequence: Synthetic probe
gctcagtcgcccgctttgcactaccctacaccgcaccacacggtgttttggcaactgtgt

SEQ ID NO: 4694 - DNA, 60 bp, Artificial Sequence
  Description of Artificial Sequence: Synthetic probe
atgaacacgactgactgttttatcgctctgttacacgctatcggagagattaaagcactc

SEQ ID NO: 4695 - DNA, 60 bp, Artificial Sequence
  Description of Artificial Sequence: Synthetic probe
gggcggctgcccacctccttcaactacggcgctgtaaaggctgacaccatcactgagctt

SEQ ID NO: 4696 - DNA, 60 bp, Artificial Sequence
  Description of Artificial Sequence: Synthetic probe
ccaacacgggctggtgggtgccctgttgcgtgctgccacgtactacttctccgacctgga

SEQ ID NO: 4697 - DNA, 60 bp, Artificial Sequence
  Description of Artificial Sequence: Synthetic probe
gaccatccacgagcttctcgtgcgcatgaaacgtgccgagctctactgccccaggcctct

SEQ ID NO: 4698 - DNA, 60 bp, Artificial Sequence
  Description of Artificial Sequence: Synthetic probe
gggtggtacgcgattgacgtcgaggacttttacccttggacgccggatccgtccgacgtt

SEQ ID NO: 4699 - DNA, 60 bp, Artificial Sequence
  Description of Artificial Sequence: Synthetic probe
gatcactttacctgcgttgggtgaacgccgtgtgcggcgacgcataatccctcagatgtc

SEQ ID NO: 4700 - DNA, 60 bp, Artificial Sequence
  Description of Artificial Sequence: Synthetic probe
acggtgccatcaaggctactcgggtgactgaactgctttaccgcatgaagagggctgaaa

SEQ ID NO: 4701 - DNA, 60 bp, Artificial Sequence
  Description of Artificial Sequence: Synthetic probe
acgtacggggaaacaacctcacggcgtggtgatatggcggcccttgcacaaaggctgatg

SEQ ID NO: 4702 - DNA, 60 bp, Artificial Sequence
  Description of Artificial Sequence: Synthetic probe
agacaacgtacggggaaacaacctcacggcgtggtgatatggcggcccttgcacaaaggc

SEQ ID NO: 4703 - DNA, 60 bp, Artificial Sequence
  Description of Artificial Sequence: Synthetic probe
agcgaccggatcacagaatcaatcaggtaacacaggtagtatcatcaacaactactatat

SEQ ID NO: 4704 - DNA, 60 bp, Artificial Sequence
  Description of Artificial Sequence: Synthetic probe
ttgtgtgacacaggtgaggtctactaccggatgaagagaaccgagctgtactgccctcga

SEQ ID NO: 4705 - DNA, 60 bp, Artificial Sequence
  Description of Artificial Sequence: Synthetic probe
ccatcaaggccacccgggtgactgaactgctttaccgcatgaagagggccgaaacatact

SEQ ID NO: 4706 - DNA, 60 bp, Artificial Sequence
  Description of Artificial Sequence: Synthetic probe
acggtgccatcaaggccacccgggtgactgaactgctttaccgcatgaagagggccgaaa

SEQ ID NO: 4707 - DNA, 59 bp, Artificial Sequence
  Description of Artificial Sequence: Synthetic probe
ggcaactgcaaatactccaaaacccaacacgttgcaccacgtcgcggtgatctggcggc

SEQ ID NO: 4708 - DNA, 60 bp, Artificial Sequence
  Description of Artificial Sequence: Synthetic probe
tggcaactgcaaatactccaaaacccaacacgttgcgccacgtcgcggtgatctggcggc

SEQ ID NO: 4709 - DNA, 60 bp, Artificial Sequence
  Description of Artificial Sequence: Synthetic probe
gtctacaatggcaactgcaaatactccaaaacccaacacgttgcgccacgtcgcggtgat

SEQ ID NO: 4710 - DNA, 60 bp, Artificial Sequence
  Description of Artificial Sequence: Synthetic probe
gctcactgaacgcgtggaggacaacccagtcgttcacgcgaaaaacggtgtcgcccgttt

SEQ ID NO: 4711 - DNA, 60 bp, Artificial Sequence
  Description of Artificial Sequence: Synthetic probe
ctatggcaggatttacacacaagctgaggttgacgtgtacgtcaggatgaagcgtgcgga

SEQ ID NO: 4712 - DNA, 60 bp, Artificial Sequence
  Description of Artificial Sequence: Synthetic probe
ctgctggcaacagaggtgccttcgcagggcaggtacaaacagaagattattgcacccgca

SEQ ID NO: 4713 - DNA, 60 bp, Artificial Sequence
  Description of Artificial Sequence: Synthetic probe
cactgctggcaacagaggtgccttcgcagggcaggtacaaacagaagattattgcacccg

SEQ ID NO: 4714 - DNA, 60 bp, Artificial Sequence
  Description of Artificial Sequence: Synthetic probe
tacgtatgaaacgggccgagctctactgccccagaccactgctggcaacagaggtgcctt

SEQ ID NO: 4715 - DNA, 60 bp, Artificial Sequence
  Description of Artificial Sequence: Synthetic probe
acacgagcttctcgtacgtatgaaacgggccgagctctactgccccagaccactgctggc

SEQ ID NO: 4716 - DNA, 60 bp, Artificial Sequence
  Description of Artificial Sequence: Synthetic probe
cctgcttcttttaactacggtgcaatcaaggccgacaacatacacgagcttctcgtacgt

SEQ ID NO: 4717 - DNA, 60 bp, Artificial Sequence
  Description of Artificial Sequence: Synthetic probe
aagacacttcctgcttcttttaactacggtgcaatcaaggccgacaacatacacgagctt

SEQ ID NO: 4718 - DNA, 58 bp, Artificial Sequence
  Description of Artificial Sequence: Synthetic probe
taacgggacgagcgagtacactgtgagtggttcaaacgggcggggtgacatggcgcct

SEQ ID NO: 4719 - DNA, 60 bp, Artificial Sequence
  Description of Artificial Sequence: Synthetic probe
gtcctactccagcaaccccactgcctacaaaaaggcaccattcacgagacttgctctccc

SEQ ID NO: 4720 - DNA, 60 bp, Artificial Sequence
  Description of Artificial Sequence: Synthetic probe
attatggacagatttgtgaagataaacagcccaagtcctactcatgtcattgacctcatg

SEQ ID NO: 4721 - DNA, 60 bp, Artificial Sequence
  Description of Artificial Sequence: Synthetic probe
tcattatggacagatttgtgaagataaacagcccaagtcctactcatgtcattgacctca

SEQ ID NO: 4722 - DNA, 60 bp, Artificial Sequence
  Description of Artificial Sequence: Synthetic probe
acttccgcctctggagagtcagtggaccctgtcaccaccaccgtagagaactacggcggt

SEQ ID NO: 4723 - DNA, 60 bp, Artificial Sequence
  Description of Artificial Sequence: Synthetic probe
cttctcgtgcgcatgaagcgggccgagctctactgccctagaccacttttggcaatagag

SEQ ID NO: 4724 - DNA, 60 bp, Artificial Sequence
  Description of Artificial Sequence: Synthetic probe
ggagaggattgcaagcgagacacacatcccaaccaccttcaattttggcaggatctacac

SEQ ID NO: 4725 - DNA, 60 bp, Artificial Sequence
  Description of Artificial Sequence: Synthetic probe
gtggtgatatggcggcccttgcacaaaggctgagtggccggttgcccacctctttcaact

SEQ ID NO: 4726 - DNA, 60 bp, Artificial Sequence
  Description of Artificial Sequence: Synthetic probe
agggtggaccgcccgctctcgtcatctggaacatcaaacaccttctccacaccggaatcg

SEQ ID NO: 4727 - DNA, 60 bp, Artificial Sequence
  Description of Artificial Sequence: Synthetic probe
cgccggatccgtccgacgttctggtgtttgttccgtacgatcaagaaccactcaacggag

SEQ ID NO: 4728 - DNA, 60 bp, Artificial Sequence
  Description of Artificial Sequence: Synthetic probe
ccgtggacgccggatccgtctgacgtcctggtgtttgttccgtacgatcaagaaccactc

SEQ ID NO: 4729 - DNA, 60 bp, Artificial Sequence
  Description of Artificial Sequence: Synthetic probe
ataccacaaggcaccgctcacccggcttgcactgccatacacagcaccacaccgcgtgtt

SEQ ID NO: 4730 - DNA, 60 bp, Artificial Sequence
  Description of Artificial Sequence: Synthetic probe
ctcacacactacgatcacaacggcaaggatcgctacaaaaccgcgatcaccagacctgcc

SEQ ID NO: 4731 - DNA, 60 bp, Artificial Sequence
  Description of Artificial Sequence: Synthetic probe
gtctgctacgtactacttctcagacctagaggttgcgcttgtccacacaggcccggtcac

SEQ ID NO: 4732 - DNA, 60 bp, Artificial Sequence
  Description of Artificial Sequence: Synthetic probe
atggtgacaccatgcctggcctctttgcctacagagccgccaccaaggctggttactgtg

SEQ ID NO: 4733 - DNA, 60 bp, Artificial Sequence
  Description of Artificial Sequence: Synthetic probe
gcaaccctggctgcgcggattgctagtgagacccacatcccgacaacattcaactacggg

SEQ ID NO: 4734 - DNA, 60 bp, Artificial Sequence
  Description of Artificial Sequence: Synthetic probe
accgggtgactgaactgctttaccgcatgaagagggccgaaacatactgcccccgacctc

SEQ ID NO: 4735 - DNA, 60 bp, Artificial Sequence
  Description of Artificial Sequence: Synthetic probe
ctttgcactgccctacaccgctccacacaggtgcctggcaacaacctacaacggtgactg

SEQ ID NO: 4736 - DNA, 60 bp, Artificial Sequence
  Description of Artificial Sequence: Synthetic probe
gttcacggccccacacaggctgctgtccactgtctacaatggcgagtgcacctacgcaaa

SEQ ID NO: 4737 - DNA, 60 bp, Artificial Sequence
  Description of Artificial Sequence: Synthetic probe
gttcacggccccacacaggctgctgtccactgtctacaacggcgagtgcacctacacaaa

SEQ ID NO: 4738 - DNA, 60 bp, Artificial Sequence
  Description of Artificial Sequence: Synthetic probe
cccgttcacggccccacacaggctgctgtccactgtctacaatggcgagtgcacctacgc

SEQ ID NO: 4739 - DNA, 60 bp, Artificial Sequence
  Description of Artificial Sequence: Synthetic probe
ggtttgctgtgccatacactgcgccccaccgcttgttgtcaactgtttacaacggtgagt

SEQ ID NO: 4740 - DNA, 60 bp, Artificial Sequence
  Description of Artificial Sequence: Synthetic probe
ctggagttttcgggacggcttacctcgtgcctcgtcatcttttcgcagagaagtatgaca

SEQ ID NO: 4741 - DNA, 60 bp, Artificial Sequence
  Description of Artificial Sequence: Synthetic probe
cacacaggtgcttggcaacaacctacaacggtgattgtaagtacaaacccactggcacag

SEQ ID NO: 4742 - DNA, 60 bp, Artificial Sequence
  Description of Artificial Sequence: Synthetic probe
tttgctagctctagacaccactcaggaccgccgtaaacaggagatcattgcacctgagaa

SEQ ID NO: 4743 - DNA, 53 bp, Artificial Sequence
  Description of Artificial Sequence: Synthetic probe
accaccgcaacgggggaatctgcagaccctgtcaccaccactgtggaaaacta

SEQ ID NO: 4744 - DNA, 60 bp, Artificial Sequence
  Description of Artificial Sequence: Synthetic probe
attgacctcatgcaaacccaccaacacgggttggtgggtgccctgttacgtgccgccacg

SEQ ID NO: 4745 - DNA, 60 bp, Artificial Sequence
  Description of Artificial Sequence: Synthetic probe
tgagtcggctgaccccgtgactgccactgttgagaactacggtggtgagacacaggtcca

SEQ ID NO: 4746 - DNA, 60 bp, Artificial Sequence
  Description of Artificial Sequence: Synthetic probe
gctgacagcagcgttgatgtgtactacaggatgaagcgtgctgaactttactgccccagg

SEQ ID NO: 4747 - DNA, 60 bp, Artificial Sequence
  Description of Artificial Sequence: Synthetic probe
gaggtgtcttcgcaagacaggcacaagcaaaagattattgcgcccgcaaaacagctcttg

SEQ ID NO: 4748 - DNA, 60 bp, Artificial Sequence
  Description of Artificial Sequence: Synthetic probe
gcaaatcccctcacacacgctggttggagcactgcttcggtctgcgacgtactacttctc

SEQ ID NO: 4749 - DNA, 60 bp, Artificial Sequence
  Description of Artificial Sequence: Synthetic probe
gcagatcccctcacacacgctggttggagcactgcttcggtctgcgacgtactacttctc

SEQ ID NO: 4750 - DNA, 60 bp, Artificial Sequence
  Description of Artificial Sequence: Synthetic probe
tgagaactacggcggtgagacacaggcccagcggcgtcaccacactgacgtcagctttat

SEQ ID NO: 4751 - DNA, 60 bp, Artificial Sequence
  Description of Artificial Sequence: Synthetic probe
taacccgatggttttctcacacaacaacgtcacccggtttgccgtgccatacaccgcacc

SEQ ID NO: 4752 - DNA, 60 bp, Artificial Sequence
  Description of Artificial Sequence: Synthetic probe
accaccgcgacccgggaatctgcagaccctgtcaccaccactgtggagaactacggtggt

SEQ ID NO: 4753 - DNA, 60 bp, Artificial Sequence
  Description of Artificial Sequence: Synthetic probe
agcaatacgggccacgaacatccacgagcttctcgtgcgcatgaagcgtgccgagctcta

SEQ ID NO: 4754 - DNA, 60 bp, Artificial Sequence
  Description of Artificial Sequence: Synthetic probe
gcaatacgggctacgaacatccacgagcttctcgtgcgcatgaagcgtgccgagctctac

SEQ ID NO: 4755 - DNA, 60 bp, Artificial Sequence
  Description of Artificial Sequence: Synthetic probe
ccaagctagtagcacctgataaacaactgtgtaatttcgacctgttgaagttggccggag

SEQ ID NO: 4756 - DNA, 60 bp, Artificial Sequence
  Description of Artificial Sequence: Synthetic probe
gaccaagctggtagcacctaataaacaactgtgtaatttcgacctgttgaagttggccgg

SEQ ID NO: 4757 - DNA, 60 bp, Artificial Sequence
  Description of Artificial Sequence: Synthetic probe
agaccaagctggtagcacctaataaacaactgtgtaatttcgacctgttgaagttggccg

SEQ ID NO: 4758 - DNA, 60 bp, Artificial Sequence
  Description of Artificial Sequence: Synthetic probe
agaccaagctagtagcacctgataaacaactgtgtaatttcgacctgttgaagttggccg

SEQ ID NO: 4759 - DNA, 60 bp, Artificial Sequence
  Description of Artificial Sequence: Synthetic probe
cggcggtgagacacaagtccagcggcgtcaccacactgatgtcggcttcataatggacag

SEQ ID NO: 4760 - DNA, 60 bp, Artificial Sequence
  Description of Artificial Sequence: Synthetic probe
atccacgagcttctcgtgcgcatgaagcgtgccgaactctactgccccagaccactgttg

SEQ ID NO: 4761 - DNA, 53 bp, Artificial Sequence
  Description of Artificial Sequence: Synthetic probe
ccaccaacacgggctggtgggtgccctgttgcgtgctgccacgtactacttct

SEQ ID NO: 4762 - DNA, 60 bp, Artificial Sequence
  Description of Artificial Sequence: Synthetic probe
ggctgacaccattactgagcttttgatccgcatgaaacgcgcggagacatactgccctag

SEQ ID NO: 4763 - DNA, 60 bp, Artificial Sequence
  Description of Artificial Sequence: Synthetic probe
cagaggctgagtgggcaactgcccacctccttcaactacggcgctgtaaaggctgacacc

SEQ ID NO: 4764 - DNA, 60 bp, Artificial Sequence
  Description of Artificial Sequence: Synthetic probe
gctggcactcccctacactgcaccacaccgtgtgttggcaacagtgtacaacgggacgag

SEQ ID NO: 4765 - DNA, 60 bp, Artificial Sequence
  Description of Artificial Sequence: Synthetic probe
cggcgctgtaaaggctgacaccatcactgagctgttgatccgcatgaaacgcgcggagac

SEQ ID NO: 4766 - DNA, 60 bp, Artificial Sequence
  Description of Artificial Sequence: Synthetic probe
ctcacttggcagcagcacacagccggcgtcttcccacgtcgttcaactttggtgccatca

SEQ ID NO: 4767 - DNA, 60 bp, Artificial Sequence
  Description of Artificial Sequence: Synthetic probe
gaggggacttggctcacttggcagcagcacacagccggcgtcttcccacgtcgttcaact

SEQ ID NO: 4768 - DNA, 60 bp, Artificial Sequence
  Description of Artificial Sequence: Synthetic probe
cgaggtgtgcatggttgacggtactgacatgtgtcttgctgatttccacgcaggaatctt

SEQ ID NO: 4769 - DNA, 60 bp, Artificial Sequence
  Description of Artificial Sequence: Synthetic probe
cgccaccgaccgacttgcaaaagatggtcatggccaacgtcaagcccgttgagctcatcc

SEQ ID NO: 4770 - DNA, 57 bp, Artificial Sequence
  Description of Artificial Sequence: Synthetic probe
tacgatcaagaaccactcaacggagaatggaaagcaaaggttcagaaacgactcaag

SEQ ID NO: 4771 - DNA, 60 bp, Artificial Sequence
  Description of Artificial Sequence: Synthetic probe
aaacggggctcctgagaccgcgctggacaacaccaccaacccaacagcataccacaaggc

SEQ ID NO: 4772 - DNA, 60 bp, Artificial Sequence
  Description of Artificial Sequence: Synthetic probe
tgtgtttgcctgtctgacctccaacggttggtacgccattgacgacgaggacttctaccc

SEQ ID NO: 4773 - DNA, 60 bp, Artificial Sequence
  Description of Artificial Sequence: Synthetic probe
aacggtgactgtaagtacaagcccactggcacggccccgcgcgaaaacattcgtggggac

SEQ ID NO: 4774 - DNA, 60 bp, Artificial Sequence
  Description of Artificial Sequence: Synthetic probe
tgaccaatgtgagaggtgacctgcaagtgttggcccagaaggcggcaagagcgctgccta

SEQ ID NO: 4775 - DNA, 60 bp, Artificial Sequence
  Description of Artificial Sequence: Synthetic probe
aaccagagacggacacgccgcgttcacacggacgtagcgttccttctggacaggttcaca

SEQ ID NO: 4776 - DNA, 60 bp, Artificial Sequence
  Description of Artificial Sequence: Synthetic probe
taaccagagacggacacgccgcgttcacacggacgtagcgttccttctggacaggttcac

SEQ ID NO: 4777 - DNA, 60 bp, Artificial Sequence
  Description of Artificial Sequence: Synthetic probe
acacggcggtaaccagagacggacacgccgcgttcacacggacgtagcgttccttctgga

SEQ ID NO: 4778 - DNA, 60 bp, Artificial Sequence
  Description of Artificial Sequence: Synthetic probe
acacggtggtaaccagagacggacacgccgcgttcacacggacgtagcgttccttctgga

SEQ ID NO: 4779 - DNA, 60 bp, Artificial Sequence
  Description of Artificial Sequence: Synthetic probe
caaacaaccagcgcaggtgaaggggcagacgtggtgaccgtcgacgccgccgcacacggt

SEQ ID NO: 4780 - DNA, 60 bp, Artificial Sequence
  Description of Artificial Sequence: Synthetic probe
ctacggaggagaaactcagacggccagacggcttcacactgacgttgccttcgttcttga

SEQ ID NO: 4781 - DNA, 60 bp, Artificial Sequence
  Description of Artificial Sequence: Synthetic probe
cgctctttgagccagagtatctgtcaccagagaacaagacactggacatgatcagacagc

SEQ ID NO: 4782 - DNA, 60 bp, Artificial Sequence
  Description of Artificial Sequence: Synthetic probe
ctacggcgccatcaaggccactgtgactgaactgctttaccgcataaagagggctgaaac

SEQ ID NO: 4783 - DNA, 60 bp, Artificial Sequence
  Description of Artificial Sequence: Synthetic probe
actacggcgccatcaaggccactgtgactgaactgctttaccgcataaagagggctgaaa

SEQ ID NO: 4784 - DNA, 60 bp, Artificial Sequence
  Description of Artificial Sequence: Synthetic probe
tgcaggtatggtacgagcacggtggccgtgagaggtgacctacaagtgttggcccagaag

SEQ ID NO: 4785 - DNA, 60 bp, Artificial Sequence
  Description of Artificial Sequence: Synthetic probe
tacaacgggggctgcaggtatggtacgagcacggtggccgtgagaggtgacctacaagtg

SEQ ID NO: 4786 - DNA, 60 bp, Artificial Sequence
  Description of Artificial Sequence: Synthetic probe
gaactacggaggagagactcaggtccaacgtcgccaccacaccgacgttgccttcgttct

SEQ ID NO: 4787 - DNA, 60 bp, Artificial Sequence
  Description of Artificial Sequence: Synthetic probe
actgctaccactcggaatgggacactggactgaactcacagttcacgttcgctgtgccct

SEQ ID NO: 4788 - DNA, 60 bp, Artificial Sequence
  Description of Artificial Sequence: Synthetic probe
gttctacccatggacaccggatccagaaaacgtactcgcgtacgtgccctacgaccagga

SEQ ID NO: 4789 - DNA, 60 bp, Artificial Sequence
  Description of Artificial Sequence: Synthetic probe
accggatccgtccgacgtcctctgttttgtcccgtacgacatggaaccgttcaacgggga

SEQ ID NO: 4790 - DNA, 60 bp, Artificial Sequence
  Description of Artificial Sequence: Synthetic probe
gtggacaccggatccgtccgacgtcctctgttttgtcccgtacgacatggaaccgttcaa

SEQ ID NO: 4791 - DNA, 60 bp, Artificial Sequence
  Description of Artificial Sequence: Synthetic probe
ggatggtatgccattgacgacgaggaattctacccgtggacaccggatccgtccgacgtc

SEQ ID NO: 4792 - DNA, 60 bp, Artificial Sequence
  Description of Artificial Sequence: Synthetic probe
tgcctgacctccgatggatggtatgccattgacgacgaggaattctacccgtggacaccg

SEQ ID NO: 4793 - DNA, 60 bp, Artificial Sequence
  Description of Artificial Sequence: Synthetic probe
acttccacgcgggaattttcctgaaaggtactgaacacgccgtgttcgcctgcctgacct

SEQ ID NO: 4794 - DNA, 60 bp, Artificial Sequence
  Description of Artificial Sequence: Synthetic probe
ccccagcgaggtttgtatggtagatggtacagagatgtgtcttgctgacttccacgcggg

SEQ ID NO: 4795 - DNA, 60 bp, Artificial Sequence
  Description of Artificial Sequence: Synthetic probe
gcgccccagcgaggtttgtatggtagatggtacagagatgtgtcttgctgacttccacgc

SEQ ID NO: 4796 - DNA, 56 bp, Artificial Sequence
  Description of Artificial Sequence: Synthetic probe
ctcgagttacacgagggaggccctcccgccctcgtgatctggaacatcaaacacct

SEQ ID NO: 4797 - DNA, 60 bp, Artificial Sequence
  Description of Artificial Sequence: Synthetic probe
tctaggccaaacaaacatgacaactgctggcttaacaccatcctgcagctgtttcggtac

SEQ ID NO: 4798 - DNA, 60 bp, Artificial Sequence
  Description of Artificial Sequence: Synthetic probe
ctactctaggccaaacaaacatgacaactgctggcttaacaccatcctgcagctgtttcg

SEQ ID NO: 4799 - DNA, 60 bp, Artificial Sequence
  Description of Artificial Sequence: Synthetic probe
cacaaagaagatggaattcacgctctacaacggtgagaagaaaaccttctactctaggcc

SEQ ID NO: 4800 - DNA, 60 bp, Artificial Sequence
  Description of Artificial Sequence: Synthetic probe
aacacaaagaagatggaattcacgctctacaacggtgagaagaaaaccttctactctagg

SEQ ID NO: 4801 - DNA, 60 bp, Artificial Sequence
  Description of Artificial Sequence: Synthetic probe
cactggagtgtttggtactgcctatctcgtgcctcgtcatcttttcgctgagaagtatga

SEQ ID NO: 4802 - DNA, 60 bp, Artificial Sequence
  Description of Artificial Sequence: Synthetic probe
ccgtggagaactacggcggtgagacacaagttcagagacgccaccacactgacatcggct

SEQ ID NO: 4803 - DNA, 60 bp, Artificial Sequence
  Description of Artificial Sequence: Synthetic probe
atggtgacaccatgccaggcctctttgcctacaaagccgccaccaaggcgggatactgcg

SEQ ID NO: 4804 - DNA, 60 bp, Artificial Sequence
  Description of Artificial Sequence: Synthetic probe
atcccaccgcctacaacaaggcaccattcacgagacttgctctcccttacacggcaccac

SEQ ID NO: 4805 - DNA, 60 bp, Artificial Sequence
  Description of Artificial Sequence: Synthetic probe
aaccccacagcctaccacaaggcaccgttcacgagacttgcgctcccgtacaccgcacca

SEQ ID NO: 4806 - DNA, 60 bp, Artificial Sequence
  Description of Artificial Sequence: Synthetic probe
tgcacagaggctgagtgggctactgcccacctccttcaactacggcgctgtaaaggctga

SEQ ID NO: 4807 - DNA, 60 bp, Artificial Sequence
  Description of Artificial Sequence: Synthetic probe
attcgagccacggggatccaagaacttctcgtgcgcatgaagcgtgccgagctctactgc

SEQ ID NO: 4808 - DNA, 60 bp, Artificial Sequence
  Description of Artificial Sequence: Synthetic probe
tcagagtgtttgagtttgaggtaaaagtaaaaggacaggacatgctttcagatgccgcgc

SEQ ID NO: 4809 - DNA, 60 bp, Artificial Sequence
  Description of Artificial Sequence: Synthetic probe
acagtgacttcagagtgtttgagtttgaggtaaaagtaaaaggacaggacatgctctcag

SEQ ID NO: 4810 - DNA, 60 bp, Artificial Sequence
  Description of Artificial Sequence: Synthetic probe
atccgagccacggagatccaagaacttctcgtgcgcatgaagcgtgccgagctctactgc

SEQ ID NO: 4811 - DNA, 54 bp, Artificial Sequence
  Description of Artificial Sequence: Synthetic probe
cgtgcgcatgaagcgtgctgagctctactgccccaggccactgctggcagtgga

SEQ ID NO: 4812 - DNA, 60 bp, Artificial Sequence
  Description of Artificial Sequence: Synthetic probe
ccgggttggtcaaagtcgcctcgagtttcttccggtccacacccgaagaccttgagagag

SEQ ID NO: 4813 - DNA, 60 bp, Artificial Sequence
  Description of Artificial Sequence: Synthetic probe
attctgctggccgggttggtcaaagtcgcctcgagtttcttccggtcgacacccgaagac

SEQ ID NO: 4814 - DNA, 60 bp, Artificial Sequence
  Description of Artificial Sequence: Synthetic probe
ccccgattctgctggccgggttggtcaaagtcgcctcgagtttcttccggtcgacacccg

SEQ ID NO: 4815 - DNA, 60 bp, Artificial Sequence
  Description of Artificial Sequence: Synthetic probe
tgtgggggaccacacccgcgtcttttggcagcccaacggcgcgccccggacaaccgtgtt

SEQ ID NO: 4816 - DNA, 60 bp, Artificial Sequence
  Description of Artificial Sequence: Synthetic probe
cgcgcttctccgcgcagccacatactacttctctgacttggaaattgcagtggcccacac

SEQ ID NO: 4817 - DNA, 60 bp, Artificial Sequence
  Description of Artificial Sequence: Synthetic probe
ctttcaagagtcacagggaaaatggaattcacacttcacaacggtgagaagaagaccttt

SEQ ID NO: 4818 - DNA, 58 bp, Artificial Sequence
  Description of Artificial Sequence: Synthetic probe
aagcgacccgcgtcaccgagttgctttaccggatgaagagggccgaaacgtactgccc

SEQ ID NO: 4819 - DNA, 60 bp, Artificial Sequence
  Description of Artificial Sequence: Synthetic probe
gtgctatcaaagcgacccgcgtcaccgagttgctttaccggatgaagagggccgaaacgt

SEQ ID NO: 4820 - DNA, 60 bp, Artificial Sequence
  Description of Artificial Sequence: Synthetic probe
gctgcaggtacagcaacaccgctgtacccaatgtgagaggagacctccaaacgctggctc

SEQ ID NO: 4821 - DNA, 60 bp, Artificial Sequence
  Description of Artificial Sequence: Synthetic probe
caacggtagctgcaggtacagcaacaccgctgtacccaatgtgagaggagacctccaaac

SEQ ID NO: 4822 - DNA, 60 bp, Artificial Sequence
  Description of Artificial Sequence: Synthetic probe
ggagacctcacatgggttccgaacggagcgcctgagaaggcgttggacaacaccaccaac

SEQ ID NO: 4823 - DNA, 58 bp, Artificial Sequence
  Description of Artificial Sequence: Synthetic probe
tgcctacgaccacgcagacaggggcagattcgacgcccccattggcgtcgagaaacaa

SEQ ID NO: 4824 - DNA, 60 bp, Artificial Sequence
  Description of Artificial Sequence: Synthetic probe
tgaagaggactgaactctactgcccaaggcctctcctccctgcctacgaccacgcagaca

SEQ ID NO: 4825 - DNA, 60 bp, Artificial Sequence
  Description of Artificial Sequence: Synthetic probe
tactaccggatgaagaggactgaactctactgcccaaggcctctcctccctgcctacgac

SEQ ID NO: 4826 - DNA, 51 bp, Artificial Sequence
  Description of Artificial Sequence: Synthetic probe
taacatcaaacatgagttgccgtccactttcaatttcggttacgtgaccgc

SEQ ID NO: 4827 - DNA, 60 bp, Artificial Sequence
  Description of Artificial Sequence: Synthetic probe
cgtggtgaccgtgctgttctggcttccaaatacagtaacatcaaacatgagttgccgtcc

SEQ ID NO: 4828 - DNA, 60 bp, Artificial Sequence
  Description of Artificial Sequence: Synthetic probe
cagtctactgcaattcgtggtgaccgtgctgttctggcttccaaatacagtaacatcaaa

SEQ ID NO: 4829 - DNA, 60 bp, Artificial Sequence
  Description of Artificial Sequence: Synthetic probe
acacgctttgctgtcccgtacacagcgccacaccggctgctatcaaccaggtacaacggt

SEQ ID NO: 4830 - DNA, 60 bp, Artificial Sequence
  Description of Artificial Sequence: Synthetic probe
attggtgaacacgcacgcgtgtggtggcaacccaacggagcgccgcggacaacccagctt

SEQ ID NO: 4831 - DNA, 60 bp, Artificial Sequence
  Description of Artificial Sequence: Synthetic probe
ctgtattggtgaacacgcacgcgtgtggtggcaacccaacggagcgccgcggacaaccca

SEQ ID NO: 4832 - DNA, 60 bp, Artificial Sequence
  Description of Artificial Sequence: Synthetic probe
gagacgcatgcacacagatgtggcatttgtcatggacaggttcacccacgtcctgacaga

SEQ ID NO: 4833 - DNA, 60 bp, Artificial Sequence
  Description of Artificial Sequence: Synthetic probe
aagagacgcatgcacacagatgtggcatttgtcatggacaggttcacccacgtcctgaca

SEQ ID NO: 4834 - DNA, 55 bp, Artificial Sequence
  Description of Artificial Sequence: Synthetic probe
accactagcgcaggcgagggagcggatgtcgtgacaaccgacccctcaactcacg

SEQ ID NO: 4835 - DNA, 60 bp, Artificial Sequence
  Description of Artificial Sequence: Synthetic probe
cgattcagccaacgggcgatagacacaagcaaccgctcatcgcacctgaaaaacaactgc

SEQ ID NO: 4836 - DNA, 60 bp, Artificial Sequence
  Description of Artificial Sequence: Synthetic probe
ggttcttccgattcagccaacgggcgatagacacaagcaaccgctcatcgcacctgaaaa

SEQ ID NO: 4837 - DNA, 60 bp, Artificial Sequence
  Description of Artificial Sequence: Synthetic probe
aacaggctgcccacctccttcaactacggtgctgtgaaggctgacaacatcacggagctg

SEQ ID NO: 4838 - DNA, 60 bp, Artificial Sequence
  Description of Artificial Sequence: Synthetic probe
cagtgacgcgatgaacatcatgttcgaggaggtgtttcgcacggagttcggtttccaccc

SEQ ID NO: 4839 - DNA, 60 bp, Artificial Sequence
  Description of Artificial Sequence: Synthetic probe
atgctaaccactgcagtgacgcgatgaacatcatgttcgaggaggtgtttcgcacggagt

SEQ ID NO: 4840 - DNA, 60 bp, Artificial Sequence
  Description of Artificial Sequence: Synthetic probe
ccgtgctggcgtccaagtacgctggtgcgcgacacacgcttccgtccacgttcaactttg

SEQ ID NO: 4841 - DNA, 55 bp, Artificial Sequence
  Description of Artificial Sequence: Synthetic probe
cgcgtgttttggcaacccaacggcgcacctagaaccactcagcttggggataacc

SEQ ID NO: 4842 - DNA, 60 bp, Artificial Sequence
  Description of Artificial Sequence: Synthetic probe
acccaccaacacgggctggtaggtgcgctgttgcgtgcagccacgtactacttctctgac

SEQ ID NO: 4843 - DNA, 60 bp, Artificial Sequence
  Description of Artificial Sequence: Synthetic probe
gaagcgtgcagaactctattgccccaggccgattcttccgattcagccaacgggcgatag

SEQ ID NO: 4844 - DNA, 60 bp, Artificial Sequence
  Description of Artificial Sequence: Synthetic probe
acaagaccaccttcaacgtggacctcatggacaccaaggacaagaccctagtaggtgctc

SEQ ID NO: 4845 - DNA, 60 bp, Artificial Sequence
  Description of Artificial Sequence: Synthetic probe
ccttcgttcttgaccggtttgtgaaggtccaagtgtcgggcaaccaacacacactggacg

SEQ ID NO: 4846 - DNA, 60 bp, Artificial Sequence
  Description of Artificial Sequence: Synthetic probe
cacggacgtcagtttcatcatggacagatttgtgaagataaacagccctagtcccacaca

SEQ ID NO: 4847 - DNA, 60 bp, Artificial Sequence
  Description of Artificial Sequence: Synthetic probe
ccaccactgtagagaactacggcggtgagacacaagttcagagacgccaccacactgacg

SEQ ID NO: 4848 - DNA, 60 bp, Artificial Sequence
  Description of Artificial Sequence: Synthetic probe
ccaccactgtagagaactacggcggtgagacacaagttcagagacgccaccacaccgacg

SEQ ID NO: 4849 - DNA, 60 bp, Artificial Sequence
  Description of Artificial Sequence: Synthetic probe
accaccactgtagagaactacggcggtgagacacaagttcagagacgccaccacaccgac

SEQ ID NO: 4850 - DNA, 60 bp, Artificial Sequence
  Description of Artificial Sequence: Synthetic probe
ccggagtgtttggcactgcctacctcgtgcctcgtcatcttttcgcggaaaagtatgaca

SEQ ID NO: 4851 - DNA, 57 bp, Artificial Sequence
  Description of Artificial Sequence: Synthetic probe
ccggagtgtttggcactgcctacctcgtgcctcgtcatcttttcgcggaaaagtatg

SEQ ID NO: 4852 - DNA, 60 bp, Artificial Sequence
  Description of Artificial Sequence: Synthetic probe
tgttcttggtcaatccattaccgatgtcactttcctcaaaagacacttccgcatggacta

SEQ ID NO: 4853 - DNA, 60 bp, Artificial Sequence
  Description of Artificial Sequence: Synthetic probe
cacacaggtgcttggcaacatcctacaacggtgactgtaagtacaaacccactggcacag

SEQ ID NO: 4854 - DNA, 60 bp, Artificial Sequence
  Description of Artificial Sequence: Synthetic probe
ctacggaggagaaactcagacggccagacggcttcacactgatgttgccttcgttcttga

SEQ ID NO: 4855 - DNA, 60 bp, Artificial Sequence
  Description of Artificial Sequence: Synthetic probe
taccctacgaccaagaaccattggacgtggactggcaggaccgagctggactgttcctcc

SEQ ID NO: 4856 - DNA, 60 bp, Artificial Sequence
  Description of Artificial Sequence: Synthetic probe
cgtacgtaccctacgaccaagaaccattggacgtggactggcaggaccgagctggactgt

SEQ ID NO: 4857 - DNA, 60 bp, Artificial Sequence
  Description of Artificial Sequence: Synthetic probe
tctacccatggacacccgaccctgcaaacgtgctcgcgtacgtaccctacgaccaagaac

SEQ ID NO: 4858 - DNA, 60 bp, Artificial Sequence
  Description of Artificial Sequence: Synthetic probe
cacgctgtcttcgccctcaacacatctgagggttggtatgcaattgatgatgaggtgttc

SEQ ID NO: 4859 - DNA, 60 bp, Artificial Sequence
  Description of Artificial Sequence: Synthetic probe
actgaacacgctgtcttcgccctcaacacatctgagggttggtatgcaattgatgatgag

SEQ ID NO: 4860 - DNA, 60 bp, Artificial Sequence
  Description of Artificial Sequence: Synthetic probe
ccctggctgattttcacgccggtatctttatcaaaggtactgaacacgctgtcttcgccc

SEQ ID NO: 4861 - DNA, 60 bp, Artificial Sequence
  Description of Artificial Sequence: Synthetic probe
gggtcaccatgaccctggctgattttcacgccggtatctttatcaaaggtactgaacacg

SEQ ID NO: 4862 - DNA, 60 bp, Artificial Sequence
  Description of Artificial Sequence: Synthetic probe
actggacatgatcaaacagctttctgactacaccggacttgatctctcggacggtggacc

SEQ ID NO: 4863 - DNA, 60 bp, Artificial Sequence
  Description of Artificial Sequence: Synthetic probe
accagagaacaagacactggacatgatcaaacagctttctgactacaccggacttgatct

SEQ ID NO: 4864 - DNA, 58 bp, Artificial Sequence
  Description of Artificial Sequence: Synthetic probe
cgatgagccgctcttcgagtctgagtatttgtcaccagagaacaagacactggacatg

SEQ ID NO: 4865 - DNA, 60 bp, Artificial Sequence
  Description of Artificial Sequence: Synthetic probe
cagctctttcggtacgtcgatgagccgctcttcgagtctgagtatttgtcaccagagaac

SEQ ID NO: 4866 - DNA, 55 bp, Artificial Sequence
  Description of Artificial Sequence: Synthetic probe
ttggagatcttccacaggttcagacaaacgttcaagacaaacagagaaatggaat

SEQ ID NO: 4867 - DNA, 60 bp, Artificial Sequence
  Description of Artificial Sequence: Synthetic probe
aacatcaaacacttgctgcacaccggaatcggcactgcctcgcgacccagcgaggtgtgc

SEQ ID NO: 4868 - DNA, 60 bp, Artificial Sequence
  Description of Artificial Sequence: Synthetic probe
cgttgagaatgaaaccacaagatgcattcccacgacattcaacttcggaagattgttgtg

SEQ ID NO: 4869 - DNA, 60 bp, Artificial Sequence
  Description of Artificial Sequence: Synthetic probe
aatacgagccaccgccatccacgagcttctcgtgcgcatgaagcgtgccgagctctactg

SEQ ID NO: 4870 - DNA, 60 bp, Artificial Sequence
  Description of Artificial Sequence: Synthetic probe
ccactattggcaatagaggtgtcttcacaagacaggcacaagcaaaagatcattgcaccc

SEQ ID NO: 4871 - DNA, 60 bp, Artificial Sequence
  Description of Artificial Sequence: Synthetic probe
tacaaggacgtcgtcgtctgcatggacggtgacaccatgcctggactcttcgcgtaccgc

SEQ ID NO: 4872 - DNA, 60 bp, Artificial Sequence
  Description of Artificial Sequence: Synthetic probe
gtacaaggacgtcgtcgtctgcatggacggtgacaccatgcctggactcttcgcgtaccg

SEQ ID NO: 4873 - DNA, 60 bp, Artificial Sequence
  Description of Artificial Sequence: Synthetic probe
ccatcacccgcttggccctcccttacaccgccccccaccgtgtgctggcgacagtgtaca

SEQ ID NO: 4874 - DNA, 60 bp, Artificial Sequence
  Description of Artificial Sequence: Synthetic probe
gttacagctgacaaagcagttgacgtgtactacaggatgaagcgtgctgaactgtactgc

SEQ ID NO: 4875 - DNA, 60 bp, Artificial Sequence
  Description of Artificial Sequence: Synthetic probe
tgtccgaggcctatccttacgcactacgaccacggtgacaaagatcgctacaagaccgcg

SEQ ID NO: 4876 - DNA, 60 bp, Artificial Sequence
  Description of Artificial Sequence: Synthetic probe
actgtccgaggcctatccttacgcactacgaccacggtgacaaagatcgctacaagaccg

SEQ ID NO: 4877 - DNA, 60 bp, Artificial Sequence
  Description of Artificial Sequence: Synthetic probe
atgaaacgtgctgagctttactgccccaggccactgctggcagtggaggtgacggcacag

SEQ ID NO: 4878 - DNA, 60 bp, Artificial Sequence
  Description of Artificial Sequence: Synthetic probe
aaacgcgcggaactctactgtccgcggcctctcctcacacactacgaccacgctggtaaa

SEQ ID NO: 4879 - DNA, 59 bp, Artificial Sequence
  Description of Artificial Sequence: Synthetic probe
gcgagacacacatcccaaccacttttaactacggcaggctctacacacaagccgaggtc

SEQ ID NO: 4880 - DNA, 60 bp, Artificial Sequence
  Description of Artificial Sequence: Synthetic probe
gcgcacgaacatccgcggggacctcgcaactcttgcagagaggattgcaagcgagacaca

SEQ ID NO: 4881 - DNA, 60 bp, Artificial Sequence
  Description of Artificial Sequence: Synthetic probe
tgtacaacggtgactgtaagtacaaacccgctagcacgaccccgcgcacgaacatccgcg

SEQ ID NO: 4882 - DNA, 60 bp, Artificial Sequence
  Description of Artificial Sequence: Synthetic probe
gcaacactgtacaacggtgactgtaagtacaaacccgctagcacgaccccgcgcacgaac

SEQ ID NO: 4883 - DNA, 60 bp, Artificial Sequence
  Description of Artificial Sequence: Synthetic probe
gtcacctgagaacaagacattggacatgatcaaacaactttctgattacaccaaacttga

SEQ ID NO: 4884 - DNA, 60 bp, Artificial Sequence
  Description of Artificial Sequence: Synthetic probe
gagtatctctcacctgagaacaagacattggacatgatcaaacaactttcagattacacc

SEQ ID NO: 4885 - DNA, 60 bp, Artificial Sequence
  Description of Artificial Sequence: Synthetic probe
tttgagtctgagtatctctcacctgagaacaagacattggacatgatcaaacaactttca

SEQ ID NO: 4886 - DNA, 60 bp, Artificial Sequence
  Description of Artificial Sequence: Synthetic probe
gttgggggacaacccgatggtcttctcgcacaacaaagtgacacgcttcgccatccctta

SEQ ID NO: 4887 - DNA, 60 bp, Artificial Sequence
  Description of Artificial Sequence: Synthetic probe
acatactgccccaggcctctcttggctttgacactcacccaggaccgccgtaaacaggag

SEQ ID NO: 4888 - DNA, 60 bp, Artificial Sequence
  Description of Artificial Sequence: Synthetic probe
atgaagcgcgcggagacatactgccccaggcctctcttggctttgacactcacccaggac

SEQ ID NO: 4889 - DNA, 60 bp, Artificial Sequence
  Description of Artificial Sequence: Synthetic probe
cggcgctgtaaaggctgaacccattactgagctcttgattcgcatgaagcgcgcggagac

SEQ ID NO: 4890 - DNA, 60 bp, Artificial Sequence
  Description of Artificial Sequence: Synthetic probe
tcaactacggcgctgtaaaggctgaacccattactgagctcttgattcgcatgaagcgcg

SEQ ID NO: 4891 - DNA, 56 bp, Artificial Sequence
  Description of Artificial Sequence: Synthetic probe
gcgttcgtgcttgacaggttcacccatgtgcacaccagtaagaccacattcaacgt

SEQ ID NO: 4892 - DNA, 56 bp, Artificial Sequence
  Description of Artificial Sequence: Synthetic probe
gcgttcgtgcttgacaggttcacccatgtgcacaccagtaagaccacattcaatgt

SEQ ID NO: 4893 - DNA, 60 bp, Artificial Sequence
  Description of Artificial Sequence: Synthetic probe
gggtggtacgcgattgatgacgaggacttttacccttggacgccggatccgtccgacgtt

SEQ ID NO: 4894 - DNA, 60 bp, Artificial Sequence
  Description of Artificial Sequence: Synthetic probe
gtctgcgacgtactacttctcagacctggaggttgcgcttgttcacacgggcccagccac

SEQ ID NO: 4895 - DNA, 60 bp, Artificial Sequence
  Description of Artificial Sequence: Synthetic probe
gtctgcgacgtactacttctcagacctggaggttgcgcttgtccacacaggcccagccac

SEQ ID NO: 4896 - DNA, 60 bp, Artificial Sequence
  Description of Artificial Sequence: Synthetic probe
gtctgcgacgtactacttctcagacctggaggttgcgcttgtccacacaggcccagtcac

SEQ ID NO: 4897 - DNA, 60 bp, Artificial Sequence
  Description of Artificial Sequence: Synthetic probe
tggaggtgtcgtcacaagacagacacaaacagaagatcattgcacctgcaaaacaactcc

SEQ ID NO: 4898 - DNA, 60 bp, Artificial Sequence
  Description of Artificial Sequence: Synthetic probe
ccctggacgccggatccgtccgacgttctggtgtttgtcccgtacgatcaagaaccactt

SEQ ID NO: 4899 - DNA, 60 bp, Artificial Sequence
  Description of Artificial Sequence: Synthetic probe
acatactgccctaggcctctgctagctcttgacaccactcaggaccgccgtaaacaggag

SEQ ID NO: 4900 - DNA, 60 bp, Artificial Sequence
  Description of Artificial Sequence: Synthetic probe
ttgtactgccccaggccacttctcccggcttacgaacacgcaaaccgggacagattcgac

SEQ ID NO: 4901 - DNA, 60 bp, Artificial Sequence
  Description of Artificial Sequence: Synthetic probe
attgtctcaacactggcgttggcaccagcactcgccccagcgagatctgtgtgatcaacg

SEQ ID NO: 4902 - DNA, 60 bp, Artificial Sequence
  Description of Artificial Sequence: Synthetic probe
tgcctaccacaaggaaccattcacgagacttgcgcttccctacactgctccgcaccgcgt

SEQ ID NO: 4903 - DNA, 60 bp, Artificial Sequence
  Description of Artificial Sequence: Synthetic probe
cggtgctgtaaaggctgacaccatcacggagctgttgatccgcatgaaacgcgcggagac

SEQ ID NO: 4904 - DNA, 60 bp, Artificial Sequence
  Description of Artificial Sequence: Synthetic probe
acggtgctatcaaggctacacgggtgactgaactgctttaccgcatgaagagggctgaga

SEQ ID NO: 4905 - DNA, 60 bp, Artificial Sequence
  Description of Artificial Sequence: Synthetic probe
cggtggcgagacacaagttcagagaaggcaccatacggacattggctttattatggacag

SEQ ID NO: 4906 - DNA, 60 bp, Artificial Sequence
  Description of Artificial Sequence: Synthetic probe
ctacggtggcgagacacaagttcagagaaggcaccatacggacattggctttattatgga

SEQ ID NO: 4907 - DNA, 60 bp, Artificial Sequence
  Description of Artificial Sequence: Synthetic probe
gctggcattttcttgaaaggacaagaacacgctgtgtttgcctgtgtcacctccaacggg

SEQ ID NO: 4908 - DNA, 60 bp, Artificial Sequence
  Description of Artificial Sequence: Synthetic probe
gaggctgatggggcaactgcccacctccttcaactacggcgctgtaaaggctgacaccat

SEQ ID NO: 4909 - DNA, 60 bp, Artificial Sequence
  Description of Artificial Sequence: Synthetic probe
ccacggacgacaagactcttgacgaggcggaaaagaaccctctagagaccagcggtgcca

SEQ ID NO: 4910 - DNA, 60 bp, Artificial Sequence
  Description of Artificial Sequence: Synthetic probe
acaaccgctaccggggaatcagcagaccctgtcaccaccaccgtggagaactacggcggt

SEQ ID NO: 4911 - DNA, 60 bp, Artificial Sequence
  Description of Artificial Sequence: Synthetic probe
accacggttgagaactacggaggagaaactcagacagccagacggcttcacactgacgtt

SEQ ID NO: 4912 - DNA, 60 bp, Artificial Sequence
  Description of Artificial Sequence: Synthetic probe
acccaacgcgtcacaccacgccgtggcgacatggccgtgttgtcacaacgcgttgagaat

SEQ ID NO: 4913 - DNA, 60 bp, Artificial Sequence
  Description of Artificial Sequence: Synthetic probe
ccacagtgtataacggcaactgcaagtattccaaaacccaacgcgtcacaccacgccgtg

SEQ ID NO: 4914 - DNA, 60 bp, Artificial Sequence
  Description of Artificial Sequence: Synthetic probe
ccacagtgtacaacggcaactgcaagtattccaaaacccaacgcgtcacaccacgccgtg

SEQ ID NO: 4915 - DNA, 60 bp, Artificial Sequence
  Description of Artificial Sequence: Synthetic probe
cacacagggttcttgccacagtgtacaacggcaactgcaagtattccaaaacccaacgcg

SEQ ID NO: 4916 - DNA, 60 bp, Artificial Sequence
  Description of Artificial Sequence: Synthetic probe
cacacagggttcttgccacagtgtataacggcaactgcaagtattccaaaacccaacgcg

SEQ ID NO: 4917 - DNA, 60 bp, Artificial Sequence
  Description of Artificial Sequence: Synthetic probe
agcggatgcccaccgaccgacttgcaaaagatggtcatggcaaacgtaaagcccgttgag

SEQ ID NO: 4918 - DNA, 60 bp, Artificial Sequence
  Description of Artificial Sequence: Synthetic probe
tgatgtgtactacaggatgaagcgtgctgaactttactgccccaggccacttctcccggc

SEQ ID NO: 4919 - DNA, 60 bp, Artificial Sequence
  Description of Artificial Sequence: Synthetic probe
ttgatgtgtactacaggatgaagcgtgctgaactttactgccccaggccacttctcccgg

SEQ ID NO: 4920 - DNA, 60 bp, Artificial Sequence
  Description of Artificial Sequence: Synthetic probe
acggggcaccgcggacaaacacgcttcgcgacaaccccatggtgttttcacacaacaacg

SEQ ID NO: 4921 - DNA, 60 bp, Artificial Sequence
  Description of Artificial Sequence: Synthetic probe
cacacaggtgtttggcaacgtcatacaacggtgactgtaagtacaagcccgctggcacag

SEQ ID NO: 4922 - DNA, 60 bp, Artificial Sequence
  Description of Artificial Sequence: Synthetic probe
acccaacggcataccacaaggcaccgctcacccggcttgcactgccttacacggcaccac

SEQ ID NO: 4923 - DNA, 60 bp, Artificial Sequence
  Description of Artificial Sequence: Synthetic probe
ggtgctctcctgagggcgtcaacctactacttctgtgacctggaaattgcctgtgtgggg

SEQ ID NO: 4924 - DNA, 60 bp, Artificial Sequence
  Description of Artificial Sequence: Synthetic probe
aggtgccttcctgagggcctccacctactacttctgtgacctggaaattgcctgtgtagg

SEQ ID NO: 4925 - DNA, 60 bp, Artificial Sequence
  Description of Artificial Sequence: Synthetic probe
gtaggtgctctcctgagggcgtcaacctactacttctgtgacctggaaattgcctgtgtg

SEQ ID NO: 4926 - DNA, 60 bp, Artificial Sequence
  Description of Artificial Sequence: Synthetic probe
tgccagcgtacgaccaccagtcacgcgacaggtttgatgcgcccattggcgtggagaagc

SEQ ID NO: 4927 - DNA, 60 bp, Artificial Sequence
  Description of Artificial Sequence: Synthetic probe
ggacggagccgagactttcatcgtcggcactcactccgcaggcggcaacggagttggata

SEQ ID NO: 4928 - DNA, 60 bp, Artificial Sequence
  Description of Artificial Sequence: Synthetic probe
gatgacaagactcttgacgaggcggaaaagaaccctctggagaccagtggtgccagcact

SEQ ID NO: 4929 - DNA, 60 bp, Artificial Sequence
  Description of Artificial Sequence: Synthetic probe
ggatctacacggaggcggaagtcgacgtgtatgtgaggatgaaacgggcggagctttatt

SEQ ID NO: 4930 - DNA, 60 bp, Artificial Sequence
  Description of Artificial Sequence: Synthetic probe
aagtacaaacccactggcacacctccgcgtgaaaacatccgcggagatctcgcgaccctc

SEQ ID NO: 4931 - DNA, 56 bp, Artificial Sequence
  Description of Artificial Sequence: Synthetic probe
gctctcccctacaccgcgccacaccgcgtgttggcgacagtgtacaacgggacgag

SEQ ID NO: 4932 - DNA, 60 bp, Artificial Sequence
  Description of Artificial Sequence: Synthetic probe
acgtactacttctcagacctggaggttgcgcttgtccacacaggcccagtcacctgggtg

SEQ ID NO: 4933 - DNA, 60 bp, Artificial Sequence
  Description of Artificial Sequence: Synthetic probe
ctgttacgtgccgctacgtactacttctccgacctggagattgtggtgcgtcacgacggc

SEQ ID NO: 4934 - DNA, 60 bp, Artificial Sequence
  Description of Artificial Sequence: Synthetic probe
aaatggaccggatgggttcccaacggctgcccgcacactgaacgcgtggaggacaaccca

SEQ ID NO: 4935 - DNA, 60 bp, Artificial Sequence
  Description of Artificial Sequence: Synthetic probe
aaatggaccggatgggttcccaacggctgcccgctcactgaacgcgtggaggacaaccca

SEQ ID NO: 4936 - DNA, 60 bp, Artificial Sequence
  Description of Artificial Sequence: Synthetic probe
gaggttactggccttgagctgcacgagggtggaccaccggctctcgtcatttggaacatc

SEQ ID NO: 4937 - DNA, 60 bp, Artificial Sequence
  Description of Artificial Sequence: Synthetic probe
agaggttactggccttgagctgcacgagggtggaccaccggctctcgtcatttggaacat

SEQ ID NO: 4938 - DNA, 60 bp, Artificial Sequence
  Description of Artificial Sequence: Synthetic probe
cttgacaccactcaggaccgccgtaaacaggagatcattgcacctgagaagcagatgctg

SEQ ID NO: 4939 - DNA, 60 bp, Artificial Sequence
  Description of Artificial Sequence: Synthetic probe
ctttggtgcccaacggtgcccccgaagcagccctctcaaacaccagcaaccccactgcct

SEQ ID NO: 4940 - DNA, 60 bp, Artificial Sequence
  Description of Artificial Sequence: Synthetic probe
aactttggtgcagttaaagcagaaacaatcactgagctgctggtgcgcatgaagcgtgca

SEQ ID NO: 4941 - DNA, 60 bp, Artificial Sequence
  Description of Artificial Sequence: Synthetic probe
gctgagttatactgtcccagaccacttcacccggcctacgatcacccaaaccgggacagg

SEQ ID NO: 4942 - DNA, 60 bp, Artificial Sequence
  Description of Artificial Sequence: Synthetic probe
aggatgaagcgtgctgagttatactgtcccagaccacttcacccggcctacgatcaccca

SEQ ID NO: 4943 - DNA, 60 bp, Artificial Sequence
  Description of Artificial Sequence: Synthetic probe
cgtggtgatcgcgctgtgttggcagccaagtacgccaacacacgacacgcacttccttca

SEQ ID NO: 4944 - DNA, 60 bp, Artificial Sequence
  Description of Artificial Sequence: Synthetic probe
catccgtggtgatcgcgctgtgttggcagccaagtacgccaacacacgacacgcacttcc

SEQ ID NO: 4945 - DNA, 60 bp, Artificial Sequence
  Description of Artificial Sequence: Synthetic probe
cccggtttgccgtgccatacactgcaccgcaccgcttgttgtcaaccgtctacaatggtg

SEQ ID NO: 4946 - DNA, 60 bp, Artificial Sequence
  Description of Artificial Sequence: Synthetic probe
acaacaatgtcacccggtttgccgtgccatacactgcaccgcaccgcttgttgtcaaccg

SEQ ID NO: 4947 - DNA, 60 bp, Artificial Sequence
  Description of Artificial Sequence: Synthetic probe
ggcgcgcctaggaccacacagcttggggataacccgatggttttctcacacaacaatgtc

SEQ ID NO: 4948 - DNA, 60 bp, Artificial Sequence
  Description of Artificial Sequence: Synthetic probe
cggcgcgcctaggaccacacagcttggggataacccgatggttttctcacacaacaatgt

SEQ ID NO: 4949 - DNA, 60 bp, Artificial Sequence
  Description of Artificial Sequence: Synthetic probe
acaacacacgctaccgtccacattcaactttggttacgttacagctgacaaagcagttga

SEQ ID NO: 4950 - DNA, 60 bp, Artificial Sequence
  Description of Artificial Sequence: Synthetic probe
tgggaagcaacacacgctaccgtccacattcaactttggtcatgtcacagctgacaaagc

SEQ ID NO: 4951 - DNA, 60 bp, Artificial Sequence
  Description of Artificial Sequence: Synthetic probe
acacacaggcccggtcacctgggtgcccaacggctcgcccaaggatgccctagacaacca

SEQ ID NO: 4952 - DNA, 60 bp, Artificial Sequence
  Description of Artificial Sequence: Synthetic probe
tggcagcctaacggggcaccgcggaccacccaacctggtgataatcccatggttttcgcc

SEQ ID NO: 4953 - DNA, 60 bp, Artificial Sequence
  Description of Artificial Sequence: Synthetic probe
cggccgcgccctgacagacagtgacttcagagtgtttgagttcgaggtaaaagtaaaagg

SEQ ID NO: 4954 - DNA, 60 bp, Artificial Sequence
  Description of Artificial Sequence: Synthetic probe
tacagcaaaaccgccaccgccatccgtggagaccgcgcggcacttgcggcaaagtacgct

SEQ ID NO: 4955 - DNA, 60 bp, Artificial Sequence
  Description of Artificial Sequence: Synthetic probe
cttacacgaaacacaggaaagatggaattcacacttcacaacggtgagaagaagaccttc

SEQ ID NO: 4956 - DNA, 58 bp, Artificial Sequence
  Description of Artificial Sequence: Synthetic probe
atgaacacaactgactgttttaccgctctgctgcacgctctcagagagatcaaaacgc

SEQ ID NO: 4957 - DNA, 60 bp, Artificial Sequence
  Description of Artificial Sequence: Synthetic probe
ccctcctgagggcgtccacctactacttctgtgacctggaaattgcatgtgtgggcacgc

SEQ ID NO: 4958 - DNA, 60 bp, Artificial Sequence
  Description of Artificial Sequence: Synthetic probe
tactctacagaatgaagagagccgagacgtactgtcccaggccccttctcgccatccaac

SEQ ID NO: 4959 - DNA, 60 bp, Artificial Sequence
  Description of Artificial Sequence: Synthetic probe
tgaactactctacagaatgaagagagccgagacgtactgccccaggcctcttctcgccat

SEQ ID NO: 4960 - DNA, 60 bp, Artificial Sequence
  Description of Artificial Sequence: Synthetic probe
ctcgtgtgactgaactactctacagaatgaagagagccgagacgtactgtcccaggcccc

SEQ ID NO: 4961 - DNA, 60 bp, Artificial Sequence
  Description of Artificial Sequence: Synthetic probe
gcctacctccttcaacttcggtgccattaaggcaactcgtgtgactgaactactctacag

SEQ ID NO: 4962 - DNA, 60 bp, Artificial Sequence
  Description of Artificial Sequence: Synthetic probe
actctgcctacctccttcaacttcggtgccattaaggcaactcgtgtgactgaactactc

SEQ ID NO: 4963 - DNA, 60 bp, Artificial Sequence
  Description of Artificial Sequence: Synthetic probe
ggcagaaagaactctgcccacctccttcaacttcggtgccattaaggcaactcgtgtgac

SEQ ID NO: 4964 - DNA, 60 bp, Artificial Sequence
  Description of Artificial Sequence: Synthetic probe
ggcactgccttacacggctccacaccgcgtcttagcgaccgtctacaacgggagcagtaa

SEQ ID NO: 4965 - DNA, 60 bp, Artificial Sequence
  Description of Artificial Sequence: Synthetic probe
ccgctcacacggctggcactgccttacacggctccacaccgcgtcttagcgaccgtctac

SEQ ID NO: 4966 - DNA, 60 bp, Artificial Sequence
  Description of Artificial Sequence: Synthetic probe
accgctcacacggctggcactgccttacacggctccacaccgcgtcttagcgaccgtcta

SEQ ID NO: 4967 - DNA, 60 bp, Artificial Sequence
  Description of Artificial Sequence: Synthetic probe
gacaacaccaccaacccaacagcttaccacaaggaaccgctcacacggctggcactgcct

SEQ ID NO: 4968 - DNA, 60 bp, Artificial Sequence
  Description of Artificial Sequence: Synthetic probe
ggacaacactaccaacccaacagcttaccacaaggaaccgctcacacggctggcactgcc

SEQ ID NO: 4969 - DNA, 60 bp, Artificial Sequence
  Description of Artificial Sequence: Synthetic probe
ctgagacagcactggacaacactaccaacccaacagcttaccacaaggaaccgctcacac

SEQ ID NO: 4970 - DNA, 60 bp, Artificial Sequence
  Description of Artificial Sequence: Synthetic probe
cccgagacagcactggacaacaccaccaacccaacagcttaccacaaggaaccgctcaca

SEQ ID NO: 4971 - DNA, 60 bp, Artificial Sequence
  Description of Artificial Sequence: Synthetic probe
caactacggtgctgtgaaggctgaaaacatcaccgagctcttgctccgcatgaagcgtgc

SEQ ID NO: 4972 - DNA, 60 bp, Artificial Sequence
  Description of Artificial Sequence: Synthetic probe
ctccttcaactacggtgctgtgaaggctgaaaacatcacggagctgttgatccgcatgaa

SEQ ID NO: 4973 - DNA, 60 bp, Artificial Sequence
  Description of Artificial Sequence: Synthetic probe
taccgtcgagaactacggaggagaaacacaaactcaacgtcgtcaccacactgacgttgc

SEQ ID NO: 4974 - DNA, 60 bp, Artificial Sequence
  Description of Artificial Sequence: Synthetic probe
accaccactgccggggagtctgcagaccctgtcaccaccactgttgagaactacggtggt

SEQ ID NO: 4975 - DNA, 60 bp, Artificial Sequence
  Description of Artificial Sequence: Synthetic probe
gctcctcgtgcgcatgaagcgtgccgaactctactgccccaggccactgttggcagtgga

SEQ ID NO: 4976 - DNA, 60 bp, Artificial Sequence
  Description of Artificial Sequence: Synthetic probe
tttggcactcccctacaccgccccccaccgtgtgctggcaacagtgtacaacgggaagac

SEQ ID NO: 4977 - DNA, 60 bp, Artificial Sequence
  Description of Artificial Sequence: Synthetic probe
tccttacaccgcgccacaccgcgtgctggcaacggtgtacaacgggacgagcaagtactc

SEQ ID NO: 4978 - DNA, 60 bp, Artificial Sequence
  Description of Artificial Sequence: Synthetic probe
acgtcattgacctcatgcaaacccaccaacacgggctggtgggtgccctgttgcgtgctg

SEQ ID NO: 4979 - DNA, 60 bp, Artificial Sequence
  Description of Artificial Sequence: Synthetic probe
cccactgcctacaacaaggcaccattcacgagactcgctctcccgtacacggcaccacac

SEQ ID NO: 4980 - DNA, 60 bp, Artificial Sequence
  Description of Artificial Sequence: Synthetic probe
gctgctcgtgcgcatgaagcgtgccgaactctactgccccagaccattgttggcggtgga

SEQ ID NO: 4981 - DNA, 60 bp, Artificial Sequence
  Description of Artificial Sequence: Synthetic probe
ggacggctgcccacctccttcaactacggcgctgtaaaggctgaaaccatcactgagctc

SEQ ID NO: 4982 - DNA, 60 bp, Artificial Sequence
  Description of Artificial Sequence: Synthetic probe
cagctgcccacctccttcaactacggcgctgtaaaggctgaaaccattactgagctcttg

SEQ ID NO: 4983 - DNA, 60 bp, Artificial Sequence
  Description of Artificial Sequence: Synthetic probe
actgcggaggagccgtactcgcgaaggacggagccgagactttcatcgtcggcactcact

SEQ ID NO: 4984 - DNA, 57 bp, Artificial Sequence
  Description of Artificial Sequence: Synthetic probe
acagctgacaaagctgttgacgtctactacaggatgaagcgtgctgaactgtactgc

SEQ ID NO: 4985 - DNA, 60 bp, Artificial Sequence
  Description of Artificial Sequence: Synthetic probe
cggggcgacctagggcctctgggggcgagggtcgccgcgcagcttcctgcttcctttaac

SEQ ID NO: 4986 - DNA, 60 bp, Artificial Sequence
  Description of Artificial Sequence: Synthetic probe
cttgatctcatgcagatcccctcacacacgctggttggagcactgcttcggtctgcgacg

SEQ ID NO: 4987 - DNA, 56 bp, Artificial Sequence
  Description of Artificial Sequence: Synthetic probe
agcttacgggtgacaggcacaagcaaccgatcatcgcacctgcaaaacagctgcta

SEQ ID NO: 4988 - DNA, 53 bp, Artificial Sequence
  Description of Artificial Sequence: Synthetic probe
cacgtactacttttctgatttggaaatagcagtgacccacactgggaagctta

SEQ ID NO: 4989 - DNA, 60 bp, Artificial Sequence
  Description of Artificial Sequence: Synthetic probe
gccccaggccgctgttggcagtggaggtgtcgtcacaagacagacacaaacagaagatca

SEQ ID NO: 4990 - DNA, 60 bp, Artificial Sequence
  Description of Artificial Sequence: Synthetic probe
tgagattgttgccctatgtttgacccttttggcaaacatagtgatcatgatccgcgagac

SEQ ID NO: 4991 - DNA, 60 bp, Artificial Sequence
  Description of Artificial Sequence: Synthetic probe
acatactacttctcagacctggaggttgcgcttgttcacacgggcccagccacctgggtg

SEQ ID NO: 4992 - DNA, 60 bp, Artificial Sequence
  Description of Artificial Sequence: Synthetic probe
ggtgccctgttacgcgctgccacgtactacttctccgacttggagattgtggtgcgccac

SEQ ID NO: 4993 - DNA, 60 bp, Artificial Sequence
  Description of Artificial Sequence: Synthetic probe
cgggtggtacgcaattgatgacgaggacttttacccttggacgccggacccgtccaacgt

SEQ ID NO: 4994 - DNA, 60 bp, Artificial Sequence
  Description of Artificial Sequence: Synthetic probe
cgggtggtacgcaattgatgacgaggacttttacccttggacgccggacccgtctgacgt

SEQ ID NO: 4995 - DNA, 60 bp, Artificial Sequence
  Description of Artificial Sequence: Synthetic probe
tgtgtcacctccaatgggtggtatgcgattgatgacgaggacttttacccttggacgccg

SEQ ID NO: 4996 - DNA, 60 bp, Artificial Sequence
  Description of Artificial Sequence: Synthetic probe
ctgtgtcacgtccgacgggtggtacgcaattgatgacgaggacttttacccttggacgcc

SEQ ID NO: 4997 - DNA, 60 bp, Artificial Sequence
  Description of Artificial Sequence: Synthetic probe
ctgtgtcacatccgacgggtggtacgcaattgatgacgaggacttttacccttggacgcc

SEQ ID NO: 4998 - DNA, 60 bp, Artificial Sequence
  Description of Artificial Sequence: Synthetic probe
cgtctacaatggtgaatgtgaatacaacacgcgcgtcaccgccatccgtggtgatcgcgc

SEQ ID NO: 4999 - DNA, 60 bp, Artificial Sequence
  Description of Artificial Sequence: Synthetic probe
cattcacagcgccgcacagagtcgtgggcacatcgtacaacggcaactgcaagtaccaag

SEQ ID NO: 5000 - DNA, 60 bp, Artificial Sequence
  Description of Artificial Sequence: Synthetic probe
tttggtgcagttcgagccacgaccatccacgagcttctcgtgcgcatgaagcgtgctgag

SEQ ID NO: 5001 - DNA, 60 bp, Artificial Sequence
  Description of Artificial Sequence: Synthetic probe
actaccgccaccggggagtcagcagaccctgtcaccaccaccgtggagaactacggcggt

SEQ ID NO: 5002 - DNA, 60 bp, Artificial Sequence
  Description of Artificial Sequence: Synthetic probe
gggcctccacctactacttctgtgacctggaaattgcctgtgtaggcgaacacgctcgtg

SEQ ID NO: 5003 - DNA, 60 bp, Artificial Sequence
  Description of Artificial Sequence: Synthetic probe
tgagggcctccacctactacttctgtgacctggaaattgcctgtgtaggcgaacacgctc

SEQ ID NO: 5004 - DNA, 60 bp, Artificial Sequence
  Description of Artificial Sequence: Synthetic probe
ctgacaccatcactgagcttttgatccgcatgaaacgcgcggagacatactgtcccaggc

SEQ ID NO: 5005 - DNA, 60 bp, Artificial Sequence
  Description of Artificial Sequence: Synthetic probe
gccactgctaccagtggaagtgctgtcgcaagacaggtacaaacaaaagatcattgcacc

SEQ ID NO: 5006 - DNA, 60 bp, Artificial Sequence
  Description of Artificial Sequence: Synthetic probe
aggccactgctaccagtggaagtgctgtcgcaagacaggtacaaacaaaagatcattgca

SEQ ID NO: 5007 - DNA, 60 bp, Artificial Sequence
  Description of Artificial Sequence: Synthetic probe
tctcgtgcgcatgaaacgtgccgagctctattgccccaggccactgctaccagtggaagt

SEQ ID NO: 5008 - DNA, 60 bp, Artificial Sequence
  Description of Artificial Sequence: Synthetic probe
ccgcacagctccctgcctcttttaactttggtgcaattcgggccacgaacatccaggagc

SEQ ID NO: 5009 - DNA, 60 bp, Artificial Sequence
  Description of Artificial Sequence: Synthetic probe
tgccgcacagctccctgcctcttttaactttggtgcaattcgggccacgaacatccagga

SEQ ID NO: 5010 - DNA, 60 bp, Artificial Sequence
  Description of Artificial Sequence: Synthetic probe
agacggggtgacctcgggtctcttgcggcacgggttgccgcacagctccctgcctctttt

SEQ ID NO: 5011 - DNA, 60 bp, Artificial Sequence
  Description of Artificial Sequence: Synthetic probe
acaacgggtggcggcagacggggtgacctcgggtctcttgcggcacgggttgccgcacag

SEQ ID NO: 5012 - DNA, 60 bp, Artificial Sequence
  Description of Artificial Sequence: Synthetic probe
tttccaacacgagcaaccccactgtctaccccaagcaaccgttcacgaggctcgcactcc

SEQ ID NO: 5013 - DNA, 60 bp, Artificial Sequence
  Description of Artificial Sequence: Synthetic probe
cagccctttccaacacgagcaaccccactgtctaccccaagcaaccgttcacgaggctcg

SEQ ID NO: 5014 - DNA, 60 bp, Artificial Sequence
  Description of Artificial Sequence: Synthetic probe
caatctaacgtgggtacccaatggagcacccgaggcagccctttccaacacgagcaaccc

SEQ ID NO: 5015 - DNA, 60 bp, Artificial Sequence
  Description of Artificial Sequence: Synthetic probe
ggtacgccatgaaggcaatctaacgtgggtacccaatggagcacccgaggcagccctttc

SEQ ID NO: 5016 - DNA, 60 bp, Artificial Sequence
  Description of Artificial Sequence: Synthetic probe
gccccacacatgtcattgaccttatgcagacccaccagcacgcgttggtgggcgctctgc

SEQ ID NO: 5017 - DNA, 51 bp, Artificial Sequence
  Description of Artificial Sequence: Synthetic probe
gccccacacatgtcattgaccttatgcagacccaccagcacgcgttggtgg

SEQ ID NO: 5018 - DNA, 50 bp, Artificial Sequence
  Description of Artificial Sequence: Synthetic probe
ccaaacctgccaaacaactgtgcaacttcgacctgttaaagttggccgga

SEQ ID NO: 5019 - DNA, 60 bp, Artificial Sequence
  Description of Artificial Sequence: Synthetic probe
acaagcaaccccactgcctaccacaaggaaccatttacgaggctcgcgctcccctacacc

SEQ ID NO: 5020 - DNA, 60 bp, Artificial Sequence
  Description of Artificial Sequence: Synthetic probe
tacaagcaaccccactgcctaccacaaggaaccatttacgaggctcgcgctcccctacac

SEQ ID NO: 5021 - DNA, 60 bp, Artificial Sequence
  Description of Artificial Sequence: Synthetic probe
accaaggagaaagcacttgtgggcgcaatcctgcgcgctgccacgtactacttctcggac

SEQ ID NO: 5022 - DNA, 60 bp, Artificial Sequence
  Description of Artificial Sequence: Synthetic probe
tgggtgccctcctcagggcgtcaacctactacttttgtgacctggagattgcttgcgttg

SEQ ID NO: 5023 - DNA, 60 bp, Artificial Sequence
  Description of Artificial Sequence: Synthetic probe
gttgcccgcaacgccagaaatggcgtcacactgctatcacgcagagtgggatactggcct

SEQ ID NO: 5024 - DNA, 60 bp, Artificial Sequence
  Description of Artificial Sequence: Synthetic probe
tacatcccaccgggcattcaccctctgcccgcaacgccagaaatggcgtcacactgctac

SEQ ID NO: 5025 - DNA, 60 bp, Artificial Sequence
  Description of Artificial Sequence: Synthetic probe
gccttcgttcttgacaggtttgtgaaactcactgcacccaagaacactcagatccttgac

SEQ ID NO: 5026 - DNA, 60 bp, Artificial Sequence
  Description of Artificial Sequence: Synthetic probe
gcggagctctactgccccagaccactgttggcaatagaggtgtcttcgcaagacaggcac

SEQ ID NO: 5027 - DNA, 60 bp, Artificial Sequence
  Description of Artificial Sequence: Synthetic probe
cgcgtgtactggcaacccaacggcgcacccagaaccagagagctcggggacaacccgatg

SEQ ID NO: 5028 - DNA, 60 bp, Artificial Sequence
  Description of Artificial Sequence: Synthetic probe
cgcgtgtactggcaacccaacggcgcacccagaaccaacgagctcggggacaacccgatg

SEQ ID NO: 5029 - DNA, 60 bp, Artificial Sequence
  Description of Artificial Sequence: Synthetic probe
atctcgtgcctcgtcatcttttcgcagagaagtatgacaagatcatgattgacggcagag

SEQ ID NO: 5030 - DNA, 60 bp, Artificial Sequence
  Description of Artificial Sequence: Synthetic probe
gggacaggtttgacagccccattggtgttgagaagcaactgtgcaacttcgacctgttga

SEQ ID NO: 5031 - DNA, 59 bp, Artificial Sequence
  Description of Artificial Sequence: Synthetic probe
ctgcgacgtactacttctcagacctggaggttgcgcttgtccacacaggcccagccacc

SEQ ID NO: 5032 - DNA, 54 bp, Artificial Sequence
  Description of Artificial Sequence: Synthetic probe
actgtccgcgccctctcctgacacactacgaccacggtgggaaggatcgctaca

SEQ ID NO: 5033 - DNA, 60 bp, Artificial Sequence
  Description of Artificial Sequence: Synthetic probe
gcaggacagacacaagcaaaagatcattgcacctgcaaagcagctcttgaactttgacct

SEQ ID NO: 5034 - DNA, 60 bp, Artificial Sequence
  Description of Artificial Sequence: Synthetic probe
cgcaggacagacacaagcaaaagatcattgcacctgcaaagcaactcctgaacttcgacc

SEQ ID NO: 5035 - DNA, 60 bp, Artificial Sequence
  Description of Artificial Sequence: Synthetic probe
tcgcaggacagacacaagcaaaagatcattgcacctgcaaagcaactcctgaacttcgac

SEQ ID NO: 5036 - DNA, 60 bp, Artificial Sequence
  Description of Artificial Sequence: Synthetic probe
gtgctgaactttactgccccagaccacttctcccggcctacgatcacgcagaccgggata

SEQ ID NO: 5037 - DNA, 60 bp, Artificial Sequence
  Description of Artificial Sequence: Synthetic probe
aaccccaccgcctacaacaaagcgccgttcacgagacttggcctcccctacactgcgcca

SEQ ID NO: 5038 - DNA, 60 bp, Artificial Sequence
  Description of Artificial Sequence: Synthetic probe
gccaccgttgagaactacggcggcgagacacaggtccagaggcgccaacacacggacgtc

SEQ ID NO: 5039 - DNA, 51 bp, Artificial Sequence
  Description of Artificial Sequence: Synthetic probe
ggcgctcccctacaccgccccccaccgtgtgctggcgacagtgtacaacgg

SEQ ID NO: 5040 - DNA, 60 bp, Artificial Sequence
  Description of Artificial Sequence: Synthetic probe
ttaagtcactgtttctttcacggacaacagggaaaatggaattcacacttcacaacggtg

SEQ ID NO: 5041 - DNA, 60 bp, Artificial Sequence
  Description of Artificial Sequence: Synthetic probe
acgttctcagagagattaagtcactgtttctttcacggacaacagggaaaatggaattca

SEQ ID NO: 5042 - DNA, 59 bp, Artificial Sequence
  Description of Artificial Sequence: Synthetic probe
cgcatgctcggcatttgccgacatcgttcaactttggtgcagttaaagcagaaacaatc

SEQ ID NO: 5043 - DNA, 51 bp, Artificial Sequence
  Description of Artificial Sequence: Synthetic probe
tactaccggatgaagagggctgagctgtactgtccacgcgccttacgggtt

SEQ ID NO: 5044 - DNA, 60 bp, Artificial Sequence
  Description of Artificial Sequence: Synthetic probe
cggcaccacacggagttcttgccacagtttacaatggaaactgcaaatactccaagaccc

SEQ ID NO: 5045 - DNA, 60 bp, Artificial Sequence
  Description of Artificial Sequence: Synthetic probe
gtactacttctgtgaccttgaagttgccgtcttaggcactgggaaaaaatgggtcgcgtg

SEQ ID NO: 5046 - DNA, 60 bp, Artificial Sequence
  Description of Artificial Sequence: Synthetic probe
cgaaggaacacacgctagtgggcgcaatcctgcgttctgctacgtactacttctgtgacc

SEQ ID NO: 5047 - DNA, 60 bp, Artificial Sequence
  Description of Artificial Sequence: Synthetic probe
acaggttcacacacattggtacgatcaccggctcaaaaaccattgacctcatggacacga

SEQ ID NO: 5048 - DNA, 60 bp, Artificial Sequence
  Description of Artificial Sequence: Synthetic probe
agctgtggacacaccgcgccgccagcacaccaacgtggagttcctgctggacaggttcac

SEQ ID NO: 5049 - DNA, 60 bp, Artificial Sequence
  Description of Artificial Sequence: Synthetic probe
caagttcacgttcacggtaccgtacatgtcagcagcagactttgcctatacatattgtga

SEQ ID NO: 5050 - DNA, 60 bp, Artificial Sequence
  Description of Artificial Sequence: Synthetic probe
ctgaatctgcacttcatgtacaccggtcccacgcagtcaaaagcacgcttcatggttgcg

SEQ ID NO: 5051 - DNA, 60 bp, Artificial Sequence
  Description of Artificial Sequence: Synthetic probe
acgtggcagggctcgcgcagtactacgcccaatacagtggttctctgaatctgcacttca

SEQ ID NO: 5052 - DNA, 60 bp, Artificial Sequence
  Description of Artificial Sequence: Synthetic probe
ggacttcgacggcacaccgtacgtcaagaccaagcacaacagtggcagcaagatactcac

SEQ ID NO: 5053 - DNA, 60 bp, Artificial Sequence
  Description of Artificial Sequence: Synthetic probe
ccggcaggttcaccaacctgttggacgtcgctgaagcgtgcccaactttcttggacttcg

SEQ ID NO: 5054 - DNA, 60 bp, Artificial Sequence
  Description of Artificial Sequence: Synthetic probe
gaccctatctacggcctagtgtccaacccgccacgcacagcgtttcccggcaggttcacc

SEQ ID NO: 5055 - DNA, 60 bp, Artificial Sequence
  Description of Artificial Sequence: Synthetic probe
gaccccaagaccgcggaccctatctacggcctagtgtccaacccgccacgcacagcgttt

SEQ ID NO: 5056 - DNA, 60 bp, Artificial Sequence
  Description of Artificial Sequence: Synthetic probe
cgttgaggtgtacgcaaacatcgcaccaaccaacgtgtatgttgctggagagaagccgac

SEQ ID NO: 5057 - DNA, 60 bp, Artificial Sequence
  Description of Artificial Sequence: Synthetic probe
gtgctcgcaccgctcaccacctccaacatggggcaagacaacgttgaggtgtacgcaaac

SEQ ID NO: 5058 - DNA, 60 bp, Artificial Sequence
  Description of Artificial Sequence: Synthetic probe
cacgtaccaacaccactgcccacatcgtggtaccctacgtgggtgtcaacagacacgacc

SEQ ID NO: 5059 - DNA, 58 bp, Artificial Sequence
  Description of Artificial Sequence: Synthetic probe
gcgtgacgtttcacaactcacgctctttcctcaccagttcatcaacccacgtaccaac

SEQ ID NO: 5060 - DNA, 60 bp, Artificial Sequence
  Description of Artificial Sequence: Synthetic probe
gccacgcatacgtgcgcaacggctgggatgtgcaggtttcagcaaccagcacacagttca

SEQ ID NO: 5061 - DNA, 60 bp, Artificial Sequence
  Description of Artificial Sequence: Synthetic probe
tggaccacaaaggcatctacggtgccatgctggacagccacgcatacgtgcgcaacggct

SEQ ID NO: 5062 - DNA, 60 bp, Artificial Sequence
  Description of Artificial Sequence: Synthetic probe
gagaaactctttacttggaccgcggctcaagagtacgcacacgtgcatctgttggagctg

SEQ ID NO: 5063 - DNA, 60 bp, Artificial Sequence
  Description of Artificial Sequence: Synthetic probe
acaccagtggactcgagacacgcgttgaacaagcagagagattcttcaaggagaaactct

SEQ ID NO: 5064 - DNA, 60 bp, Artificial Sequence
  Description of Artificial Sequence: Synthetic probe
gttacgcatcagcggaccgttttctacctggacccaacaccagtggactcgagacacgcg

SEQ ID NO: 5065 - DNA, 60 bp, Artificial Sequence
  Description of Artificial Sequence: Synthetic probe
tggcacaatctgccatctcaggcctcttcggggccctcctggcagacaaaaagacagaag

SEQ ID NO: 5066 - DNA, 60 bp, Artificial Sequence
  Description of Artificial Sequence: Synthetic probe
cacgtccacgcataccaacaacacccagaacaatgattggttttccaaattggcacaatc

SEQ ID NO: 5067 - DNA, 60 bp, Artificial Sequence
  Description of Artificial Sequence: Synthetic probe
ggcgacaacgccataagtggaggttccaatgagggtagcacggacaccacgtccacgcat

SEQ ID NO: 5068 - DNA, 60 bp, Artificial Sequence
  Description of Artificial Sequence: Synthetic probe
ggagcgggccagtcatcccctgccactggatcccaaaaccaatctggtaacactggcagc

SEQ ID NO: 5069 - DNA, 60 bp, Artificial Sequence
  Description of Artificial Sequence: Synthetic probe
gcaatagaggtgtcttcacaagacaggcacaagcaaaagatcattgcacctgcaaaacag

SEQ ID NO: 5070 - DNA, 60 bp, Artificial Sequence
  Description of Artificial Sequence: Synthetic probe
ctcaccggttgcttgcaacaggttacaacggcgagtgtaagtacacgcaggaagcaaggg

SEQ ID NO: 5071 - DNA, 60 bp, Artificial Sequence
  Description of Artificial Sequence: Synthetic probe
tggcatcccaacggcgcaccccgaacaacgcagttgggggacaacccgatggtcttctcg

SEQ ID NO: 5072 - DNA, 60 bp, Artificial Sequence
  Description of Artificial Sequence: Synthetic probe
gcgttggtaccagcactcgccccagcgagatctgtgtcatcaacggagttaccatgactc

SEQ ID NO: 5073 - DNA, 60 bp, Artificial Sequence
  Description of Artificial Sequence: Synthetic probe
accactgcaacgggggaatctgcagaccctgtcaccaccacggttgagaactacggtggt

SEQ ID NO: 5074 - DNA, 60 bp, Artificial Sequence
  Description of Artificial Sequence: Synthetic probe
agacgcccgaggacgcggctcactgttaccactcggaatgggacactggactgaactccc

SEQ ID NO: 5075 - DNA, 60 bp, Artificial Sequence
  Description of Artificial Sequence: Synthetic probe
gcctgttccgacggctacggcggattccaaaacactgacccgaagaccgcagatccaatc

SEQ ID NO: 5076 - DNA, 60 bp, Artificial Sequence
  Description of Artificial Sequence: Synthetic probe
gtctgcgacgtactacttctcagacctggaggttgcgcttgtccacacaggccaggtcac

SEQ ID NO: 5077 - DNA, 55 bp, Artificial Sequence
  Description of Artificial Sequence: Synthetic probe
aacgtactcgcgtacgtgccctacgaccaggaaccactggacgtggactggcagg

SEQ ID NO: 5078 - DNA, 60 bp, Artificial Sequence
  Description of Artificial Sequence: Synthetic probe
cggcggtgagacacaagtccagcggcgtcaccacactgacgtcagcttcataatggacag

SEQ ID NO: 5079 - DNA, 60 bp, Artificial Sequence
  Description of Artificial Sequence: Synthetic probe
aaaaccacgttcagcgtggacctgatggacaccaaggaaaagaccctagtaggtgccttc

SEQ ID NO: 5080 - DNA, 60 bp, Artificial Sequence
  Description of Artificial Sequence: Synthetic probe
catgtcattgacctcatgcaaacccaccaacacggtctagtgggtgcgttgctgcgtgcg

SEQ ID NO: 5081 - DNA, 55 bp, Artificial Sequence
  Description of Artificial Sequence: Synthetic probe
gaactttgacctgctcaagttggcgggagacgtggagtccaaccctgggcccttc

SEQ ID NO: 5082 - DNA, 60 bp, Artificial Sequence
  Description of Artificial Sequence: Synthetic probe
actcctgaactttgacctgctcaagttggcgggagacgtggagtccaaccctgggccctt

SEQ ID NO: 5083 - DNA, 60 bp, Artificial Sequence
  Description of Artificial Sequence: Synthetic probe
agggctgaaacatactgcccccggcctcttttggctatccacccgaacgaggccagacac

SEQ ID NO: 5084 - DNA, 60 bp, Artificial Sequence
  Description of Artificial Sequence: Synthetic probe
cctgtcaccaccaccgtggagaactacggcggtgagacacaagttcagagacgccaccac

SEQ ID NO: 5085 - DNA, 57 bp, Artificial Sequence
  Description of Artificial Sequence: Synthetic probe
cacccgaatgaggctagacacaagcagaagattgtggcacccgtgaaacaggttctg

SEQ ID NO: 5086 - DNA, 60 bp, Artificial Sequence
  Description of Artificial Sequence: Synthetic probe
ccaaaatccacccatgtcattgaccttatgcaaacccaccaacacggtctagtgggtgcg

SEQ ID NO: 5087 - DNA, 60 bp, Artificial Sequence
  Description of Artificial Sequence: Synthetic probe
ccaaaatccacccatgtcattgacctcatgcaaacccaccaacacggtctagtgggtgcg

SEQ ID NO: 5088 - DNA, 60 bp, Artificial Sequence
  Description of Artificial Sequence: Synthetic probe
aaaggaaatagccgcccttggacgtgccgccgcgcatccacatgacgagggcgctggtcg

SEQ ID NO: 5089 - DNA, 60 bp, Artificial Sequence
  Description of Artificial Sequence: Synthetic probe
gaaaggaaatagccgcccttggacgtgccgccgcgcatccacatgacgagggcgctggtc

SEQ ID NO: 5090 - DNA, 60 bp, Artificial Sequence
  Description of Artificial Sequence: Synthetic probe
gaatgccggccaggatattgccgcaattctgcgcgtcgctgaccatcgcctgatcgacga

SEQ ID NO: 5091 - DNA, 60 bp, Artificial Sequence
  Description of Artificial Sequence: Synthetic probe
atcgcgaaggggccgaatgccggccaggatattgccgcaattctgcgcgtcgctgaccat

SEQ ID NO: 5092 - DNA, 54 bp, Artificial Sequence
  Description of Artificial Sequence: Synthetic probe
gtgtcgcgaaactccagcgggatcggcgcgggcatgccgggcacgccgtcgatc

SEQ ID NO: 5093 - DNA, 60 bp, Artificial Sequence
  Description of Artificial Sequence: Synthetic probe
aatttgccggtcggcagcagcgcgccgctaggaggagccggcggtgtcgcgaaactccag

SEQ ID NO: 5094 - DNA, 60 bp, Artificial Sequence
  Description of Artificial Sequence: Synthetic probe
atgaggcaatttgccggtcggcagcagcgcgccgctaggaggagccggcggtgtcgcgaa

SEQ ID NO: 5095 - DNA, 60 bp, Artificial Sequence
  Description of Artificial Sequence: Synthetic probe
gatgccgacatcctgcgccttcatcacgacgcagggcattgccattgtcgatacgggtgt

SEQ ID NO: 5096 - DNA, 60 bp, Artificial Sequence
  Description of Artificial Sequence: Synthetic probe
tcttcatagccggtgatgccgacatcctgcgccttcatcacgacgcagggcattgccatt

SEQ ID NO: 5097 - DNA, 60 bp, Artificial Sequence
  Description of Artificial Sequence: Synthetic probe
ctttaagcgccacgtccttgtccagcgtgtcgcggtcttcatagccggtgatgccgacat

SEQ ID NO: 5098 - DNA, 60 bp, Artificial Sequence
  Description of Artificial Sequence: Synthetic probe
gggcctcgatccgggctttaagcgccacgtccttgtccagcgtgtcgcggtcttcatagc

SEQ ID NO: 5099 - DNA, 60 bp, Artificial Sequence
  Description of Artificial Sequence: Synthetic probe
cgacaaaccagtcgatgtttactaccggatgaagagggctgagttgtactgtccacgccc

SEQ ID NO: 5100 - DNA, 60 bp, Artificial Sequence
  Description of Artificial Sequence: Synthetic probe
tcgacagcccagtcgatgtttactaccggatgaagagggctgaactgtactgtccacgcc

SEQ ID NO: 5101 - DNA, 60 bp, Artificial Sequence
  Description of Artificial Sequence: Synthetic probe
tcgacaacccagtcgatgtttactaccggatgaagagggctgaactgtactgcccacgcc

SEQ ID NO: 5102 - DNA, 60 bp, Artificial Sequence
  Description of Artificial Sequence: Synthetic probe
tcgacaaaccagtcgatgtttactaccggatgaagagggctgaactgtactgtccacgcc

SEQ ID NO: 5103 - DNA, 60 bp, Artificial Sequence
  Description of Artificial Sequence: Synthetic probe
tcgacaacccagtcgatgtttactaccggatgaagagggctgaactgtactgtccacgcc

SEQ ID NO: 5104 - DNA, 60 bp, Artificial Sequence
  Description of Artificial Sequence: Synthetic probe
tgaccgtcgacaacccagtcgatgtttactaccggatgaagagggctgaactgtactgtc

SEQ ID NO: 5105 - DNA, 60 bp, Artificial Sequence
  Description of Artificial Sequence: Synthetic probe
tcgtgaccgccgacaagccagtcgacgtttactaccggatgaagcgagcggagctgtact

SEQ ID NO: 5106 - DNA, 60 bp, Artificial Sequence
  Description of Artificial Sequence: Synthetic probe
cgctactggggaatcagcagaccctgtcaccaccactgtagagaactacggcggtgagac

SEQ ID NO: 5107 - DNA, 56 bp, Artificial Sequence
  Description of Artificial Sequence: Synthetic probe
ggcttgcattgccctacacggcaccacaccgtgtgttggctaccgcttacaacggg

SEQ ID NO: 5108 - DNA, 60 bp, Artificial Sequence
  Description of Artificial Sequence: Synthetic probe
taacggcaccacccgctttgcactgccctacactgcgccacacagatgtctggcaacaac

SEQ ID NO: 5109 - DNA, 60 bp, Artificial Sequence
  Description of Artificial Sequence: Synthetic probe
gaggtctcgtcgcatgacagacacaaacagaagatcattgcacctgcaaaacagctcctg

SEQ ID NO: 5110 - DNA, 60 bp, Artificial Sequence
  Description of Artificial Sequence: Synthetic probe
tcttgacacactacgaccacaatggactggatcgctacaagaccgcgataaccaaacctg

SEQ ID NO: 5111 - DNA, 60 bp, Artificial Sequence
  Description of Artificial Sequence: Synthetic probe
aagcaaccccaccgcctaccacaaggaaccattcacgagacttgcgctcccttacaccgc

SEQ ID NO: 5112 - DNA, 60 bp, Artificial Sequence
  Description of Artificial Sequence: Synthetic probe
gcaagcaaccccaccgcctaccacaaggaaccattcacgagacttgcgctcccttacacc

SEQ ID NO: 5113 - DNA, 60 bp, Artificial Sequence
  Description of Artificial Sequence: Synthetic probe
aggctgaaaccattactgagctcctgatacgcatgaaacgtgcggagacatactgcccta

SEQ ID NO: 5114 - DNA, 60 bp, Artificial Sequence
  Description of Artificial Sequence: Synthetic probe
tgatctggctgtccttgcacagagggctaacaggcagctgcccacctccttcaactacgg

SEQ ID NO: 5115 - DNA, 60 bp, Artificial Sequence
  Description of Artificial Sequence: Synthetic probe
cggcgtggtgatctggctgtccttgcacagagggctaacaggcagctgcccacctccttc

SEQ ID NO: 5116 - DNA, 56 bp, Artificial Sequence
  Description of Artificial Sequence: Synthetic probe
agcctacgggtgacaggcacaagcaaccgatcatcgcgcctgcaaaacagctattg

SEQ ID NO: 5117 - DNA, 60 bp, Artificial Sequence
  Description of Artificial Sequence: Synthetic probe
ccaacttgttcaggaggtgattgaccgggttgagctccacgagaaagtgtcgaaccaccc

SEQ ID NO: 5118 - DNA, 60 bp, Artificial Sequence
  Description of Artificial Sequence: Synthetic probe
acagaatgtataccaacttgttcaggaggtgattgaccgggttgagctccacgagaaagt

SEQ ID NO: 5119 - DNA, 54 bp, Artificial Sequence
  Description of Artificial Sequence: Synthetic probe
ccggtggcgatgttccaatatgattgtgcccttctcaatggcatggccgttgag

SEQ ID NO: 5120 - DNA, 60 bp, Artificial Sequence
  Description of Artificial Sequence: Synthetic probe
ccggtggcgatgttccaatatgattgtgcccttctcaatggcatggccgttgagatgaag

SEQ ID NO: 5121 - DNA, 60 bp, Artificial Sequence
  Description of Artificial Sequence: Synthetic probe
ggtttcaccccgagaaccatggtgtgccctgacgcgctgaaccgaaggttccactttgac

SEQ ID NO: 5122 - DNA, 60 bp, Artificial Sequence
  Description of Artificial Sequence: Synthetic probe
tgtattcgggtttcaccccgagaaccatggtgtgccctgacgcgctgaaccgaaggttcc

SEQ ID NO: 5123 - DNA, 57 bp, Artificial Sequence
  Description of Artificial Sequence: Synthetic probe
caaatggtttcaaccacggggttcatcccgcccatggcatcactcgaggacaaaggc

SEQ ID NO: 5124 - DNA, 60 bp, Artificial Sequence
  Description of Artificial Sequence: Synthetic probe
ttgaggatttgggtcagaaccccgacggcaaggacttcaagtacttcgcccaaatggttt

SEQ ID NO: 5125 - DNA, 60 bp, Artificial Sequence
  Description of Artificial Sequence: Synthetic probe
ccttcggcggtttcaaccagcagaccctcgttgtgattgaggatttgggtcagaaccccg

SEQ ID NO: 5126 - DNA, 60 bp, Artificial Sequence
  Description of Artificial Sequence: Synthetic probe
gcctgaccctgaccccttcggcggtttcaaccagcagaccctcgttgtgattgaggattt

SEQ ID NO: 5127 - DNA, 60 bp, Artificial Sequence
  Description of Artificial Sequence: Synthetic probe
taccctcttcactggcagaaccgattccgtttggtactgcccgcctgaccctgacccctt

SEQ ID NO: 5128 - DNA, 60 bp, Artificial Sequence
  Description of Artificial Sequence: Synthetic probe
gcgatttctaccctcttcactggcagaaccgattccgtttggtactgcccgcctgaccct

SEQ ID NO: 5129 - DNA, 60 bp, Artificial Sequence
  Description of Artificial Sequence: Synthetic probe
cggccagggtaagagtttccttgcgaacgtgctcgctcaagcgatttctaccctcttcac

SEQ ID NO: 5130 - DNA, 60 bp, Artificial Sequence
  Description of Artificial Sequence: Synthetic probe
gtggcaaatccggccagggtaagagtttccttgcgaacgtgctcgctcaagcgatttcta

SEQ ID NO: 5131 - DNA, 52 bp, Artificial Sequence
  Description of Artificial Sequence: Synthetic probe
ccaagcgtgtctgatgagcgggaacgtcccctttgcccacttgtgcaaagtg

SEQ ID NO: 5132 - DNA, 60 bp, Artificial Sequence
  Description of Artificial Sequence: Synthetic probe
ccaagcgtgtctgatgagcgggaacgtcccctttgcccacttgtgcaaagtggtcgcccc

SEQ ID NO: 5133 - DNA, 60 bp, Artificial Sequence
  Description of Artificial Sequence: Synthetic probe
acgcatgttcaaggaggctaaggtgtggctcgacaacgcgcgccaagcgtgtctgatgag

SEQ ID NO: 5134 - DNA, 60 bp, Artificial Sequence
  Description of Artificial Sequence: Synthetic probe
aacggccaacgcatgttcaaggaggctaaggtgtggctcgacaacgcgcgccaagcgtgt

SEQ ID NO: 5135 - DNA, 60 bp, Artificial Sequence
  Description of Artificial Sequence: Synthetic probe
tagtacctggcatacttgatatgcaacgggacctcaacggccaacgcatgttcaaggagg

SEQ ID NO: 5136 - DNA, 60 bp, Artificial Sequence
  Description of Artificial Sequence: Synthetic probe
tcaccatgacaaacttagtacctggcatacttgatatgcaacgggacctcaacggccaac

SEQ ID NO: 5137 - DNA, 52 bp, Artificial Sequence
  Description of Artificial Sequence: Synthetic probe
tggctggtcaagctgatccttgccatccgcgactggatcaaggagtggatcg

SEQ ID NO: 5138 - DNA, 60 bp, Artificial Sequence
  Description of Artificial Sequence: Synthetic probe
cactgtttctcacacgagacacgggaaagatggaattcacacttcacaacggtgagaaaa

SEQ ID NO: 5139 - DNA, 60 bp, Artificial Sequence
  Description of Artificial Sequence: Synthetic probe
caaaacactgtttctcacacgagacacgggaaagatggaattcacacttcacaacggtga

SEQ ID NO: 5140 - DNA, 51 bp, Artificial Sequence
  Description of Artificial Sequence: Synthetic probe
gccccacacatgtcattgacctcatgcaaacccaccaacacgggttggtag

SEQ ID NO: 5141 - DNA, 60 bp, Artificial Sequence
  Description of Artificial Sequence: Synthetic probe
cactggagtgtttggcactgcctatctcgtgcctcgtcatcttttcgctgagaagtatga

SEQ ID NO: 5142 - DNA, 60 bp, Artificial Sequence
  Description of Artificial Sequence: Synthetic probe
atccacgaacttctcgtgcgcatgaagcgggccgagctctactgccctagaccactactg

SEQ ID NO: 5143 - DNA, 60 bp, Artificial Sequence
  Description of Artificial Sequence: Synthetic probe
gaatgaagagagcggagctttactgtccaagaccccttctccctggctacgatcacgcaa

SEQ ID NO: 5144 - DNA, 60 bp, Artificial Sequence
  Description of Artificial Sequence: Synthetic probe
aaagtacgccaacaccaggcatgagctcccgtccacgttcaacttcggctacgtgaccgc

SEQ ID NO: 5145 - DNA, 60 bp, Artificial Sequence
  Description of Artificial Sequence: Synthetic probe
gccgtcttggccgcaaagtacgccaacaccaggcatgagctcccgtccacgttcaacttc

SEQ ID NO: 5146 - DNA, 60 bp, Artificial Sequence
  Description of Artificial Sequence: Synthetic probe
agtacacacaacaatctaccgccatccgcggtgaccgtgccgtcttggccgcaaagtacg

SEQ ID NO: 5147 - DNA, 60 bp, Artificial Sequence
  Description of Artificial Sequence: Synthetic probe
acggtgagtgcaagtacacacaacaatctaccgccatccgcggtgaccgtgccgtcttgg

SEQ ID NO: 5148 - DNA, 60 bp, Artificial Sequence
  Description of Artificial Sequence: Synthetic probe
ttctgtgacctggaaatcgcctgtctcggcgagcacaaacgcgtgtggtggcaaccgaac

SEQ ID NO: 5149 - DNA, 60 bp, Artificial Sequence
  Description of Artificial Sequence: Synthetic probe
cctactatttctgtgacctggaaatcgcctgtctcggcgagcacaaacgcgtgtggtggc

SEQ ID NO: 5150 - DNA, 60 bp, Artificial Sequence
  Description of Artificial Sequence: Synthetic probe
tttgtcatggacaggttcacccacgttttgacaaacaggaccacattcgcggtcgacttg

SEQ ID NO: 5151 - DNA, 60 bp, Artificial Sequence
  Description of Artificial Sequence: Synthetic probe
atttgtcatggacaggttcacccacgttttgacaaacaggaccacattcgcggtcgactt

SEQ ID NO: 5152 - DNA, 60 bp, Artificial Sequence
  Description of Artificial Sequence: Synthetic probe
gaaggagcagacgtcgtgacgactgacccgtcgacccatggtggttctgtcacagagaag

SEQ ID NO: 5153 - DNA, 60 bp, Artificial Sequence
  Description of Artificial Sequence: Synthetic probe
accaccagctcgggagaaggagcagacgtcgtgacgactgacccgtcgacccatggtggt

SEQ ID NO: 5154 - DNA, 60 bp, Artificial Sequence
  Description of Artificial Sequence: Synthetic probe
gcttggcaacatcatacaacggtgattgtaagtacaaacccgctggcacagccccgcgtg

SEQ ID NO: 5155 - DNA, 60 bp, Artificial Sequence
  Description of Artificial Sequence: Synthetic probe
cacacaggtgcttggcaacatcatacaacggtgattgtaagtacaaacccgctggcacag

SEQ ID NO: 5156 - DNA, 50 bp, Artificial Sequence
  Description of Artificial Sequence: Synthetic probe
cagcagacagacacaagcaaaagatcattgcacccgcaaaacaactcctg

SEQ ID NO: 5157 - DNA, 50 bp, Artificial Sequence
  Description of Artificial Sequence: Synthetic probe
cgatgctcgatcagatgaaggcccacatcgacccagcacctcacaccgag

SEQ ID NO: 5158 - DNA, 60 bp, Artificial Sequence
  Description of Artificial Sequence: Synthetic probe
ccactctgctggtgggaatggcgtgggatactgttcgtgtgtctccaaatcgatgctcga

SEQ ID NO: 5159 - DNA, 60 bp, Artificial Sequence
  Description of Artificial Sequence: Synthetic probe
ggccgcagtcctcaccaagagtggaagtcaaaccgtcatcattggcacccactctgctgg

SEQ ID NO: 5160 - DNA, 60 bp, Artificial Sequence
  Description of Artificial Sequence: Synthetic probe
ggggccgcagtcctcaccaagagtggaagtcaaaccgtcatcattggcacccactctgct

SEQ ID NO: 5161 - DNA, 60 bp, Artificial Sequence
  Description of Artificial Sequence: Synthetic probe
ttcgcgtaccgcgcggggaccaaggtagggtattgtggggccgcagtcctcaccaagagt

SEQ ID NO: 5162 - DNA, 60 bp, Artificial Sequence
  Description of Artificial Sequence: Synthetic probe
ccatgcctggactcttcgcgtaccgcgcggggaccaaggtagggtattgtggggccgcag

SEQ ID NO: 5163 - DNA, 60 bp, Artificial Sequence
  Description of Artificial Sequence: Synthetic probe
cgctgacgttgggagactcatcttctcaggagatgccctcacatacaaggacatcgtcgt

SEQ ID NO: 5164 - DNA, 60 bp, Artificial Sequence
  Description of Artificial Sequence: Synthetic probe
tcaacaacgctgacgttgggagactcatcttctcaggagatgccctcacatacaaggaca

SEQ ID NO: 5165 - DNA, 60 bp, Artificial Sequence
  Description of Artificial Sequence: Synthetic probe
gcgacactgtacgtgttgcgaaaggaaaccccgttgtcggcgtggtcaacaacgctgacg

SEQ ID NO: 5166 - DNA, 60 bp, Artificial Sequence
  Description of Artificial Sequence: Synthetic probe
cttccgcgacactgtacgtgttgcgaaaggaaaccccgttgtcggcgtggtcaacaacgc

SEQ ID NO: 5167 - DNA, 60 bp, Artificial Sequence
  Description of Artificial Sequence: Synthetic probe
aacagaggacagcgggtcagagacatcacagcccacttccgcgacactgtacgtgttgcg

SEQ ID NO: 5168 - DNA, 60 bp, Artificial Sequence
  Description of Artificial Sequence: Synthetic probe
gccctcatggtcctcaacagaggacagcgggtcagagacatcacagcccacttccgcgac

SEQ ID NO: 5169 - DNA, 60 bp, Artificial Sequence
  Description of Artificial Sequence: Synthetic probe
cgggagtgttcggaaccgcctacctcgtgcctcgtcatctcttcgccgagaagtatgaca

SEQ ID NO: 5170 - DNA, 60 bp, Artificial Sequence
  Description of Artificial Sequence: Synthetic probe
tcgagttgatccttgacgggaagatcgtcgcgctctgctgtgcgacgggagtgttcggaa

SEQ ID NO: 5171 - DNA, 60 bp, Artificial Sequence
  Description of Artificial Sequence: Synthetic probe
gcccgtcgagttgatccttgacgggaagatcgtcgcgctctgctgtgcgacgggagtgtt

SEQ ID NO: 5172 - DNA, 60 bp, Artificial Sequence
  Description of Artificial Sequence: Synthetic probe
gtttctttcacgaaacacaggaaagatggaattcacactctacaacggtgagaagaagac

SEQ ID NO: 5173 - DNA, 60 bp, Artificial Sequence
  Description of Artificial Sequence: Synthetic probe
cattcaactttggtgcagttaaagcagaaacaatcacagaattgcttgtgcgcatgaagc

SEQ ID NO: 5174 - DNA, 60 bp, Artificial Sequence
  Description of Artificial Sequence: Synthetic probe
cccacctccttcaactacggtgctgtgaaggctgacaacatcacggagctgttgatccgc

SEQ ID NO: 5175 - DNA, 51 bp, Artificial Sequence
  Description of Artificial Sequence: Synthetic probe
aaacaactccacggcgtggtgatatggcggcccttgcacaaaggctgagcg

SEQ ID NO: 5176 - DNA, 60 bp, Artificial Sequence
  Description of Artificial Sequence: Synthetic probe
accacgcaggccgggacaggttcgacgccccgattggtgtcgagaaacaactgtgcaact

SEQ ID NO: 5177 - DNA, 60 bp, Artificial Sequence
  Description of Artificial Sequence: Synthetic probe
actgtccacgaccacttctcccgacttaccaacacaacaaccgggacaggttcgacgccc

SEQ ID NO: 5178 - DNA, 60 bp, Artificial Sequence
  Description of Artificial Sequence: Synthetic probe
actgtccaagaccactcctcccggcttaccaacacaacaaccgggacaggttcgacgccc

SEQ ID NO: 5179 - DNA, 60 bp, Artificial Sequence
  Description of Artificial Sequence: Synthetic probe
tcccctacactgcgccacaccgcgtgttggcaacagtgtacaacgggacgaacaagtact

SEQ ID NO: 5180 - DNA, 60 bp, Artificial Sequence
  Description of Artificial Sequence: Synthetic probe
tgccaacaccgttggtttcagagagagagctctcccggggcacaaggcgagtgatgacgt

SEQ ID NO: 5181 - DNA, 60 bp, Artificial Sequence
  Description of Artificial Sequence: Synthetic probe
tctagagaccagcggtgccaacaccgttggtttcagagagagagctctcccggggcacaa

SEQ ID NO: 5182 - DNA, 60 bp, Artificial Sequence
  Description of Artificial Sequence: Synthetic probe
gggcatctgcccacctctttcaactacggcgctgtgaaggctgacaccatcactgagctt

SEQ ID NO: 5183 - DNA, 60 bp, Artificial Sequence
  Description of Artificial Sequence: Synthetic probe
gaccactcaaacaaggaccgctaccgagtggccctcgtcaagcctgccaaacaaatgtgc

SEQ ID NO: 5184 - DNA, 60 bp, Artificial Sequence
  Description of Artificial Sequence: Synthetic probe
cactacgaccactcaaacaaggaccgctaccgagtggccctcgtcaagcctgccaaacaa

SEQ ID NO: 5185 - DNA, 60 bp, Artificial Sequence
  Description of Artificial Sequence: Synthetic probe
acacacaggcagaggtggacgtctacctgaggatgaagagagcagaactctactgtcctc

SEQ ID NO: 5186 - DNA, 60 bp, Artificial Sequence
  Description of Artificial Sequence: Synthetic probe
ccttggctgcgcggattgctggtgagacccacatcccaacaacattcaattacgggatga

SEQ ID NO: 5187 - DNA, 60 bp, Artificial Sequence
  Description of Artificial Sequence: Synthetic probe
ccctggctgcgcggattgctggtgagacccacatcccaacaacattcaattacgggatga

SEQ ID NO: 5188 - DNA, 60 bp, Artificial Sequence
  Description of Artificial Sequence: Synthetic probe
aaccctggctgcgcggattgctggtgagacccacatcccaacaacattcaattacgggat

SEQ ID NO: 5189 - DNA, 60 bp, Artificial Sequence
  Description of Artificial Sequence: Synthetic probe
aaccttggctgcgcggattgctggtgagacccacatcccaacaacattcaattacgggat

SEQ ID NO: 5190 - DNA, 60 bp, Artificial Sequence
  Description of Artificial Sequence: Synthetic probe
tgggtgggttggacccccaacggcagcccagtgctgagtgaggtgggcgacaacccagtc

SEQ ID NO: 5191 - DNA, 60 bp, Artificial Sequence
  Description of Artificial Sequence: Synthetic probe
tgggtaggttggactcccaacggcagcccagtgctgagtgaggtgggcgacaacccagtc

SEQ ID NO: 5192 - DNA, 60 bp, Artificial Sequence
  Description of Artificial Sequence: Synthetic probe
gggaatctgcagacccggttaccaccactgttgaaaactacggtggtgagacacaggtcc

SEQ ID NO: 5193 - DNA, 60 bp, Artificial Sequence
  Description of Artificial Sequence: Synthetic probe
cgctttgcactgccctacaccgctccacacaggtgcttggcaacaacctacaacggtgat

SEQ ID NO: 5194 - DNA, 60 bp, Artificial Sequence
  Description of Artificial Sequence: Synthetic probe
gagcacctgagacagcccttcacaacacgagcaaccccactgcataccacaaggggcctt

SEQ ID NO: 5195 - DNA, 60 bp, Artificial Sequence
  Description of Artificial Sequence: Synthetic probe
ctgggtacccaatggagcacctgagacagcccttcacaacacgagcaaccccactgcata

SEQ ID NO: 5196 - DNA, 60 bp, Artificial Sequence
  Description of Artificial Sequence: Synthetic probe
tactacttctctgacttggagattgtggtgcgtcacgatgacaacttgacctgggtaccc

SEQ ID NO: 5197 - DNA, 60 bp, Artificial Sequence
  Description of Artificial Sequence: Synthetic probe
tactacttctctgacttggagattgtggtgcgtcatgaggacaatttaacctgggtaccc

SEQ ID NO: 5198 - DNA, 60 bp, Artificial Sequence
  Description of Artificial Sequence: Synthetic probe
cccttgtgatctggaacatcaaacacttgctccacaccggcatcggtaccgcctcgcgac

SEQ ID NO: 5199 - DNA, 60 bp, Artificial Sequence
  Description of Artificial Sequence: Synthetic probe
aggggggacccccctcccttgtgatctggaacatcaaacacttgctccacaccggcatcg

SEQ ID NO: 5200 - DNA, 60 bp, Artificial Sequence
  Description of Artificial Sequence: Synthetic probe
cacgagggcggaccacctgcccttgtgatctggaacatcaaacacttgctccacaccggt

SEQ ID NO: 5201 - DNA, 60 bp, Artificial Sequence
  Description of Artificial Sequence: Synthetic probe
aaacagctccgcggcgcggtgatatggcggcccttgcacaaaggctgagtgggcatctgc

SEQ ID NO: 5202 - DNA, 60 bp, Artificial Sequence
  Description of Artificial Sequence: Synthetic probe
gcaacatcttacaacggtgattgcaagtacaaacccgctggcacagccccgcgcggcaac

SEQ ID NO: 5203 - DNA, 60 bp, Artificial Sequence
  Description of Artificial Sequence: Synthetic probe
aacccgatggttttctccaacaacggtgttaccaggtttgccgtgccgtacaccgcgccc

SEQ ID NO: 5204 - DNA, 60 bp, Artificial Sequence
  Description of Artificial Sequence: Synthetic probe
caacccgatggttttctccaacaacggtgttaccaggttcgctgtgccatacaccgcgcc

SEQ ID NO: 5205 - DNA, 60 bp, Artificial Sequence
  Description of Artificial Sequence: Synthetic probe
cccttacaccgcgccacaccgcgtgttggcaacagtgtacaacgggacgagcaagtactc

SEQ ID NO: 5206 - DNA, 60 bp, Artificial Sequence
  Description of Artificial Sequence: Synthetic probe
gtctgcgacgtactacttctcagacctggaggttgcgctcgtccacacaggcccagccac

SEQ ID NO: 5207 - DNA, 60 bp, Artificial Sequence
  Description of Artificial Sequence: Synthetic probe
acacactcgacgtgatgcaggcacacaaagacaatatcgtcgcggcgcttctccgcgcag

SEQ ID NO: 5208 - DNA, 60 bp, Artificial Sequence
  Description of Artificial Sequence: Synthetic probe
tctacccatggacacccgaccctgaaaacgtgcttgcgtacgtgccctacgaccaggagc

SEQ ID NO: 5209 - DNA, 60 bp, Artificial Sequence
  Description of Artificial Sequence: Synthetic probe
gtgttctacccatggacacccgaccctgaaaacgtgctcgcgtacgtgccctacgaccag

SEQ ID NO: 5210 - DNA, 60 bp, Artificial Sequence
  Description of Artificial Sequence: Synthetic probe
agcggatgcccaccgaccgacttgcaaaagatggtcatggcaaacgtgaagcccgttgag

SEQ ID NO: 5211 - DNA, 60 bp, Artificial Sequence
  Description of Artificial Sequence: Synthetic probe
aaagcgccgttcacgaggcttgcgcttccctacactgcgccacaccgcgtgctggcaaca

SEQ ID NO: 5212 - DNA, 60 bp, Artificial Sequence
  Description of Artificial Sequence: Synthetic probe
ggcagctgcccacctccttcaattacggcgctgtaaaggctgaaaacatcactgagctcc

SEQ ID NO: 5213 - DNA, 60 bp, Artificial Sequence
  Description of Artificial Sequence: Synthetic probe
ggcctctgctagctcttgacaccactcaggaccgccgtaaacaggagatcattgcacctg

SEQ ID NO: 5214 - DNA, 60 bp, Artificial Sequence
  Description of Artificial Sequence: Synthetic probe
caaggctggttactgtggaggagccgttcttgcaaaagacggagctgacactttcatcgt

SEQ ID NO: 5215 - DNA, 54 bp, Artificial Sequence
  Description of Artificial Sequence: Synthetic probe
cagcttctgaacttcgacctgctcaagttggcaggagacgtagagtccaaccct

SEQ ID NO: 5216 - DNA, 60 bp, Artificial Sequence
  Description of Artificial Sequence: Synthetic probe
catccgtggagaccgcgcggcacttgcggcaaagtacgctagcaacacgcacactttgcc

SEQ ID NO: 5217 - DNA, 60 bp, Artificial Sequence
  Description of Artificial Sequence: Synthetic probe
caccgccatccgtggagaccgcgcggcacttgcggcaaagtacgccagtaacacgcacac

SEQ ID NO: 5218 - DNA, 60 bp, Artificial Sequence
  Description of Artificial Sequence: Synthetic probe
accgccaccgccatccgtggagaccgcgcggcacttgcggcaaagtacgctagcaacacg

SEQ ID NO: 5219 - DNA, 60 bp, Artificial Sequence
  Description of Artificial Sequence: Synthetic probe
aaacacttgctcaacaccggaatcggcactgcttcgcgacccagcgaggtgtgcgtggtt

SEQ ID NO: 5220 - DNA, 60 bp, Artificial Sequence
  Description of Artificial Sequence: Synthetic probe
ggcaatagaggtgtcttctcaagacagacacaaacagaagatcattgcacccgcgaagca

SEQ ID NO: 5221 - DNA, 60 bp, Artificial Sequence
  Description of Artificial Sequence: Synthetic probe
ggtcagctgcccacctctttcaactacggcgctgtaaaggctgaaaccatcactgagctt

SEQ ID NO: 5222 - DNA, 50 bp, Artificial Sequence
  Description of Artificial Sequence: Synthetic probe
agattgtggtgcgtcacgacggcaacctgacatgggtacccaatggagca

SEQ ID NO: 5223 - DNA, 60 bp, Artificial Sequence
  Description of Artificial Sequence: Synthetic probe
gcggagacctcgcgacccttgcgcagaggattgccagtgagacacacattccaaccactt

SEQ ID NO: 5224 - DNA, 60 bp, Artificial Sequence
  Description of Artificial Sequence: Synthetic probe
ggtacgccattgatgatgaggtgttttacccatggacacctgaccctgagaacgtactcg

SEQ ID NO: 5225 - DNA, 60 bp, Artificial Sequence
  Description of Artificial Sequence: Synthetic probe
aaacggggtcaccatgaccctggctgactttcacgccggcatcttcatcaaaggtaccga

SEQ ID NO: 5226 - DNA, 60 bp, Artificial Sequence
  Description of Artificial Sequence: Synthetic probe
cgagatctgtgtcataaacggggtcaccatgaccctggctgactttcacgccggcatctt

SEQ ID NO: 5227 - DNA, 60 bp, Artificial Sequence
  Description of Artificial Sequence: Synthetic probe
acaccaaactggacttgtcggacggagggccccccgctctcgtcctctggctgatcaaag

SEQ ID NO: 5228 - DNA, 58 bp, Artificial Sequence
  Description of Artificial Sequence: Synthetic probe
tgcagctctttcgatacgtcgacgagccactctttgagtctgagtatttgtcacctga

SEQ ID NO: 5229 - DNA, 60 bp, Artificial Sequence
  Description of Artificial Sequence: Synthetic probe
ggcccaacacacacgggaactgttggctcaactcactgttgcagctctttcgatacgtcg

SEQ ID NO: 5230 - DNA, 60 bp, Artificial Sequence
  Description of Artificial Sequence: Synthetic probe
cttctacagcaggcccaacacacacgggaactgttggctcaactcactgttgcagctctt

SEQ ID NO: 5231 - DNA, 60 bp, Artificial Sequence
  Description of Artificial Sequence: Synthetic probe
accactgccacgggggaatctgcagaccctgtcaccaccacggttgagaactacggtggt

SEQ ID NO: 5232 - DNA, 60 bp, Artificial Sequence
  Description of Artificial Sequence: Synthetic probe
cccacctccttcaactacggcgctgtaaaggctgagaccatcactgagctcctgatccgc

SEQ ID NO: 5233 - DNA, 60 bp, Artificial Sequence
  Description of Artificial Sequence: Synthetic probe
cactgcgccacaccgcgtgctggcaacagtgtacaacgggacgaacaagtactccgcgac

SEQ ID NO: 5234 - DNA, 53 bp, Artificial Sequence
  Description of Artificial Sequence: Synthetic probe
ctcctcgtgcgcatgaaacgggccgaactctactgccccaggccactcctggc

SEQ ID NO: 5235 - DNA, 60 bp, Artificial Sequence
  Description of Artificial Sequence: Synthetic probe
tcgtcatttggaacatcaagcacctgctccacacgggaatcggcaccgcctcgcgaccca

SEQ ID NO: 5236 - DNA, 60 bp, Artificial Sequence
  Description of Artificial Sequence: Synthetic probe
acggtgccatcaaagccacttgggtgactgaactgctttaccgcatgaagagggccgaaa

SEQ ID NO: 5237 - DNA, 60 bp, Artificial Sequence
  Description of Artificial Sequence: Synthetic probe
agatcgttgccctgtgtttgactcttctggcaaacatagtgatcatgatccgcgagactc

SEQ ID NO: 5238 - DNA, 60 bp, Artificial Sequence
  Description of Artificial Sequence: Synthetic probe
ggcagtggaggtgtcgtcacaagacagacacaaacagaagatcattgcaccagcaaaaca

SEQ ID NO: 5239 - DNA, 60 bp, Artificial Sequence
  Description of Artificial Sequence: Synthetic probe
aggcagctgcccacctccttcaactacggcgctgtaaaggctgaaaacatcactgagctc

SEQ ID NO: 5240 - DNA, 60 bp, Artificial Sequence
  Description of Artificial Sequence: Synthetic probe
ggcagctgcccacctccttcaactacggcgctgtaaaggctgaaaacatcactgagctcc

SEQ ID NO: 5241 - DNA, 60 bp, Artificial Sequence
  Description of Artificial Sequence: Synthetic probe
aaaccatcactgagctcttgatccgcatgaaacgcgcggagacatactgccctaggcctt

SEQ ID NO: 5242 - DNA, 60 bp, Artificial Sequence
  Description of Artificial Sequence: Synthetic probe
caaaggaacaagttaatgtgttggacctgatgcagattccggcccacaccctggtagggg

SEQ ID NO: 5243 - DNA, 53 bp, Artificial Sequence
  Description of Artificial Sequence: Synthetic probe
accgggtgactgaactgctttaccgcatgaagagggccgaaacatactgcccc

SEQ ID NO: 5244 - DNA, 60 bp, Artificial Sequence
  Description of Artificial Sequence: Synthetic probe
ggtaaaagtaaaaggacaggacatgctctcagatgccgcgctgatggttctccactccgg

SEQ ID NO: 5245 - DNA, 60 bp, Artificial Sequence
  Description of Artificial Sequence: Synthetic probe
attagagccacaaccatccacgagcttctcgtgcgcatgaagcgggccgagctctactgc

SEQ ID NO: 5246 - DNA, 60 bp, Artificial Sequence
  Description of Artificial Sequence: Synthetic probe
tgcgcatgaagcgtgccgaactctactgccccagaccattgttggctgtggaggtctcgt

SEQ ID NO: 5247 - DNA, 60 bp, Artificial Sequence
  Description of Artificial Sequence: Synthetic probe
gtgcgcatgaagcgtgccgaactctactgccccagaccattgttggcagtggaggtctcg

SEQ ID NO: 5248 - DNA, 60 bp, Artificial Sequence
  Description of Artificial Sequence: Synthetic probe
gcttcggtctgcgacgtactacttctcagacctggaggttgcgcttgttcacacaggccc

SEQ ID NO: 5249 - DNA, 60 bp, Artificial Sequence
  Description of Artificial Sequence: Synthetic probe
tgtgactcgggcgacgtgtactacaggatgaagagggcggagctttactgcccgcgccct

SEQ ID NO: 5250 - DNA, 60 bp, Artificial Sequence
  Description of Artificial Sequence: Synthetic probe
ttgtgtgactcaggcgacgtgtactacaggatgaagagggcggagctttactgcccgcgc

SEQ ID NO: 5251 - DNA, 60 bp, Artificial Sequence
  Description of Artificial Sequence: Synthetic probe
tgttgtgtgactcgggcgacgtgtactacaggatgaagagggcggagctttactgcccgc

SEQ ID NO: 5252 - DNA, 60 bp, Artificial Sequence
  Description of Artificial Sequence: Synthetic probe
gtcgattgttgtgtgactcgggcgacgtgtactacaggatgaagagggcggagctttact

SEQ ID NO: 5253 - DNA, 60 bp, Artificial Sequence
  Description of Artificial Sequence: Synthetic probe
ggtcgattgttgtgtgactcaggcgacgtgtactacaggatgaagagggcggagctttac

SEQ ID NO: 5254 - DNA, 60 bp, Artificial Sequence
  Description of Artificial Sequence: Synthetic probe
cccaatgggtgcccacacaccgaccgggtggaagacaatccagtcgttcactcgaaaaac

SEQ ID NO: 5255 - DNA, 58 bp, Artificial Sequence
  Description of Artificial Sequence: Synthetic probe
cccaatgggtgcccacacaccgaccgggtggaagacaatccagtcgttcactcgaaaa

SEQ ID NO: 5256 - DNA, 60 bp, Artificial Sequence
  Description of Artificial Sequence: Synthetic probe
gtgcccaatgggtgcccacacaccaaccgggtggaagacaatccagtcgttcactcgaga

SEQ ID NO: 5257 - DNA, 60 bp, Artificial Sequence
  Description of Artificial Sequence: Synthetic probe
gtgcccaatgggtgcccacacaccgaccgggtggaagacaatccagtcgttcactcgaaa

SEQ ID NO: 5258 - DNA, 60 bp, Artificial Sequence
  Description of Artificial Sequence: Synthetic probe
tgggtgcccaatgggtgcccacacaccgaccgggtggaagacaatccagtcgttcactcg

SEQ ID NO: 5259 - DNA, 60 bp, Artificial Sequence
  Description of Artificial Sequence: Synthetic probe
tgggtgcccaatgggtgcccacacaccaaccgggtggaagacaatccagtcgttcactcg

SEQ ID NO: 5260 - DNA, 60 bp, Artificial Sequence
  Description of Artificial Sequence: Synthetic probe
gccctgccatacacagcaccacaccgcgtgttggcaaccgtttacaacgggaactgcaag

SEQ ID NO: 5261 - DNA, 60 bp, Artificial Sequence
  Description of Artificial Sequence: Synthetic probe
cttgccctgccatacacagcaccacaccgcgtgttggcaaccgtttacaacgggaactgc

SEQ ID NO: 5262 - DNA, 60 bp, Artificial Sequence
  Description of Artificial Sequence: Synthetic probe
tttgagattaaagtaaaaggacaggacatgctctctgacgccgctctcatggtgttacac

SEQ ID NO: 5263 - DNA, 60 bp, Artificial Sequence
  Description of Artificial Sequence: Synthetic probe
ttgagtttgagattaaagtaaaaggacaggacatgctctcagatgccgcgctcatggtgc

SEQ ID NO: 5264 - DNA, 60 bp, Artificial Sequence
  Description of Artificial Sequence: Synthetic probe
cagcaaaacagctcctgaactttgacctgctcaagttggcgggagacgttgagtccaacc

SEQ ID NO: 5265 - DNA, 60 bp, Artificial Sequence
  Description of Artificial Sequence: Synthetic probe
ataaacagcccaaaatccacccatgtcattgacctcatgcaaacccaccaacacggtcta

SEQ ID NO: 5266 - DNA, 60 bp, Artificial Sequence
  Description of Artificial Sequence: Synthetic probe
tcaactttggcgcaatccgggccactaccatccacgagcttctcgtgcgcatgaagcgtg

SEQ ID NO: 5267 - DNA, 60 bp, Artificial Sequence
  Description of Artificial Sequence: Synthetic probe
agttcagagacgccaccacaccgacgttggcttcatcatggacagatttgtgaaaataaa

SEQ ID NO: 5268 - DNA, 60 bp, Artificial Sequence
  Description of Artificial Sequence: Synthetic probe
cggtggggagacacaggtccaaaggcggcaccacacggatgtcagcttcatcatggatag

SEQ ID NO: 5269 - DNA, 60 bp, Artificial Sequence
  Description of Artificial Sequence: Synthetic probe
ctacggtggggagacacaggtccaaaggcggcaccacacggatgtcagcttcatcatgga

SEQ ID NO: 5270 - DNA, 60 bp, Artificial Sequence
  Description of Artificial Sequence: Synthetic probe
tggcaacaacctacaacggtgactgcaagtacaaacccactagcacagccccgcgtgaga

SEQ ID NO: 5271 - DNA, 51 bp, Artificial Sequence
  Description of Artificial Sequence: Synthetic probe
tggcaacaacctacaacggtgactgcaagtacaaacccgctagcacacccc

SEQ ID NO: 5272 - DNA, 60 bp, Artificial Sequence
  Description of Artificial Sequence: Synthetic probe
tggcaacaacctacaacggtgactgcaagtacaaacccgctagcacacccccgcgtgaga

SEQ ID NO: 5273 - DNA, 60 bp, Artificial Sequence
  Description of Artificial Sequence: Synthetic probe
atggtgacaccatgcctggcctctttgcctacagagccgccaccaaagctggctactgcg

SEQ ID NO: 5274 - DNA, 60 bp, Artificial Sequence
  Description of Artificial Sequence: Synthetic probe
ctgagggctggtacgccattgatgatgaggtgttctacccttggacacccgaccctgaga

SEQ ID NO: 5275 - DNA, 60 bp, Artificial Sequence
  Description of Artificial Sequence: Synthetic probe
ctgagggctggtacgccattgatgatgaggtgttctacccatggacgcctgaccctgaga

SEQ ID NO: 5276 - DNA, 60 bp, Artificial Sequence
  Description of Artificial Sequence: Synthetic probe
gtgactgcaagtacaggccagctgaccaagccccgcgaaccaacattcgcggagatctcg

SEQ ID NO: 5277 - DNA, 59 bp, Artificial Sequence
  Description of Artificial Sequence: Synthetic probe
gtgactgcaagtacaggccagttgaccaagccccgcgaaccaacattcgcggagatctc

SEQ ID NO: 5278 - DNA, 60 bp, Artificial Sequence
  Description of Artificial Sequence: Synthetic probe
tcccatacaccgctccccaccgtgtgctggcaacagtgtacaacgggaagacgacgtacg

SEQ ID NO: 5279 - DNA, 60 bp, Artificial Sequence
  Description of Artificial Sequence: Synthetic probe
ggacgttatgcaggtacacaagaacagtatcgtgggcgcgcttctccgcgcagccacata

SEQ ID NO: 5280 - DNA, 60 bp, Artificial Sequence
  Description of Artificial Sequence: Synthetic probe
ggtggccctcaccaaacctgccaaacaactttacaatttcgacctgctgatgttggccgg

SEQ ID NO: 5281 - DNA, 60 bp, Artificial Sequence
  Description of Artificial Sequence: Synthetic probe
aaggtggccctcaccaaacctgccaaacaactttacaatttcgacctgctgatgttggcc

SEQ ID NO: 5282 - DNA, 60 bp, Artificial Sequence
  Description of Artificial Sequence: Synthetic probe
gcccgtgctgacacactacgaccaccaaggcaaagatcgctacaaggtggccctcaccaa

SEQ ID NO: 5283 - DNA, 55 bp, Artificial Sequence
  Description of Artificial Sequence: Synthetic probe
agaggcggaagtgacgtcgtacgtgaggatgaaacgggcggagctctactgcccc

SEQ ID NO: 5284 - DNA, 60 bp, Artificial Sequence
  Description of Artificial Sequence: Synthetic probe
gcttgctactacctacaacggtgactgcaagtacaacccacaaggtcaagccccgcggac

SEQ ID NO: 5285 - DNA, 51 bp, Artificial Sequence
  Description of Artificial Sequence: Synthetic probe
cactgaacttttgatccgcatgaaacgcgcggagacatactgccccaggcc

SEQ ID NO: 5286 - DNA, 60 bp, Artificial Sequence
  Description of Artificial Sequence: Synthetic probe
ctacgcggattgctagtgagacccacatcccgacaacattcaactacgggatgatctaca

SEQ ID NO: 5287 - DNA, 53 bp, Artificial Sequence
  Description of Artificial Sequence: Synthetic probe
atcactgagcttttgatccgcatgaaacgcgcggagacatactgccccaggcc

SEQ ID NO: 5288 - DNA, 60 bp, Artificial Sequence
  Description of Artificial Sequence: Synthetic probe
agcagccctctcaaacaccagcaaccccactgcctacaacaaggcaccattcacgagact

SEQ ID NO: 5289 - DNA, 60 bp, Artificial Sequence
  Description of Artificial Sequence: Synthetic probe
cgcctttaagcgcctgaaggaaaactttgagattgttgccctgtgtttgactcttttggc

SEQ ID NO: 5290 - DNA, 60 bp, Artificial Sequence
  Description of Artificial Sequence: Synthetic probe
gaaccctacagcctacaacaaagcgccgttcacgaggcttgcgcttccctacactgcgcc

SEQ ID NO: 5291 - DNA, 60 bp, Artificial Sequence
  Description of Artificial Sequence: Synthetic probe
aaccctacagcctacaacaaagcgccgttcacgaggcttgcgcttccctacactgcgcca

SEQ ID NO: 5292 - DNA, 60 bp, Artificial Sequence
  Description of Artificial Sequence: Synthetic probe
cgacgcaccagtcgacgtttactaccgaatgaaaaggagcgaactctactgtcccagacc

SEQ ID NO: 5293 - DNA, 60 bp, Artificial Sequence
  Description of Artificial Sequence: Synthetic probe
cgacgcaccagtcgacgtttactaccgaatgaaaaggagcgaactctactgccccaggcc

SEQ ID NO: 5294 - DNA, 60 bp, Artificial Sequence
  Description of Artificial Sequence: Synthetic probe
aacaccaagcacacgctcccgtccactttcaatttcgggtacgtgaccgccgacgcacca

SEQ ID NO: 5295 - DNA, 60 bp, Artificial Sequence
  Description of Artificial Sequence: Synthetic probe
aacaccaagcacacgctcccgtccactttcaatttcgggtatgtgaccgccgacgcacca

SEQ ID NO: 5296 - DNA, 60 bp, Artificial Sequence
  Description of Artificial Sequence: Synthetic probe
tggcagcctaacggggcaccgcggaccgcccaacttggtgataatcccatggttttcgcc

SEQ ID NO: 5297 - DNA, 60 bp, Artificial Sequence
  Description of Artificial Sequence: Synthetic probe
ccttgcacaaagactgagcgggcagctgcccacctctttcaactacggcgctgtaaaggc

SEQ ID NO: 5298 - DNA, 60 bp, Artificial Sequence
  Description of Artificial Sequence: Synthetic probe
ggatttacactgaagccgacgttgacgtgtacgtaaggatgaaacgcgcggaactctact

SEQ ID NO: 5299 - DNA, 60 bp, Artificial Sequence
  Description of Artificial Sequence: Synthetic probe
acggtgccattaaagctactcgggtgactgaactgctttaccgcatgaaaagggctgaga

SEQ ID NO: 5300 - DNA, 60 bp, Artificial Sequence
  Description of Artificial Sequence: Synthetic probe
gcagatccctgcacacacgctggttggagcactgcttcggtctgcgacgtactacttctc

SEQ ID NO: 5301 - DNA, 53 bp, Artificial Sequence
  Description of Artificial Sequence: Synthetic probe
agtactccaacatcaagcacacgctcccgtccactttcaactttgggcacgtc

SEQ ID NO: 5302 - DNA, 60 bp, Artificial Sequence
  Description of Artificial Sequence: Synthetic probe
cggtgaaggtctcgtcgcaagacagacacaaacagaagatcattgcaccagcaaaacagc

SEQ ID NO: 5303 - DNA, 60 bp, Artificial Sequence
  Description of Artificial Sequence: Synthetic probe
ccccaccgtgtactggcgacagtgtacaacgggaagactacgtacggggaaacaacttca

SEQ ID NO: 5304 - DNA, 60 bp, Artificial Sequence
  Description of Artificial Sequence: Synthetic probe
ctacgtctccgccagtgacttctcctacacccacacagacacaccagcaatggcgaccac

SEQ ID NO: 5305 - DNA, 60 bp, Artificial Sequence
  Description of Artificial Sequence: Synthetic probe
tcacgagactagcactgccttataccgcgccacaccgcgtgttggcaacggtgtacaacg

SEQ ID NO: 5306 - DNA, 60 bp, Artificial Sequence
  Description of Artificial Sequence: Synthetic probe
caacccgatggttttctcacacaacaacgttacccggtttgccgtgccatacaccgcacc

SEQ ID NO: 5307 - DNA, 60 bp, Artificial Sequence
  Description of Artificial Sequence: Synthetic probe
taacccgatggttttctcacacaacaacgttacccggtttgccgtgccatacaccgcacc

SEQ ID NO: 5308 - DNA, 52 bp, Artificial Sequence
  Description of Artificial Sequence: Synthetic probe
ttactgagcttttgatccgcatgaaacgcgcggagacatactgccctaggcc

SEQ ID NO: 5309 - DNA, 60 bp, Artificial Sequence
  Description of Artificial Sequence: Synthetic probe
tgggtgacttccacgctggcattttcctgaaaggacaagagcatgctgtgttcgcctgtg

SEQ ID NO: 5310 - DNA, 60 bp, Artificial Sequence
  Description of Artificial Sequence: Synthetic probe
ctgaagtcgacgtgtacgttaggatgaaacgtgcggagctttactgcccgcgccctctcc

SEQ ID NO: 5311 - DNA, 60 bp, Artificial Sequence
  Description of Artificial Sequence: Synthetic probe
tattgcgtgcagccacgtactacttctctgacttggagattgttgtgcggcatgacggca

SEQ ID NO: 5312 - DNA, 60 bp, Artificial Sequence
  Description of Artificial Sequence: Synthetic probe
tgacaccatcacggagctgttgatccgcatgaaacgcgcggagacatactgccctaggcc

SEQ ID NO: 5313 - DNA, 60 bp, Artificial Sequence
  Description of Artificial Sequence: Synthetic probe
gcagaggcttgcaagcgagacacacattccaaccactttcaactatggcaggatttacac

SEQ ID NO: 5314 - DNA, 60 bp, Artificial Sequence
  Description of Artificial Sequence: Synthetic probe
tgggacactggactgaactccaagttcacgttcacagtgccgtacatgtctgcagctgac

SEQ ID NO: 5315 - DNA, 59 bp, Artificial Sequence
  Description of Artificial Sequence: Synthetic probe
gagacctcgcgaccctcgcggccaggatagccagtgagacacacattccaaccactttt

SEQ ID NO: 5316 - DNA, 60 bp, Artificial Sequence
  Description of Artificial Sequence: Synthetic probe
gaagtgggcgacaatccagtcgtcttctccgctaatggtaccacccgctttgcattgccc

SEQ ID NO: 5317 - DNA, 60 bp, Artificial Sequence
  Description of Artificial Sequence: Synthetic probe
cccacctctttcaactacggcgctgtgaaggctgacaccatcactgagcttttgatccgc

SEQ ID NO: 5318 - DNA, 60 bp, Artificial Sequence
  Description of Artificial Sequence: Synthetic probe
gctccagaactcagtgaagtgggcgacaatccagtcgtcttctccgctaatggtaccacc

SEQ ID NO: 5319 - DNA, 60 bp, Artificial Sequence
  Description of Artificial Sequence: Synthetic probe
cgagcttctcgtgcgcatgaaacgggccgaactctactgccctagaccactgttggcact

SEQ ID NO: 5320 - DNA, 60 bp, Artificial Sequence
  Description of Artificial Sequence: Synthetic probe
gcagccacgtactacttctccgacttggagattgttgtgcggcacgatggtaatctgacc

SEQ ID NO: 5321 - DNA, 60 bp, Artificial Sequence
  Description of Artificial Sequence: Synthetic probe
gttctcaaccgcggtcaacgcgtgcgagacatcacgatgcacttccgcgatcaggtacac

SEQ ID NO: 5322 - DNA, 60 bp, Artificial Sequence
  Description of Artificial Sequence: Synthetic probe
atggttctcaaccgcggacaacgcgtgcgagacatcacgatgcacttccgcgaccaggta

SEQ ID NO: 5323 - DNA, 60 bp, Artificial Sequence
  Description of Artificial Sequence: Synthetic probe
agcactcatggttctcaaccgcggtcaacgcgtgcgagacatcacgatgcacttccgcga

SEQ ID NO: 5324 - DNA, 51 bp, Artificial Sequence
  Description of Artificial Sequence: Synthetic probe
cgctcggcgcctgccgacgtcgttcaactttggtgcagttaaagcagaaac

SEQ ID NO: 5325 - DNA, 60 bp, Artificial Sequence
  Description of Artificial Sequence: Synthetic probe
aagtcgatgtgtacgtgagaatgaagcgggcggagctttactgccctcgcccggtgctga

SEQ ID NO: 5326 - DNA, 60 bp, Artificial Sequence
  Description of Artificial Sequence: Synthetic probe
gaggcggaagtcgatgtgtacgtgagaatgaagcgggcggagctttactgccctcgcccg

SEQ ID NO: 5327 - DNA, 60 bp, Artificial Sequence
  Description of Artificial Sequence: Synthetic probe
ccgccatccgtggtgaccgtgctgtcttggcagcaaagtactccaacatcaagcacacgc

SEQ ID NO: 5328 - DNA, 60 bp, Artificial Sequence
  Description of Artificial Sequence: Synthetic probe
accgcctacaacaaaacgccgttcacgagacttgccctcccctacactgcgccacaccgc

SEQ ID NO: 5329 - DNA, 60 bp, Artificial Sequence
  Description of Artificial Sequence: Synthetic probe
ccaccgcctacaacaaaacgccgttcacgagacttgccctcccctacactgcgccacacc

SEQ ID NO: 5330 - DNA, 60 bp, Artificial Sequence
  Description of Artificial Sequence: Synthetic probe
ccaccgcctacaataaaaagccgttcacgagacttgccctcccctacactgcgccacacc

SEQ ID NO: 5331 - DNA, 60 bp, Artificial Sequence
  Description of Artificial Sequence: Synthetic probe
cgagcggctgcccacctccttcaactacggcgctgtaaaggctgaaaccatcactgagct

SEQ ID NO: 5332 - DNA, 60 bp, Artificial Sequence
  Description of Artificial Sequence: Synthetic probe
tgcagccacgtactacttctctgacctggagattgtggcgcgccacgaaggcaacctaac

SEQ ID NO: 5333 - DNA, 60 bp, Artificial Sequence
  Description of Artificial Sequence: Synthetic probe
cgtgcggccacgtactacttctctgacctggagattgtggtgcgccacacagacaaccta

SEQ ID NO: 5334 - DNA, 60 bp, Artificial Sequence
  Description of Artificial Sequence: Synthetic probe
caggtgcttggcaacaacctacaacggtgactgtaagtacaagcccactggcacggcccc

SEQ ID NO: 5335 - DNA, 60 bp, Artificial Sequence
  Description of Artificial Sequence: Synthetic probe
ggcagagctcctgagaccaacgtgagaggtgacctacaagtgttggcccagaaggcagct

SEQ ID NO: 5336 - DNA, 60 bp, Artificial Sequence
  Description of Artificial Sequence: Synthetic probe
ggcgagagctccgagaccaatgtgagaggtgacctacaagtgttggcccagaaggcagca

SEQ ID NO: 5337 - DNA, 60 bp, Artificial Sequence
  Description of Artificial Sequence: Synthetic probe
cgtgcagccacgtactacttctctgacctggagattgtggcgcgccacgaaggcaaccta

SEQ ID NO: 5338 - DNA, 60 bp, Artificial Sequence
  Description of Artificial Sequence: Synthetic probe
gttacgtgcagccacgtactacttctctgacctggagattgtggcgcgccacgaaggcaa

SEQ ID NO: 5339 - DNA, 60 bp, Artificial Sequence
  Description of Artificial Sequence: Synthetic probe
tgccttgttacgtgcggccacgtactacttctctgacctggagattgtggtgcgccacac

SEQ ID NO: 5340 - DNA, 60 bp, Artificial Sequence
  Description of Artificial Sequence: Synthetic probe
gtgccttgtttcgtgctgccacgtactacttctctgacctggagattgtggtgcgccaca

SEQ ID NO: 5341 - DNA, 60 bp, Artificial Sequence
  Description of Artificial Sequence: Synthetic probe
ccgagctctactgccccaggccactgctggcagtggaggtgtcgtcgcaagacagacaca

SEQ ID NO: 5342 - DNA, 60 bp, Artificial Sequence
  Description of Artificial Sequence: Synthetic probe
atgaacacaactgactgttttatcgctctgttgcacgctatcagagagatcaagacactg

SEQ ID NO: 5343 - DNA, 60 bp, Artificial Sequence
  Description of Artificial Sequence: Synthetic probe
ggccggcgttggcaccagcactcgccccagcgagatctgtgtgatcaacggagtcaccat

SEQ ID NO: 5344 - DNA, 60 bp, Artificial Sequence
  Description of Artificial Sequence: Synthetic probe
cgtgccgagctctactgtcccaggcctctgctgacagtggaagtgtctgtcgcaggacag

SEQ ID NO: 5345 - DNA, 60 bp, Artificial Sequence
  Description of Artificial Sequence: Synthetic probe
cgtgccgagctctactgtcccaggcctctgctggcagtggaagtgttgtcgcaggacaga

SEQ ID NO: 5346 - DNA, 60 bp, Artificial Sequence
  Description of Artificial Sequence: Synthetic probe
cgtgccgagctctactgtcccaggcctctgctgacagtggaagtgttgtcgcaggacaga

SEQ ID NO: 5347 - DNA, 60 bp, Artificial Sequence
  Description of Artificial Sequence: Synthetic probe
gcagacatcaccacggacgacaagactcttgacgaggcggaaaagaaccctctagagacc

SEQ ID NO: 5348 - DNA, 60 bp, Artificial Sequence
  Description of Artificial Sequence: Synthetic probe
ccacgaacttctcgtgcgcatgaaacgggccgaactctactgtcctaggccactactggc

SEQ ID NO: 5349 - DNA, 58 bp, Artificial Sequence
  Description of Artificial Sequence: Synthetic probe
accatttacgaggcttgcgctcccctacactgcgccacaccgcgtgttggcaacagtg

SEQ ID NO: 5350 - DNA, 60 bp, Artificial Sequence
  Description of Artificial Sequence: Synthetic probe
atcctcgatgggaagacggtggccatctgctgtgctaccggagtgtttggcactgcctac

SEQ ID NO: 5351 - DNA, 60 bp, Artificial Sequence
  Description of Artificial Sequence: Synthetic probe
tgggagcgcttctccgcgcagccacatactacttctctgatctggaaatagcggtgaccc

SEQ ID NO: 5352 - DNA, 60 bp, Artificial Sequence
  Description of Artificial Sequence: Synthetic probe
ccggtacaagactaaactggtatcacctgaaaagcaactgtgcaatttcgacctgttaaa

SEQ ID NO: 5353 - DNA, 60 bp, Artificial Sequence
  Description of Artificial Sequence: Synthetic probe
gcggcccctgagggtcaggtacgtacacaccagcgaccggtacaagactaaactggtatc

SEQ ID NO: 5354 - DNA, 60 bp, Artificial Sequence
  Description of Artificial Sequence: Synthetic probe
gaactgtactgcccgcggcccctgagggtcaggtacgtacacaccagcgaccggtacaag

SEQ ID NO: 5355 - DNA, 60 bp, Artificial Sequence
  Description of Artificial Sequence: Synthetic probe
gacacaggtgacgtctactatcggatgaagagagctgaactgtactgcccgcggcccctg

SEQ ID NO: 5356 - DNA, 60 bp, Artificial Sequence
  Description of Artificial Sequence: Synthetic probe
ggagactgttgtgtgacacaggtgacgtctactatcggatgaagagagctgaactgtact

SEQ ID NO: 5357 - DNA, 60 bp, Artificial Sequence
  Description of Artificial Sequence: Synthetic probe
tactccaagacccaacacgtttcagcgcgccgtggcgacatggcagtgttggcacaacgt

SEQ ID NO: 5358 - DNA, 60 bp, Artificial Sequence
  Description of Artificial Sequence: Synthetic probe
agtactccaagacccaacacgtttcagcgcgccgtggcgacatggcagtgttggcacaac

SEQ ID NO: 5359 - DNA, 60 bp, Artificial Sequence
  Description of Artificial Sequence: Synthetic probe
cagcaccacacggagttcttgccactgtctacaacggaaactgcaagtactccaagaccc

SEQ ID NO: 5360 - DNA, 60 bp, Artificial Sequence
  Description of Artificial Sequence: Synthetic probe
gtacacagcaccacacggagttcttgccactgtctacaacggaaactgcaagtactccaa

SEQ ID NO: 5361 - DNA, 60 bp, Artificial Sequence
  Description of Artificial Sequence: Synthetic probe
ttcaactatggcaggatttacacagaagctgaggtcaacgtgtacgttaggatgaagcgc

SEQ ID NO: 5362 - DNA, 60 bp, Artificial Sequence
  Description of Artificial Sequence: Synthetic probe
atgacgaagacttttacccctggacgccggacccgtccgacgtcttggtatttgtcccgt

SEQ ID NO: 5363 - DNA, 60 bp, Artificial Sequence
  Description of Artificial Sequence: Synthetic probe
tgagacacacattccaaccactttcaactatggcaggatttacacagaggccgaggttga

SEQ ID NO: 5364 - DNA, 60 bp, Artificial Sequence
  Description of Artificial Sequence: Synthetic probe
gcaggcagctgcccacctccttcaattacggcgctgtaaaggctgaaaacatcactgagc

SEQ ID NO: 5365 - DNA, 60 bp, Artificial Sequence
  Description of Artificial Sequence: Synthetic probe
ggggcaactgcccacctccttcaactacggcgctgtaaaggctgacaccatcactgagct

SEQ ID NO: 5366 - DNA, 60 bp, Artificial Sequence
  Description of Artificial Sequence: Synthetic probe
atctcaattccttcccaaaagtctgtgttgtactttctcattgagaagggccaacacgaa

SEQ ID NO: 5367 - DNA, 53 bp, Artificial Sequence
  Description of Artificial Sequence: Synthetic probe
atctcaattccttcccaaaagtctgtgttgtactttctcattgagaagggcca

SEQ ID NO: 5368 - DNA, 60 bp, Artificial Sequence
  Description of Artificial Sequence: Synthetic probe
gccttgccctacaccgcgccacacagatgtctggcaacaacctacaacggtgactgcaag

SEQ ID NO: 5369 - DNA, 60 bp, Artificial Sequence
  Description of Artificial Sequence: Synthetic probe
ccgaggttgacgtgtacgtaaggatgaaacgcgcggaactctactgtccgcgtcccgttc

SEQ ID NO: 5370 - DNA, 60 bp, Artificial Sequence
  Description of Artificial Sequence: Synthetic probe
aggccgaggttgacgtgtacgtaaggatgaaacgcgcggaactctactgtccgcgtcccg

SEQ ID NO: 5371 - DNA, 60 bp, Artificial Sequence
  Description of Artificial Sequence: Synthetic probe
gaagccgacgttgacgtgtacgtaaggatgaaacgcgcggaactctactgtccgcgtccc

SEQ ID NO: 5372 - DNA, 60 bp, Artificial Sequence
  Description of Artificial Sequence: Synthetic probe
ggaggagaaactcagacggccagacggcttcacactgacgttgccttcgttcttgacagg

SEQ ID NO: 5373 - DNA, 60 bp, Artificial Sequence
  Description of Artificial Sequence: Synthetic probe
aaggtctcgtcgcaagacagacacaaacagaagatcattgcacctgcaaaacagctcctg

SEQ ID NO: 5374 - DNA, 60 bp, Artificial Sequence
  Description of Artificial Sequence: Synthetic probe
caccgccagtgcacgcggggatttggctcacctaaagacgacgcatgctcggcatttgcc

SEQ ID NO: 5375 - DNA, 60 bp, Artificial Sequence
  Description of Artificial Sequence: Synthetic probe
cgccctcaacacatcagagggctggtacgccattgatgacgaggtgttctacccatggac

SEQ ID NO: 5376 - DNA, 60 bp, Artificial Sequence
  Description of Artificial Sequence: Synthetic probe
aaaattagccctacagcccccactcacgtcattgacctcatgcaaacccaccagcactcg

SEQ ID NO: 5377 - DNA, 60 bp, Artificial Sequence
  Description of Artificial Sequence: Synthetic probe
gggcgcctgaaacagcgctggacaacaccaccaacccaacagattaccacaaggcaccac

SEQ ID NO: 5378 - DNA, 60 bp, Artificial Sequence
  Description of Artificial Sequence: Synthetic probe
gggtcccgaacggggcgcctgaaacagcgctggacaacaccaccaacccaacagattacc

SEQ ID NO: 5379 - DNA, 60 bp, Artificial Sequence
  Description of Artificial Sequence: Synthetic probe
gaatctcacctgggtcccgaacggggcgcctgaaacagcgctggacaacaccaccaaccc

SEQ ID NO: 5380 - DNA, 60 bp, Artificial Sequence
  Description of Artificial Sequence: Synthetic probe
aaacagctcctgaactttgacctacttaagttggcgggagacgttgagtccaaccctggg

SEQ ID NO: 5381 - DNA, 60 bp, Artificial Sequence
  Description of Artificial Sequence: Synthetic probe
tagaggtgtcttcacaagacaggcacaagcaaaggatcattgcacctgcaaagcagttgc

SEQ ID NO: 5382 - DNA, 60 bp, Artificial Sequence
  Description of Artificial Sequence: Synthetic probe
gcaatagaggtgtcttcacaagacaggcacaagcaaaggatcattgcacctgcaaagcag

SEQ ID NO: 5383 - DNA, 60 bp, Artificial Sequence
  Description of Artificial Sequence: Synthetic probe
cggtgccatgaaagccacttgggtgactgaactgctttaccgcatgaagagggccgaaac

SEQ ID NO: 5384 - DNA, 60 bp, Artificial Sequence
  Description of Artificial Sequence: Synthetic probe
tactgtcccaggccacttctcccggcttacgaacatgcaagccggtacagattcgacgcc

SEQ ID NO: 5385 - DNA, 60 bp, Artificial Sequence
  Description of Artificial Sequence: Synthetic probe
aattgtactgtcccaggccacttctcccggcttacgaacatgcaagccggtacagattcg

SEQ ID NO: 5386 - DNA, 60 bp, Artificial Sequence
  Description of Artificial Sequence: Synthetic probe
caaccccatggttttctcgcgcaaccgtgttactcggttcgccgtgccatacaccgcacc

SEQ ID NO: 5387 - DNA, 60 bp, Artificial Sequence
  Description of Artificial Sequence: Synthetic probe
cttctcgtgcgcatgaaacggaccgaactctactgccctagaccactgttggcactagag

SEQ ID NO: 5388 - DNA, 60 bp, Artificial Sequence
  Description of Artificial Sequence: Synthetic probe
ataaacagcccaaaatccacccatgtcattgaccttatgcaaacccaccaacacggtcta

SEQ ID NO: 5389 - DNA, 60 bp, Artificial Sequence
  Description of Artificial Sequence: Synthetic probe
tgaaaataaacagcccaaaatccacccatgtcattgaccttatgcaaacccaccaacacg

SEQ ID NO: 5390 - DNA, 60 bp, Artificial Sequence
  Description of Artificial Sequence: Synthetic probe
caacccggtcgtcttctccgctaacggcaccacccgttttgcactgccttacactgcgcc

SEQ ID NO: 5391 - DNA, 60 bp, Artificial Sequence
  Description of Artificial Sequence: Synthetic probe
ttaattacggtgcaattagagccacaaccatccacgagcttctcgtgcgcatgaagcggg

SEQ ID NO: 5392 - DNA, 60 bp, Artificial Sequence
  Description of Artificial Sequence: Synthetic probe
gcttcggtctgcgacgtactacttctcagacctagaggttgcgcttgtccacacaggccc

SEQ ID NO: 5393 - DNA, 60 bp, Artificial Sequence
  Description of Artificial Sequence: Synthetic probe
tacagattcgacgcccccatcggcgttgaaaaacaactgtgcaacttcgacctgttaaag

SEQ ID NO: 5394 - DNA, 60 bp, Artificial Sequence
  Description of Artificial Sequence: Synthetic probe
gggacagattcgacgcccccatcggcgttgaaaaacaactgtgcaacttcgacctgttaa

SEQ ID NO: 5395 - DNA, 60 bp, Artificial Sequence
  Description of Artificial Sequence: Synthetic probe
aaacccctgctcacactctggtgggggcgctccttcgcactgccacgtactactttgctg

SEQ ID NO: 5396 - DNA, 60 bp, Artificial Sequence
  Description of Artificial Sequence: Synthetic probe
accacctccgcgggtgagtcagctgaccccgtgaccgctaccgttgagaactacggtggt

SEQ ID NO: 5397 - DNA, 53 bp, Artificial Sequence
  Description of Artificial Sequence: Synthetic probe
acagcaccacaccgcgtgttggcaaccgtttacaacgggaactgcaagtacgg

SEQ ID NO: 5398 - DNA, 60 bp, Artificial Sequence
  Description of Artificial Sequence: Synthetic probe
caacggtgtcactaggttcgctgtgccatacactgcaccccaccgcctgctctcaactgt

SEQ ID NO: 5399 - DNA, 60 bp, Artificial Sequence
  Description of Artificial Sequence: Synthetic probe
tttctcgagcaacggtgtcactaggttcgctgtgccatacactgcaccccaccgcctgct

SEQ ID NO: 5400 - DNA, 60 bp, Artificial Sequence
  Description of Artificial Sequence: Synthetic probe
caccggacccgtccgacgtcctggtatttgtcccgtacgatcaagaaccactcaacggag

SEQ ID NO: 5401 - DNA, 60 bp, Artificial Sequence
  Description of Artificial Sequence: Synthetic probe
ttctacccctggacgccggatccgtccgacgttctggtgtttgtcccgtacgatcaagaa

SEQ ID NO: 5402 - DNA, 60 bp, Artificial Sequence
  Description of Artificial Sequence: Synthetic probe
atgtgagaggtgacctgcaagtgttggcccagaaggcggcaagaacgctgcctacctcct

SEQ ID NO: 5403 - DNA, 60 bp, Artificial Sequence
  Description of Artificial Sequence: Synthetic probe
aatgtgagaggtgacctgcaagtgttggcccagaaggcggcaagaacgctgcctacctcc

SEQ ID NO: 5404 - DNA, 60 bp, Artificial Sequence
  Description of Artificial Sequence: Synthetic probe
aatcccactgcctaccacaaggcaccgttcacgagacttgcactcccttacaccgcgcca

SEQ ID NO: 5405 - DNA, 60 bp, Artificial Sequence
  Description of Artificial Sequence: Synthetic probe
cactgctggcaatagaggtgtcttcacaagacagacacaaacagaagatcattgcacccg

SEQ ID NO: 5406 - DNA, 53 bp, Artificial Sequence
  Description of Artificial Sequence: Synthetic probe
gaactctattgcccgcgacctctcctcacacactacgaccacggtggcaagga

SEQ ID NO: 5407 - DNA, 60 bp, Artificial Sequence
  Description of Artificial Sequence: Synthetic probe
tgccggggagtcagcagaccctgtcaccaccaccgttgagaactacggcggtgagacaca

SEQ ID NO: 5408 - DNA, 60 bp, Artificial Sequence
  Description of Artificial Sequence: Synthetic probe
cgctctcaacacatctgagggctggtacgccattgatgatgaggtgttctacccttggac

SEQ ID NO: 5409 - DNA, 60 bp, Artificial Sequence
  Description of Artificial Sequence: Synthetic probe
cgccctcaacacatctgagggctggtacgccattgatgatgaggtgttctacccatggac

SEQ ID NO: 5410 - DNA, 60 bp, Artificial Sequence
  Description of Artificial Sequence: Synthetic probe
cgctctcaacacatctgagggctggtacgccattgatgatgaggtgttctacccatggac

SEQ ID NO: 5411 - DNA, 60 bp, Artificial Sequence
  Description of Artificial Sequence: Synthetic probe
aggctgacaccatcacggagctgttgatccgcatgaagcgtgcggagacatactgcccca

SEQ ID NO: 5412 - DNA, 60 bp, Artificial Sequence
  Description of Artificial Sequence: Synthetic probe
accactgcaacggggggatctgcggaccctgtcaccaccacggttgagaactacggtggt

SEQ ID NO: 5413 - DNA, 60 bp, Artificial Sequence
  Description of Artificial Sequence: Synthetic probe
atagtgatcatgatccgcgagactcgcaagagacagcagatggtggatgatgcagtgaac

SEQ ID NO: 5414 - DNA, 60 bp, Artificial Sequence
  Description of Artificial Sequence: Synthetic probe
tctggagaccagcggtgccagcactgttggtttcagagagaaagtcctcccgggacacaa

SEQ ID NO: 5415 - DNA, 60 bp, Artificial Sequence
  Description of Artificial Sequence: Synthetic probe
tcgttcttgacaggtttgtgaaactcactgcacccaagaacactcagactcttgacctca

SEQ ID NO: 5416 - DNA, 60 bp, Artificial Sequence
  Description of Artificial Sequence: Synthetic probe
cgcatgaagcgtgctgagctctactgccctagaccactactggcagtggaagtgacaacc

SEQ ID NO: 5417 - DNA, 60 bp, Artificial Sequence
  Description of Artificial Sequence: Synthetic probe
tgtcaggatgaagcgcgcagaactctactgcccgcgacccattctcacacactacgacca

SEQ ID NO: 5418 - DNA, 60 bp, Artificial Sequence
  Description of Artificial Sequence: Synthetic probe
cgtgtactggcgacagtgtacaacgggaagactacgtacggggaaacaacttcacggcgc

SEQ ID NO: 5419 - DNA, 60 bp, Artificial Sequence
  Description of Artificial Sequence: Synthetic probe
ccaccgtgtactggcgacagtgtacaacgggaagactacgtacggggaaacaacttcacg

SEQ ID NO: 5420 - DNA, 60 bp, Artificial Sequence
  Description of Artificial Sequence: Synthetic probe
ggcggccctagcacaaaggctgagtgggcagctgcccacctctttcaactacggcgctgt

SEQ ID NO: 5421 - DNA, 60 bp, Artificial Sequence
  Description of Artificial Sequence: Synthetic probe
acggttacgtgtacaacccgtctcggaacgactgtcacggcaggtactccaacctgttgg

SEQ ID NO: 5422 - DNA, 56 bp, Artificial Sequence
  Description of Artificial Sequence: Synthetic probe
cgccataagtggtggttccaatgagggtagcacggacaccacgtccacgcacacca

SEQ ID NO: 5423 - DNA, 60 bp, Artificial Sequence
  Description of Artificial Sequence: Synthetic probe
aacggcgcccctgagtcagccctagacaacactggcaatcccaccgcctacaacaaggca

SEQ ID NO: 5424 - DNA, 60 bp, Artificial Sequence
  Description of Artificial Sequence: Synthetic probe
caccacagatgacaagactcttgacgaggcggaaaagagccctctggagaccagcggtgc

SEQ ID NO: 5425 - DNA, 60 bp, Artificial Sequence
  Description of Artificial Sequence: Synthetic probe
gcgaacatcaccacagatgacaagactcttgacgaggcggaaaagaacccactggagacc

SEQ ID NO: 5426 - DNA, 60 bp, Artificial Sequence
  Description of Artificial Sequence: Synthetic probe
tcgaagagctccttgtgcgcatgaaacgtgctgaactctactgccccaggccactgctgg

SEQ ID NO: 5427 - DNA, 60 bp, Artificial Sequence
  Description of Artificial Sequence: Synthetic probe
cgcgcaactccctacttccttcaactttggtgcaattcgagccacaaccatcgaagagct

SEQ ID NO: 5428 - DNA, 60 bp, Artificial Sequence
  Description of Artificial Sequence: Synthetic probe
agcaaccccactgcctaccacaagaaaccgttcacgagacttgcgcttccctacaccgcg

SEQ ID NO: 5429 - DNA, 60 bp, Artificial Sequence
  Description of Artificial Sequence: Synthetic probe
tcataatggacaggttcgtgagagtcagcaccgtgagctccactcacgttattgacctca

SEQ ID NO: 5430 - DNA, 60 bp, Artificial Sequence
  Description of Artificial Sequence: Synthetic probe
ctacggtggtgagacacaggcccagcgacgttaccacactgacgtcagcttcataatgga

SEQ ID NO: 5431 - DNA, 60 bp, Artificial Sequence
  Description of Artificial Sequence: Synthetic probe
tactacagaatgaagcgtgctgaactttactgccccaggccacttctcccggcttacaac

SEQ ID NO: 5432 - DNA, 60 bp, Artificial Sequence
  Description of Artificial Sequence: Synthetic probe
gtactacagaatgaagcgtgctgaactttactgccccaggccacttctcccggcttacaa

SEQ ID NO: 5433 - DNA, 60 bp, Artificial Sequence
  Description of Artificial Sequence: Synthetic probe
gcttggcaacatcctacaatggtgactgtaagtacaaacccactggcacagccccgcgcg

SEQ ID NO: 5434 - DNA, 60 bp, Artificial Sequence
  Description of Artificial Sequence: Synthetic probe
taacaactactacatgcagcagtaccaaaactcaatggacacccagcttggtgacaacgc

SEQ ID NO: 5435 - DNA, 60 bp, Artificial Sequence
  Description of Artificial Sequence: Synthetic probe
tacacacaggcagaagtggacgtttacctgaggatgaagagagcagaactctactgccct

SEQ ID NO: 5436 - DNA, 60 bp, Artificial Sequence
  Description of Artificial Sequence: Synthetic probe
tccttacactgccccccaccgtgtactggcgacagtgtacaacaagaagacgacgtacgg

SEQ ID NO: 5437 - DNA, 60 bp, Artificial Sequence
  Description of Artificial Sequence: Synthetic probe
gagcgttgctgcgtgcggcgacctactacttttctgacttggaaattgttgtgcagcacg

SEQ ID NO: 5438 - DNA, 60 bp, Artificial Sequence
  Description of Artificial Sequence: Synthetic probe
aaaggaaccctaggagggtgtcgacaaacccactgtcgggcttccgggagaggagactcc

SEQ ID NO: 5439 - DNA, 60 bp, Artificial Sequence
  Description of Artificial Sequence: Synthetic probe
gcttgatgaggcggaaaagaaccctaggagggtgtcgacaaacccactgtcgggcttccg

SEQ ID NO: 5440 - DNA, 60 bp, Artificial Sequence
  Description of Artificial Sequence: Synthetic probe
ctcttgacgaggcggaaaggaaccctaggagggtgtcgacaaacccactgtcgggcttcc

SEQ ID NO: 5441 - DNA, 58 bp, Artificial Sequence
  Description of Artificial Sequence: Synthetic probe
tactgccccaggccactgctggcagtagaggtgtcatcacaagacagacacaaacaga

SEQ ID NO: 5442 - DNA, 60 bp, Artificial Sequence
  Description of Artificial Sequence: Synthetic probe
cgacctgttctcacgcactacgaccacggtggcaaggaccgttacaagacggctctcgtt

SEQ ID NO: 5443 - DNA, 54 bp, Artificial Sequence
  Description of Artificial Sequence: Synthetic probe
tgggtgggctggactcccaacggcagtccacagctgacggaagtgggcgacaac

SEQ ID NO: 5444 - DNA, 60 bp, Artificial Sequence
  Description of Artificial Sequence: Synthetic probe
tcccctacaccgcgccacaccgtgtgttggccacagtgtacaacgggacgaacaagtacg

SEQ ID NO: 5445 - DNA, 60 bp, Artificial Sequence
  Description of Artificial Sequence: Synthetic probe
aggttgacgtgtacgttaggatgaaacgtgcggagctctactgcccgcgccctctcctga

SEQ ID NO: 5446 - DNA, 60 bp, Artificial Sequence
  Description of Artificial Sequence: Synthetic probe
ctgaggttgacgtgtacgttaggatgaaacgtgcggagctctactgcccgcgccctctcc

SEQ ID NO: 5447 - DNA, 60 bp, Artificial Sequence
  Description of Artificial Sequence: Synthetic probe
cacagaggctggagtcgacgtgtacgttaggatgaaacgtgcggagctctactgcccgcg

SEQ ID NO: 5448 - DNA, 60 bp, Artificial Sequence
  Description of Artificial Sequence: Synthetic probe
ggccacgtcactgctgacagtagcgttgatgtgtactacaggatgaagcgtgctgaactt

SEQ ID NO: 5449 - DNA, 60 bp, Artificial Sequence
  Description of Artificial Sequence: Synthetic probe
tggccacgtcactgctgacagtagcgttgatgtgtactacaggatgaagcgtgctgaact

SEQ ID NO: 5450 - DNA, 60 bp, Artificial Sequence
  Description of Artificial Sequence: Synthetic probe
aacaccagcaaccccactgcctacaacaaggcaccgttcacgaggcttgctctcccttac

SEQ ID NO: 5451 - DNA, 60 bp, Artificial Sequence
  Description of Artificial Sequence: Synthetic probe
ctgaacaccagcaaccccactgcctacaacaaggcaccgttcacgagacttgctctcccc

SEQ ID NO: 5452 - DNA, 60 bp, Artificial Sequence
  Description of Artificial Sequence: Synthetic probe
gtcaaacaccagcaaccccactgcctacaacaaggcaccgttcacgagacttgctctccc

SEQ ID NO: 5453 - DNA, 60 bp, Artificial Sequence
  Description of Artificial Sequence: Synthetic probe
atgaagcgtgccgagctctactgccccaggccactgctggcggtggaggtgtcgtcgcaa

SEQ ID NO: 5454 - DNA, 60 bp, Artificial Sequence
  Description of Artificial Sequence: Synthetic probe
cggttgagaactacggaggagaaactcagacagccagacggcttcacactgacgttgcct

SEQ ID NO: 5455 - DNA, 60 bp, Artificial Sequence
  Description of Artificial Sequence: Synthetic probe
acttcgggagactgttgtgtgaaacaggcgaggtctactatcggatgaagaggacagagc

SEQ ID NO: 5456 - DNA, 60 bp, Artificial Sequence
  Description of Artificial Sequence: Synthetic probe
gacttggcggtgttagcacggcgtgttgagaatgaaaccacaagatgcagacccacgaca

SEQ ID NO: 5457 - DNA, 60 bp, Artificial Sequence
  Description of Artificial Sequence: Synthetic probe
gaacggtgtcgctcgttttgctctgccttacacagcaccacacagagttcttgcaaccgt

SEQ ID NO: 5458 - DNA, 60 bp, Artificial Sequence
  Description of Artificial Sequence: Synthetic probe
cgtccatgcaaagaacggtgtcgctcgttttgctctgccttacacagcaccacacagagt

SEQ ID NO: 5459 - DNA, 60 bp, Artificial Sequence
  Description of Artificial Sequence: Synthetic probe
tgcccgtacaccgaacgcgtggaggacaacccagtcgtccatgcaaagaacggtgtcgct

SEQ ID NO: 5460 - DNA, 60 bp, Artificial Sequence
  Description of Artificial Sequence: Synthetic probe
tgggttcccaacggctgcccgtacaccgaacgcgtggaggacaacccagtcgtccatgca

SEQ ID NO: 5461 - DNA, 60 bp, Artificial Sequence
  Description of Artificial Sequence: Synthetic probe
acgctgtgttcgccctcaacacatcagagggctggtacgccattgatgacgaggtgttct

SEQ ID NO: 5462 - DNA, 60 bp, Artificial Sequence
  Description of Artificial Sequence: Synthetic probe
ccgagcacgcagtgttcgccctcaacacatcagagggctggtacgccattgatgatgagg

SEQ ID NO: 5463 - DNA, 60 bp, Artificial Sequence
  Description of Artificial Sequence: Synthetic probe
catcagaggcaccgagcacgcagtgttcgccctcaacacatcagagggctggtacgccat

SEQ ID NO: 5464 - DNA, 60 bp, Artificial Sequence
  Description of Artificial Sequence: Synthetic probe
taaggatgaaacgcgcggagctctactgcccgcgtcccgtcctgacacactacgaccacg

SEQ ID NO: 5465 - DNA, 60 bp, Artificial Sequence
  Description of Artificial Sequence: Synthetic probe
gcactggcccgcgtgagaacattcgcggggacctcgcaactcttgcacagagaatcgcca

SEQ ID NO: 5466 - DNA, 60 bp, Artificial Sequence
  Description of Artificial Sequence: Synthetic probe
gctggcactggcccgcgtgagaacattcgcggggacctcgcaactcttgcacagagaatc

SEQ ID NO: 5467 - DNA, 60 bp, Artificial Sequence
  Description of Artificial Sequence: Synthetic probe
acaacggtaccacccgcttcgcactgccttacactgcaccacacaggtcgttggcaacag

SEQ ID NO: 5468 - DNA, 60 bp, Artificial Sequence
  Description of Artificial Sequence: Synthetic probe
tggactcccaacggagcccccgagttggacgaagtgggcgacaatccagtcgtcttctcg

SEQ ID NO: 5469 - DNA, 60 bp, Artificial Sequence
  Description of Artificial Sequence: Synthetic probe
taacggctgcccacacaccgaccgcgtggaagacaacccagtcgttcacgccaggaacaa

SEQ ID NO: 5470 - DNA, 60 bp, Artificial Sequence
  Description of Artificial Sequence: Synthetic probe
cttgccgacgtcgttcaactttggtgcagttaaagcagaaacagtcactgagctgctggt

SEQ ID NO: 5471 - DNA, 60 bp, Artificial Sequence
  Description of Artificial Sequence: Synthetic probe
ctcggcacttgccgacgtcgttcaactttggtgcagttaaagcagaaacaatcactgagc

SEQ ID NO: 5472 - DNA, 58 bp, Artificial Sequence
  Description of Artificial Sequence: Synthetic probe
gccactcgggtgactgaactgctttaccgcatgaagagggccgaaacatactgccccc

SEQ ID NO: 5473 - DNA, 57 bp, Artificial Sequence
  Description of Artificial Sequence: Synthetic probe
gccactcgggtgactgaactgctttaccgcatgaagagggccgaaacatactgcccc

SEQ ID NO: 5474 - DNA, 60 bp, Artificial Sequence
  Description of Artificial Sequence: Synthetic probe
cggtggggagacacaggtccagaggcgccaacacacggacgtctctttcatattggatag

SEQ ID NO: 5475 - DNA, 60 bp, Artificial Sequence
  Description of Artificial Sequence: Synthetic probe
ttacggtggggagacacaggtccagaggcgccaacacacggacgtctctttcatattgga

SEQ ID NO: 5476 - DNA, 60 bp, Artificial Sequence
  Description of Artificial Sequence: Synthetic probe
gaaggcggcaagaacgctgcctacctccttcaactacggtgccatcaaggctactcgggt

SEQ ID NO: 5477 - DNA, 60 bp, Artificial Sequence
  Description of Artificial Sequence: Synthetic probe
tgccccagacctttgctagcccttgactacccacaggaccgccgcaagcaggagatcatt

SEQ ID NO: 5478 - DNA, 60 bp, Artificial Sequence
  Description of Artificial Sequence: Synthetic probe
cgcgcggagacctactgccccagacctttgctagcccttgactacccacaggaccgccgc

SEQ ID NO: 5479 - DNA, 60 bp, Artificial Sequence
  Description of Artificial Sequence: Synthetic probe
ctaacaccatcactgagctgctgatccgcatgaaacgcgcggagacctactgccccagac

SEQ ID NO: 5480 - DNA, 60 bp, Artificial Sequence
  Description of Artificial Sequence: Synthetic probe
acggtgctgtcaaggctaacaccatcactgagctgctgatccgcatgaaacgcgcggaga

SEQ ID NO: 5481 - DNA, 60 bp, Artificial Sequence
  Description of Artificial Sequence: Synthetic probe
gcgaccgttgcacaaagggtgaacaacagcttacccacctctttcaactacggtgctgtc

SEQ ID NO: 5482 - DNA, 60 bp, Artificial Sequence
  Description of Artificial Sequence: Synthetic probe
tgcgaccgttgcacaaagggtgaacaacagcttacccacctctttcaactacggtgctgt

SEQ ID NO: 5483 - DNA, 58 bp, Artificial Sequence
  Description of Artificial Sequence: Synthetic probe
gtgtttggggccgcctcgtgcgagccgttcgcctggtgtgcttcggctgtcacccgaa

SEQ ID NO: 5484 - DNA, 60 bp, Artificial Sequence
  Description of Artificial Sequence: Synthetic probe
gtgtttggggccgcctcgtgcgagccgttcgcctggtgtgcttcggctgtcacccgaagc

SEQ ID NO: 5485 - DNA, 60 bp, Artificial Sequence
  Description of Artificial Sequence: Synthetic probe
cgttgggggccgttcgacgctccacggtgtcccccgtgtaacagattacggtgtttgggg

SEQ ID NO: 5486 - DNA, 60 bp, Artificial Sequence
  Description of Artificial Sequence: Synthetic probe
ctcttaccaccttccgcctacttggtcgtcagcgctgtcttgggcactcccgttgggggc

SEQ ID NO: 5487 - DNA, 58 bp, Artificial Sequence
  Description of Artificial Sequence: Synthetic probe
ctcttaccaccttccgcctacttggtcgtcagcgctgtcttgggcactcccgttgggg

SEQ ID NO: 5488 - DNA, 60 bp, Artificial Sequence
  Description of Artificial Sequence: Synthetic probe
gacgaacaccgcttgcgcatctcgcgtgaccggttagtactcttaccaccttccgcctac

SEQ ID NO: 5489 - DNA, 60 bp, Artificial Sequence
  Description of Artificial Sequence: Synthetic probe
tggattgtgcggacgaacaccgcttgcgcatctcgcgtgaccggttagtactcttaccac

SEQ ID NO: 5490 - DNA, 60 bp, Artificial Sequence
  Description of Artificial Sequence: Synthetic probe
acctacggctggactcacggcaccgcgtgaccattccagctggattgtgcggacgaacac

SEQ ID NO: 5491 - DNA, 60 bp, Artificial Sequence
  Description of Artificial Sequence: Synthetic probe
tcgttcacccacctacggctggactcacggcaccgcgtgaccattccagctggattgtgc

SEQ ID NO: 5492 - DNA, 60 bp, Artificial Sequence
  Description of Artificial Sequence: Synthetic probe
cttacgtctgtgtgcacgcgggaaccgatggactttcgttcacccacctacggctggact

SEQ ID NO: 5493 - DNA, 60 bp, Artificial Sequence
  Description of Artificial Sequence: Synthetic probe
gcgtagcactccacacttacgtctgtgtgcacgcgggaaccgatggactttcgttcaccc

SEQ ID NO: 5494 - DNA, 60 bp, Artificial Sequence
  Description of Artificial Sequence: Synthetic probe
agggtctcacccctagcatgccaacgacagctcctgcgtagcactccacacttacgtctg

SEQ ID NO: 5495 - DNA, 60 bp, Artificial Sequence
  Description of Artificial Sequence: Synthetic probe
ttgaaaggggacgctagggtctcacccctagcatgccaacgacagctcctgcgtagcact

SEQ ID NO: 5496 - DNA, 60 bp, Artificial Sequence
  Description of Artificial Sequence: Synthetic probe
tgccttataccgcgccacaccgcgtgttggcaacggtgtacaacgggacgagcaagtact

SEQ ID NO: 5497 - DNA, 60 bp, Artificial Sequence
  Description of Artificial Sequence: Synthetic probe
tgagacacacattccaaccactttcaactatggcaggatttacacagaggctgaggttga

SEQ ID NO: 5498 - DNA, 60 bp, Artificial Sequence
  Description of Artificial Sequence: Synthetic probe
tgagacacacattccaaccactttcaactatggcaggatttacacagaagctgaggttga

SEQ ID NO: 5499 - DNA, 60 bp, Artificial Sequence
  Description of Artificial Sequence: Synthetic probe
gtgagacacaggtccagcggcgtcaccacactgatgtcggcttcataatggacagatttg

SEQ ID NO: 5500 - DNA, 50 bp, Artificial Sequence
  Description of Artificial Sequence: Synthetic probe
actgagcttttaatccgcatgaaacgcgcggagacatactgccccaggcc

SEQ ID NO: 5501 - DNA, 60 bp, Artificial Sequence
  Description of Artificial Sequence: Synthetic probe
tgagaactacggaggagagactcagtcggcccgacggctacacactgacgttgcttttgt

SEQ ID NO: 5502 - DNA, 60 bp, Artificial Sequence
  Description of Artificial Sequence: Synthetic probe
tgagaactacggaggagagactcagtcggcccgacggctacacactgacgttgcttttat

SEQ ID NO: 5503 - DNA, 60 bp, Artificial Sequence
  Description of Artificial Sequence: Synthetic probe
agcggtgcgccaccgaccgacttgcaaaagatggtcatggctaacgtcaagcctgttgag

SEQ ID NO: 5504 - DNA, 60 bp, Artificial Sequence
  Description of Artificial Sequence: Synthetic probe
actgcttcggtctgcgacgtactacttctcagacctagaggttgcgcttgtacacacagg

SEQ ID NO: 5505 - DNA, 60 bp, Artificial Sequence
  Description of Artificial Sequence: Synthetic probe
cggatccgtccgacgttttggtgtttgttccgtacgatcaagaaccactcaacggagaat

SEQ ID NO: 5506 - DNA, 60 bp, Artificial Sequence
  Description of Artificial Sequence: Synthetic probe
tgcaatacgagccaccgccatccacgagcttctcgtgcgcatgaagcgtgccgagctcta

SEQ ID NO: 5507 - DNA, 60 bp, Artificial Sequence
  Description of Artificial Sequence: Synthetic probe
tgcccacacaccgaccgcgtggaagacaacccagtcgttcacgcgaagaacggtgttgcc

SEQ ID NO: 5508 - DNA, 60 bp, Artificial Sequence
  Description of Artificial Sequence: Synthetic probe
aatggctgcccacacaccgaccgcgtggaagacaacccagtcgtacacgcgaagaacggc

SEQ ID NO: 5509 - DNA, 60 bp, Artificial Sequence
  Description of Artificial Sequence: Synthetic probe
gcggtgagacacaagttcaacggcgtcaccacactgatgtcggcttcataatggacagat

SEQ ID NO: 5510 - DNA, 60 bp, Artificial Sequence
  Description of Artificial Sequence: Synthetic probe
cggtgccatcaaagctacccgggtgactgaactgctttaccgcatgaagagggccgaaac

SEQ ID NO: 5511 - DNA, 60 bp, Artificial Sequence
  Description of Artificial Sequence: Synthetic probe
cgccctcaatacatccgagggctggtacgccattgatgacgaggtgttctacccatggac

SEQ ID NO: 5512 - DNA, 60 bp, Artificial Sequence
  Description of Artificial Sequence: Synthetic probe
tcgccccagcgagatttgtgtcatcaacggggtcgtcatgactctggctgacttccacgc

SEQ ID NO: 5513 - DNA, 60 bp, Artificial Sequence
  Description of Artificial Sequence: Synthetic probe
cactagcactcgccccagcgagatttgtgtcatcaacggggtcgccatgactcttgctga

SEQ ID NO: 5514 - DNA, 60 bp, Artificial Sequence
  Description of Artificial Sequence: Synthetic probe
gtcggtaccagcactcgccccagcgagatttgtgtcatcaacggggtcgtcatgactctg

SEQ ID NO: 5515 - DNA, 60 bp, Artificial Sequence
  Description of Artificial Sequence: Synthetic probe
cgcggacaacccagctccgcgacaacccaatggtgttctcacacaacaacgtcacacgct

SEQ ID NO: 5516 - DNA, 60 bp, Artificial Sequence
  Description of Artificial Sequence: Synthetic probe
ggtgcgccgcggacaacccagctccgcgacaacccaatggtgttctcacacaacaacgtc

SEQ ID NO: 5517 - DNA, 60 bp, Artificial Sequence
  Description of Artificial Sequence: Synthetic probe
tggcagcccaacggcgcgccgcggacaacccagctccgcgacaacccaatggtgttttca

SEQ ID NO: 5518 - DNA, 55 bp, Artificial Sequence
  Description of Artificial Sequence: Synthetic probe
ggagcagacgtagtcacgactgatccctccacccacggtgggtctgtgacggaga

SEQ ID NO: 5519 - DNA, 60 bp, Artificial Sequence
  Description of Artificial Sequence: Synthetic probe
tctcgtgcgcatgaagcgtgccgaactctactgtcccagaccactgttggcggtggaggt

SEQ ID NO: 5520 - DNA, 60 bp, Artificial Sequence
  Description of Artificial Sequence: Synthetic probe
ttccctacactgcgccgcaccgcgtgttggcaacagtgtacaacgggacgaacaggtact

SEQ ID NO: 5521 - DNA, 60 bp, Artificial Sequence
  Description of Artificial Sequence: Synthetic probe
agaatgaaaccacaagatgcaggcccacgacattcaacttcgggagattgttgtgtgaca

SEQ ID NO: 5522 - DNA, 60 bp, Artificial Sequence
  Description of Artificial Sequence: Synthetic probe
accactaccgttgagaactacggaggagagactcaagtccaacgtcgccaccacaccgac

SEQ ID NO: 5523 - DNA, 60 bp, Artificial Sequence
  Description of Artificial Sequence: Synthetic probe
ccactaccgttgagaactacggaggagagactcaagtccaacgtcgccaccacaccgacg

SEQ ID NO: 5524 - DNA, 60 bp, Artificial Sequence
  Description of Artificial Sequence: Synthetic probe
ttcaggtgacgtctactaccggatgaaacgcactgagctgtactgcccacgacccctgag

SEQ ID NO: 5525 - DNA, 60 bp, Artificial Sequence
  Description of Artificial Sequence: Synthetic probe
tgcacagaggctgatggggcaactgcccacctccttcaactacggcgctgtaaaggctga

SEQ ID NO: 5526 - DNA, 60 bp, Artificial Sequence
  Description of Artificial Sequence: Synthetic probe
ggcagctgcccacctctttcaactacggcgctgtaaaggctgagaacatcactgagcttc

SEQ ID NO: 5527 - DNA, 60 bp, Artificial Sequence
  Description of Artificial Sequence: Synthetic probe
tgcgcatgaagcgtgccgaactctactgccccagaccactgttggcagaggtggagtcgt

SEQ ID NO: 5528 - DNA, 60 bp, Artificial Sequence
  Description of Artificial Sequence: Synthetic probe
caattacggcgctgtaaaggctgataacatcactgagctcctgatccgcatgaaacgcgc

SEQ ID NO: 5529 - DNA, 60 bp, Artificial Sequence
  Description of Artificial Sequence: Synthetic probe
cttgcacagaagattgctagtgagacacacattccaaccactttcaactatggcaggatt

SEQ ID NO: 5530 - DNA, 60 bp, Artificial Sequence
  Description of Artificial Sequence: Synthetic probe
cctgcttctttcaacttcggtgcaattcgagccacgaccatccacgagcttctcgtgcgc

SEQ ID NO: 5531 - DNA, 60 bp, Artificial Sequence
  Description of Artificial Sequence: Synthetic probe
cttctcgtgcgcatgaaacgggccgaactctactgccctagaccactgttgacacgagag

SEQ ID NO: 5532 - DNA, 60 bp, Artificial Sequence
  Description of Artificial Sequence: Synthetic probe
aagtacacgcagcagtccactgccattcgcggtgaccgtgccgtcctggccgcaaagtac

SEQ ID NO: 5533 - DNA, 60 bp, Artificial Sequence
  Description of Artificial Sequence: Synthetic probe
agtgcaagtacacgcagcagtccactgccattcgcggtgaccgtgccgtcttggccgcaa

SEQ ID NO: 5534 - DNA, 60 bp, Artificial Sequence
  Description of Artificial Sequence: Synthetic probe
acggtgagtgcaagtacacgcagcagtccactgccattcgcggtgaccgtgccgtcttgg

SEQ ID NO: 5535 - DNA, 60 bp, Artificial Sequence
  Description of Artificial Sequence: Synthetic probe
acggtgagtgcaagtacacgcagcagtccactgccattcgcggtgaccgtgccgtcctgg

SEQ ID NO: 5536 - DNA, 58 bp, Artificial Sequence
  Description of Artificial Sequence: Synthetic probe
ctgcgacgtactacttctcagacctggaggttgcgcttgtccacacgggcccagccac

SEQ ID NO: 5537 - DNA, 60 bp, Artificial Sequence
  Description of Artificial Sequence: Synthetic probe
agatattactggtcttgagctacacgagggtgggccacccgctctcgtcatttggaacat

SEQ ID NO: 5538 - DNA, 60 bp, Artificial Sequence
  Description of Artificial Sequence: Synthetic probe
tggtgcaattcaggccacgaccatccacgagctcctcgtgcgcatgaaacgtgccgagct

SEQ ID NO: 5539 - DNA, 60 bp, Artificial Sequence
  Description of Artificial Sequence: Synthetic probe
ctcaggagacgcactgacctacaaagacctggtcgtttgtatggacggtgacaccatgcc

SEQ ID NO: 5540 - DNA, 60 bp, Artificial Sequence
  Description of Artificial Sequence: Synthetic probe
ctctggagatgcactgacctacaaagacctggtcgtttgtatggacggtgacaccatgcc

SEQ ID NO: 5541 - DNA, 60 bp, Artificial Sequence
  Description of Artificial Sequence: Synthetic probe
ttctcaggagatgcactgacctacaaagacctggtcgtttgtatggacggtgacaccatg

SEQ ID NO: 5542 - DNA, 60 bp, Artificial Sequence
  Description of Artificial Sequence: Synthetic probe
ctcaggtgatgcactgacctacaaagacctggtcgtttgtatggacggtgacaccatgcc

SEQ ID NO: 5543 - DNA, 60 bp, Artificial Sequence
  Description of Artificial Sequence: Synthetic probe
acgttaccgcggaccaaccagttgacgtgtactacaggatgaagcgtgctgaactgtact

SEQ ID NO: 5544 - DNA, 60 bp, Artificial Sequence
  Description of Artificial Sequence: Synthetic probe
gaggagagacgcaagtccaacgtcgccaccacactgacgttgccttcgttcttgaccggt

SEQ ID NO: 5545 - DNA, 60 bp, Artificial Sequence
  Description of Artificial Sequence: Synthetic probe
gaccgttaccagacggccctcgtcaaacctgccaaacaattgtgcaacttcgacctgcta

SEQ ID NO: 5546 - DNA, 60 bp, Artificial Sequence
  Description of Artificial Sequence: Synthetic probe
gaccgttacaaaacggccctcgtcaaacctgccaaacaattgtgcaacttcgacctgcta

SEQ ID NO: 5547 - DNA, 60 bp, Artificial Sequence
  Description of Artificial Sequence: Synthetic probe
gaccgttacaagacgaccctcgtcaaacctgccaaacaattgtgcaacttcgacctgttg

SEQ ID NO: 5548 - DNA, 60 bp, Artificial Sequence
  Description of Artificial Sequence: Synthetic probe
cgttcacggacacaagggaagatggaattcacactctacaacggcgagagaaagaccttc

SEQ ID NO: 5549 - DNA, 60 bp, Artificial Sequence
  Description of Artificial Sequence: Synthetic probe
taaaacactctttcgttcacggacacaagggaagatggaattcacactctacaacggcga

SEQ ID NO: 5550 - DNA, 58 bp, Artificial Sequence
  Description of Artificial Sequence: Synthetic probe
ttttaccgctctattacacgctattagagagattaaaacactctttcgttcacggaca

SEQ ID NO: 5551 - DNA, 60 bp, Artificial Sequence
  Description of Artificial Sequence: Synthetic probe
atgaacacgactgactgttttaccgctctattacacgctattagagagattaaaacactc

SEQ ID NO: 5552 - DNA, 60 bp, Artificial Sequence
  Description of Artificial Sequence: Synthetic probe
caagacactgtttctttcaagagtcacagggaaaatggaattcacacttcacaacggtga

SEQ ID NO: 5553 - DNA, 54 bp, Artificial Sequence
  Description of Artificial Sequence: Synthetic probe
accaccacaacgggggaatctgcagaccctgtcacaaccaccgttgagaactac

SEQ ID NO: 5554 - DNA, 54 bp, Artificial Sequence
  Description of Artificial Sequence: Synthetic probe
gagacagaagatggtcgatgacgccctcgatgaatacattgagaaggcgaacat

SEQ ID NO: 5555 - DNA, 60 bp, Artificial Sequence
  Description of Artificial Sequence: Synthetic probe
tccaacggcgtcaccacactgatgtcggcttcataatggacagatttgtgaagattaaca

SEQ ID NO: 5556 - DNA, 60 bp, Artificial Sequence
  Description of Artificial Sequence: Synthetic probe
cagcatcatcaacaactactacatgcaacagtaccaaaattccatggacacccaactcgg

SEQ ID NO: 5557 - DNA, 60 bp, Artificial Sequence
  Description of Artificial Sequence: Synthetic probe
acaccatgcctggactcttcgcgtaccgcgcagggaccaaggttggatactgcggagcag

SEQ ID NO: 5558 - DNA, 55 bp, Artificial Sequence
  Description of Artificial Sequence: Synthetic probe
actttgacctgcttaagttggcaggggacgttgagtccaaccctgggcccttcaa

SEQ ID NO: 5559 - DNA, 60 bp, Artificial Sequence
  Description of Artificial Sequence: Synthetic probe
gcaaaagatcattgcacctgcaaagcagctcttgaactttgacctgcttaagttggcagg

SEQ ID NO: 5560 - DNA, 54 bp, Artificial Sequence
  Description of Artificial Sequence: Synthetic probe
agccacatactacttctctgacttggaaattgcagtgacccacactgggaagct

SEQ ID NO: 5561 - DNA, 60 bp, Artificial Sequence
  Description of Artificial Sequence: Synthetic probe
cactgcgccacaccgcgtgctggcaacagtgtacaacgggacgaacaagtactccgcggc

SEQ ID NO: 5562 - DNA, 60 bp, Artificial Sequence
  Description of Artificial Sequence: Synthetic probe
aacgtactacttctcagacctggaggttgcgcttgttcacacgggcccagccacctgggt

SEQ ID NO: 5563 - DNA, 60 bp, Artificial Sequence
  Description of Artificial Sequence: Synthetic probe
gaggtctactaccggatgaagagaaccgagctgtactgccctcgacccctgagggtgaga

SEQ ID NO: 5564 - DNA, 60 bp, Artificial Sequence
  Description of Artificial Sequence: Synthetic probe
ggtgatgtctactaccggatgaagagaaccgagctgtactgccctcggcccctgaaggtg

SEQ ID NO: 5565 - DNA, 60 bp, Artificial Sequence
  Description of Artificial Sequence: Synthetic probe
ttgtgtgacacaggcgaggtctactaccggatgaagagaaccgagctgtactgccctcga

SEQ ID NO: 5566 - DNA, 60 bp, Artificial Sequence
  Description of Artificial Sequence: Synthetic probe
ttgtgtgacacaggtgatgtctactaccggatgaagagaaccgagctgtactgccctcgg

SEQ ID NO: 5567 - DNA, 60 bp, Artificial Sequence
  Description of Artificial Sequence: Synthetic probe
ccacaagatgcaggcccacgacattcaacttcgggagattgttgtgtgacacaggcgagg

SEQ ID NO: 5568 - DNA, 52 bp, Artificial Sequence
  Description of Artificial Sequence: Synthetic probe
aaaacggtgtcgcccgttttgctctgccttacacagcaccacacagtgttct

SEQ ID NO: 5569 - DNA, 60 bp, Artificial Sequence
  Description of Artificial Sequence: Synthetic probe
ggacaacccactcgttcacgcgaaaaacggtgtcgcccgttttgctctgccttacacagc

SEQ ID NO: 5570 - DNA, 60 bp, Artificial Sequence
  Description of Artificial Sequence: Synthetic probe
acgcgtggaggacaacccgctcgttcacgcgaaaaacggtgtcgcccgttttgctctgcc

SEQ ID NO: 5571 - DNA, 60 bp, Artificial Sequence
  Description of Artificial Sequence: Synthetic probe
acgcgtggaggacaacccagtcgtttacgcgaaaaacggtgtcgcccgttttgctctgcc

SEQ ID NO: 5572 - DNA, 60 bp, Artificial Sequence
  Description of Artificial Sequence: Synthetic probe
agggaaatggaccggatgggttcccaacggctgcccacacactgaacgcgtggaggacaa

SEQ ID NO: 5573 - DNA, 60 bp, Artificial Sequence
  Description of Artificial Sequence: Synthetic probe
ggcacagggaaatggaccggatgggttcccaacggctgcccacacactgaacgcgtggag

SEQ ID NO: 5574 - DNA, 60 bp, Artificial Sequence
  Description of Artificial Sequence: Synthetic probe
ggcacagggaaatggaccggatgggttcccaacggctgcccgctcactgaacgcgtggag

SEQ ID NO: 5575 - DNA, 60 bp, Artificial Sequence
  Description of Artificial Sequence: Synthetic probe
gcgacccagcgaggtgtgtatggtagacggcacggacatgtgtcttgctgatttccacgc

SEQ ID NO: 5576 - DNA, 60 bp, Artificial Sequence
  Description of Artificial Sequence: Synthetic probe
cggtaccgcctcgcgacccagcgaggtgtgtatggtagacggcacggacatgtgtcttgc

SEQ ID NO: 5577 - DNA, 60 bp, Artificial Sequence
  Description of Artificial Sequence: Synthetic probe
gtcccagaccactcctgccagcgtacgaccaccagtcacgcgacaggtttgatgcgccca

SEQ ID NO: 5578 - DNA, 60 bp, Artificial Sequence
  Description of Artificial Sequence: Synthetic probe
cacacgctcccgtccactttcaatttcgggtatgtgaccgccgacgcaccagtcgacgtt

SEQ ID NO: 5579 - DNA, 60 bp, Artificial Sequence
  Description of Artificial Sequence: Synthetic probe
gtgacacggtttgcaatcccgttcaccgctccacaccgcctgctctccactgtttacaac

SEQ ID NO: 5580 - DNA, 60 bp, Artificial Sequence
  Description of Artificial Sequence: Synthetic probe
ttctcccacaacaaggtgacacggtttgcaatcccgttcaccgctccacaccgcctgctc

SEQ ID NO: 5581 - DNA, 51 bp, Artificial Sequence
  Description of Artificial Sequence: Synthetic probe
tggacacacagcttggcgacaacgccatcagtggtggttccaacgaggggt

SEQ ID NO: 5582 - DNA, 60 bp, Artificial Sequence
  Description of Artificial Sequence: Synthetic probe
aacaaaaccgccaccgccatccgtggagaccgcgcggtactcgcggcaaagtacgctggc

SEQ ID NO: 5583 - DNA, 60 bp, Artificial Sequence
  Description of Artificial Sequence: Synthetic probe
ggtgcccctgaagcagctttgtcaaacaccagcaaccccactgcctacaacaaggcaccg

SEQ ID NO: 5584 - DNA, 60 bp, Artificial Sequence
  Description of Artificial Sequence: Synthetic probe
aatggtgcccctgaagcagctttgtcaaacaccagcaaccccactgcctacaacaaggca

SEQ ID NO: 5585 - DNA, 60 bp, Artificial Sequence
  Description of Artificial Sequence: Synthetic probe
ggaggagagactcagtcggcccgacggctacacactgacgttgcttttgttctcgacagg

SEQ ID NO: 5586 - DNA, 60 bp, Artificial Sequence
  Description of Artificial Sequence: Synthetic probe
cgcacggaggtaacactcgccctacacggcgggttcacaccgacgtcgcatttctcttgg

SEQ ID NO: 5587 - DNA, 60 bp, Artificial Sequence
  Description of Artificial Sequence: Synthetic probe
gctgccacgtactacttctccgacctggagattgtggttcgacacgacggcagcctgaca

SEQ ID NO: 5588 - DNA, 60 bp, Artificial Sequence
  Description of Artificial Sequence: Synthetic probe
agcggatgcccaccgaccgacttgcaaaagatggtcatggcaaacgtgaagcctgttgag

SEQ ID NO: 5589 - DNA, 60 bp, Artificial Sequence
  Description of Artificial Sequence: Synthetic probe
cccacatcccaacaacatttaactacgggatgatctacacacaggcagaagtggacgtct

SEQ ID NO: 5590 - DNA, 60 bp, Artificial Sequence
  Description of Artificial Sequence: Synthetic probe
ccaccgttgagaactacggtggcgagacacaggtccagaggcgccaacacacggacgtct

SEQ ID NO: 5591 - DNA, 60 bp, Artificial Sequence
  Description of Artificial Sequence: Synthetic probe
gcgagacacaggtccagaggcgccaacacacggacgtctcgttcatattagacagatttg

SEQ ID NO: 5592 - DNA, 60 bp, Artificial Sequence
  Description of Artificial Sequence: Synthetic probe
ggcgagacacaggtccagaggcgccaacacacggacgtctcgttcatattagacagattt

SEQ ID NO: 5593 - DNA, 60 bp, Artificial Sequence
  Description of Artificial Sequence: Synthetic probe
ggcggcgagacacaggtccagaggcgccaacacacggacgtctcattcatattggacaga

SEQ ID NO: 5594 - DNA, 60 bp, Artificial Sequence
  Description of Artificial Sequence: Synthetic probe
cggtggcgagacacaggtccagaggcgccaacacacggacgtctcattcatattggacag

SEQ ID NO: 5595 - DNA, 60 bp, Artificial Sequence
  Description of Artificial Sequence: Synthetic probe
tacggcggcgagacacaggtccagaggcgccaacacacggacgtctcattcatattggac

SEQ ID NO: 5596 - DNA, 60 bp, Artificial Sequence
  Description of Artificial Sequence: Synthetic probe
ttgagaactacggtggcgagacacaggtccagaggcgccaacacacggacgtctcattca

SEQ ID NO: 5597 - DNA, 60 bp, Artificial Sequence
  Description of Artificial Sequence: Synthetic probe
gttgagaactacggtggcgagacacaggtccagaggcgccaacacacggacgtctcattc

SEQ ID NO: 5598 - DNA, 60 bp, Artificial Sequence
  Description of Artificial Sequence: Synthetic probe
ttgagaactacggcggcgagacacaggtccagaggcgccaacacacggacgtctcattca

SEQ ID NO: 5599 - DNA, 60 bp, Artificial Sequence
  Description of Artificial Sequence: Synthetic probe
gagacgccaccacaccgacgttggcttcatcatggacagatttgtgaaaataaacagccc

SEQ ID NO: 5600 - DNA, 60 bp, Artificial Sequence
  Description of Artificial Sequence: Synthetic probe
agagacgccaccacaccgacgttggcttcatcatggacagatttgtgaaaataaacagcc

SEQ ID NO: 5601 - DNA, 60 bp, Artificial Sequence
  Description of Artificial Sequence: Synthetic probe
gtacgatcaagaaccgctcaacggagaatggaaagcaaaggttcaaaaacgactcaaggg

SEQ ID NO: 5602 - DNA, 60 bp, Artificial Sequence
  Description of Artificial Sequence: Synthetic probe
agcggtgcgccaccgaccgacctgcaaaagatggtcatggccaacgtcaagcccgtcgag

SEQ ID NO: 5603 - DNA, 60 bp, Artificial Sequence
  Description of Artificial Sequence: Synthetic probe
aagacacgccggtactcgtcaggtccagagtggacggcgagtcccgccacggagatcaac

SEQ ID NO: 5604 - DNA, 60 bp, Artificial Sequence
  Description of Artificial Sequence: Synthetic probe
ttgtccaaggccacttctcccggcctaccaacacggtatccgggacaggttcgacgcgcc

SEQ ID NO: 5605 - DNA, 60 bp, Artificial Sequence
  Description of Artificial Sequence: Synthetic probe
ccgcctgctctccactgtttacaacggtgagtgtaactactccacgtcggtgacgccggt

SEQ ID NO: 5606 - DNA, 60 bp, Artificial Sequence
  Description of Artificial Sequence: Synthetic probe
acgtcctacaacggtgactgcaagtacaagcccgctggcacagccccacgcgagaacatt

SEQ ID NO: 5607 - DNA, 60 bp, Artificial Sequence
  Description of Artificial Sequence: Synthetic probe
acatcgtacaacggtgactgcaagtacaagcccgctggcacagtcccgcgcgagaacatc

SEQ ID NO: 5608 - DNA, 60 bp, Artificial Sequence
  Description of Artificial Sequence: Synthetic probe
caacgtcctacaacggtgactgcaagtacaagcccgctggcacagccccacgcgagaaca

SEQ ID NO: 5609 - DNA, 60 bp, Artificial Sequence
  Description of Artificial Sequence: Synthetic probe
acaggtgcctagcaacatcgtacaacggtgactgcaagtacaagcccgctggcacagtcc

SEQ ID NO: 5610 - DNA, 60 bp, Artificial Sequence
  Description of Artificial Sequence: Synthetic probe
agatcccctcacacacgctggttggagcactgcttcggtctgcgacgtactacttctcag

SEQ ID NO: 5611 - DNA, 59 bp, Artificial Sequence
  Description of Artificial Sequence: Synthetic probe
agtcgacgtttactaccggatgaagagggcggagctttactgtccaagacctctcctcc

SEQ ID NO: 5612 - DNA, 60 bp, Artificial Sequence
  Description of Artificial Sequence: Synthetic probe
ctgacccactatgaccatcagggcagggaccgctacaaagtggccctaaccaaacctgcc

SEQ ID NO: 5613 - DNA, 60 bp, Artificial Sequence
  Description of Artificial Sequence: Synthetic probe
gctgactcactatgatcaccagggcaaggaccgctacaaagtggccctaaccaaacctgc

SEQ ID NO: 5614 - DNA, 60 bp, Artificial Sequence
  Description of Artificial Sequence: Synthetic probe
cactctttcgttcacgagacacaggaaagatggaattcacactctacaacggcgagaaaa

SEQ ID NO: 5615 - DNA, 60 bp, Artificial Sequence
  Description of Artificial Sequence: Synthetic probe
taaaacactctttcgttcacgagacacaggaaagatggaattcacactctacaacggtga

SEQ ID NO: 5616 - DNA, 60 bp, Artificial Sequence
  Description of Artificial Sequence: Synthetic probe
caaaacactgtttctttcacgaaacacaggaaagatggaattcacactctacaacggtga

SEQ ID NO: 5617 - DNA, 60 bp, Artificial Sequence
  Description of Artificial Sequence: Synthetic probe
caaaacactctttcgttcacgagacacaggaaagatggaattcacactctacaacggcga

SEQ ID NO: 5618 - DNA, 60 bp, Artificial Sequence
  Description of Artificial Sequence: Synthetic probe
cgtgcggaaacatactgccccaggcctttactagctcttgacaccacacaagaccgccgt

SEQ ID NO: 5619 - DNA, 60 bp, Artificial Sequence
  Description of Artificial Sequence: Synthetic probe
tgaaggccgatgccatcacggagctgttgatccgcatgaggcgtgcggaaacatactgcc

SEQ ID NO: 5620 - DNA, 60 bp, Artificial Sequence
  Description of Artificial Sequence: Synthetic probe
acggtgcggtgaaggccgatgccatcacggagctgttgatccgcatgaggcgtgcggaaa

SEQ ID NO: 5621 - DNA, 60 bp, Artificial Sequence
  Description of Artificial Sequence: Synthetic probe
tgccgcacttgcgcgcagagtgaacaaccggctgcccacctccttcaactacggtgcggt

SEQ ID NO: 5622 - DNA, 52 bp, Artificial Sequence
  Description of Artificial Sequence: Synthetic probe
ggaagagtccacgcggcgtggtgatcttgccgcacttgcgcgcagagtgaac

SEQ ID NO: 5623 - DNA, 60 bp, Artificial Sequence
  Description of Artificial Sequence: Synthetic probe
tacaacgggaagacaacgtacggggaagagtccacgcggcgtggtgatcttgccgcactt

SEQ ID NO: 5624 - DNA, 60 bp, Artificial Sequence
  Description of Artificial Sequence: Synthetic probe
cggcggaagtgtagtggagaagagacggatgcacacagatgtcgcgttcgtgcttgacag

SEQ ID NO: 5625 - DNA, 60 bp, Artificial Sequence
  Description of Artificial Sequence: Synthetic probe
acacggcggaagtgtagtggagaagagacggatgcacacagatgtcgcgttcgtgcttga

SEQ ID NO: 5626 - DNA, 60 bp, Artificial Sequence
  Description of Artificial Sequence: Synthetic probe
gatatggcggcccttgcacagaggctgagcaggcagctgcccacctccttcaattacggc

SEQ ID NO: 5627 - DNA, 60 bp, Artificial Sequence
  Description of Artificial Sequence: Synthetic probe
caggacactgtttctttcaagagtcacaggaagaatggaattcacactttacaacggtga

SEQ ID NO: 5628 - DNA, 60 bp, Artificial Sequence
  Description of Artificial Sequence: Synthetic probe
cgtggccttcacccacaaggtgcacaagaacacgtttttggcggggctggccgactatta

SEQ ID NO: 5629 - DNA, 60 bp, Artificial Sequence
  Description of Artificial Sequence: Synthetic probe
ggccgcttttgacgtggccttcacccacaaggtgcacaagaacacgtttctggcggggtt

SEQ ID NO: 5630 - DNA, 60 bp, Artificial Sequence
  Description of Artificial Sequence: Synthetic probe
cgaagagcagtggggacaaggtaatggccgcttttgacgtggccttcacccacaaggtgc

SEQ ID NO: 5631 - DNA, 60 bp, Artificial Sequence
  Description of Artificial Sequence: Synthetic probe
ccgtacgttgtgacgaagagcagtggggacaaggtaatggccgcttttgacgtggccttc

SEQ ID NO: 5632 - DNA, 60 bp, Artificial Sequence
  Description of Artificial Sequence: Synthetic probe
ccacacttctgaacttcgacgggaaaccgtacgttgtgacgaaaaacaacggggacaagg

SEQ ID NO: 5633 - DNA, 60 bp, Artificial Sequence
  Description of Artificial Sequence: Synthetic probe
gacgtcgctgaggcatgccccacactactgaacttcgacgggaaaccgtacgttgtgacg

SEQ ID NO: 5634 - DNA, 55 bp, Artificial Sequence
  Description of Artificial Sequence: Synthetic probe
actaaaaggggccggacaatccagtccggcaaccgggtcacagaaccaatcaggc

SEQ ID NO: 5635 - DNA, 58 bp, Artificial Sequence
  Description of Artificial Sequence: Synthetic probe
acgactaaaaggggccggacaatccagtccggcaaccgggtcacagaaccaatcaggc

SEQ ID NO: 5636 - DNA, 60 bp, Artificial Sequence
  Description of Artificial Sequence: Synthetic probe
agaagagacggatgcacacagacgttgcgttcgtgcttgacaggttcacacacgttcaca

SEQ ID NO: 5637 - DNA, 60 bp, Artificial Sequence
  Description of Artificial Sequence: Synthetic probe
ggcggaagtgtagtagagaagaggcgaatgcacacagacgttgcgttcgtgcttgacagg

SEQ ID NO: 5638 - DNA, 60 bp, Artificial Sequence
  Description of Artificial Sequence: Synthetic probe
cggtggaagtgtagtcgagaagagacgaatgcacacagacgttgcgttcgtgcttgacag

SEQ ID NO: 5639 - DNA, 60 bp, Artificial Sequence
  Description of Artificial Sequence: Synthetic probe
gagtcggcagaccctgtcaccaccactgtggagaactacggtggcgagacacaagttcag

SEQ ID NO: 5640 - DNA, 60 bp, Artificial Sequence
  Description of Artificial Sequence: Synthetic probe
actaccgctactggggagtcggcagaccctgtcaccaccactgtggagaactacggtggc

SEQ ID NO: 5641 - DNA, 60 bp, Artificial Sequence
  Description of Artificial Sequence: Synthetic probe
tttcaactacggcgctgtaaaggctgacaccatcactgagcttttgatccgcatgaaacg

SEQ ID NO: 5642 - DNA, 60 bp, Artificial Sequence
  Description of Artificial Sequence: Synthetic probe
acaacgtacacgagcttctcgtgcgcatgaaacgggccgaactctactgccctagaccac

SEQ ID NO: 5643 - DNA, 60 bp, Artificial Sequence
  Description of Artificial Sequence: Synthetic probe
gctgagtggacggctgcccacctccttcaactacggcgctgtaaaggctgaaaccatcac

SEQ ID NO: 5644 - DNA, 60 bp, Artificial Sequence
  Description of Artificial Sequence: Synthetic probe
ggggatggtgcacgactccatcaaagaggagctccgccctctcgtccaacagacctcatt

SEQ ID NO: 5645 - DNA, 60 bp, Artificial Sequence
  Description of Artificial Sequence: Synthetic probe
gccgaactctactgccctagaccactgctggcaatagaggtgtcttcacaagacagacac

SEQ ID NO: 5646 - DNA, 60 bp, Artificial Sequence
  Description of Artificial Sequence: Synthetic probe
gaggtgtcttcacaagacaggcacaagcaaaagatcattgcacctgcaaagcagttgctg

SEQ ID NO: 5647 - DNA, 60 bp, Artificial Sequence
  Description of Artificial Sequence: Synthetic probe
gcacagaggctgagcaggcagctgcccacctccttcaattacggcgctgtaaaggctgat

SEQ ID NO: 5648 - DNA, 60 bp, Artificial Sequence
  Description of Artificial Sequence: Synthetic probe
tgatccgcatgaaacgcgcggagacatactgccccaggcctctgttggctcttgacacca

SEQ ID NO: 5649 - DNA, 50 bp, Artificial Sequence
  Description of Artificial Sequence: Synthetic probe
cccttacaccgccccccaccgtgtgctggcaacagtgtacaacgggaaga

SEQ ID NO: 5650 - DNA, 60 bp, Artificial Sequence
  Description of Artificial Sequence: Synthetic probe
attcgagccactaccatccacgagctcctcgtgcgcatgaagcgtgccgaactctactgc

SEQ ID NO: 5651 - DNA, 60 bp, Artificial Sequence
  Description of Artificial Sequence: Synthetic probe
ggagctttattgccctaggcccatccttccactccagcctacgggtgacaggcacaagca

SEQ ID NO: 5652 - DNA, 60 bp, Artificial Sequence
  Description of Artificial Sequence: Synthetic probe
cggagctttattgccctaggcccatccttccactccagcttacgggtgacaggcacaagc

SEQ ID NO: 5653 - DNA, 60 bp, Artificial Sequence
  Description of Artificial Sequence: Synthetic probe
ctacggcggtgagacacaagtccagagacgccaccacacagacgttggcttcattatgga

SEQ ID NO: 5654 - DNA, 60 bp, Artificial Sequence
  Description of Artificial Sequence: Synthetic probe
ctacggcggtgagacacaagtccagagacgccagcacacggacgtcggcttcatcatgga

SEQ ID NO: 5655 - DNA, 60 bp, Artificial Sequence
  Description of Artificial Sequence: Synthetic probe
ctacggcggtgagacacaagtccagagacgccaccacacagacgtcggcttcatcatgga

SEQ ID NO: 5656 - DNA, 60 bp, Artificial Sequence
  Description of Artificial Sequence: Synthetic probe
acaacccagtcgatgtttactaccggatgaagagggctgaactgtactgtccacgcccgc

SEQ ID NO: 5657 - DNA, 60 bp, Artificial Sequence
  Description of Artificial Sequence: Synthetic probe
acaaaccagtcgatgtttactaccggatgaagagggctgaactgtactgtccacgcccgc

SEQ ID NO: 5658 - DNA, 60 bp, Artificial Sequence
  Description of Artificial Sequence: Synthetic probe
acagcccagtcgatgtttactaccggatgaagagggctgaactgtactgtccacgcccgc

SEQ ID NO: 5659 - DNA, 60 bp, Artificial Sequence
  Description of Artificial Sequence: Synthetic probe
tctcgtgcgcatgaagcgtgccgaactctactgccccagaccactgttggcggtggaggt

SEQ ID NO: 5660 - DNA, 60 bp, Artificial Sequence
  Description of Artificial Sequence: Synthetic probe
aaaattagccctacaacccccacccacgtcattgacctcatgcaaacccaccagcactcg

SEQ ID NO: 5661 - DNA, 60 bp, Artificial Sequence
  Description of Artificial Sequence: Synthetic probe
cgtgctctggcttatcaaggactgtcttcaaaccggtgttggcaccagcactcgccccag

SEQ ID NO: 5662 - DNA, 60 bp, Artificial Sequence
  Description of Artificial Sequence: Synthetic probe
cgtgctttggctcatcaagggctgtcttcaaaccggtgttggcaccagcactcgcccaag

SEQ ID NO: 5663 - DNA, 60 bp, Artificial Sequence
  Description of Artificial Sequence: Synthetic probe
ccgttgagaactacggaggagagactcaagtccaacgtcgccaccacaccgacgttgcct

SEQ ID NO: 5664 - DNA, 60 bp, Artificial Sequence
  Description of Artificial Sequence: Synthetic probe
taccgttgagaactacggaggagagactcaagtccaacgtcgccaccacaccgacgttgc

SEQ ID NO: 5665 - DNA, 60 bp, Artificial Sequence
  Description of Artificial Sequence: Synthetic probe
gtttgcctgtgtcacctccaacgggtggtacgcgattgatgacgaggacttttacccctg

SEQ ID NO: 5666 - DNA, 60 bp, Artificial Sequence
  Description of Artificial Sequence: Synthetic probe
aggacaggacatgctctcagacgccgcactcatggtgctacaccgtgggaaccgtgtgag

SEQ ID NO: 5667 - DNA, 50 bp, Artificial Sequence
  Description of Artificial Sequence: Synthetic probe
ttgcgggtcagatacacgcacaccactgaccggtacaagaccaagctggt

SEQ ID NO: 5668 - DNA, 60 bp, Artificial Sequence
  Description of Artificial Sequence: Synthetic probe
ccgaactctactgccccagaccattgttggcggtggaggtgtcgtcgcaagacagacaca

SEQ ID NO: 5669 - DNA, 60 bp, Artificial Sequence
  Description of Artificial Sequence: Synthetic probe
gggccgaactctactgccccagaccactgttggcaatagaggtgtcttcacaagacagac

SEQ ID NO: 5670 - DNA, 60 bp, Artificial Sequence
  Description of Artificial Sequence: Synthetic probe
acgggccgaactctactgccccagaccactgttggcaatagaggtgtcttcacaagacag

SEQ ID NO: 5671 - DNA, 60 bp, Artificial Sequence
  Description of Artificial Sequence: Synthetic probe
cgcctgagaacctcactctcgaggcaatcaggcagttggaagaggttactggccttgagc

SEQ ID NO: 5672 - DNA, 60 bp, Artificial Sequence
  Description of Artificial Sequence: Synthetic probe
tactgccatccacgagctgctcgtgcgcatgaagcgtgccgaactctactgccccagacc

SEQ ID NO: 5673 - DNA, 60 bp, Artificial Sequence
  Description of Artificial Sequence: Synthetic probe
gacggatgcacacagacgttgcgttcgtgcttgacaggttcacacacgttcacaccaaga

SEQ ID NO: 5674 - DNA, 59 bp, Artificial Sequence
  Description of Artificial Sequence: Synthetic probe
ggagtgttcgggacggcctacctcgtgcctcgtcatcttttcgctgagaagtatgacaa

SEQ ID NO: 5675 - DNA, 60 bp, Artificial Sequence
  Description of Artificial Sequence: Synthetic probe
ggagtgttcgggacggcctacctcgtgcctcgtcatcttttcgctgagaagtatgacaag

SEQ ID NO: 5676 - DNA, 60 bp, Artificial Sequence
  Description of Artificial Sequence: Synthetic probe
accactgccacgggtgagtcagcagaccctgtcaccaccaccgtggaaaactacggcggt

SEQ ID NO: 5677 - DNA, 60 bp, Artificial Sequence
  Description of Artificial Sequence: Synthetic probe
tacaggagaagttgatctccgtggcaggactcgccgtccactctggacctgacgagtacc

SEQ ID NO: 5678 - DNA, 60 bp, Artificial Sequence
  Description of Artificial Sequence: Synthetic probe
catacaggagaagttgatctccgtggcaggactcgccgtccactctggacctgacgagta

SEQ ID NO: 5679 - DNA, 60 bp, Artificial Sequence
  Description of Artificial Sequence: Synthetic probe
tgggaccatacaggagaagttgatctccgtggcaggactcgccgtccactccggaccaga

SEQ ID NO: 5680 - DNA, 60 bp, Artificial Sequence
  Description of Artificial Sequence: Synthetic probe
ttgcacgccgtgggaccatacaggagaagttgatctccgtggcaggactcgccgtccact

SEQ ID NO: 5681 - DNA, 60 bp, Artificial Sequence
  Description of Artificial Sequence: Synthetic probe
ctcctttgcacgccgtgggaccatacaggagaagttgatctccgtggcaggactcgccgt

SEQ ID NO: 5682 - DNA, 60 bp, Artificial Sequence
  Description of Artificial Sequence: Synthetic probe
tcctctcctttgcacgccgtgggaccatacaggagaagttgatctccgtggcaggactcg

SEQ ID NO: 5683 - DNA, 60 bp, Artificial Sequence
  Description of Artificial Sequence: Synthetic probe
ccatcctctcctttgcacgccgtgggaccatacaggagaagttgatctccgtggcaggac

SEQ ID NO: 5684 - DNA, 60 bp, Artificial Sequence
  Description of Artificial Sequence: Synthetic probe
cccttgaggctatcctctcctttgcacgccgtgggaccatacaggagaagttgatctccg

SEQ ID NO: 5685 - DNA, 60 bp, Artificial Sequence
  Description of Artificial Sequence: Synthetic probe
ggagatcaacttctcctgtatggtcccacggcgtgcaaaggagaggatagcctcgagggt

SEQ ID NO: 5686 - DNA, 60 bp, Artificial Sequence
  Description of Artificial Sequence: Synthetic probe
cgaagaccctcgaggccatcctctcctttgcacgccgtgggaccatacaggagaagttga

SEQ ID NO: 5687 - DNA, 60 bp, Artificial Sequence
  Description of Artificial Sequence: Synthetic probe
acttctcctgtatggtcccacggcgtgcaaaggagaggatagcctcgagggtcttcgagg

SEQ ID NO: 5688 - DNA, 60 bp, Artificial Sequence
  Description of Artificial Sequence: Synthetic probe
gcctcaaagacccttgaggctatcctctcctttgcacgccgtgggaccatacaggagaag

SEQ ID NO: 5689 - DNA, 60 bp, Artificial Sequence
  Description of Artificial Sequence: Synthetic probe
atggcctcaaagacccttgaggctatcctctcctttgcacgccgtgggaccatacaggag

SEQ ID NO: 5690 - DNA, 52 bp, Artificial Sequence
  Description of Artificial Sequence: Synthetic probe
gtgcgcatgaaacgggccgaactctactgccctagaccactgttggcactag

SEQ ID NO: 5691 - DNA, 60 bp, Artificial Sequence
  Description of Artificial Sequence: Synthetic probe
tcatcatggacagatttgtgaagataaacagcctcagccccacacacgtcatagacctca

SEQ ID NO: 5692 - DNA, 60 bp, Artificial Sequence
  Description of Artificial Sequence: Synthetic probe
tgacttgggagctcttgcggcgagggtcgccgcccaactccctgcctctttcaactttgg

SEQ ID NO: 5693 - DNA, 60 bp, Artificial Sequence
  Description of Artificial Sequence: Synthetic probe
aatgggacgagcaagtactcgacaactggtgggcacacacggggtgacttgggagctctc

SEQ ID NO: 5694 - DNA, 60 bp, Artificial Sequence
  Description of Artificial Sequence: Synthetic probe
aagtacaaacccactggcacagccccgcgtgagaacatccgtggggacttcgcgactctt

SEQ ID NO: 5695 - DNA, 60 bp, Artificial Sequence
  Description of Artificial Sequence: Synthetic probe
actgaagccgaggtcgacgtgtatgttaggatgaagcgtgcggagctttactgcccgcgg

SEQ ID NO: 5696 - DNA, 60 bp, Artificial Sequence
  Description of Artificial Sequence: Synthetic probe
ggatttacactgaagccgaggtcgacgtgtatgttaggatgaagcgtgcggagctttact

SEQ ID NO: 5697 - DNA, 52 bp, Artificial Sequence
  Description of Artificial Sequence: Synthetic probe
ccacgcgaaaacatccgtggtgacctcgcaactcttgcggcgaggattgcaa

SEQ ID NO: 5698 - DNA, 60 bp, Artificial Sequence
  Description of Artificial Sequence: Synthetic probe
cttgacctcatgcaaattccctcacacacgctggttggagcactgcttcggtctgcgacg

SEQ ID NO: 5699 - DNA, 60 bp, Artificial Sequence
  Description of Artificial Sequence: Synthetic probe
ggccctcacctacaaggacattgtagtgtgcatggatggcgacaccatgcctggcctctt

SEQ ID NO: 5700 - DNA, 60 bp, Artificial Sequence
  Description of Artificial Sequence: Synthetic probe
ggcagctgcccacctccttcaactacggcgctgtaaaggctgaagctattactgagctcc

SEQ ID NO: 5701 - DNA, 60 bp, Artificial Sequence
  Description of Artificial Sequence: Synthetic probe
aggtatggtaacgttgcgaccaacgtgagactgcaagtgttggcccaggcggcgagaacg

SEQ ID NO: 5702 - DNA, 60 bp, Artificial Sequence
  Description of Artificial Sequence: Synthetic probe
gcaggtatggtaacgttgcgaccaacgtgagactgcaagtgttggcccaggcggcgagaa

SEQ ID NO: 5703 - DNA, 60 bp, Artificial Sequence
  Description of Artificial Sequence: Synthetic probe
ccacggcaccacgcgtgttggctactgttgggaactgcaggtatggtaacgttgcgacca

SEQ ID NO: 5704 - DNA, 60 bp, Artificial Sequence
  Description of Artificial Sequence: Synthetic probe
ccggcttgcactgcccacggcaccacgcgtgttggctactgttgggaactgcaggtatgg

SEQ ID NO: 5705 - DNA, 60 bp, Artificial Sequence
  Description of Artificial Sequence: Synthetic probe
tatgctttgttggcggtgaaaggaaacgtcccgaacggggcgcctgaaacagcgctggac

SEQ ID NO: 5706 - DNA, 60 bp, Artificial Sequence
  Description of Artificial Sequence: Synthetic probe
gcgctgctacctatgctttgttggcggtgaaaggaaacgtcccgaacggggcgcctgaaa

SEQ ID NO: 5707 - DNA, 54 bp, Artificial Sequence
  Description of Artificial Sequence: Synthetic probe
ccccgctcacactctggtggcactccttcgcgctgctacctatgctttgttggc

SEQ ID NO: 5708 - DNA, 60 bp, Artificial Sequence
  Description of Artificial Sequence: Synthetic probe
cattaatgtgttactgcaaacccccgctcacactctggtggcactccttcgcgctgctac

SEQ ID NO: 5709 - DNA, 60 bp, Artificial Sequence
  Description of Artificial Sequence: Synthetic probe
gacgccaagatgtctcattcatattggataaggtgccaaaagacattaatgtgttactgc

SEQ ID NO: 5710 - DNA, 60 bp, Artificial Sequence
  Description of Artificial Sequence: Synthetic probe
gagatcagacgccaagatgtctcattcatattggataaggtgccaaaagacattaatgtg

SEQ ID NO: 5711 - DNA, 59 bp, Artificial Sequence
  Description of Artificial Sequence: Synthetic probe
ctgcctacaacaaggcaccgttcacgagacttgctctcccttacactgcgccacaccgc

SEQ ID NO: 5712 - DNA, 60 bp, Artificial Sequence
  Description of Artificial Sequence: Synthetic probe
actgaggtcgacgtgtacgttaggatgaagcgcgcagaactctactgcccgcgccctctc

SEQ ID NO: 5713 - DNA, 60 bp, Artificial Sequence
  Description of Artificial Sequence: Synthetic probe
cggcggaagtgtagtggagaagagacggatgcacacagatgttgcgttcgtgcttgacag

SEQ ID NO: 5714 - DNA, 60 bp, Artificial Sequence
  Description of Artificial Sequence: Synthetic probe
ttgctcgtgcgcatgaagcgtgccgaactctactgccccagaccactgttggctgtgaag

SEQ ID NO: 5715 - DNA, 60 bp, Artificial Sequence
  Description of Artificial Sequence: Synthetic probe
tacagcctacaacaaagcgccgttcacgaggcttgcgcttccctacactgcaccacaccg

SEQ ID NO: 5716 - DNA, 60 bp, Artificial Sequence
  Description of Artificial Sequence: Synthetic probe
ctttgctagctcttggaaccactcaggaccgccgtaaacaggagatcattgcacctgaga

SEQ ID NO: 5717 - DNA, 60 bp, Artificial Sequence
  Description of Artificial Sequence: Synthetic probe
acgttacagctgacaaagcagttgacgtgtactacaggatgaagcgtgctgaactgtact

SEQ ID NO: 5718 - DNA, 59 bp, Artificial Sequence
  Description of Artificial Sequence: Synthetic probe
acacagaggcggaagtcgatgtgtatgtgaggatgaagcgggcggagctctactgcccc

SEQ ID NO: 5719 - DNA, 60 bp, Artificial Sequence
  Description of Artificial Sequence: Synthetic probe
acacagaggcggaagtcgatgtgtatgtgaggatgaagcgggcggagctctactgccccc

SEQ ID NO: 5720 - DNA, 60 bp, Artificial Sequence
  Description of Artificial Sequence: Synthetic probe
ggcaggatttacactgaggcggaagtcgatgtgtatgtgaggatgaagcgggcggagctc

SEQ ID NO: 5721 - DNA, 60 bp, Artificial Sequence
  Description of Artificial Sequence: Synthetic probe
cctacaccgccccccaccgtgtgctggcaacagtgtacaacgggaagacggcgtacgggg

SEQ ID NO: 5722 - DNA, 60 bp, Artificial Sequence
  Description of Artificial Sequence: Synthetic probe
acgatcacgcagaccgggacagattcgacgcccccatcggcgttgaaaaacaactgtgta

SEQ ID NO: 5723 - DNA, 60 bp, Artificial Sequence
  Description of Artificial Sequence: Synthetic probe
cccgcctggcactcccctacacagcgccccaccgtgtgctggcaacagtgtacaacggga

SEQ ID NO: 5724 - DNA, 60 bp, Artificial Sequence
  Description of Artificial Sequence: Synthetic probe
gtctgcaacatactacttctcagacctggaggttgcgcttgttcacacgggcccagccac

SEQ ID NO: 5725 - DNA, 60 bp, Artificial Sequence
  Description of Artificial Sequence: Synthetic probe
cgccggatccgtccgacgttctggtgtttgtcccgtacgatcaagaaccactcaacggag

SEQ ID NO: 5726 - DNA, 60 bp, Artificial Sequence
  Description of Artificial Sequence: Synthetic probe
acgccggatccgtccgacgttctggtgtttgtcccgtacgatcaagaaccactcaacggg

SEQ ID NO: 5727 - DNA, 60 bp, Artificial Sequence
  Description of Artificial Sequence: Synthetic probe
gagaccgctgcccacctccttcaactacggtgccatcaaggccactcgggtgacagaact

SEQ ID NO: 5728 - DNA, 60 bp, Artificial Sequence
  Description of Artificial Sequence: Synthetic probe
gcgccctctcctgacgcactacgatcacaacggcaaggatcgctacaagaccgcgataac

SEQ ID NO: 5729 - DNA, 60 bp, Artificial Sequence
  Description of Artificial Sequence: Synthetic probe
tgcccgcgccctctcctgacgcactacgatcacaacggcaaggatcgctacaagaccgcg

SEQ ID NO: 5730 - DNA, 60 bp, Artificial Sequence
  Description of Artificial Sequence: Synthetic probe
cgcgcaacaacatccgtggagatctcgcgactctcgcgaacaggattgccagtgagacac

SEQ ID NO: 5731 - DNA, 60 bp, Artificial Sequence
  Description of Artificial Sequence: Synthetic probe
ccgcgcaacaacatccgtggagatctcgcgactctcgcgaacaggattgccagtgagaca

SEQ ID NO: 5732 - DNA, 60 bp, Artificial Sequence
  Description of Artificial Sequence: Synthetic probe
ggatgaagcgtgccgagttgtactgtccacgcccgttcctgccagcttacaatcacgcag

SEQ ID NO: 5733 - DNA, 60 bp, Artificial Sequence
  Description of Artificial Sequence: Synthetic probe
tcgacgtttactaccggatgaagcgtgccgagttgtactgtccacgcccgttcctgccag

SEQ ID NO: 5734 - DNA, 60 bp, Artificial Sequence
  Description of Artificial Sequence: Synthetic probe
gagcggtgttggctgcaaagtacagctctggtggccacgcgctaccttccaccttcaact

SEQ ID NO: 5735 - DNA, 60 bp, Artificial Sequence
  Description of Artificial Sequence: Synthetic probe
ggggttacgcgtttcgcaatcccgtacaccgccccacacaggttactgtcaaccgtgtac

SEQ ID NO: 5736 - DNA, 60 bp, Artificial Sequence
  Description of Artificial Sequence: Synthetic probe
tggtcatgggcaacaccaagcctgtcgagctcatcctcgatgggaaaacggtggccatct

SEQ ID NO: 5737 - DNA, 60 bp, Artificial Sequence
  Description of Artificial Sequence: Synthetic probe
gcgccgcgcactacgcagctgggtgacaacccaatggtgtttgcgcacaacggggttacg

SEQ ID NO: 5738 - DNA, 60 bp, Artificial Sequence
  Description of Artificial Sequence: Synthetic probe
tgtaggcgctgtcctgagatcagcaacttactacttttgtgaccttgagattgcgtgcgt

SEQ ID NO: 5739 - DNA, 60 bp, Artificial Sequence
  Description of Artificial Sequence: Synthetic probe
acacatgtgcacaccaacaaaaccactttccccgtggacctcatggccaccaaggagaag

SEQ ID NO: 5740 - DNA, 60 bp, Artificial Sequence
  Description of Artificial Sequence: Synthetic probe
ctaccagcacaatgaccgggacaggttcgacgcccccattggtgtcgagaaacagttgtg

SEQ ID NO: 5741 - DNA, 55 bp, Artificial Sequence
  Description of Artificial Sequence: Synthetic probe
ctttcccattgacccagtcaggcaaaccacgtctgctggtgagggagctgacgtc

SEQ ID NO: 5742 - DNA, 60 bp, Artificial Sequence
  Description of Artificial Sequence: Synthetic probe
cacagacacaccagccatggctaccaccaatggttgggttgtggttttgcaggtcaccga

SEQ ID NO: 5743 - DNA, 60 bp, Artificial Sequence
  Description of Artificial Sequence: Synthetic probe
gtttcacgttcgcagtaccgtacctgtcatctgctgattactcttacacccacacagaca

SEQ ID NO: 5744 - DNA, 60 bp, Artificial Sequence
  Description of Artificial Sequence: Synthetic probe
ctcgaacaaaggtgtcaccaggttcgctgtgccatacactgcaccccaccgcctgctttc

SEQ ID NO: 5745 - DNA, 60 bp, Artificial Sequence
  Description of Artificial Sequence: Synthetic probe
ctcgaacaaacgtgtcaccaggttcgctgtgccatacactgcaccccaccgcctgctttc

SEQ ID NO: 5746 - DNA, 60 bp, Artificial Sequence
  Description of Artificial Sequence: Synthetic probe
gttttctcgaacaaaggtgtcaccaggttcgctgtgccatacactgcaccccaccgcctg

SEQ ID NO: 5747 - DNA, 60 bp, Artificial Sequence
  Description of Artificial Sequence: Synthetic probe
cgctgcgcattgctaccattctgagtgggacacaggtttgaactcgagtttcacgttcgc

SEQ ID NO: 5748 - DNA, 60 bp, Artificial Sequence
  Description of Artificial Sequence: Synthetic probe
cacctggcatcgaagtaagtgcgttgcccaacacacctgaggacgctgcgcattgctacc

SEQ ID NO: 5749 - DNA, 60 bp, Artificial Sequence
  Description of Artificial Sequence: Synthetic probe
accacttcatgtacacggggccaacccaccacaaagcaaagttcatggtagcgtacgtgc

SEQ ID NO: 5750 - DNA, 60 bp, Artificial Sequence
  Description of Artificial Sequence: Synthetic probe
cgcagactactacacgcagtactctggcagtctgaactaccacttcatgtacacggggcc

SEQ ID NO: 5751 - DNA, 60 bp, Artificial Sequence
  Description of Artificial Sequence: Synthetic probe
atgacagcatttgacgtggctttcacccacaaagttcacaagaacacgtatctggccgga

SEQ ID NO: 5752 - DNA, 60 bp, Artificial Sequence
  Description of Artificial Sequence: Synthetic probe
gctggatgtggcagaggcttgccctactctcctaaactttgatggtaagccatacgtggt

SEQ ID NO: 5753 - DNA, 60 bp, Artificial Sequence
  Description of Artificial Sequence: Synthetic probe
gtgccgatggttatggtgggtttcagaacaccgacccgaagtccgctgatccaatctacg

SEQ ID NO: 5754 - DNA, 60 bp, Artificial Sequence
  Description of Artificial Sequence: Synthetic probe
atgaacagcgggaccgtcgaggtctacgcaaacattgccccaaccaacgtctacgtggct

SEQ ID NO: 5755 - DNA, 60 bp, Artificial Sequence
  Description of Artificial Sequence: Synthetic probe
caggtgccatacctgggtgtgaaccgccacgatcagggtaaaagacaccagtcttggtcc

SEQ ID NO: 5756 - DNA, 60 bp, Artificial Sequence
  Description of Artificial Sequence: Synthetic probe
cagctcacgctctacccgcaccagtttattaaccccaggaccaacaccacagctcacatc

SEQ ID NO: 5757 - DNA, 57 bp, Artificial Sequence
  Description of Artificial Sequence: Synthetic probe
acacagttcaacggtggttcactcctcgttgcaatggttccagaactttgcagcctg

SEQ ID NO: 5758 - DNA, 60 bp, Artificial Sequence
  Description of Artificial Sequence: Synthetic probe
gtcctggagttgcccaaagatcacaaaggcatctacggtaaactgaccgactcctacacg

SEQ ID NO: 5759 - DNA, 60 bp, Artificial Sequence
  Description of Artificial Sequence: Synthetic probe
agttgttcgactggacctccgacaaaccctttggaacattgtacgtcctggagttgccca

SEQ ID NO: 5760 - DNA, 60 bp, Artificial Sequence
  Description of Artificial Sequence: Synthetic probe
gcctggacccaacacctcgggtctagagacccgcgtggaacaagctgagcgcttcttcaa

SEQ ID NO: 5761 - DNA, 60 bp, Artificial Sequence
  Description of Artificial Sequence: Synthetic probe
gctggccgacaagaagaccgaggaaaccacgcttttggaagaccgtattctcaccacgag

SEQ ID NO: 5762 - DNA, 60 bp, Artificial Sequence
  Description of Artificial Sequence: Synthetic probe
gaacaacgattggttttcaaagttggcccagtccgcaatctccgggattttcggagcatt

SEQ ID NO: 5763 - DNA, 60 bp, Artificial Sequence
  Description of Artificial Sequence: Synthetic probe
ggagcagggcaatccagcccagcgaccggatcgcagaaccagtcaggcaatactggtagc

SEQ ID NO: 5764 - DNA, 60 bp, Artificial Sequence
  Description of Artificial Sequence: Synthetic probe
gtcccgtacgatcaagagccactcaacggggaatggaagatgaaggttcagaagcgactc

SEQ ID NO: 5765 - DNA, 60 bp, Artificial Sequence
  Description of Artificial Sequence: Synthetic probe
cttggacgccggacccgtctgacgttctggtttttgtcccgtacgatcaagagccactca

SEQ ID NO: 5766 - DNA, 60 bp, Artificial Sequence
  Description of Artificial Sequence: Synthetic probe
cttggacgccggacccgtccaacgttctggtttttgtcccgtacgatcaagagccactca

SEQ ID NO: 5767 - DNA, 60 bp, Artificial Sequence
  Description of Artificial Sequence: Synthetic probe
ccgacatcgttcaactttggtgcagttaaagcagaaacaatcactgagttgctcgtgcgc

SEQ ID NO: 5768 - DNA, 59 bp, Artificial Sequence
  Description of Artificial Sequence: Synthetic probe
caccattcacgagactcgcgcttccctacactgcgccacaccgcgtgctggcaacagtg

SEQ ID NO: 5769 - DNA, 60 bp, Artificial Sequence
  Description of Artificial Sequence: Synthetic probe
gcaatagaggtgtcgtctcaagacagacacaaacagaagattattgcgcctgcaaaacaa

SEQ ID NO: 5770 - DNA, 60 bp, Artificial Sequence
  Description of Artificial Sequence: Synthetic probe
gaggtgtcgtctcaagacagacacaaacagaagattattgcgcctgcaaaacaactcctg

SEQ ID NO: 5771 - DNA, 60 bp, Artificial Sequence
  Description of Artificial Sequence: Synthetic probe
acaacccagtcgtcttctccactaacggcaccacccgttttgcactgccttacaccgccc

SEQ ID NO: 5772 - DNA, 60 bp, Artificial Sequence
  Description of Artificial Sequence: Synthetic probe
tctcgtgcgcatgaagcgtgccgaactctactgccccagaccactattggcggtggaggt

SEQ ID NO: 5773 - DNA, 60 bp, Artificial Sequence
  Description of Artificial Sequence: Synthetic probe
gctggcacagccccgcgcgacaacatccgcggggacctcgcgacccttgcgcagaggctt

SEQ ID NO: 5774 - DNA, 60 bp, Artificial Sequence
  Description of Artificial Sequence: Synthetic probe
agctctactgtccaagacctctcctccctggctacgaccacgcaggcagggacaggtttg

SEQ ID NO: 5775 - DNA, 60 bp, Artificial Sequence
  Description of Artificial Sequence: Synthetic probe
gtcctggccgcaaagtacgccaacgccaaacacgaactcccgtctaccttcaacttcggc

SEQ ID NO: 5776 - DNA, 60 bp, Artificial Sequence
  Description of Artificial Sequence: Synthetic probe
gccgtcctggccgcaaagtacgccaacgccaaacacgaactcccgtctaccttcaacttc

SEQ ID NO: 5777 - DNA, 60 bp, Artificial Sequence
  Description of Artificial Sequence: Synthetic probe
tgaaagcattactgagctcttgatccgcatgaaacgcgcggagacgtactgccccaggcc

SEQ ID NO: 5778 - DNA, 60 bp, Artificial Sequence
  Description of Artificial Sequence: Synthetic probe
caagtccaacgtcgtcaccacactgacgttgccttcgttcttgaccggtttgtgaaggtc

SEQ ID NO: 5779 - DNA, 59 bp, Artificial Sequence
  Description of Artificial Sequence: Synthetic probe
acactgaggcggaagtcgatgtgtacgtgaggatgaaacgggcggagctctactgcccc

SEQ ID NO: 5780 - DNA, 60 bp, Artificial Sequence
  Description of Artificial Sequence: Synthetic probe
acactgaggcggaagtcgatgtgtacgtgaggatgaaacgggcggagctctactgccccc

SEQ ID NO: 5781 - DNA, 60 bp, Artificial Sequence
  Description of Artificial Sequence: Synthetic probe
acaagccagtcgacgtttactaccggatgaagagggcggaactctactgtccaagacctc

SEQ ID NO: 5782 - DNA, 60 bp, Artificial Sequence
  Description of Artificial Sequence: Synthetic probe
gaggttactggccttgagctgcacgagggtggaccacccgctctcgtcatttggaacatc

SEQ ID NO: 5783 - DNA, 60 bp, Artificial Sequence
  Description of Artificial Sequence: Synthetic probe
agaggttactggccttgagctgcacgagggtggaccacccgctctcgtcatttggaacat

SEQ ID NO: 5784 - DNA, 60 bp, Artificial Sequence
  Description of Artificial Sequence: Synthetic probe
cggctacgtgaccgccgacaagccagtcgacgtttactaccgaatgaagagagcggagct

SEQ ID NO: 5785 - DNA, 60 bp, Artificial Sequence
  Description of Artificial Sequence: Synthetic probe
ccgtccactttcaacttcggttacgtgaccgccgacaagccagtcgacgtttactaccgg

SEQ ID NO: 5786 - DNA, 60 bp, Artificial Sequence
  Description of Artificial Sequence: Synthetic probe
ccacgagcttctcgtgcgcatgaaacgggccgagctctactgccccaggccactgctggc

SEQ ID NO: 5787 - DNA, 51 bp, Artificial Sequence
  Description of Artificial Sequence: Synthetic probe
cactgagctcttgatccgcatgaaacgcgcggagacatactgtcccaggcc

SEQ ID NO: 5788 - DNA, 60 bp, Artificial Sequence
  Description of Artificial Sequence: Synthetic probe
ggcgtggtgatatggcggcccttgcacaaaggctgagcaaacagctgcccacctctttca

SEQ ID NO: 5789 - DNA, 60 bp, Artificial Sequence
  Description of Artificial Sequence: Synthetic probe
aatggtgactgtaagtacaagcccactggcactccggcccgcggcaacatccgcggtgac

SEQ ID NO: 5790 - DNA, 60 bp, Artificial Sequence
  Description of Artificial Sequence: Synthetic probe
cctgcgtgctgccacgtactacttctcagacctggagattgtggtgcgccacgaaggcaa

SEQ ID NO: 5791 - DNA, 60 bp, Artificial Sequence
  Description of Artificial Sequence: Synthetic probe
tgggcgctctcctgcgtgctgccacgtactacttctcagacctggagattgtggtgcgcc

SEQ ID NO: 5792 - DNA, 53 bp, Artificial Sequence
  Description of Artificial Sequence: Synthetic probe
accgggtgactgaactgctttaccgcatgaagagggctgaaacatactgcccc

SEQ ID NO: 5793 - DNA, 60 bp, Artificial Sequence
  Description of Artificial Sequence: Synthetic probe
catgtcattgacctcatgcaaacccaccaacacgggttggtgggtgccctgttacgcgct

SEQ ID NO: 5794 - DNA, 57 bp, Artificial Sequence
  Description of Artificial Sequence: Synthetic probe
gatcacgcaaacagggacaggtttgacagccccataggtgttgaaaaacaactgtgt

SEQ ID NO: 5795 - DNA, 53 bp, Artificial Sequence
  Description of Artificial Sequence: Synthetic probe
ctactcaggaccgccgtaagcaggagatcattgcacctgagaagcagatgatg

SEQ ID NO: 5796 - DNA, 60 bp, Artificial Sequence
  Description of Artificial Sequence: Synthetic probe
gtctcacgctcgagcctgctccaactcaaagcacacattgacccagaacctcgcaccgag

SEQ ID NO: 5797 - DNA, 60 bp, Artificial Sequence
  Description of Artificial Sequence: Synthetic probe
tcctgcgtctcacgctcgagcctgctccaactcaaagcacacattgacccagaacctcgc

SEQ ID NO: 5798 - DNA, 60 bp, Artificial Sequence
  Description of Artificial Sequence: Synthetic probe
tgattatcggcacacactccgccggtgggaacggtgtgggctactgctcctgcgtctcac

SEQ ID NO: 5799 - DNA, 60 bp, Artificial Sequence
  Description of Artificial Sequence: Synthetic probe
ctgtgattatcggcacacactccgccggtgggaacggtgtgggctactgctcctgcgtct

SEQ ID NO: 5800 - DNA, 60 bp, Artificial Sequence
  Description of Artificial Sequence: Synthetic probe
tggaggagccgtcatgacaaaagacggcgctcacactgtgattatcggcacacactccgc

SEQ ID NO: 5801 - DNA, 60 bp, Artificial Sequence
  Description of Artificial Sequence: Synthetic probe
caaggttggatactgtggaggagccgtcatgacaaaagacggcgctcacactgtgattat

SEQ ID NO: 5802 - DNA, 60 bp, Artificial Sequence
  Description of Artificial Sequence: Synthetic probe
acaccatgccaggactcttcgcttaccgcgcagggaccaaggttggatactgtggaggag

SEQ ID NO: 5803 - DNA, 60 bp, Artificial Sequence
  Description of Artificial Sequence: Synthetic probe
tgcatggacggtgacaccatgccaggactcttcgcttaccgcgcagggaccaaggttgga

SEQ ID NO: 5804 - DNA, 60 bp, Artificial Sequence
  Description of Artificial Sequence: Synthetic probe
caggtgatgctttgacatacaaagatgttgtcgtctgcatggacggtgacaccatgccag

SEQ ID NO: 5805 - DNA, 60 bp, Artificial Sequence
  Description of Artificial Sequence: Synthetic probe
ggagactcatcttctcaggtgatgctttgacatacaaagatgttgtcgtctgcatggacg

SEQ ID NO: 5806 - DNA, 57 bp, Artificial Sequence
  Description of Artificial Sequence: Synthetic probe
gatgcacttccgcgaccaggtacacattaagaaaggtacccccgtcctcggcgttat

SEQ ID NO: 5807 - DNA, 60 bp, Artificial Sequence
  Description of Artificial Sequence: Synthetic probe
gacgctgcactcatggttctcaaccgcggacaacgcgtgcgagacatcacgatgcacttc

SEQ ID NO: 5808 - DNA, 60 bp, Artificial Sequence
  Description of Artificial Sequence: Synthetic probe
ggtggtcttggacggcagacagctggacaacagtgacttcagagtgtttgagtttgaggt

SEQ ID NO: 5809 - DNA, 60 bp, Artificial Sequence
  Description of Artificial Sequence: Synthetic probe
aaagtatgacaaggtggtcttggacggcagacagctggacaacagtgacttcagagtgtt

SEQ ID NO: 5810 - DNA, 60 bp, Artificial Sequence
  Description of Artificial Sequence: Synthetic probe
atactcgatggtaagacggttgcgctctgctgcgcgaccggagtgttcggtactgcctac

SEQ ID NO: 5811 - DNA, 60 bp, Artificial Sequence
  Description of Artificial Sequence: Synthetic probe
gcccgttgagttgatactcgatggtaagacggttgcgctctgctgcgcgaccggagtgtt

SEQ ID NO: 5812 - DNA, 60 bp, Artificial Sequence
  Description of Artificial Sequence: Synthetic probe
gcgctccgccgaccgacttgcaaaagatggtcatggcgaacgtcaagcccgttgagttga

SEQ ID NO: 5813 - DNA, 59 bp, Artificial Sequence
  Description of Artificial Sequence: Synthetic probe
ccgcgatcaccaagcctgtcaaacaactgtgtaatttcgacctgttaaagttggccgga

SEQ ID NO: 5814 - DNA, 60 bp, Artificial Sequence
  Description of Artificial Sequence: Synthetic probe
ggggcagctgcccacctcttttaactacggcgctgtaaaggctgacaccatcactgagct

SEQ ID NO: 5815 - DNA, 56 bp, Artificial Sequence
  Description of Artificial Sequence: Synthetic probe
caggtgaggtgtactaccgcatgaagcgagctgaactttactgtccacgcccgctg

SEQ ID NO: 5816 - DNA, 60 bp, Artificial Sequence
  Description of Artificial Sequence: Synthetic probe
gctggcacaacgcgtagaaactgagcaagcaaggtgtatacccacgacattcaacttcgg

SEQ ID NO: 5817 - DNA, 60 bp, Artificial Sequence
  Description of Artificial Sequence: Synthetic probe
acgctggcacaacgcgtagaaactgagcaagcaaggtgtatacccacgacattcaacttc

SEQ ID NO: 5818 - DNA, 60 bp, Artificial Sequence
  Description of Artificial Sequence: Synthetic probe
atccacgagctcctcgtgcgcatgaagcgggccgagctctactgccccagaccactactg

SEQ ID NO: 5819 - DNA, 56 bp, Artificial Sequence
  Description of Artificial Sequence: Synthetic probe
acgggacgaacaggtacactgtgagtggttcaaacaggcggggcgacttgggcccc

SEQ ID NO: 5820 - DNA, 60 bp, Artificial Sequence
  Description of Artificial Sequence: Synthetic probe
cggagctttattgccctaggcccatccttccattccagcctacgggtgacaggcacaagc

SEQ ID NO: 5821 - DNA, 60 bp, Artificial Sequence
  Description of Artificial Sequence: Synthetic probe
tgagaacattcgcggggacctcgcgacccttgcgcagaggattgcaagcgagacacacat

SEQ ID NO: 5822 - DNA, 60 bp, Artificial Sequence
  Description of Artificial Sequence: Synthetic probe
cgcgagaacattcgcggggacctcgcgacccttgcgcagaggattgcaagcgagacacac

SEQ ID NO: 5823 - DNA, 60 bp, Artificial Sequence
  Description of Artificial Sequence: Synthetic probe
ccgcgtgagaacattcgcggggacctcgcgacccttgcgcagaggattgcaagcgagaca

SEQ ID NO: 5824 - DNA, 60 bp, Artificial Sequence
  Description of Artificial Sequence: Synthetic probe
acttttacccctggacaccggacccgtccgacgtcctggtatttgttccgtacgatcaag

SEQ ID NO: 5825 - DNA, 60 bp, Artificial Sequence
  Description of Artificial Sequence: Synthetic probe
gattcaggtgacgtctactaccggatgaagcgtaccgagctttactgcccacgacccctg

SEQ ID NO: 5826 - DNA, 60 bp, Artificial Sequence
  Description of Artificial Sequence: Synthetic probe
gaagactgttgtgtgattcaggtgacgtctactaccggatgaagcgtaccgagctttact

SEQ ID NO: 5827 - DNA, 60 bp, Artificial Sequence
  Description of Artificial Sequence: Synthetic probe
ataccacaagggaccgctgactcgactggctctcccatacaccgcgccacatcgcgtgtt

SEQ ID NO: 5828 - DNA, 60 bp, Artificial Sequence
  Description of Artificial Sequence: Synthetic probe
ggctgaagctattactgagctcctgatccgcatgaaacgcgcggagacatactgccctag

SEQ ID NO: 5829 - DNA, 60 bp, Artificial Sequence
  Description of Artificial Sequence: Synthetic probe
actacggtgccattaaagccacccgggtgactgaactgctctaccgcatgaagagggccg

SEQ ID NO: 5830 - DNA, 60 bp, Artificial Sequence
  Description of Artificial Sequence: Synthetic probe
tgcctacctctttcaactacggtgccattaaagccacccgggtgactgaactgctctacc

SEQ ID NO: 5831 - DNA, 60 bp, Artificial Sequence
  Description of Artificial Sequence: Synthetic probe
accttcaggtgctggcccagaaggcggcgagaccgctgcctacctctttcaactacggtg

SEQ ID NO: 5832 - DNA, 60 bp, Artificial Sequence
  Description of Artificial Sequence: Synthetic probe
taatgtgaggggtgaccttcaggtgctggcccagaaggcggcgagaccgctgcctacctc

SEQ ID NO: 5833 - DNA, 60 bp, Artificial Sequence
  Description of Artificial Sequence: Synthetic probe
aacgggaattgcaagtatgccgagggctcattaactaatgtgaggggtgaccttcaggtg

SEQ ID NO: 5834 - DNA, 60 bp, Artificial Sequence
  Description of Artificial Sequence: Synthetic probe
ctggctaccgtttacaacgggaattgcaagtatgccgagggctcattaactaatgtgagg

SEQ ID NO: 5835 - DNA, 60 bp, Artificial Sequence
  Description of Artificial Sequence: Synthetic probe
cggcttgcgctgccttacacggcaccacaccgtgttctggctaccgtttacaacgggaat

SEQ ID NO: 5836 - DNA, 60 bp, Artificial Sequence
  Description of Artificial Sequence: Synthetic probe
aggcaccactcacccggcttgcgctgccttacacggcaccacaccgtgttctggctaccg

SEQ ID NO: 5837 - DNA, 60 bp, Artificial Sequence
  Description of Artificial Sequence: Synthetic probe
actattggcaatagaggtgtcttcacaagacaggcacaagcaaaggatcattgcacctgc

SEQ ID NO: 5838 - DNA, 60 bp, Artificial Sequence
  Description of Artificial Sequence: Synthetic probe
ggccactattggcaatagaggtgtcttcacaagacaggcacaagcaaaggatcattgcac

SEQ ID NO: 5839 - DNA, 60 bp, Artificial Sequence
  Description of Artificial Sequence: Synthetic probe
actgccccaggccactattggcaatagaggtgtcttcacaagacaggcacaagcaaaaga

SEQ ID NO: 5840 - DNA, 53 bp, Artificial Sequence
  Description of Artificial Sequence: Synthetic probe
ccacacaggaccgccgtaaacaggagatcattgcacctgaaaagcagatgatg

SEQ ID NO: 5841 - DNA, 54 bp, Artificial Sequence
  Description of Artificial Sequence: Synthetic probe
cccactcaggaccgccgtaaacaggagatcattgcacctgaaaagcagatgatg

SEQ ID NO: 5842 - DNA, 60 bp, Artificial Sequence
  Description of Artificial Sequence: Synthetic probe
tggcagcctaacggggcaccgcggaccacccaacttggtgataatcccatggttttcgcc

SEQ ID NO: 5843 - DNA, 60 bp, Artificial Sequence
  Description of Artificial Sequence: Synthetic probe
gactacagagtgtttgagtttgagattaaagtaaaaggacaggacatgctctcagacgct

SEQ ID NO: 5844 - DNA, 60 bp, Artificial Sequence
  Description of Artificial Sequence: Synthetic probe
tgactacagagtgtttgagtttgagattaaagtaaaaggacaggacatgctctcagacgc

SEQ ID NO: 5845 - DNA, 60 bp, Artificial Sequence
  Description of Artificial Sequence: Synthetic probe
gttttgaactttgacctgctgaagttggcgggagacgtggagtccaaccctgggcccttc

SEQ ID NO: 5846 - DNA, 60 bp, Artificial Sequence
  Description of Artificial Sequence: Synthetic probe
cgacgtactacttctcagacctggaggttgcgcttgttcacacaggcccagccacatggg

SEQ ID NO: 5847 - DNA, 60 bp, Artificial Sequence
  Description of Artificial Sequence: Synthetic probe
attcctcccggcatacgaccacgcaagccgggacaggttcgacgcgcccattggcgttga

SEQ ID NO: 5848 - DNA, 60 bp, Artificial Sequence
  Description of Artificial Sequence: Synthetic probe
attcctcccggcatacgaccacgcagaccgggacaggttcgacgcgcccattggcgttga

SEQ ID NO: 5849 - DNA, 60 bp, Artificial Sequence
  Description of Artificial Sequence: Synthetic probe
gtattgcccgcgtccattcctcccggcatacgaccacgcagaccgggacaggttcgacgc

SEQ ID NO: 5850 - DNA, 60 bp, Artificial Sequence
  Description of Artificial Sequence: Synthetic probe
gtattgcccgcgtccattcctcccggcatacgaccacgcaagccgggacaggttcgacgc

SEQ ID NO: 5851 - DNA, 60 bp, Artificial Sequence
  Description of Artificial Sequence: Synthetic probe
gcgtctggcaaacacacactaccctccaccttcaacttcggattcgtgacggcagacaaa

SEQ ID NO: 5852 - DNA, 60 bp, Artificial Sequence
  Description of Artificial Sequence: Synthetic probe
ggagacagagcggtgttggctgcaaagtacgcgtctggcaaacacacactaccctccacc

SEQ ID NO: 5853 - DNA, 60 bp, Artificial Sequence
  Description of Artificial Sequence: Synthetic probe
cgcggagacagagcggtgttggctgcaaagtacgcgtctggcaaacacacactaccctcc

SEQ ID NO: 5854 - DNA, 60 bp, Artificial Sequence
  Description of Artificial Sequence: Synthetic probe
tccgcggagacagagcggtgttggctgcaaagtacgcgtctggcaaacacacactaccct

SEQ ID NO: 5855 - DNA, 60 bp, Artificial Sequence
  Description of Artificial Sequence: Synthetic probe
agactgtttctgctatccgcggagacagagcggtgttggctgcaaagtacgcgtctggca

SEQ ID NO: 5856 - DNA, 60 bp, Artificial Sequence
  Description of Artificial Sequence: Synthetic probe
caacggtgaatgtgaatacaccaagactgtttctgctatccgcggagacagagcggtgtt

SEQ ID NO: 5857 - DNA, 60 bp, Artificial Sequence
  Description of Artificial Sequence: Synthetic probe
caactgtctacaacggtgaatgtgaatacaccaagactgtttctgctatccgcggagaca

SEQ ID NO: 5858 - DNA, 60 bp, Artificial Sequence
  Description of Artificial Sequence: Synthetic probe
gtcaactgtctacaacggtgaatgtgagtacaccaagactgtttctgctatccgcggaga

SEQ ID NO: 5859 - DNA, 60 bp, Artificial Sequence
  Description of Artificial Sequence: Synthetic probe
cccgcacagattgttgtcaactgtctacaacggtgaatgtgagtacaccaagactgtttc

SEQ ID NO: 5860 - DNA, 60 bp, Artificial Sequence
  Description of Artificial Sequence: Synthetic probe
cgcggttcgcaattccgtacactgccccgcacagattgttgtcaactgtctacaacggtg

SEQ ID NO: 5861 - DNA, 60 bp, Artificial Sequence
  Description of Artificial Sequence: Synthetic probe
caaagtgacgcggttcgcaattccgtacactgccccgcacagattgttgtcaactgtcta

SEQ ID NO: 5862 - DNA, 60 bp, Artificial Sequence
  Description of Artificial Sequence: Synthetic probe
gcgcacaacaaagtgacacggttcgcaattccgtacactgccccgcacagattgttgtca

SEQ ID NO: 5863 - DNA, 60 bp, Artificial Sequence
  Description of Artificial Sequence: Synthetic probe
atggtgtttgcgcacaacaaagtgacacggttcgcaattccgtacactgccccgcacaga

SEQ ID NO: 5864 - DNA, 60 bp, Artificial Sequence
  Description of Artificial Sequence: Synthetic probe
cactacgcagttgggtgacaacccgatggtgttcgcgcacaacaaagtgacgcggttcgc

SEQ ID NO: 5865 - DNA, 60 bp, Artificial Sequence
  Description of Artificial Sequence: Synthetic probe
gcaccgcgcactacgcagttgggtgacaacccgatggtgttcgcgcacaacaaagtgacg

SEQ ID NO: 5866 - DNA, 60 bp, Artificial Sequence
  Description of Artificial Sequence: Synthetic probe
gggcgccgcgcactacgcagttgggtgacaacccgatggtgtttgcgcacaacaaagtga

SEQ ID NO: 5867 - DNA, 60 bp, Artificial Sequence
  Description of Artificial Sequence: Synthetic probe
acaggggaatcagcagaccctgtcaccaccaccgtggaaaactacggcggtgagacacag

SEQ ID NO: 5868 - DNA, 60 bp, Artificial Sequence
  Description of Artificial Sequence: Synthetic probe
actcaccaacacggcctagtgggtgcactgctgcgtgcggccacctactacttctctgat

SEQ ID NO: 5869 - DNA, 60 bp, Artificial Sequence
  Description of Artificial Sequence: Synthetic probe
aacccaccaacacggccttgtgggcgcgctgctgcgtgcggccacctactacttctctga

SEQ ID NO: 5870 - DNA, 60 bp, Artificial Sequence
  Description of Artificial Sequence: Synthetic probe
atgaagagagccgagacatactgtcccaggccccttcttgccattcaaccgagtgacgct

SEQ ID NO: 5871 - DNA, 60 bp, Artificial Sequence
  Description of Artificial Sequence: Synthetic probe
gagttactctaccgcatgaagagagccgagacatactgtcccaggccccttcttgccatt

SEQ ID NO: 5872 - DNA, 60 bp, Artificial Sequence
  Description of Artificial Sequence: Synthetic probe
tccctacatccttcaactacggtgcgcttcgtgccacggctgttcacgagcttctcgtgc

SEQ ID NO: 5873 - DNA, 60 bp, Artificial Sequence
  Description of Artificial Sequence: Synthetic probe
actcgccgtgcagctccctacatccttcaactacggtgcgcttcgtgccacggctgttca

SEQ ID NO: 5874 - DNA, 60 bp, Artificial Sequence
  Description of Artificial Sequence: Synthetic probe
aaccccacagtctaccacaaagcaccgttcacgaggcttgcacttccctacaccgcacca

SEQ ID NO: 5875 - DNA, 53 bp, Artificial Sequence
  Description of Artificial Sequence: Synthetic probe
ccccgaggctgccctccagaacatgagcaaccccacagtctaccacaaagcac

SEQ ID NO: 5876 - DNA, 60 bp, Artificial Sequence
  Description of Artificial Sequence: Synthetic probe
tgacgtgggtgcccaacggcgcccccgaggctgccctccagaacatgagcaaccccacag

SEQ ID NO: 5877 - DNA, 52 bp, Artificial Sequence
  Description of Artificial Sequence: Synthetic probe
ctcatgcagacacaccaacacgggctggtgggcgcgttgctgcgcgcagcta

SEQ ID NO: 5878 - DNA, 60 bp, Artificial Sequence
  Description of Artificial Sequence: Synthetic probe
ctcatgcagacacaccaacacgggctggtgggcgcgttgctgcgcgcagctacgtactac

SEQ ID NO: 5879 - DNA, 55 bp, Artificial Sequence
  Description of Artificial Sequence: Synthetic probe
tcattatggacagatttgtgaaaataaacaaccctaaacccacacatgtcataga

SEQ ID NO: 5880 - DNA, 60 bp, Artificial Sequence
  Description of Artificial Sequence: Synthetic probe
cggtggtgagacgcaagttcaaaggcgacaccacacggatgtaagtttcattatggacag

SEQ ID NO: 5881 - DNA, 60 bp, Artificial Sequence
  Description of Artificial Sequence: Synthetic probe
ttacggtggtgagacgcaagttcaaaggcgacaccacacggatgtaagtttcattatgga

SEQ ID NO: 5882 - DNA, 60 bp, Artificial Sequence
  Description of Artificial Sequence: Synthetic probe
gggagtctgcagaccctgtcacaactactgttgaaaattacggtggtgagacgcaagttc

SEQ ID NO: 5883 - DNA, 60 bp, Artificial Sequence
  Description of Artificial Sequence: Synthetic probe
accactacaacgggggagtctgcagaccctgtcacaactactgttgaaaattacggtggt

SEQ ID NO: 5884 - DNA, 60 bp, Artificial Sequence
  Description of Artificial Sequence: Synthetic probe
ccacgagcttctcgtgcgtatgaagcgggccgaactctactgccctagaccacttttggc

SEQ ID NO: 5885 - DNA, 60 bp, Artificial Sequence
  Description of Artificial Sequence: Synthetic probe
tccacgagcttctcgtgcgtatgaagcgggccgaactctactgccctagaccacttttgg

SEQ ID NO: 5886 - DNA, 60 bp, Artificial Sequence
  Description of Artificial Sequence: Synthetic probe
accactgcaacgggggaatctgcagaccctgtcacaaccactgttgagaactacggtggt

SEQ ID NO: 5887 - DNA, 60 bp, Artificial Sequence
  Description of Artificial Sequence: Synthetic probe
aacgtgtacgtgagaatgaagcgggcggagctctactgcccccgaccgctgctgactcac

SEQ ID NO: 5888 - DNA, 60 bp, Artificial Sequence
  Description of Artificial Sequence: Synthetic probe
ggtgcaggccagtcctctcccgccacagggtcacaaaaccaatctggcaacactggtagc

SEQ ID NO: 5889 - DNA, 60 bp, Artificial Sequence
  Description of Artificial Sequence: Synthetic probe
acagaggccgaggttgacgtgtacgttaggatgaaacgcgcggaactctactgcccgcga

SEQ ID NO: 5890 - DNA, 53 bp, Artificial Sequence
  Description of Artificial Sequence: Synthetic probe
cccgggtgactgaactgctttaccgcatgaagagggccgaaatgtactgcccc

SEQ ID NO: 5891 - DNA, 54 bp, Artificial Sequence
  Description of Artificial Sequence: Synthetic probe
cccgggtgactgaactgctttaccgcatgaagagggccgaaatgtactgccccc

SEQ ID NO: 5892 - DNA, 60 bp, Artificial Sequence
  Description of Artificial Sequence: Synthetic probe
cctctggctgatcaaggactgtcttcaaaccggcgtcggcaccagcactcgccctagtga

SEQ ID NO: 5893 - DNA, 60 bp, Artificial Sequence
  Description of Artificial Sequence: Synthetic probe
tcgtcctctggctgatcaaggactgtcttcaaaccggcgtcggtaccagcactcgcccca

SEQ ID NO: 5894 - DNA, 60 bp, Artificial Sequence
  Description of Artificial Sequence: Synthetic probe
gccacctgccctcgtcctctggctgatcaaggactgtcttcaaaccggcgtcggcaccag

SEQ ID NO: 5895 - DNA, 60 bp, Artificial Sequence
  Description of Artificial Sequence: Synthetic probe
ggccccccgccctcgtcctctggctgatcaaggactgtcttcaaaccggcgtcggtacca

SEQ ID NO: 5896 - DNA, 60 bp, Artificial Sequence
  Description of Artificial Sequence: Synthetic probe
cgcagctacgtactacttctctgacttggagattgtggtaaaacacgagggcaacttgac

SEQ ID NO: 5897 - DNA, 60 bp, Artificial Sequence
  Description of Artificial Sequence: Synthetic probe
atagacctcatgcagacacaccagcacgggctggtaggtgcgttgctgcgcgcagctacg

SEQ ID NO: 5898 - DNA, 60 bp, Artificial Sequence
  Description of Artificial Sequence: Synthetic probe
ttgtgaaaataaacagccttaaccccacacatgtcatagacctcatgcagacacaccagc

SEQ ID NO: 5899 - DNA, 60 bp, Artificial Sequence
  Description of Artificial Sequence: Synthetic probe
ctcatgcagatcccctcacacacgctggttggagcactgcttcggtctgcgacgtactac

SEQ ID NO: 5900 - DNA, 60 bp, Artificial Sequence
  Description of Artificial Sequence: Synthetic probe
cactgcaccacaccgcgtgctggcaacagtgtacaacgggacgaacaagtactccgcggc

SEQ ID NO: 5901 - DNA, 60 bp, Artificial Sequence
  Description of Artificial Sequence: Synthetic probe
ttgcttttgttctcgacaggtttgtgaaactcacccccaagaacacccagattcttgatc

SEQ ID NO: 5902 - DNA, 60 bp, Artificial Sequence
  Description of Artificial Sequence: Synthetic probe
ccaacacgaagcagcaattgaattctttgagggaatggtgcacgactccatcaaggagga

SEQ ID NO: 5903 - DNA, 52 bp, Artificial Sequence
  Description of Artificial Sequence: Synthetic probe
ccaacacgaagcagcaattgaattctttgagggaatggtgcacgactccatc

SEQ ID NO: 5904 - DNA, 60 bp, Artificial Sequence
  Description of Artificial Sequence: Synthetic probe
gggccgagctttattgcccacgcccgctgatggtcaggtacactcacaccacagacagat

SEQ ID NO: 5905 - DNA, 60 bp, Artificial Sequence
  Description of Artificial Sequence: Synthetic probe
actaccggatgaagcgggccgagctttattgcccacgcccgctgatggtcaggtacactc

SEQ ID NO: 5906 - DNA, 60 bp, Artificial Sequence
  Description of Artificial Sequence: Synthetic probe
cttcggtcgattgttgtgtgactcgggtgacgtgtactaccggatgaagcgggccgagct

SEQ ID NO: 5907 - DNA, 60 bp, Artificial Sequence
  Description of Artificial Sequence: Synthetic probe
gcgtgcccacacaccgaccgagtggaagacaacccagtcgttcacgccaagaggaatgtt

SEQ ID NO: 5908 - DNA, 60 bp, Artificial Sequence
  Description of Artificial Sequence: Synthetic probe
tgggtgccgaatgcgtgcccacacaccgaccgagtggaagacaacccagtcgttcacgcc

SEQ ID NO: 5909 - DNA, 52 bp, Artificial Sequence
  Description of Artificial Sequence: Synthetic probe
agaaggagataggtacaagattggcctggtgaggccacagaaacaactgtgc

SEQ ID NO: 5910 - DNA, 60 bp, Artificial Sequence
  Description of Artificial Sequence: Synthetic probe
caggggagacctcgccacgctctcagcaagaattgccagtgagacccacattccagtgag

SEQ ID NO: 5911 - DNA, 60 bp, Artificial Sequence
  Description of Artificial Sequence: Synthetic probe
agaacccgcaccgcgcaggggagacctcgccacgctctcagcaagaattgccagtgagac

SEQ ID NO: 5912 - DNA, 60 bp, Artificial Sequence
  Description of Artificial Sequence: Synthetic probe
ttgcgaccgcctacaacggcgattgcaagtacaaacccgcgggacagtcagaacccgcac

SEQ ID NO: 5913 - DNA, 60 bp, Artificial Sequence
  Description of Artificial Sequence: Synthetic probe
gttgcgaccgcctacaacggcgattgcaagtacaaacccgcgggacagtcagaacccgca

SEQ ID NO: 5914 - DNA, 60 bp, Artificial Sequence
  Description of Artificial Sequence: Synthetic probe
ggatgaagcgtgctgaactttactgccccaggccacttctcccggcttacgatcacgcag

SEQ ID NO: 5915 - DNA, 60 bp, Artificial Sequence
  Description of Artificial Sequence: Synthetic probe
ctgctggcagtagaggtgtcaacgcaagacagacacaaacagaagatcattgcacctgca

SEQ ID NO: 5916 - DNA, 60 bp, Artificial Sequence
  Description of Artificial Sequence: Synthetic probe
accgcgtgagagacatcacgaaacactttcgtgacacagcaagaatgaaaaaaggcaccc

SEQ ID NO: 5917 - DNA, 54 bp, Artificial Sequence
  Description of Artificial Sequence: Synthetic probe
ctaaagggagccgggcagtccagtccggcgaccgggtcgcagaaccagtcaggc

SEQ ID NO: 5918 - DNA, 60 bp, Artificial Sequence
  Description of Artificial Sequence: Synthetic probe
ccactcaacggagaatggaagatgaaggttcagaagcggctaaagggagccgggcagtcc

SEQ ID NO: 5919 - DNA, 60 bp, Artificial Sequence
  Description of Artificial Sequence: Synthetic probe
atgatcaggaaccactcaacggagaatggaagatgaaggttcagaagcggctaaagggag

SEQ ID NO: 5920 - DNA, 60 bp, Artificial Sequence
  Description of Artificial Sequence: Synthetic probe
gagcatgctgtgttcgcctgtgtcacctctgacgggtggtacgcgattgatgacgaggac

SEQ ID NO: 5921 - DNA, 60 bp, Artificial Sequence
  Description of Artificial Sequence: Synthetic probe
taaagcactctttcgcacacaaaacacaggcaagatggaattcacactctacaacggtga

SEQ ID NO: 5922 - DNA, 60 bp, Artificial Sequence
  Description of Artificial Sequence: Synthetic probe
tgttttatcgctctgttacacgctatcggagagattaaagcactctttcgcacacaaaac

SEQ ID NO: 5923 - DNA, 60 bp, Artificial Sequence
  Description of Artificial Sequence: Synthetic probe
gttacgtgctgccacgtactacttctccgacctggagattgtggttcgtcacgacggcaa

SEQ ID NO: 5924 - DNA, 60 bp, Artificial Sequence
  Description of Artificial Sequence: Synthetic probe
tgttacgtgctgccacgtactacttctccgacctggagattgtggttcgtcacgacggca

SEQ ID NO: 5925 - DNA, 60 bp, Artificial Sequence
  Description of Artificial Sequence: Synthetic probe
atggacacaactgactgttttaccgctctgctgcacgctctcagagagatcaaaacactg

SEQ ID NO: 5926 - DNA, 51 bp, Artificial Sequence
  Description of Artificial Sequence: Synthetic probe
cactgagcttttgattcgcatgaaacgcgcggagacatactgccccaggcc

SEQ ID NO: 5927 - DNA, 60 bp, Artificial Sequence
  Description of Artificial Sequence: Synthetic probe
gctgcctacctccttcaactacggtgccatcaaagccacttgggtgactgaactgcttta

SEQ ID NO: 5928 - DNA, 60 bp, Artificial Sequence
  Description of Artificial Sequence: Synthetic probe
gaacgctgcctacctccttcaactacggtgccatcaaagccacccgggtgactgaactgc

SEQ ID NO: 5929 - DNA, 60 bp, Artificial Sequence
  Description of Artificial Sequence: Synthetic probe
agaacgctgcctacctccttcaactacggtgccatcaaagccacccgggtgactgaactg

SEQ ID NO: 5930 - DNA, 51 bp, Artificial Sequence
  Description of Artificial Sequence: Synthetic probe
cactgagcttttgatccgcatgaagcgcgcggagacgtactgccccaggcc

SEQ ID NO: 5931 - DNA, 60 bp, Artificial Sequence
  Description of Artificial Sequence: Synthetic probe
cgccgcatgggtgcccaacgggtgccctgaagtgagcagggttgaggataacccagtggt

SEQ ID NO: 5932 - DNA, 60 bp, Artificial Sequence
  Description of Artificial Sequence: Synthetic probe
cgaccaaggaacacacgttggtcggtgccattcttcgctccgcaacctactatttctgtg

SEQ ID NO: 5933 - DNA, 60 bp, Artificial Sequence
  Description of Artificial Sequence: Synthetic probe
tggcgcggcggcaacacactgatgtcgctttcctgcttgaccggttcactcacattgggt

SEQ ID NO: 5934 - DNA, 60 bp, Artificial Sequence
  Description of Artificial Sequence: Synthetic probe
ttccgactcccaatcaacccagcgccacagaccacctcttccggtgaaggagctgacgtt

SEQ ID NO: 5935 - DNA, 60 bp, Artificial Sequence
  Description of Artificial Sequence: Synthetic probe
cctcggctcaaggatgggtaacactttaccaaatcacagacacccacgaccctgactcag

SEQ ID NO: 5936 - DNA, 60 bp, Artificial Sequence
  Description of Artificial Sequence: Synthetic probe
taccctacgtctccggggcggactacgcctacacttactgtgatgagccagagaccacct

SEQ ID NO: 5937 - DNA, 60 bp, Artificial Sequence
  Description of Artificial Sequence: Synthetic probe
gcaccgagcccgtcccgaacacaccggagaaggcagcacactgctaccactctgaatggg

SEQ ID NO: 5938 - DNA, 60 bp, Artificial Sequence
  Description of Artificial Sequence: Synthetic probe
tcatgtacactggcccaacacaatccaaggcccgcttcatggtggtgtacgtgccacccg

SEQ ID NO: 5939 - DNA, 60 bp, Artificial Sequence
  Description of Artificial Sequence: Synthetic probe
ggcccagtacttcgcacagtacagtggcacactcaacctccacttcatgtacactggccc

SEQ ID NO: 5940 - DNA, 57 bp, Artificial Sequence
  Description of Artificial Sequence: Synthetic probe
ccgaggaacgccttccccggtaggttcacgaacctcatggacgtggctgaggcgtgt

SEQ ID NO: 5941 - DNA, 60 bp, Artificial Sequence
  Description of Artificial Sequence: Synthetic probe
tacgccaacattgccccgaccaacgtgtacgtctctggtgagaagcccgcaaaacagggc

SEQ ID NO: 5942 - DNA, 60 bp, Artificial Sequence
  Description of Artificial Sequence: Synthetic probe
gctgtcatggcaccgcttaccactggcaccatgggttctgacaatgttgaggtctacgcc

SEQ ID NO: 5943 - DNA, 60 bp, Artificial Sequence
  Description of Artificial Sequence: Synthetic probe
gtacatcggggtcaacagacacgaccaagtcaaccaacacaaagcttggacactggtggt

SEQ ID NO: 5944 - DNA, 60 bp, Artificial Sequence
  Description of Artificial Sequence: Synthetic probe
gacaaacgctgtgtgtcacagctgactctgttcccacaccagttcatcaacccgcgtaca

SEQ ID NO: 5945 - DNA, 60 bp, Artificial Sequence
  Description of Artificial Sequence: Synthetic probe
gactagcacgcagtccaatggtggagcactcttggtggccttggtgccagaactgaagag

SEQ ID NO: 5946 - DNA, 54 bp, Artificial Sequence
  Description of Artificial Sequence: Synthetic probe
acctggaccgcgaaccaagagtacgctcacgtccactgccttgagctgcccaca

SEQ ID NO: 5947 - DNA, 57 bp, Artificial Sequence
  Description of Artificial Sequence: Synthetic probe
tgcccggtccgaacacgagcggccttgacacaagagttgagcacgctgagcgcttct

SEQ ID NO: 5948 - DNA, 60 bp, Artificial Sequence
  Description of Artificial Sequence: Synthetic probe
tggttttcaaagttagctcagtcagccatctcaggtctcttcggagccctgctggccgac

SEQ ID NO: 5949 - DNA, 52 bp, Artificial Sequence
  Description of Artificial Sequence: Synthetic probe
ggtgccggacaatccagcccggcaaccggttcacagaatcagtcagggaaca

SEQ ID NO: 5950 - DNA, 60 bp, Artificial Sequence
  Description of Artificial Sequence: Synthetic probe
tggcgctcccctacaccgctccccaccgtgtgctggcaacagtgtacaacgggaagacaa

SEQ ID NO: 5951 - DNA, 60 bp, Artificial Sequence
  Description of Artificial Sequence: Synthetic probe
taggatgaaacgcgcagagctctactgtccgcgccctctcctgacacactacgaccacag

SEQ ID NO: 5952 - DNA, 60 bp, Artificial Sequence
  Description of Artificial Sequence: Synthetic probe
gtgtatgttaggatgaaacgcgcagagctctactgtccgcgccctctcctgacacactac

SEQ ID NO: 5953 - DNA, 51 bp, Artificial Sequence
  Description of Artificial Sequence: Synthetic probe
tggcaacaacctacaacggtgactgcaagtacaaacccgctggcacacccc

SEQ ID NO: 5954 - DNA, 60 bp, Artificial Sequence
  Description of Artificial Sequence: Synthetic probe
ccactcgcggcaagagttgccgcccagcttcctgcctctttcaacttcggtgcaatcaag

SEQ ID NO: 5955 - DNA, 60 bp, Artificial Sequence
  Description of Artificial Sequence: Synthetic probe
ctgggaccactcgcggcaagagttgccgcccagcttcctgcctcttttaactttggtgca

SEQ ID NO: 5956 - DNA, 60 bp, Artificial Sequence
  Description of Artificial Sequence: Synthetic probe
cggggtgacctgggaccactcgcggcaagagttgccgcccagcttcctgcctcttttaac

SEQ ID NO: 5957 - DNA, 60 bp, Artificial Sequence
  Description of Artificial Sequence: Synthetic probe
cggggtgacctgggaccactcgcggcaagagttgccgcccagcttcctgcctctttcaac

SEQ ID NO: 5958 - DNA, 60 bp, Artificial Sequence
  Description of Artificial Sequence: Synthetic probe
catgtcattgacctcatgcaaactcaccaacacgggttggtgggtgccctgttacgtgct

SEQ ID NO: 5959 - DNA, 60 bp, Artificial Sequence
  Description of Artificial Sequence: Synthetic probe
acatgtcattgacctcatgcaaactcaccaacacgggttggtgggtgccctgttacgtgc

SEQ ID NO: 5960 - DNA, 60 bp, Artificial Sequence
  Description of Artificial Sequence: Synthetic probe
ccttggacgcccgatccgtccgacgttttagtgtttgtcccgtatgatcaagaaccactc

SEQ ID NO: 5961 - DNA, 60 bp, Artificial Sequence
  Description of Artificial Sequence: Synthetic probe
atttctatccttggacgcccgatccgtccgacgttttagtgtttgtcccgtatgatcaag

SEQ ID NO: 5962 - DNA, 60 bp, Artificial Sequence
  Description of Artificial Sequence: Synthetic probe
ggctgaacaccattcttcagttgttcaggtacgtcgacgagcctttcttcgactgggtct

SEQ ID NO: 5963 - DNA, 60 bp, Artificial Sequence
  Description of Artificial Sequence: Synthetic probe
tgttggctgaacaccattcttcagttgttcaggtacgtcgacgagcctttcttcgactgg

SEQ ID NO: 5964 - DNA, 60 bp, Artificial Sequence
  Description of Artificial Sequence: Synthetic probe
gttcttttcacgagtcacaggaaagatggagttcacacttcacaacggtgagaagaagac

SEQ ID NO: 5965 - DNA, 60 bp, Artificial Sequence
  Description of Artificial Sequence: Synthetic probe
taagtcactgttcttttcacgagtcacaggaaagatggagttcacacttcacaacggtga

SEQ ID NO: 5966 - DNA, 60 bp, Artificial Sequence
  Description of Artificial Sequence: Synthetic probe
gcgagactcacatcccaaccactttcaactacggcaggatttacactgaagccgaggttg

SEQ ID NO: 5967 - DNA, 60 bp, Artificial Sequence
  Description of Artificial Sequence: Synthetic probe
aagcgagactcacatcccaaccactttcaactacggcaggatttacactgaagccgaggt

SEQ ID NO: 5968 - DNA, 60 bp, Artificial Sequence
  Description of Artificial Sequence: Synthetic probe
ggtgctgtgaaggctgacaccatcacggagctgttgatccgcatgaagcgtgcggaaaca

SEQ ID NO: 5969 - DNA, 50 bp, Artificial Sequence
  Description of Artificial Sequence: Synthetic probe
aaacctgccaaacaacttgggaactttgaactgttgaagttggccggaga

SEQ ID NO: 5970 - DNA, 60 bp, Artificial Sequence
  Description of Artificial Sequence: Synthetic probe
cgacgtgtacgttaggatgaaacgtgcggagctctactgcccgcgccctctcctgacaca

SEQ ID NO: 5971 - DNA, 60 bp, Artificial Sequence
  Description of Artificial Sequence: Synthetic probe
ggtctgcgacgtactacttctcagacctggaggttgcgctcgtccacacaggcccagcca

SEQ ID NO: 5972 - DNA, 60 bp, Artificial Sequence
  Description of Artificial Sequence: Synthetic probe
agtggtgcccccccgaccgacttgcaaaagatggtcatgggcaacaccaagcctgtcgag

SEQ ID NO: 5973 - DNA, 60 bp, Artificial Sequence
  Description of Artificial Sequence: Synthetic probe
caacggtgattgtaagtacaaacccactggcacagctccacgcgagaacatcggtggaga

SEQ ID NO: 5974 - DNA, 60 bp, Artificial Sequence
  Description of Artificial Sequence: Synthetic probe
cgtgcgcatgaaacgggccgagctctactgtcccaggccacttctagcaatagaggtgtc

SEQ ID NO: 5975 - DNA, 50 bp, Artificial Sequence
  Description of Artificial Sequence: Synthetic probe
actgagcttttgtttcgcatgaaacgtgcggagacatactgccctaggcc

SEQ ID NO: 5976 - DNA, 50 bp, Artificial Sequence
  Description of Artificial Sequence: Synthetic probe
actgagcttttgattcgcatgaaacgtgcggagacatactgccctaggcc

SEQ ID NO: 5977 - DNA, 60 bp, Artificial Sequence
  Description of Artificial Sequence: Synthetic probe
tgaaaccattactgagctcctgatacgcatgaaacgtgcggagacatactgccctaggcc

SEQ ID NO: 5978 - DNA, 60 bp, Artificial Sequence
  Description of Artificial Sequence: Synthetic probe
gctttcaagcgcctgaaggagaactttgagatcgttgctctcgttgttgtgctgttggca

SEQ ID NO: 5979 - DNA, 60 bp, Artificial Sequence
  Description of Artificial Sequence: Synthetic probe
tgcgccacaccgcgtgttggcaacagtgtacaacgggacgaacaagtactccgcggctag

SEQ ID NO: 5980 - DNA, 53 bp, Artificial Sequence
  Description of Artificial Sequence: Synthetic probe
aacgggtgactgaactgctttaccgcatgaagagggccgagacatactgcccc

SEQ ID NO: 5981 - DNA, 60 bp, Artificial Sequence
  Description of Artificial Sequence: Synthetic probe
cgcacactttgccgtcaaccttcaacttcgggtttgtgaccgtcgacaacccagtcgatg

SEQ ID NO: 5982 - DNA, 60 bp, Artificial Sequence
  Description of Artificial Sequence: Synthetic probe
cacgcacactttgccgtcaaccttcaacttcgggtttgtgaccgtcgacaacccagtcga

SEQ ID NO: 5983 - DNA, 60 bp, Artificial Sequence
  Description of Artificial Sequence: Synthetic probe
acacgcacactttgccgtcaaccttcaacttcgggtttgtgaccgtcgacaacccagtcg

SEQ ID NO: 5984 - DNA, 60 bp, Artificial Sequence
  Description of Artificial Sequence: Synthetic probe
tggcaacacgcacactttgccgtcaaccttcaacttcgggtttgtgaccgtcgacaaccc

SEQ ID NO: 5985 - DNA, 60 bp, Artificial Sequence
  Description of Artificial Sequence: Synthetic probe
gtacgctagcaacacgcacactttgccgtcaaccttcaacttcgggtttgtgaccgtcga

SEQ ID NO: 5986 - DNA, 60 bp, Artificial Sequence
  Description of Artificial Sequence: Synthetic probe
gcagtcccgtcgttggcgtggtcaacaacgctgatgtcggaagactcatcttctcaggag

SEQ ID NO: 5987 - DNA, 56 bp, Artificial Sequence
  Description of Artificial Sequence: Synthetic probe
cataccggaatcggcactgcctcgcgccccagcgaggtgtgcatggtggacggaac

SEQ ID NO: 5988 - DNA, 60 bp, Artificial Sequence
  Description of Artificial Sequence: Synthetic probe
ccgaaacaacaaacgtacagggatgggtctgcatctaccagatcacacacgggaaggctc

SEQ ID NO: 5989 - DNA, 60 bp, Artificial Sequence
  Description of Artificial Sequence: Synthetic probe
ggccgaaacaacaaacgtacagggatgggtctgcatctaccagatcacacacgggaaggc

SEQ ID NO: 5990 - DNA, 59 bp, Artificial Sequence
  Description of Artificial Sequence: Synthetic probe
caccattcacgaggcttgcgctcccttacactgcgccacaccgcgtgttggcaacagtg

SEQ ID NO: 5991 - DNA, 58 bp, Artificial Sequence
  Description of Artificial Sequence: Synthetic probe
caagcaattgaacagttggaggaactcactgggctagagttgcatgagggtgggcccc

SEQ ID NO: 5992 - DNA, 60 bp, Artificial Sequence
  Description of Artificial Sequence: Synthetic probe
caagcaattgaacagttggaggaactcactgggctagagttgcatgagggtgggcccccg

SEQ ID NO: 5993 - DNA, 60 bp, Artificial Sequence
  Description of Artificial Sequence: Synthetic probe
cacactccaagcaattgaacagttggaggaactcactgggctagagttgcacgagggtgg

SEQ ID NO: 5994 - DNA, 60 bp, Artificial Sequence
  Description of Artificial Sequence: Synthetic probe
ctcgcctgagaacctcacactccaagcaattgaacagttggaggaactcactgggctaga

SEQ ID NO: 5995 - DNA, 60 bp, Artificial Sequence
  Description of Artificial Sequence: Synthetic probe
aactatggaattattctgactgaagcagaagtggacgtctacgtgcgcatgaagcgggcg

SEQ ID NO: 5996 - DNA, 60 bp, Artificial Sequence
  Description of Artificial Sequence: Synthetic probe
cgacactggctgcgcgcatccgcgaacagtcgcacattccaacaactttcaactatggaa

SEQ ID NO: 5997 - DNA, 60 bp, Artificial Sequence
  Description of Artificial Sequence: Synthetic probe
cgcgacactggctgcgcgcgtccgcgaacagtcgcacattccaacaactttcaactatgg

SEQ ID NO: 5998 - DNA, 60 bp, Artificial Sequence
  Description of Artificial Sequence: Synthetic probe
catcaggggtgacctcgcgacactggctgcgcgcgtccgcgaacagtcgcacattccaac

SEQ ID NO: 5999 - DNA, 60 bp, Artificial Sequence
  Description of Artificial Sequence: Synthetic probe
ccgctccacaccgtgttctggcaacagtctacaacggtgattgcaagtacaaaccaatca

SEQ ID NO: 6000 - DNA, 60 bp, Artificial Sequence
  Description of Artificial Sequence: Synthetic probe
ttcaccgctccacaccgtgttctggcaacagtctacaacggtgattgcaagtacaaacca

SEQ ID NO: 6001 - DNA, 51 bp, Artificial Sequence
  Description of Artificial Sequence: Synthetic probe
tactgagcttctgatccgcatgaaacgcgcggagacatactgccctaggcc

SEQ ID NO: 6002 - DNA, 60 bp, Artificial Sequence
  Description of Artificial Sequence: Synthetic probe
cgcttgaaggaaaactttgagattgttgccctgtgtttgactctcttggcaaacatagtg

SEQ ID NO: 6003 - DNA, 60 bp, Artificial Sequence
  Description of Artificial Sequence: Synthetic probe
cgcctgaaggaaaactttgagattgttgccctgtgtttgacccttttggcaaacatagtg

SEQ ID NO: 6004 - DNA, 60 bp, Artificial Sequence
  Description of Artificial Sequence: Synthetic probe
ccttcaagcgcttgaaggaaaactttgagattgttgccctgtgtttgactctcttggcaa

SEQ ID NO: 6005 - DNA, 60 bp, Artificial Sequence
  Description of Artificial Sequence: Synthetic probe
cgtgttggcaacagtgtacaacgggacgaacaagtactccgcggccagtgggcacacacg

SEQ ID NO: 6006 - DNA, 60 bp, Artificial Sequence
  Description of Artificial Sequence: Synthetic probe
ccacaagatgcattcccacgacattcaacttcgggagactgttgtgtgataggggtgagg

SEQ ID NO: 6007 - DNA, 60 bp, Artificial Sequence
  Description of Artificial Sequence: Synthetic probe
gacgtttactaccgaatgaaaaggagcgaactctactgtcccagaccactcctgccagcg

SEQ ID NO: 6008 - DNA, 60 bp, Artificial Sequence
  Description of Artificial Sequence: Synthetic probe
tacaacggtgagtgtaactactccacgtcggtgacgccgatacgtggtgacagggcggtc

SEQ ID NO: 6009 - DNA, 60 bp, Artificial Sequence
  Description of Artificial Sequence: Synthetic probe
tgtttacaacggtgagtgtaactactccacgtcggtgacgccgatacgtggtgacagggc

SEQ ID NO: 6010 - DNA, 60 bp, Artificial Sequence
  Description of Artificial Sequence: Synthetic probe
tccactgtttacaacggtgagtgtaactactccacgtcggtgacgccgatacgtggtgac

SEQ ID NO: 6011 - DNA, 52 bp, Artificial Sequence
  Description of Artificial Sequence: Synthetic probe
aacggtgcgcccagggcgacccagttgggagacaacccaatggtcttctccc

SEQ ID NO: 6012 - DNA, 54 bp, Artificial Sequence
  Description of Artificial Sequence: Synthetic probe
ccaacggtgcgcccaggacgacccagttgggagacaacccaatggtcttctccc

SEQ ID NO: 6013 - DNA, 60 bp, Artificial Sequence
  Description of Artificial Sequence: Synthetic probe
aacccaacggtgcgcccaggacgacccagttgggagacaacccaatggtcttctcccaca

SEQ ID NO: 6014 - DNA, 57 bp, Artificial Sequence
  Description of Artificial Sequence: Synthetic probe
aacccaacggtgcgcccaggacaacccagttgggagacaacccaatggtcttctccc

SEQ ID NO: 6015 - DNA, 60 bp, Artificial Sequence
  Description of Artificial Sequence: Synthetic probe
aacccaacggtgcgcccagggcgacccagttgggagacaacccaatggtcttctcccaca

SEQ ID NO: 6016 - DNA, 60 bp, Artificial Sequence
  Description of Artificial Sequence: Synthetic probe
cttgccattcaaccgagtgacgctagacacaagcagaagattgtggcacccgcaaagcag

SEQ ID NO: 6017 - DNA, 60 bp, Artificial Sequence
  Description of Artificial Sequence: Synthetic probe
tcttgccattcaaccgagtgacgctagacacaagcagaagattgtggcacccgcaaagca

SEQ ID NO: 6018 - DNA, 60 bp, Artificial Sequence
  Description of Artificial Sequence: Synthetic probe
cccacctccttcaactacggtgccattaaggcaacccgggtgactgagttactctaccgc

SEQ ID NO: 6019 - DNA, 60 bp, Artificial Sequence
  Description of Artificial Sequence: Synthetic probe
cgctgcccacctccttcaactacggtgccattaaggcaacccgggtgactgagttactct

SEQ ID NO: 6020 - DNA, 60 bp, Artificial Sequence
  Description of Artificial Sequence: Synthetic probe
gtgagaggtgacctccaagtgttgactcagaaggcatcaagagcgctgcccacctccttc

SEQ ID NO: 6021 - DNA, 60 bp, Artificial Sequence
  Description of Artificial Sequence: Synthetic probe
gagtaacgtgagaggtgacctccaagtgttgactcagaaggcatcaagagcgctgcccac

SEQ ID NO: 6022 - DNA, 60 bp, Artificial Sequence
  Description of Artificial Sequence: Synthetic probe
ccgtctacaacggaagttgtaagtacagcgacacccacatgagtaacgtgagaggtgacc

SEQ ID NO: 6023 - DNA, 60 bp, Artificial Sequence
  Description of Artificial Sequence: Synthetic probe
gtcttagcaaccgtctacaacggaagttgtaagtacagcgacacccacatgagtaacgtg

SEQ ID NO: 6024 - DNA, 60 bp, Artificial Sequence
  Description of Artificial Sequence: Synthetic probe
gactgttttatcgctttgttgcacgccctcagagagatcaagacactgtttcttacacga

SEQ ID NO: 6025 - DNA, 53 bp, Artificial Sequence
  Description of Artificial Sequence: Synthetic probe
gataaccaacacacactcgacgtgatgcaggcacacaaagacaacatcgtggg

SEQ ID NO: 6026 - DNA, 60 bp, Artificial Sequence
  Description of Artificial Sequence: Synthetic probe
cctcttgcgagcggctacgtactacttctccgacctggagattgtggtgcgtcacgaagg

SEQ ID NO: 6027 - DNA, 60 bp, Artificial Sequence
  Description of Artificial Sequence: Synthetic probe
gggagccctcttgcgagcggctacgtactacttctccgacctggagattgtggtgcgtca

SEQ ID NO: 6028 - DNA, 60 bp, Artificial Sequence
  Description of Artificial Sequence: Synthetic probe
ctcatgcagatcccctcacacacgttggttggagcactgcttcggtctgcgacgtactac

SEQ ID NO: 6029 - DNA, 60 bp, Artificial Sequence
  Description of Artificial Sequence: Synthetic probe
cacggtgggagtgtagtagagaagagacggatgcacacagacgttgcgttcgtgcttgac

SEQ ID NO: 6030 - DNA, 60 bp, Artificial Sequence
  Description of Artificial Sequence: Synthetic probe
gcacggtgggagtgtagtagagaagagacggatgcacacagacgttgcgttcgtgcttga

SEQ ID NO: 6031 - DNA, 55 bp, Artificial Sequence
  Description of Artificial Sequence: Synthetic probe
gtcttgcaacaacttacaatggtgattgcaagtacaaacccgctggcacggcccc

SEQ ID NO: 6032 - DNA, 60 bp, Artificial Sequence
  Description of Artificial Sequence: Synthetic probe
caggtgtcttgcaacaacttacaatggtgattgcaagtacaagcccgctggcacggccct

SEQ ID NO: 6033 - DNA, 60 bp, Artificial Sequence
  Description of Artificial Sequence: Synthetic probe
cgtcacacggtggaagtgtggtagagaagagacgaatgcacacagacgttgcgttcgtgc

SEQ ID NO: 6034 - DNA, 60 bp, Artificial Sequence
  Description of Artificial Sequence: Synthetic probe
aactctactgccccaggccactgctggcggtggaggtgacgtcgcaagacagacacaaac

SEQ ID NO: 6035 - DNA, 58 bp, Artificial Sequence
  Description of Artificial Sequence: Synthetic probe
ccccgcaacagggtcacaaaaccaatctggtaacactggcagcataattaacaactac

SEQ ID NO: 6036 - DNA, 60 bp, Artificial Sequence
  Description of Artificial Sequence: Synthetic probe
agacctagaagtggcagtgaaacacgaggggaacctcacctgggtcccgaatggggcgcc

SEQ ID NO: 6037 - DNA, 60 bp, Artificial Sequence
  Description of Artificial Sequence: Synthetic probe
tcgcagatctagaagtggcagtgaaacacgaggggaaccttacctgggtcccgaacgggg

SEQ ID NO: 6038 - DNA, 60 bp, Artificial Sequence
  Description of Artificial Sequence: Synthetic probe
ttcgcagacctagaagtggcagtgaaacacgaggggaacctcacctgggtcccgaatggg

SEQ ID NO: 6039 - DNA, 60 bp, Artificial Sequence
  Description of Artificial Sequence: Synthetic probe
cttcgcagacctagaagtggcagtgaaacacgaggggaacctcacctgggtcccgaatgg

SEQ ID NO: 6040 - DNA, 60 bp, Artificial Sequence
  Description of Artificial Sequence: Synthetic probe
cttcgcagatctagaagtggcagtgaaacacgaggggaaccttacctgggtcccgaacgg

SEQ ID NO: 6041 - DNA, 60 bp, Artificial Sequence
  Description of Artificial Sequence: Synthetic probe
gctccggagcttagcgaggtgggcgacaacccagtcgtcttctccgctaacggcaccacc

SEQ ID NO: 6042 - DNA, 60 bp, Artificial Sequence
  Description of Artificial Sequence: Synthetic probe
cggcggtgagacacaaatccagcggcgtcaccacactgacgtcagcttcataatggacag

SEQ ID NO: 6043 - DNA, 60 bp, Artificial Sequence
  Description of Artificial Sequence: Synthetic probe
cggcggtgagacacacatccagcggcgtcaccacactgacgtcagcttcataatggacag

SEQ ID NO: 6044 - DNA, 60 bp, Artificial Sequence
  Description of Artificial Sequence: Synthetic probe
cggcggtgagacacaagttcagcggcgtcaccacactgacgtcagcttcataatggacag

SEQ ID NO: 6045 - DNA, 60 bp, Artificial Sequence
  Description of Artificial Sequence: Synthetic probe
cactggtagcataatcaacaactactacatgcaacaataccagaactccatggacaccca

SEQ ID NO: 6046 - DNA, 60 bp, Artificial Sequence
  Description of Artificial Sequence: Synthetic probe
cggtggaggtctcgtcgcaagacagacacaaacagaagatcattgcaccagcaaaacaac

SEQ ID NO: 6047 - DNA, 60 bp, Artificial Sequence
  Description of Artificial Sequence: Synthetic probe
acgtgaggatgaaacgggcggagctttactgcccacgcccgttgctcaccaggtacgaac

SEQ ID NO: 6048 - DNA, 60 bp, Artificial Sequence
  Description of Artificial Sequence: Synthetic probe
aattgaccaagccccgcgaaccaacattcgcggagatctcgcgacgctcgcagagcacat

SEQ ID NO: 6049 - DNA, 60 bp, Artificial Sequence
  Description of Artificial Sequence: Synthetic probe
tgcaagtacaggccaattgaccaagccccgcgaaccaacattcgcggagatctcgcgacg

SEQ ID NO: 6050 - DNA, 57 bp, Artificial Sequence
  Description of Artificial Sequence: Synthetic probe
catgaaacgggccgagctctactgccccagaccactgctggcaatagaggtgtcttc

SEQ ID NO: 6051 - DNA, 60 bp, Artificial Sequence
  Description of Artificial Sequence: Synthetic probe
tggtgttcgcccacaacggcgttaccaggtttgctataccctacactgcaccacaccggt

SEQ ID NO: 6052 - DNA, 60 bp, Artificial Sequence
  Description of Artificial Sequence: Synthetic probe
ggagacaaccccatggtgttcgcccacaacggcgttaccaggtttgctataccctacact

SEQ ID NO: 6053 - DNA, 60 bp, Artificial Sequence
  Description of Artificial Sequence: Synthetic probe
ggagacaaccccatggtgttcgcccacaacggcgttaccaggtttgccataccctacact

SEQ ID NO: 6054 - DNA, 60 bp, Artificial Sequence
  Description of Artificial Sequence: Synthetic probe
ctgacaccatcactgagcttttgatccgcatgaagcgcgcggagacatactgccccaggc

SEQ ID NO: 6055 - DNA, 60 bp, Artificial Sequence
  Description of Artificial Sequence: Synthetic probe
aagcgactcaagggagccggacaatccagtccggcaaccgggtcacagaaccaatcaggt

SEQ ID NO: 6056 - DNA, 60 bp, Artificial Sequence
  Description of Artificial Sequence: Synthetic probe
gaagcgactcaagggagccggacaatccagtccggcaaccgggtcacagaaccaatcagg

SEQ ID NO: 6057 - DNA, 57 bp, Artificial Sequence
  Description of Artificial Sequence: Synthetic probe
ttcagagtgtttgagtttgagattaaagtaaaaggacaggaaatgctctcagacgct

SEQ ID NO: 6058 - DNA, 60 bp, Artificial Sequence
  Description of Artificial Sequence: Synthetic probe
aagcaagtactccacaactggtggtggtagaaggggtgacctggggtctcttgcagcgcg

SEQ ID NO: 6059 - DNA, 60 bp, Artificial Sequence
  Description of Artificial Sequence: Synthetic probe
taagcaagtactccacaactggtggtggtagaaggggtgacctggggtctcttgcggcgc

SEQ ID NO: 6060 - DNA, 60 bp, Artificial Sequence
  Description of Artificial Sequence: Synthetic probe
aacggagtaagcaagtactccacaactggtggtggtagaaggggtgacctggggtctctt

SEQ ID NO: 6061 - DNA, 54 bp, Artificial Sequence
  Description of Artificial Sequence: Synthetic probe
gcgcgcatcgccagcgagacgcgcattccaaccacctttaactacggcaggatc

SEQ ID NO: 6062 - DNA, 60 bp, Artificial Sequence
  Description of Artificial Sequence: Synthetic probe
ggggacctcgccacgctcgctgcgcgcatcgccagcgagacgcgcattccaaccaccttt

SEQ ID NO: 6063 - DNA, 60 bp, Artificial Sequence
  Description of Artificial Sequence: Synthetic probe
actgcaagtacaagccagtcagcgaggagccccggacacacatccgcggggacctcgcca

SEQ ID NO: 6064 - DNA, 60 bp, Artificial Sequence
  Description of Artificial Sequence: Synthetic probe
gtgactgcaagtacaagccagtcagcgaggagccccggacacacatccgcggggacctcg

SEQ ID NO: 6065 - DNA, 60 bp, Artificial Sequence
  Description of Artificial Sequence: Synthetic probe
tgggtcggttggacaccgaacggtgctccagaactcagtgaagtaggcgacaacccagtc

SEQ ID NO: 6066 - DNA, 60 bp, Artificial Sequence
  Description of Artificial Sequence: Synthetic probe
gttggcacaaacaagtgggtcggttggacaccgaacggtgctccagaactcagtgaagta

SEQ ID NO: 6067 - DNA, 60 bp, Artificial Sequence
  Description of Artificial Sequence: Synthetic probe
cggcgctgtgaaggctgacaccattactgagcttttgatccgcatgaaacgcgcggagac

SEQ ID NO: 6068 - DNA, 60 bp, Artificial Sequence
  Description of Artificial Sequence: Synthetic probe
aaagtgaccagttctactcccacacatgtcatagacctcatgcaaactcaccaacacggg

SEQ ID NO: 6069 - DNA, 60 bp, Artificial Sequence
  Description of Artificial Sequence: Synthetic probe
aaagtgaccagtcttgctcccacacatgtcatagacctcatgcaaactcaccaacacggg

SEQ ID NO: 6070 - DNA, 60 bp, Artificial Sequence
  Description of Artificial Sequence: Synthetic probe
ttgtgaaagtgaacagtcctactcccacacatgtcatagacctcatgcaaactcaccaac

SEQ ID NO: 6071 - DNA, 60 bp, Artificial Sequence
  Description of Artificial Sequence: Synthetic probe
gatttgtgaaagtgaacagttctactcccacacatgtcatagacctcatgcaaactcacc

SEQ ID NO: 6072 - DNA, 60 bp, Artificial Sequence
  Description of Artificial Sequence: Synthetic probe
gactacagagtgttcgagtttgagattaaagtaaaaggacaggacatgctctcagacgcc

SEQ ID NO: 6073 - DNA, 60 bp, Artificial Sequence
  Description of Artificial Sequence: Synthetic probe
atgaacacaactgactgttttatcgctctgttgcacgctctcagagagatcaaaacactg

SEQ ID NO: 6074 - DNA, 60 bp, Artificial Sequence
  Description of Artificial Sequence: Synthetic probe
gtggacttgatggacaccaaggaaaagaccctagtaggtgcccttctgagggcctccacc

SEQ ID NO: 6075 - DNA, 60 bp, Artificial Sequence
  Description of Artificial Sequence: Synthetic probe
gtggacatcatggacaccaaggaaaagaccctagtaggtgccctccttcgggcgtccacc

SEQ ID NO: 6076 - DNA, 60 bp, Artificial Sequence
  Description of Artificial Sequence: Synthetic probe
aacgtggacctcatggacaccaaggaaaagaccctagtaggtgccctcctaagggcgtcc

SEQ ID NO: 6077 - DNA, 60 bp, Artificial Sequence
  Description of Artificial Sequence: Synthetic probe
caacgtggacttgatggacaccaaggaaaagaccctagtaggtgcccttctgagggcctc

SEQ ID NO: 6078 - DNA, 60 bp, Artificial Sequence
  Description of Artificial Sequence: Synthetic probe
tgaccaacgtgagaggtgacctacaagtgttggcccagaaggcggcgagagcgctgtcta

SEQ ID NO: 6079 - DNA, 60 bp, Artificial Sequence
  Description of Artificial Sequence: Synthetic probe
ctcctgaactttgacctacttaagttggcgggagacgttgagtccaaccctgggcccttc

SEQ ID NO: 6080 - DNA, 60 bp, Artificial Sequence
  Description of Artificial Sequence: Synthetic probe
ccactttcaactacggcaggatttacactgaggccgaagtggacgtgtacgtcaggatga

SEQ ID NO: 6081 - DNA, 60 bp, Artificial Sequence
  Description of Artificial Sequence: Synthetic probe
ggcactcgcttccatccacgttcaactttggacatgtgaccgccgacagaccagtcgacg

SEQ ID NO: 6082 - DNA, 60 bp, Artificial Sequence
  Description of Artificial Sequence: Synthetic probe
caccggacccgtccgacgtcctggtatttgttccgtacgatcaagaaccacttaacggag

SEQ ID NO: 6083 - DNA, 60 bp, Artificial Sequence
  Description of Artificial Sequence: Synthetic probe
cgcctgacccgtccgacgtcctggtatttgttccgtacgatcaagaaccgctcaacggag

SEQ ID NO: 6084 - DNA, 60 bp, Artificial Sequence
  Description of Artificial Sequence: Synthetic probe
acttttacccctggacgcctgacccgtccgacgtcctggtatttgttccgtacgatcaag

SEQ ID NO: 6085 - DNA, 60 bp, Artificial Sequence
  Description of Artificial Sequence: Synthetic probe
cacgagacttgctctcccttacacggcaccacaccgtgtgctggcaacagtctacaacgg

SEQ ID NO: 6086 - DNA, 60 bp, Artificial Sequence
  Description of Artificial Sequence: Synthetic probe
caacaaggcaccattcacgagacttgctctcccttacacggcaccacaccgtgtgctggc

SEQ ID NO: 6087 - DNA, 60 bp, Artificial Sequence
  Description of Artificial Sequence: Synthetic probe
aaattgttgtacggcacgacggcaatctgacttgggtgcccaacggcgcccctgtgtcag

SEQ ID NO: 6088 - DNA, 60 bp, Artificial Sequence
  Description of Artificial Sequence: Synthetic probe
gacttggaaattgttgtacggcacgacggcaatctgacttgggtgcccaacggcgcccct

SEQ ID NO: 6089 - DNA, 60 bp, Artificial Sequence
  Description of Artificial Sequence: Synthetic probe
ctgatctggaaattgttgtacggcacgacggcaatctgacttgggtgcccaacggcgccc

SEQ ID NO: 6090 - DNA, 60 bp, Artificial Sequence
  Description of Artificial Sequence: Synthetic probe
acgtactacttttctgacttggaaattgttgtacggcacgacggcaatctgacttgggtg

SEQ ID NO: 6091 - DNA, 60 bp, Artificial Sequence
  Description of Artificial Sequence: Synthetic probe
tgagaactacggtggtgagacacaggtccagcggcgtcaccacactgatgtcggcttcat

SEQ ID NO: 6092 - DNA, 60 bp, Artificial Sequence
  Description of Artificial Sequence: Synthetic probe
ggcggctgcccacctccttcaactacggcgctgtaaaggctgacaccatcactgagcttt

SEQ ID NO: 6093 - DNA, 60 bp, Artificial Sequence
  Description of Artificial Sequence: Synthetic probe
gagcgctcttcagaacgcgagcaaccccacggcctaccacaaggccccgttcacgagact

SEQ ID NO: 6094 - DNA, 60 bp, Artificial Sequence
  Description of Artificial Sequence: Synthetic probe
acaggatgaagcgtgctgaactttactgccccaggccacttctcccggcttatgaccatg

SEQ ID NO: 6095 - DNA, 60 bp, Artificial Sequence
  Description of Artificial Sequence: Synthetic probe
cagcccaatggagcgccacgcacaacccagttgggtgacaaccccatggtcttctcacac

SEQ ID NO: 6096 - DNA, 60 bp, Artificial Sequence
  Description of Artificial Sequence: Synthetic probe
gcagcccaatggagcgccacgcacaacccagttgggtgacaaccccatggtcttctcaca

SEQ ID NO: 6097 - DNA, 60 bp, Artificial Sequence
  Description of Artificial Sequence: Synthetic probe
gcactcgtgggtgccctcctgcgttcgaccacgtactacttctgtgacctggaaatcgct

SEQ ID NO: 6098 - DNA, 60 bp, Artificial Sequence
  Description of Artificial Sequence: Synthetic probe
ccaacgaacaagcactcgtgggtgccctcctgcgttcgaccacgtactacttctgtgacc

SEQ ID NO: 6099 - DNA, 60 bp, Artificial Sequence
  Description of Artificial Sequence: Synthetic probe
caacaaaaccacttttgcggtggacttgatggacaccaacgaacaagcactcgtgggtgc

SEQ ID NO: 6100 - DNA, 60 bp, Artificial Sequence
  Description of Artificial Sequence: Synthetic probe
cacacatgtgcataccaacaaaaccacttttgcggtggacttgatggacaccaacgaaca

SEQ ID NO: 6101 - DNA, 60 bp, Artificial Sequence
  Description of Artificial Sequence: Synthetic probe
aagagtcgccacacaactcccttcatccttcaactacggggcgctgcgtgctgaggccat

SEQ ID NO: 6102 - DNA, 60 bp, Artificial Sequence
  Description of Artificial Sequence: Synthetic probe
ggggcccttgcggcaagagtcgccacacaactcccttcatccttcaactacggggcgctg

SEQ ID NO: 6103 - DNA, 60 bp, Artificial Sequence
  Description of Artificial Sequence: Synthetic probe
accggggagtcagcagaccctgtcaccaccaccgtggagaactacggcggtgagacacag

SEQ ID NO: 6104 - DNA, 60 bp, Artificial Sequence
  Description of Artificial Sequence: Synthetic probe
cgtgcgcatgaagcgggccgagctctactgccctagaccacttttggcaatagaggtgtc

SEQ ID NO: 6105 - DNA, 60 bp, Artificial Sequence
  Description of Artificial Sequence: Synthetic probe
cccacacatgtcattgacctcatgcagacccaccaacacgcgttggtaggcgctctgttg

SEQ ID NO: 6106 - DNA, 50 bp, Artificial Sequence
  Description of Artificial Sequence: Synthetic probe
ccccacacatgtcattgacctcatgcagacccaccaacacgcgttggtag

SEQ ID NO: 6107 - DNA, 50 bp, Artificial Sequence
  Description of Artificial Sequence: Synthetic probe
ccccacacatgtcattgacctcatgcagacccaccaacgagcgttggtag

SEQ ID NO: 6108 - DNA, 60 bp, Artificial Sequence
  Description of Artificial Sequence: Synthetic probe
ggctgacaccatcactgagcttttgatccgcatgaagcgcgcggagacatactgccctag

SEQ ID NO: 6109 - DNA, 60 bp, Artificial Sequence
  Description of Artificial Sequence: Synthetic probe
accaacccgactgcctaccagaagaaacccatcacccgcctggcgctcccctacaccgct

SEQ ID NO: 6110 - DNA, 60 bp, Artificial Sequence
  Description of Artificial Sequence: Synthetic probe
actgcccgcgccctctcctgacacactacgaccacggcgggaaggatcgctacaagaccg

SEQ ID NO: 6111 - DNA, 60 bp, Artificial Sequence
  Description of Artificial Sequence: Synthetic probe
cgttgagaatgaaaccacaagatgcattcccacgacattctacttcgggagactgttgtg

SEQ ID NO: 6112 - DNA, 60 bp, Artificial Sequence
  Description of Artificial Sequence: Synthetic probe
gccctttgctagctcttgagaccactcacgaccaccgtaagcaggagatcattgcacctg

SEQ ID NO: 6113 - DNA, 60 bp, Artificial Sequence
  Description of Artificial Sequence: Synthetic probe
aaggctgacaccatcacggagctgttgatccgtatgaagcgtgcggagacatactgcccc

SEQ ID NO: 6114 - DNA, 60 bp, Artificial Sequence
  Description of Artificial Sequence: Synthetic probe
cgcggtgacctggctgttcttgcacaacaggtaagcaacaggctgcccacctccttcaac

SEQ ID NO: 6115 - DNA, 60 bp, Artificial Sequence
  Description of Artificial Sequence: Synthetic probe
gggcagctgcccacctctttcaactacggcgctgtgaaggctgacaccattaccgagctt

SEQ ID NO: 6116 - DNA, 60 bp, Artificial Sequence
  Description of Artificial Sequence: Synthetic probe
gattgcaagtacaaacccgctggcacggccccgcgcgacaacatccgcggggacctcgca

SEQ ID NO: 6117 - DNA, 60 bp, Artificial Sequence
  Description of Artificial Sequence: Synthetic probe
gcggccaagtatgccgacacaagacacacgctcccctccaccttcaactttggacacgtc

SEQ ID NO: 6118 - DNA, 60 bp, Artificial Sequence
  Description of Artificial Sequence: Synthetic probe
cgtgttggcggccaagtatgccgacacaagacacacgctcccctccaccttcaactttgg

SEQ ID NO: 6119 - DNA, 60 bp, Artificial Sequence
  Description of Artificial Sequence: Synthetic probe
aagtacagccaacgcgtcactgcaattcgcggtgaccgagccgtgttggcggccaagtat

SEQ ID NO: 6120 - DNA, 60 bp, Artificial Sequence
  Description of Artificial Sequence: Synthetic probe
tgtgaatgtaagtacagccaacgcgtcactgcaattcgcggtgaccgagccgtgttggcg

SEQ ID NO: 6121 - DNA, 60 bp, Artificial Sequence
  Description of Artificial Sequence: Synthetic probe
caggcaaccccaccgcctacaacaaagcaccattcacgaggcttgcgcttccctacactg

SEQ ID NO: 6122 - DNA, 60 bp, Artificial Sequence
  Description of Artificial Sequence: Synthetic probe
tgacgtgtatgtaaggatgaaacgcgcggaactctactgcccgcgccccgtcctgacaca

SEQ ID NO: 6123 - DNA, 60 bp, Artificial Sequence
  Description of Artificial Sequence: Synthetic probe
aagccgaggttgacgtgtatgtaaggatgaaacgcgcggaactctactgcccgcgccccg

SEQ ID NO: 6124 - DNA, 60 bp, Artificial Sequence
  Description of Artificial Sequence: Synthetic probe
ggcaggatttacactgaggccgaggttgacgtgtatgtaaggatgaaacgcgcggaactc

SEQ ID NO: 6125 - DNA, 60 bp, Artificial Sequence
  Description of Artificial Sequence: Synthetic probe
gggacctcgcgactcttgcgcagaggattgcaagcgagactcatatcccaaccactttca

SEQ ID NO: 6126 - DNA, 60 bp, Artificial Sequence
  Description of Artificial Sequence: Synthetic probe
acattcgcggggacctcgcgactcttgcgcagaggattgcaagcgagactcacatcccaa

SEQ ID NO: 6127 - DNA, 50 bp, Artificial Sequence
  Description of Artificial Sequence: Synthetic probe
ggtacgcgattgatgacgaggacttttacccttggacaccggacccgtcc

SEQ ID NO: 6128 - DNA, 60 bp, Artificial Sequence
  Description of Artificial Sequence: Synthetic probe
cggaggagaaacacaaactcagcgtcgccaccacaccgacgttgccttcgttcttgaccg

SEQ ID NO: 6129 - DNA, 60 bp, Artificial Sequence
  Description of Artificial Sequence: Synthetic probe
gcaaggatcgctacaaggcgaatctcgtcaagcccgccaaacaactgtgtaacttcgacc

SEQ ID NO: 6130 - DNA, 60 bp, Artificial Sequence
  Description of Artificial Sequence: Synthetic probe
gctggcaaggatcgctacaaggcgaatctcgtcaagcccgccaaacaactgtgtaacttc

SEQ ID NO: 6131 - DNA, 60 bp, Artificial Sequence
  Description of Artificial Sequence: Synthetic probe
tacaaacccactggcaccgacccccgcgaaaacgttcgcggcgacctcgcaaccctggct

SEQ ID NO: 6132 - DNA, 60 bp, Artificial Sequence
  Description of Artificial Sequence: Synthetic probe
acactgcacctcaccgggtgctcgccacagtctacaacggtgactgcaagtacaaaccca

SEQ ID NO: 6133 - DNA, 60 bp, Artificial Sequence
  Description of Artificial Sequence: Synthetic probe
aacccagtcgtcttctcacacggaggcaccacccgctttgcgctcccttacactgcacct

SEQ ID NO: 6134 - DNA, 60 bp, Artificial Sequence
  Description of Artificial Sequence: Synthetic probe
caacccagtcgtcttctcacacggaggcaccacccgctttgcgctcccttacactgcacc

SEQ ID NO: 6135 - DNA, 60 bp, Artificial Sequence
  Description of Artificial Sequence: Synthetic probe
cctaacggcagcccagtgctgacggaagtgggcgacaacccagtcgtcttctcacacgga

SEQ ID NO: 6136 - DNA, 60 bp, Artificial Sequence
  Description of Artificial Sequence: Synthetic probe
tgggtgggctgggtgcctaacggcagcccagtgctgacggaagtgggcgacaacccagtc

SEQ ID NO: 6137 - DNA, 60 bp, Artificial Sequence
  Description of Artificial Sequence: Synthetic probe
cggccgcgccctgacagacagtgacttcagagtgtttgagtttgaggtaaaagtaaaagg

SEQ ID NO: 6138 - DNA, 60 bp, Artificial Sequence
  Description of Artificial Sequence: Synthetic probe
cggtcgcgccctgacagacagtgacttcagagtgtttgagtttgaggtaaaagtaaaagg

SEQ ID NO: 6139 - DNA, 60 bp, Artificial Sequence
  Description of Artificial Sequence: Synthetic probe
ctggacggccgcgccctgacagacagtgacttcagagtgtttgagtttgaggtaaaagta

SEQ ID NO: 6140 - DNA, 60 bp, Artificial Sequence
  Description of Artificial Sequence: Synthetic probe
ttggacggccgcgccctgacagacagtgacttcagagtgtttgagtttgaggtaaaagta

SEQ ID NO: 6141 - DNA, 60 bp, Artificial Sequence
  Description of Artificial Sequence: Synthetic probe
ttggacggtcgcgccctgacagacagtgacttcagagtgtttgagtttgaggtaaaagta

SEQ ID NO: 6142 - DNA, 60 bp, Artificial Sequence
  Description of Artificial Sequence: Synthetic probe
tcgttctcgacaggtttgtgaaactcactgcacccaagaacattcagactcttgacctca

SEQ ID NO: 6143 - DNA, 60 bp, Artificial Sequence
  Description of Artificial Sequence: Synthetic probe
tgcaacagtaccagaactcaatggacacccagcttggcgacaacgccatttcgggtgggt

SEQ ID NO: 6144 - DNA, 60 bp, Artificial Sequence
  Description of Artificial Sequence: Synthetic probe
cacacaggcagaagtggacgtgtacctgaggatgaagagagcagaactctactgccctcg

SEQ ID NO: 6145 - DNA, 60 bp, Artificial Sequence
  Description of Artificial Sequence: Synthetic probe
gctcgcatacgtcccgtacactcccgaacctctagcagttgattggcaaggaaagtgctc

SEQ ID NO: 6146 - DNA, 60 bp, Artificial Sequence
  Description of Artificial Sequence: Synthetic probe
agatgacgtgctcgcatacgtcccgtacactcccgaacctctagcagttgattggcaagg

SEQ ID NO: 6147 - DNA, 60 bp, Artificial Sequence
  Description of Artificial Sequence: Synthetic probe
gctgtcttcgcactgctcacgcgcgagggctggtacgcgattgatgacgagcacttttac

SEQ ID NO: 6148 - DNA, 60 bp, Artificial Sequence
  Description of Artificial Sequence: Synthetic probe
ggtactgaacatgctgtcttcgcactgctcacgcgcgagggctggtacgcgattgatgac

SEQ ID NO: 6149 - DNA, 60 bp, Artificial Sequence
  Description of Artificial Sequence: Synthetic probe
gtttggccgacttccacgccgggatcttcctcaaaggtactgaacatgctgtcttcgcac

SEQ ID NO: 6150 - DNA, 60 bp, Artificial Sequence
  Description of Artificial Sequence: Synthetic probe
acggtgttcagatgtgtttggccgacttccacgccgggatcttcctcaaaggtactgaac

SEQ ID NO: 6151 - DNA, 60 bp, Artificial Sequence
  Description of Artificial Sequence: Synthetic probe
gcacgtcaactcgccccagcgagatctgtgtcgtcaacggtgttcagatgtgtttggccg

SEQ ID NO: 6152 - DNA, 60 bp, Artificial Sequence
  Description of Artificial Sequence: Synthetic probe
gatgaccggcgtcggcacgtcaactcgccccagcgagatctgtgtcgtcaacggtgttca

SEQ ID NO: 6153 - DNA, 60 bp, Artificial Sequence
  Description of Artificial Sequence: Synthetic probe
ctcatgaaacacaccggcatggacttacgcgagggcggaccgcctgctctcgttatttgg

SEQ ID NO: 6154 - DNA, 60 bp, Artificial Sequence
  Description of Artificial Sequence: Synthetic probe
gattgagcaactcatgaaacacaccggcatggacttacgcgagggcggaccgcctgctct

SEQ ID NO: 6155 - DNA, 60 bp, Artificial Sequence
  Description of Artificial Sequence: Synthetic probe
gagtaccttgcacccgaaaatcttacgggtcgcatgattgagcaactcatgaaacacacc

SEQ ID NO: 6156 - DNA, 60 bp, Artificial Sequence
  Description of Artificial Sequence: Synthetic probe
cctctgtttgaaagtgagtaccttgcacccgaaaatcttacgggtcgcatgattgagcaa

SEQ ID NO: 6157 - DNA, 60 bp, Artificial Sequence
  Description of Artificial Sequence: Synthetic probe
gctggttgaacgcaattctgcagctcttccggtatgttgacgagcctctgtttgaaagtg

SEQ ID NO: 6158 - DNA, 60 bp, Artificial Sequence
  Description of Artificial Sequence: Synthetic probe
acaactgctggttgaacgcaattctgcagctcttccggtatgttgacgagcctctgtttg

SEQ ID NO: 6159 - DNA, 60 bp, Artificial Sequence
  Description of Artificial Sequence: Synthetic probe
cggtgaaaagaagaccttctacagcagaccaaacacgcacgacaactgctggttgaacgc

SEQ ID NO: 6160 - DNA, 60 bp, Artificial Sequence
  Description of Artificial Sequence: Synthetic probe
actgtacaacggtgaaaagaagaccttctacagcagaccaaacacgcacgacaactgctg

SEQ ID NO: 6161 - DNA, 60 bp, Artificial Sequence
  Description of Artificial Sequence: Synthetic probe
gactgtttcatcgctgttctcgaggctcttagacggttgaataactacctaaggcacaag

SEQ ID NO: 6162 - DNA, 60 bp, Artificial Sequence
  Description of Artificial Sequence: Synthetic probe
atggatacaactgactgtttcatcgctgttctcgaggctcttagacggttgaataactac

SEQ ID NO: 6163 - DNA, 60 bp, Artificial Sequence
  Description of Artificial Sequence: Synthetic probe
gcaacttgacgtgggtgcccaacggcgcccccgaggccgctctccagaacacgagcaacc

SEQ ID NO: 6164 - DNA, 60 bp, Artificial Sequence
  Description of Artificial Sequence: Synthetic probe
gccccagaacactgcagacggtagaagtatcgtcgcaagacagacacaaacagaagatca

SEQ ID NO: 6165 - DNA, 60 bp, Artificial Sequence
  Description of Artificial Sequence: Synthetic probe
tctactgccccagaacactgcagacggtagaagtatcgtcgcaagacagacacaaacaga

SEQ ID NO: 6166 - DNA, 60 bp, Artificial Sequence
  Description of Artificial Sequence: Synthetic probe
gcgtgctgaactctactgccccagaacactgcagacggtagaagtatcgtcgcaagacag

SEQ ID NO: 6167 - DNA, 60 bp, Artificial Sequence
  Description of Artificial Sequence: Synthetic probe
gcatgaagcgtgctgaactctactgccccagaacactgcagacggtagaagtatcgtcgc

SEQ ID NO: 6168 - DNA, 60 bp, Artificial Sequence
  Description of Artificial Sequence: Synthetic probe
gcacgagcttctcgtaagcatgaagcgtgctgaactctactgccccagaacactgcagac

SEQ ID NO: 6169 - DNA, 60 bp, Artificial Sequence
  Description of Artificial Sequence: Synthetic probe
gcacgagcttctcgtaagcatgaagcgtgctgaactctactgccccagaagactgcagac

SEQ ID NO: 6170 - DNA, 60 bp, Artificial Sequence
  Description of Artificial Sequence: Synthetic probe
aaaaaacaagtctatgcacgagcttctcgtaagcatgaagcgtgctgaactctactgccc

SEQ ID NO: 6171 - DNA, 60 bp, Artificial Sequence
  Description of Artificial Sequence: Synthetic probe
tgctgtactttctcatcgagaaaggccagcacgaagcagcaattgaattctttgagggga

SEQ ID NO: 6172 - DNA, 60 bp, Artificial Sequence
  Description of Artificial Sequence: Synthetic probe
tgttgtactttctcatcgagaaggggcagcacgaagcagcaattgaattctttgagggga

SEQ ID NO: 6173 - DNA, 60 bp, Artificial Sequence
  Description of Artificial Sequence: Synthetic probe
acagtattgtgggagcgcttctccgcgcagccacatactacttctctgatctggaaatag

SEQ ID NO: 6174 - DNA, 60 bp, Artificial Sequence
  Description of Artificial Sequence: Synthetic probe
gacgacgacgacttttacccatggacgccggacccgtccgacgttttggtgtttgttccg

SEQ ID NO: 6175 - DNA, 60 bp, Artificial Sequence
  Description of Artificial Sequence: Synthetic probe
attgacgacgacgacttttacccatggacgccggacccgtccgacgttttggtgtttgtt

SEQ ID NO: 6176 - DNA, 60 bp, Artificial Sequence
  Description of Artificial Sequence: Synthetic probe
cggtggtgagacacaaacccagagacggcaccacacggatgtcggtttcatcatggacag

SEQ ID NO: 6177 - DNA, 60 bp, Artificial Sequence
  Description of Artificial Sequence: Synthetic probe
cggcggtgagacacaaacccagagacggcaccacacggatgtcggtttcatcatggacag

SEQ ID NO: 6178 - DNA, 60 bp, Artificial Sequence
  Description of Artificial Sequence: Synthetic probe
cggcggtcagacacaaacccagagacggcaccacacggatgtcggtttcatcatggacag

SEQ ID NO: 6179 - DNA, 60 bp, Artificial Sequence
  Description of Artificial Sequence: Synthetic probe
accaccaacccaacagcctaccacaaggcaccgctcacccggcttgccctgccttacacg

SEQ ID NO: 6180 - DNA, 60 bp, Artificial Sequence
  Description of Artificial Sequence: Synthetic probe
ctgctggcaatagaggtgtcttcacaagacagacacaaacagaagatcattgcacccgca

SEQ ID NO: 6181 - DNA, 60 bp, Artificial Sequence
  Description of Artificial Sequence: Synthetic probe
gccatcagtgagcttcttgtgcgcatgaagcgtgctgagctctactgtcccaggccacta

SEQ ID NO: 6182 - DNA, 60 bp, Artificial Sequence
  Description of Artificial Sequence: Synthetic probe
caaccccaccgcctacaacaaagcaccatttacgaggctagcactcccctacactgcgcc

SEQ ID NO: 6183 - DNA, 60 bp, Artificial Sequence
  Description of Artificial Sequence: Synthetic probe
cctgaacaacgcgggcaaccccaccgcctacaacaaagcaccatttacgaggctagcact

SEQ ID NO: 6184 - DNA, 60 bp, Artificial Sequence
  Description of Artificial Sequence: Synthetic probe
caacaactactacatgcagcagtaccagaactcgatggacacacagcttggcgacaacgc

SEQ ID NO: 6185 - DNA, 60 bp, Artificial Sequence
  Description of Artificial Sequence: Synthetic probe
gagcacctgagacagccctctccaacacgagcaaccccactgcataccacaagggaccat

SEQ ID NO: 6186 - DNA, 60 bp, Artificial Sequence
  Description of Artificial Sequence: Synthetic probe
ctgggtacccaatggagcacctgagacagccctctccaacacgagcaaccccactgcata

SEQ ID NO: 6187 - DNA, 60 bp, Artificial Sequence
  Description of Artificial Sequence: Synthetic probe
cggcaccacccgctttgcactgccctacactgctccacacaggtgcttggcaacatcata

SEQ ID NO: 6188 - DNA, 60 bp, Artificial Sequence
  Description of Artificial Sequence: Synthetic probe
ttgcttttgttctcgacaggtttgtgaaactcactgcacccaagaacacccagattcttg

SEQ ID NO: 6189 - DNA, 51 bp, Artificial Sequence
  Description of Artificial Sequence: Synthetic probe
cacccgaacgaggccagacacaaacagaagattgtggcacctgtgaagcag

SEQ ID NO: 6190 - DNA, 60 bp, Artificial Sequence
  Description of Artificial Sequence: Synthetic probe
actgcctacaacagggcaccattcacaagacttgcgctcccctacactgcgccacaccga

SEQ ID NO: 6191 - DNA, 60 bp, Artificial Sequence
  Description of Artificial Sequence: Synthetic probe
cactgcctacaacaaggcaccattcacaagacttgcgctcccctacactgcgccacaccg

SEQ ID NO: 6192 - DNA, 60 bp, Artificial Sequence
  Description of Artificial Sequence: Synthetic probe
ccactgcctacaacagggcaccattcacaagacttgcgctcccctacactgcgccacacc

SEQ ID NO: 6193 - DNA, 60 bp, Artificial Sequence
  Description of Artificial Sequence: Synthetic probe
ccactgcctacaacaaggcaccattcacaagacttgcgctcccctacactgcgccacacc

SEQ ID NO: 6194 - DNA, 53 bp, Artificial Sequence
  Description of Artificial Sequence: Synthetic probe
tacactggtactacgacctacaccgccagtgcacgcggggatttggctcacct

SEQ ID NO: 6195 - DNA, 60 bp, Artificial Sequence
  Description of Artificial Sequence: Synthetic probe
ccaccgaccggtacaaggttaaactggtagcacctgataagcaactgtgcaatttcgacc

SEQ ID NO: 6196 - DNA, 60 bp, Artificial Sequence
  Description of Artificial Sequence: Synthetic probe
cacaccaccgaccggtacaaggttaaactggtagcacctgataagcaactgtgcaatttc

SEQ ID NO: 6197 - DNA, 53 bp, Artificial Sequence
  Description of Artificial Sequence: Synthetic probe
gcgacatggcagtgttggcacgacgtgctgagactgaaaccacaagatgcaga

SEQ ID NO: 6198 - DNA, 50 bp, Artificial Sequence
  Description of Artificial Sequence: Synthetic probe
cgaagaacggtgttgcccgctttgccctgccttacacggcaccacacgga

SEQ ID NO: 6199 - DNA, 57 bp, Artificial Sequence
  Description of Artificial Sequence: Synthetic probe
tgggtgcccaacggctgcccacacactgaccgcgtggaggacaacccagttgtctat

SEQ ID NO: 6200 - DNA, 60 bp, Artificial Sequence
  Description of Artificial Sequence: Synthetic probe
gctctactgtcccaggcctctgctggcagtggaagtgttgtcgcaggacagacacaagca

SEQ ID NO: 6201 - DNA, 60 bp, Artificial Sequence
  Description of Artificial Sequence: Synthetic probe
cttccctacaccgccccccaccgtgtactggcgacagtgtacaacgggaagactacgtac

SEQ ID NO: 6202 - DNA, 60 bp, Artificial Sequence
  Description of Artificial Sequence: Synthetic probe
tacggtgccatcaaggccacccgggtgactgaactgctttaccgcatgaagagggccgaa

SEQ ID NO: 6203 - DNA, 60 bp, Artificial Sequence
  Description of Artificial Sequence: Synthetic probe
tgcaagtgttggcccagaaggcggcaagaacgctgcctacctccttcaactacggtgcca

SEQ ID NO: 6204 - DNA, 60 bp, Artificial Sequence
  Description of Artificial Sequence: Synthetic probe
tgcaagtgttgtcgcagaaggctgagagaacgctgcctacctccttcaactacggtgcca

SEQ ID NO: 6205 - DNA, 60 bp, Artificial Sequence
  Description of Artificial Sequence: Synthetic probe
acaagcaaccccactgcctaccacaaggaaccattcacgaggcttgcgcttccctacact

SEQ ID NO: 6206 - DNA, 60 bp, Artificial Sequence
  Description of Artificial Sequence: Synthetic probe
gcgtttccaggtccatgcttctgaaaatgaaggcacacattgaccctgaaccacaccacg

SEQ ID NO: 6207 - DNA, 60 bp, Artificial Sequence
  Description of Artificial Sequence: Synthetic probe
gttttgctctgccctacaccgcaccacacaggtgcttggcaacaacctacaacggtgact

SEQ ID NO: 6208 - DNA, 60 bp, Artificial Sequence
  Description of Artificial Sequence: Synthetic probe
accaccgctactggggaatcggcagaccctgtcaccaccactgtggagaactacggtggt

SEQ ID NO: 6209 - DNA, 56 bp, Artificial Sequence
  Description of Artificial Sequence: Synthetic probe
ctcgtgcgcatgaaacgtgctgagctttactgccccaggccactgctggcagtaga

SEQ ID NO: 6210 - DNA, 60 bp, Artificial Sequence
  Description of Artificial Sequence: Synthetic probe
ccctcggcccctgaaggtgagatacactcacaccactgaccggtacaagaccaagctggt

SEQ ID NO: 6211 - DNA, 60 bp, Artificial Sequence
  Description of Artificial Sequence: Synthetic probe
gccctcgacccctgagggtgagatacattcacaccactgaccggtacaagaccaagctgg

SEQ ID NO: 6212 - DNA, 59 bp, Artificial Sequence
  Description of Artificial Sequence: Synthetic probe
acgaccacgcagaccgggacaggttcgacgccccgattggcgttgaaaaacagctgtgt

SEQ ID NO: 6213 - DNA, 57 bp, Artificial Sequence
  Description of Artificial Sequence: Synthetic probe
ctgacaaagcagtcgacgtgtactacaggatgaagcgtgctgagctttattgcccca

SEQ ID NO: 6214 - DNA, 60 bp, Artificial Sequence
  Description of Artificial Sequence: Synthetic probe
cacacgctaccgtccacattcaactttggtcatgtcacagctgacaaagcagtcgacgtg

SEQ ID NO: 6215 - DNA, 60 bp, Artificial Sequence
  Description of Artificial Sequence: Synthetic probe
ccaccgcctgctgtcaactgtctacaacggtgaatgcaggtacgagacacccgtcactgc

SEQ ID NO: 6216 - DNA, 60 bp, Artificial Sequence
  Description of Artificial Sequence: Synthetic probe
gccgtacaccgcgccccaccgcctgctgtcaactgtctacaacggtgaatgcaggtacga

SEQ ID NO: 6217 - DNA, 60 bp, Artificial Sequence
  Description of Artificial Sequence: Synthetic probe
acacgcgtgtgttctggcaacccaacggtgcacctagaaccacccagcttggggacaacc

SEQ ID NO: 6218 - DNA, 60 bp, Artificial Sequence
  Description of Artificial Sequence: Synthetic probe
ggcatcaacctactatttttgtgacctggaaattgcttgcgtgggtgaccacacgcgtgt

SEQ ID NO: 6219 - DNA, 60 bp, Artificial Sequence
  Description of Artificial Sequence: Synthetic probe
gtggacctcatggacaccaaggaaaagactctagtaggtgctctccttagggcatcaacc

SEQ ID NO: 6220 - DNA, 60 bp, Artificial Sequence
  Description of Artificial Sequence: Synthetic probe
ggttcacacacgtccacacaagcaagactaccttcaacgtggacctcatggacaccaagg

SEQ ID NO: 6221 - DNA, 60 bp, Artificial Sequence
  Description of Artificial Sequence: Synthetic probe
tcgtgctcgacaggttcacacacgtccacacaagcaagactaccttcaacgtggacctca

SEQ ID NO: 6222 - DNA, 60 bp, Artificial Sequence
  Description of Artificial Sequence: Synthetic probe
acacggaggacgagtagaggagaagagacggatgcacactgatgtcgcattcgtgctcga

SEQ ID NO: 6223 - DNA, 57 bp, Artificial Sequence
  Description of Artificial Sequence: Synthetic probe
acacggaggacgagtagaggagaagagacggatgcacactgatgtcgcattcgtgct

SEQ ID NO: 6224 - DNA, 60 bp, Artificial Sequence
  Description of Artificial Sequence: Synthetic probe
gagggcgctgatgtggtgtcgaccgatccttcaacacacggaggacgagtagaggagaag

SEQ ID NO: 6225 - DNA, 60 bp, Artificial Sequence
  Description of Artificial Sequence: Synthetic probe
accaccagtgccggcgagggcgctgatgtggtgtcgaccgatccttcaacacacggagga

SEQ ID NO: 6226 - DNA, 60 bp, Artificial Sequence
  Description of Artificial Sequence: Synthetic probe
tggtgcaattcgggccacgaccatccacgagctcctcgtgcgcatgaaacgtgccgagct

SEQ ID NO: 6227 - DNA, 60 bp, Artificial Sequence
  Description of Artificial Sequence: Synthetic probe
ttggtgcaattcgggccacgaccatccacgagctcctcgtgcgcatgaaacgtgccgagc

SEQ ID NO: 6228 - DNA, 60 bp, Artificial Sequence
  Description of Artificial Sequence: Synthetic probe
ccactgctggcggtggaggtgttgtcgcaagacagacacaaacagaagatcattgcaccc

SEQ ID NO: 6229 - DNA, 60 bp, Artificial Sequence
  Description of Artificial Sequence: Synthetic probe
aaccccaccgcctaccacaaggaaccattcacgagacttgcgctcccttacactgcgcca

SEQ ID NO: 6230 - DNA, 60 bp, Artificial Sequence
  Description of Artificial Sequence: Synthetic probe
gcaagcaaccccaccgcctaccacaaggaaccattcacgagacttgcgctcccttacact

SEQ ID NO: 6231 - DNA, 60 bp, Artificial Sequence
  Description of Artificial Sequence: Synthetic probe
aagtacactgtgagtgggtcaagcagacgaggcaacttgggctccctcgcggcacgagtc

SEQ ID NO: 6232 - DNA, 60 bp, Artificial Sequence
  Description of Artificial Sequence: Synthetic probe
acgggacgagcaagtacactgtgagtgggtcaagcagacgaggcgacttgggctccctcg

SEQ ID NO: 6233 - DNA, 60 bp, Artificial Sequence
  Description of Artificial Sequence: Synthetic probe
acgggacgagcaagtacactgtgagtgggtcaagcagacgaggcaacttgggctccctcg

SEQ ID NO: 6234 - DNA, 53 bp, Artificial Sequence
  Description of Artificial Sequence: Synthetic probe
ccactcaggtccgccgtaagcaggagattaaggcacctgaaaagcagacacta

SEQ ID NO: 6235 - DNA, 60 bp, Artificial Sequence
  Description of Artificial Sequence: Synthetic probe
ggtgctgtgaaggctgaaaacatcaccgagctcttgctccgcatgaagcgtgcggagacg

SEQ ID NO: 6236 - DNA, 53 bp, Artificial Sequence
  Description of Artificial Sequence: Synthetic probe
aaaagagtagtcaactgcccacctccttcaactacggtgctgtgaaggctgaa

SEQ ID NO: 6237 - DNA, 60 bp, Artificial Sequence
  Description of Artificial Sequence: Synthetic probe
gatatggcggcccttgcccaaaaaaagagtagtcaactgcccacctccttcaactacggt

SEQ ID NO: 6238 - DNA, 60 bp, Artificial Sequence
  Description of Artificial Sequence: Synthetic probe
tgaaaactacggcggtgagacacaagtccagcggcgtcaccacactgatgtcggcttcat

SEQ ID NO: 6239 - DNA, 60 bp, Artificial Sequence
  Description of Artificial Sequence: Synthetic probe
gacggtgcagttgtggtgactgtcagcgctggacccgacttcgagttcagaatgccaatc

SEQ ID NO: 6240 - DNA, 60 bp, Artificial Sequence
  Description of Artificial Sequence: Synthetic probe
cacagtgccgtacgtgtctgcggcggacttcgcctacacctactctgacgagcctgaaca

SEQ ID NO: 6241 - DNA, 60 bp, Artificial Sequence
  Description of Artificial Sequence: Synthetic probe
cacagtgccttacatttccgcggctgacttcgcctacacctactctgacgagcctgaaca

SEQ ID NO: 6242 - DNA, 60 bp, Artificial Sequence
  Description of Artificial Sequence: Synthetic probe
cccctacactgcgccgcaccgcgtgttggcgacagtgtacaacgggacgagcaagtactc

SEQ ID NO: 6243 - DNA, 60 bp, Artificial Sequence
  Description of Artificial Sequence: Synthetic probe
agcagaccctgttaccaccactgtagagaactacggcggtgagacacaagtccagagacg

SEQ ID NO: 6244 - DNA, 60 bp, Artificial Sequence
  Description of Artificial Sequence: Synthetic probe
agagaactgaactgtactgtccgcgtcccctccgggttgcgtacacacacaccacagacc

SEQ ID NO: 6245 - DNA, 60 bp, Artificial Sequence
  Description of Artificial Sequence: Synthetic probe
tactaccggatgaagagaactgaactgtactgtccgcgtcccctccgggttgcgtacaca

SEQ ID NO: 6246 - DNA, 60 bp, Artificial Sequence
  Description of Artificial Sequence: Synthetic probe
tgcccacgacattcaacttcggaagattgttgtgtgatacaggtgaggtctactaccgga

SEQ ID NO: 6247 - DNA, 60 bp, Artificial Sequence
  Description of Artificial Sequence: Synthetic probe
ggcaaaacgtgttgagactgaaatcacaagatgtctgcccacgacattcaacttcggaag

SEQ ID NO: 6248 - DNA, 60 bp, Artificial Sequence
  Description of Artificial Sequence: Synthetic probe
cgacctggcgacgttggcaaaacgtgttgagactgaaatcacaagatgtctgcccacgac

SEQ ID NO: 6249 - DNA, 60 bp, Artificial Sequence
  Description of Artificial Sequence: Synthetic probe
aagaacggcgtaccgcggttcgctttgccttacacagcaccacacagggtccttgccaca

SEQ ID NO: 6250 - DNA, 60 bp, Artificial Sequence
  Description of Artificial Sequence: Synthetic probe
cgtacacgcgaagaacggcgtaccgcggttcgctttgccttacacagcaccacacagggt

SEQ ID NO: 6251 - DNA, 60 bp, Artificial Sequence
  Description of Artificial Sequence: Synthetic probe
tgaccagacaattggctcaacaaaggctgaggtctacgtcaacatcgcaccgaccaacgt

SEQ ID NO: 6252 - DNA, 60 bp, Artificial Sequence
  Description of Artificial Sequence: Synthetic probe
tgaccagacaattggatcaacaaaggctgaggtctacgtcaacatcgcacccaccaacgt

SEQ ID NO: 6253 - DNA, 60 bp, Artificial Sequence
  Description of Artificial Sequence: Synthetic probe
ccgggcccaacacaaacgggcttgaaacacgggtagaacaggcagaaaggttcttcaaac

SEQ ID NO: 6254 - DNA, 60 bp, Artificial Sequence
  Description of Artificial Sequence: Synthetic probe
acccgggcccaacacaaacgggcttgaaacacgggtagaacaggcagaaaggttcttcaa

SEQ ID NO: 6255 - DNA, 60 bp, Artificial Sequence
  Description of Artificial Sequence: Synthetic probe
cttcctacccgggcccaacacaaacgggcttgaaacacgggtggagcaagcagaaaggtt

SEQ ID NO: 6256 - DNA, 60 bp, Artificial Sequence
  Description of Artificial Sequence: Synthetic probe
tacaaacccgctggcacggccccgcgcgacaacatccgcggggacctcgcagtcctcgca

SEQ ID NO: 6257 - DNA, 60 bp, Artificial Sequence
  Description of Artificial Sequence: Synthetic probe
agtacaaacccgctggcacggccccgcgcgacaacatccgcggggacctcgcagtcctcg

SEQ ID NO: 6258 - DNA, 60 bp, Artificial Sequence
  Description of Artificial Sequence: Synthetic probe
aagtacaaacccgctggcacggccccgcgcgacaacatccgcggggacctcgcagtcctt

SEQ ID NO: 6259 - DNA, 60 bp, Artificial Sequence
  Description of Artificial Sequence: Synthetic probe
gttcactgccccacacaggtgtcttgcaacaacttacaatggtgattgcaagtacaaacc

SEQ ID NO: 6260 - DNA, 60 bp, Artificial Sequence
  Description of Artificial Sequence: Synthetic probe
ttgccgttcactgccccacacaggtgtcttgcaacaacttacaatggtgattgcaagtac

SEQ ID NO: 6261 - DNA, 60 bp, Artificial Sequence
  Description of Artificial Sequence: Synthetic probe
cattgccgttcactgccccacacaggtgtcttgcaacaacttacaatggtgattgcaagt

SEQ ID NO: 6262 - DNA, 60 bp, Artificial Sequence
  Description of Artificial Sequence: Synthetic probe
gtcggctggactcctaacggagcaccagaacttgaggaagttggcgacaacccagtcgtc

SEQ ID NO: 6263 - DNA, 60 bp, Artificial Sequence
  Description of Artificial Sequence: Synthetic probe
aaacaaatgggtcggctggactcctaacggagcaccagaacttgaggaagttggcgacaa

SEQ ID NO: 6264 - DNA, 60 bp, Artificial Sequence
  Description of Artificial Sequence: Synthetic probe
cgtgtctcggtgaaaacaaatgggtcggctggactcctaacggagcaccagaacttgtgg

SEQ ID NO: 6265 - DNA, 60 bp, Artificial Sequence
  Description of Artificial Sequence: Synthetic probe
ggcgtgtctcggtgaaaacaaatgggtcggctggactcctaacggagcaccagaacttgt

SEQ ID NO: 6266 - DNA, 60 bp, Artificial Sequence
  Description of Artificial Sequence: Synthetic probe
ggtggcgtgtctcggcgaaaacaaatgggtcggctggactcctaacggagcaccagaact

SEQ ID NO: 6267 - DNA, 60 bp, Artificial Sequence
  Description of Artificial Sequence: Synthetic probe
cgcgacccagcgaggtgtgcatggttgacggtacggacatgtgcttggctgattttcacg

SEQ ID NO: 6268 - DNA, 60 bp, Artificial Sequence
  Description of Artificial Sequence: Synthetic probe
ccaacacgaagcagcaattgaattctttgaggggatggttcacgactccattaaggagga

SEQ ID NO: 6269 - DNA, 57 bp, Artificial Sequence
  Description of Artificial Sequence: Synthetic probe
gcatggcctcgccccccagcgaggtgtgtatggttgacggtacggacatgtgcctgg

SEQ ID NO: 6270 - DNA, 60 bp, Artificial Sequence
  Description of Artificial Sequence: Synthetic probe
cgactgggtctatgagtcgcctgagaacctcacccttgaggcgattaggcaactggaaga

SEQ ID NO: 6271 - DNA, 60 bp, Artificial Sequence
  Description of Artificial Sequence: Synthetic probe
ccttcttcgactgggtctatgagtcgcctgagaacctcacccttgaggcgattaggcaac

SEQ ID NO: 6272 - DNA, 60 bp, Artificial Sequence
  Description of Artificial Sequence: Synthetic probe
caaaacactgtttctcacacgagacacgggaaagatggaattcacactttacaacggtga

SEQ ID NO: 6273 - DNA, 60 bp, Artificial Sequence
  Description of Artificial Sequence: Synthetic probe
cgtgctgctacgtactacttctccgacctggagattgtggttcgtcacgacggcaacctg

SEQ ID NO: 6274 - DNA, 60 bp, Artificial Sequence
  Description of Artificial Sequence: Synthetic probe
gaccacggtgacaaagatcgctacaaggtcgccctcactaagcctgccaagcaactgtgc

SEQ ID NO: 6275 - DNA, 60 bp, Artificial Sequence
  Description of Artificial Sequence: Synthetic probe
acgaccacggtgacaaagatcgctacaaggtcgccctcactaagcctgccaagcaactgt

SEQ ID NO: 6276 - DNA, 60 bp, Artificial Sequence
  Description of Artificial Sequence: Synthetic probe
accaccttcaactacggcaggatttacactgaggcggaagtcgatgtgtatgtgaggatg

SEQ ID NO: 6277 - DNA, 54 bp, Artificial Sequence
  Description of Artificial Sequence: Synthetic probe
agtacaaaccagctgaacaagcacctcggaccaacatccgcggagaccttgcga

SEQ ID NO: 6278 - DNA, 60 bp, Artificial Sequence
  Description of Artificial Sequence: Synthetic probe
ctgcaccacacaggtgtcttgcgaccgcctacaacggtgattgcaagtacaaaccagctg

SEQ ID NO: 6279 - DNA, 60 bp, Artificial Sequence
  Description of Artificial Sequence: Synthetic probe
ctacactgcaccacacaggtgtcttgcgaccgcctacaacggtgattgcaagtacaaacc

SEQ ID NO: 6280 - DNA, 60 bp, Artificial Sequence
  Description of Artificial Sequence: Synthetic probe
acggagcgccagagttgaacgaggtaggcgacaacccagtcgtcttctcgcacaacggta

SEQ ID NO: 6281 - DNA, 60 bp, Artificial Sequence
  Description of Artificial Sequence: Synthetic probe
tggactcccaacggagcgccagagttgaacgaggtaggcgacaacccagtcgtcttctcg

SEQ ID NO: 6282 - DNA, 60 bp, Artificial Sequence
  Description of Artificial Sequence: Synthetic probe
acactggcactacgacctacaccgccagtgcacgcggggatttggctcacctaaagacga

SEQ ID NO: 6283 - DNA, 60 bp, Artificial Sequence
  Description of Artificial Sequence: Synthetic probe
tacactggcactacgacctacaccgccagtgcacgcggggatttggctcacctaaagacg

SEQ ID NO: 6284 - DNA, 58 bp, Artificial Sequence
  Description of Artificial Sequence: Synthetic probe
agagactcaggtccaacgtcgccaccacaccgacgtcgccttcgttcttgaccggttt

SEQ ID NO: 6285 - DNA, 60 bp, Artificial Sequence
  Description of Artificial Sequence: Synthetic probe
taccgttgagaactacggaggagagactcaggtccaacgtcgccaccacaccgacgttgc

SEQ ID NO: 6286 - DNA, 60 bp, Artificial Sequence
  Description of Artificial Sequence: Synthetic probe
tgatccgcatgaaacgcgcggagacatactgccccaggcctctgctagctcttgacacca

SEQ ID NO: 6287 - DNA, 60 bp, Artificial Sequence
  Description of Artificial Sequence: Synthetic probe
tcacctccaacgggtggtacgcgattgatgacgaagacttctacccctggacgccggatc

SEQ ID NO: 6288 - DNA, 60 bp, Artificial Sequence
  Description of Artificial Sequence: Synthetic probe
cgaacacgctgtgtttgcttgtgtcacctccaacgggtggtacgcgattgatgacgaaga

SEQ ID NO: 6289 - DNA, 60 bp, Artificial Sequence
  Description of Artificial Sequence: Synthetic probe
ccaggagcacgctgtgtttgcctgtgtcacctccaacgggtggtacgcgattgatgacga

SEQ ID NO: 6290 - DNA, 60 bp, Artificial Sequence
  Description of Artificial Sequence: Synthetic probe
acaaccgccacaggggaatcagcagaccctgtcaccaccaccgtggaaaactacggcggt

SEQ ID NO: 6291 - DNA, 54 bp, Artificial Sequence
  Description of Artificial Sequence: Synthetic probe
tcgtcgcacgacagacacaaacagaagatcattgcacctgcaaagcaactcctg

SEQ ID NO: 6292 - DNA, 60 bp, Artificial Sequence
  Description of Artificial Sequence: Synthetic probe
tcgtcatctggaacattaaacatctgctccacaccgggatcggcaccgcctcgcgaccca

SEQ ID NO: 6293 - DNA, 60 bp, Artificial Sequence
  Description of Artificial Sequence: Synthetic probe
ctacacggaggcggaagtcgacgtgtacgtgagaatgaaaagggcggagctctactgccc

SEQ ID NO: 6294 - DNA, 60 bp, Artificial Sequence
  Description of Artificial Sequence: Synthetic probe
cgaccacggtggtaaggatcgctacaagaccgcgataaccaaacctgtcaaacaactgtg

SEQ ID NO: 6295 - DNA, 60 bp, Artificial Sequence
  Description of Artificial Sequence: Synthetic probe
ctgagttgctcgtgcgcatgaagcgtgctgaactctattgtcctaggccgattcttccga

SEQ ID NO: 6296 - DNA, 60 bp, Artificial Sequence
  Description of Artificial Sequence: Synthetic probe
caatcactgagttgctcgtacgcatgaagcgtgctgaactctattgtcctaggccgattc

SEQ ID NO: 6297 - DNA, 53 bp, Artificial Sequence
  Description of Artificial Sequence: Synthetic probe
cttctcgtgcgcatgaagcgggccgaactctactgccctaggccacttttggc

SEQ ID NO: 6298 - DNA, 59 bp, Artificial Sequence
  Description of Artificial Sequence: Synthetic probe
tgccccaggccacttctcccggcctacgaccacacaggtcgggataggttcgacgcccc

SEQ ID NO: 6299 - DNA, 60 bp, Artificial Sequence
  Description of Artificial Sequence: Synthetic probe
tgccccaggccacttctcccggcctacgaccacacaggtcgggataggttcgacgccccc

SEQ ID NO: 6300 - DNA, 60 bp, Artificial Sequence
  Description of Artificial Sequence: Synthetic probe
acgtgtactacaggatgaagcgtgctgagttgtactgccccaggccacttctcccggcct

SEQ ID NO: 6301 - DNA, 60 bp, Artificial Sequence
  Description of Artificial Sequence: Synthetic probe
ctgatgaagcggtcgacgtgtactacaggatgaagcgtgctgagttgtactgccccaggc

SEQ ID NO: 6302 - DNA, 60 bp, Artificial Sequence
  Description of Artificial Sequence: Synthetic probe
cacacgcttccctctaccttcaactttggtcacgttaccgctgatgaagcggtcgacgtg

SEQ ID NO: 6303 - DNA, 60 bp, Artificial Sequence
  Description of Artificial Sequence: Synthetic probe
caacacacaacacacgcttccctctaccttcaactttggtcacgttaccgctgatgaagc

SEQ ID NO: 6304 - DNA, 60 bp, Artificial Sequence
  Description of Artificial Sequence: Synthetic probe
cgtggcgaccgcgctgtgttggcggccaaatacgccaacacacaacacacgcttccctct

SEQ ID NO: 6305 - DNA, 60 bp, Artificial Sequence
  Description of Artificial Sequence: Synthetic probe
cgcgtcaccgccatccgtggcgaccgcgctgtgttggcggccaaatacgccaacacacaa

SEQ ID NO: 6306 - DNA, 60 bp, Artificial Sequence
  Description of Artificial Sequence: Synthetic probe
caacagtctacaacggtgagtgtaagtacactgagcgcgtcaccgccatccgtggcgacc

SEQ ID NO: 6307 - DNA, 60 bp, Artificial Sequence
  Description of Artificial Sequence: Synthetic probe
cacaccgtttgctgtcaacagtctacaacggtgagtgtaagtacactgagcgcgtcaccg

SEQ ID NO: 6308 - DNA, 60 bp, Artificial Sequence
  Description of Artificial Sequence: Synthetic probe
cggggtcacccgttttgccgtgccatacaccgcaccacaccgtttgctgtcaacagtcta

SEQ ID NO: 6309 - DNA, 60 bp, Artificial Sequence
  Description of Artificial Sequence: Synthetic probe
tgctccgagaaccacacagctcggagacaacccgatggttttctcgcacaacggggtcac

SEQ ID NO: 6310 - DNA, 60 bp, Artificial Sequence
  Description of Artificial Sequence: Synthetic probe
tggcaaccaaacggtgctccgagaaccacacagctcggagacaacccgatggttttctcg

SEQ ID NO: 6311 - DNA, 60 bp, Artificial Sequence
  Description of Artificial Sequence: Synthetic probe
tacgtcaggatgaagcgcgcggagctctactgcccgcgacctgttctcacgcactacgac

SEQ ID NO: 6312 - DNA, 54 bp, Artificial Sequence
  Description of Artificial Sequence: Synthetic probe
atgaacacgcctgactgttttatcgctttggtacaggctatcagagagatcaaa

SEQ ID NO: 6313 - DNA, 60 bp, Artificial Sequence
  Description of Artificial Sequence: Synthetic probe
gaagcgtgcagaactctattgccccaggccgattcttccgattcagccaacgggcgacag

SEQ ID NO: 6314 - DNA, 60 bp, Artificial Sequence
  Description of Artificial Sequence: Synthetic probe
gtccacgaccccttaaggtcaggtacacgcacaccaccgatcggtacaagactaagttag

SEQ ID NO: 6315 - DNA, 60 bp, Artificial Sequence
  Description of Artificial Sequence: Synthetic probe
tgtccacgaccccttaaggtcaggtacacgcacaccaccgatcggtacaagactaagtta

SEQ ID NO: 6316 - DNA, 50 bp, Artificial Sequence
  Description of Artificial Sequence: Synthetic probe
acctggcggtgctggcaagacgtgttgagactgaaatcacaagatgtaca

SEQ ID NO: 6317 - DNA, 60 bp, Artificial Sequence
  Description of Artificial Sequence: Synthetic probe
aaatactccaagacccaacacgttacagcgcgccgcggagacctggcggtgctggcaaga

SEQ ID NO: 6318 - DNA, 60 bp, Artificial Sequence
  Description of Artificial Sequence: Synthetic probe
tgggaactgcaaatactccaagacccaacacgttacagcgcgccgcggagacctggcggt

SEQ ID NO: 6319 - DNA, 60 bp, Artificial Sequence
  Description of Artificial Sequence: Synthetic probe
aacccagttgtccacgcgaagaacggtgttgcccgttttgctctgccctacacggcacct

SEQ ID NO: 6320 - DNA, 51 bp, Artificial Sequence
  Description of Artificial Sequence: Synthetic probe
cactgagctcttgatccgcatgaaacgcgcggagacatactgccccaggcc

SEQ ID NO: 6321 - DNA, 52 bp, Artificial Sequence
  Description of Artificial Sequence: Synthetic probe
tggcagcccaatggcgcaccacgcacaacgacgctgggagataatcccatgg

SEQ ID NO: 6322 - DNA, 60 bp, Artificial Sequence
  Description of Artificial Sequence: Synthetic probe
gggacctcgcgacactcgcggagaggatcgccagtgagacacacattccaaccactttca

SEQ ID NO: 6323 - DNA, 60 bp, Artificial Sequence
  Description of Artificial Sequence: Synthetic probe
ggggacctcgcaacccttgcggctaggatcgccagtgagacacacattccaaccactttc

SEQ ID NO: 6324 - DNA, 60 bp, Artificial Sequence
  Description of Artificial Sequence: Synthetic probe
gcggggacctcgcgacactcgcggagaggatcgccagtgagacacacattccaaccactt

SEQ ID NO: 6325 - DNA, 60 bp, Artificial Sequence
  Description of Artificial Sequence: Synthetic probe
tcgcggggacctcgcaacccttgcggctaggatcgccagtgagacacacattccaaccac

SEQ ID NO: 6326 - DNA, 60 bp, Artificial Sequence
  Description of Artificial Sequence: Synthetic probe
caccgcgccacaccgcgtgttggcaacagtgtacaacgggacgaacaagtactccgcggc

SEQ ID NO: 6327 - DNA, 60 bp, Artificial Sequence
  Description of Artificial Sequence: Synthetic probe
ggctgaaaccatccacgagcttctcgtgcgcatgaaaagagcggagctgtactgccccag

SEQ ID NO: 6328 - DNA, 60 bp, Artificial Sequence
  Description of Artificial Sequence: Synthetic probe
gcactctttcgcacacaaaacacaggcaagatggaattcacactctacaacggtgagaaa

SEQ ID NO: 6329 - DNA, 60 bp, Artificial Sequence
  Description of Artificial Sequence: Synthetic probe
atccacgagctcctcgtgcgcatgaagcgtgccgaactctactgccccagaccgctgttg

SEQ ID NO: 6330 - DNA, 60 bp, Artificial Sequence
  Description of Artificial Sequence: Synthetic probe
cactgcttcggtctgcgacgtactacttctcagacctggaggttgcgcttgttcacacag

SEQ ID NO: 6331 - DNA, 60 bp, Artificial Sequence
  Description of Artificial Sequence: Synthetic probe
tgacaccatcacggagctgttgatccgcatgaagcgtgcggagacatactgccccaggcc

SEQ ID NO: 6332 - DNA, 60 bp, Artificial Sequence
  Description of Artificial Sequence: Synthetic probe
gtatcatcaacaactactacatgcagcagtaccagaactccatggacacacaacttggcg

SEQ ID NO: 6333 - DNA, 60 bp, Artificial Sequence
  Description of Artificial Sequence: Synthetic probe
cgctttcaagcgcctgaaggaaaactttgagattgttgccctttgtctgactctactggc

SEQ ID NO: 6334 - DNA, 51 bp, Artificial Sequence
  Description of Artificial Sequence: Synthetic probe
caagaacccttggacgtggagtggcaggaccgtgctggcctcttccttcgt

SEQ ID NO: 6335 - DNA, 60 bp, Artificial Sequence
  Description of Artificial Sequence: Synthetic probe
accctgaaaacgtgctcgtgtacgtaccctacgaccaagaacccttggacgtggagtggc

SEQ ID NO: 6336 - DNA, 60 bp, Artificial Sequence
  Description of Artificial Sequence: Synthetic probe
acccatggactcctgaccctgaaaacgtgctcgtgtacgtaccctacgaccaagaaccct

SEQ ID NO: 6337 - DNA, 60 bp, Artificial Sequence
  Description of Artificial Sequence: Synthetic probe
cccagcgagatttgtgtcatcaacggggtcgccatgactcttgctgacttccacgccgga

SEQ ID NO: 6338 - DNA, 60 bp, Artificial Sequence
  Description of Artificial Sequence: Synthetic probe
ctttggttgataaaggactgtttgcaaaccggtgtcggcactagcactcgccccagcgag

SEQ ID NO: 6339 - DNA, 60 bp, Artificial Sequence
  Description of Artificial Sequence: Synthetic probe
cccgccctggtgctttggttgataaaggactgtttgcaaaccggtgtcggcactagcact

SEQ ID NO: 6340 - DNA, 53 bp, Artificial Sequence
  Description of Artificial Sequence: Synthetic probe
cgttgttcgagtctgagtatttgtcgcctgagaacaagacacaggacatgata

SEQ ID NO: 6341 - DNA, 60 bp, Artificial Sequence
  Description of Artificial Sequence: Synthetic probe
tttctacagcaggcccaacacgaaaggcaactgttggctcaactcgctacttcagctctt

SEQ ID NO: 6342 - DNA, 60 bp, Artificial Sequence
  Description of Artificial Sequence: Synthetic probe
gaagctccgcctggtctttccaggtctagaggggcgacactttgtactgtgcttgactcc

SEQ ID NO: 6343 - DNA, 60 bp, Artificial Sequence
  Description of Artificial Sequence: Synthetic probe
acatctacggtgatggggccgtttcgcgtgggctggtcgtttggactgcttcggctgtca

SEQ ID NO: 6344 - DNA, 60 bp, Artificial Sequence
  Description of Artificial Sequence: Synthetic probe
gtgacatctacggtgatggggccgtttcgcgtgggctggtcgtttggactgcttcggctg

SEQ ID NO: 6345 - DNA, 59 bp, Artificial Sequence
  Description of Artificial Sequence: Synthetic probe
ggggccgttcgacgctccacgggaactctcctgtgtgacatctacggtgatggggccgt

SEQ ID NO: 6346 - DNA, 60 bp, Artificial Sequence
  Description of Artificial Sequence: Synthetic probe
gtactcttaccactctccgcctacttggtcgttagcgctgtcttgggcattcctgtgggg

SEQ ID NO: 6347 - DNA, 60 bp, Artificial Sequence
  Description of Artificial Sequence: Synthetic probe
gaccggttagtactcttaccactctccgcctacttggtcgttagcgctgtcttgggcatt

SEQ ID NO: 6348 - DNA, 60 bp, Artificial Sequence
  Description of Artificial Sequence: Synthetic probe
ggattgtgcggacgaacacgcttgcgcacctcgcgtgaccggttagtactcttaccactc

SEQ ID NO: 6349 - DNA, 60 bp, Artificial Sequence
  Description of Artificial Sequence: Synthetic probe
gtggccatttagctggattgtgcggacgaacacgcttgcgcacctcgcgtgaccggttag

SEQ ID NO: 6350 - DNA, 60 bp, Artificial Sequence
  Description of Artificial Sequence: Synthetic probe
gtccctgcgttgcactccacacttacgttgtacacacgcgggacccgatgggctatcgtt

SEQ ID NO: 6351 - DNA, 60 bp, Artificial Sequence
  Description of Artificial Sequence: Synthetic probe
agtccctgcgttgcactccacacttacgttgtacacacgcgggacccgatgggctatcgt

SEQ ID NO: 6352 - DNA, 60 bp, Artificial Sequence
  Description of Artificial Sequence: Synthetic probe
ggggcattagggtctcacccctagtaagccaacgacagtccctgcgttgcactccacact

SEQ ID NO: 6353 - DNA, 60 bp, Artificial Sequence
  Description of Artificial Sequence: Synthetic probe
caagctcttgaaagggggcattagggtctcacccctagtaagccaacgacagtccctgcg

SEQ ID NO: 6354 - DNA, 60 bp, Artificial Sequence
  Description of Artificial Sequence: Synthetic probe
caccgcaccacaccgcgtgctggctacggtgtacaacgggacaagcaagtactctgtgac

SEQ ID NO: 6355 - DNA, 60 bp, Artificial Sequence
  Description of Artificial Sequence: Synthetic probe
caccgcaccacaccgcgtgctggctacggtgtacaacgggacaaataagtactctgtaac

SEQ ID NO: 6356 - DNA, 60 bp, Artificial Sequence
  Description of Artificial Sequence: Synthetic probe
cttgcactgccttacaccgcaccacaccgcgtgctggctacggtgtacaacgggacaaat

SEQ ID NO: 6357 - DNA, 60 bp, Artificial Sequence
  Description of Artificial Sequence: Synthetic probe
acttgcactgccttacaccgcaccacaccgcgtgctggctacggtgtacaacgggacaag

SEQ ID NO: 6358 - DNA, 60 bp, Artificial Sequence
  Description of Artificial Sequence: Synthetic probe
tcacgagacttgcgctgccttacaccgcaccacaccgcgtgctggctacggtgtacaacg

SEQ ID NO: 6359 - DNA, 53 bp, Artificial Sequence
  Description of Artificial Sequence: Synthetic probe
tcacgagacttgcgctgccttacaccgcaccacaccgcgtgctggctacggtg

SEQ ID NO: 6360 - DNA, 60 bp, Artificial Sequence
  Description of Artificial Sequence: Synthetic probe
agtgtttggcactgcctacctcgtgcctcgtcatcttttcgcagagaagtatgacaagat

SEQ ID NO: 6361 - DNA, 57 bp, Artificial Sequence
  Description of Artificial Sequence: Synthetic probe
agtgtttggcactgcctacctcgtgcctcgtcatcttttcgcagagaagtatgacaa

SEQ ID NO: 6362 - DNA, 60 bp, Artificial Sequence
  Description of Artificial Sequence: Synthetic probe
gcctgcatacgaccacgctggtagagacaggtttgacgcgcccataggcgtcgaaagaca

SEQ ID NO: 6363 - DNA, 60 bp, Artificial Sequence
  Description of Artificial Sequence: Synthetic probe
cctctgctgcctgcatacgaccacgctggtagagacaggtttgacgcgcccataggcgtc

SEQ ID NO: 6364 - DNA, 60 bp, Artificial Sequence
  Description of Artificial Sequence: Synthetic probe
accggatgaaaagaactgagttgtactgtcctcgccctctgctgcctgcatacgaccacg

SEQ ID NO: 6365 - DNA, 60 bp, Artificial Sequence
  Description of Artificial Sequence: Synthetic probe
cggtcgacgtgtactaccggatgaaaagaactgagttgtactgtcctcgccctctgctgc

SEQ ID NO: 6366 - DNA, 60 bp, Artificial Sequence
  Description of Artificial Sequence: Synthetic probe
caactttcaacttcgggttcgtgaccgccgacgcaccggtcgacgtgtactaccggatga

SEQ ID NO: 6367 - DNA, 60 bp, Artificial Sequence
  Description of Artificial Sequence: Synthetic probe
acacacactgccgtcaactttcaacttcgggttcgtgaccgccgacgcaccggtcgacgt

SEQ ID NO: 6368 - DNA, 60 bp, Artificial Sequence
  Description of Artificial Sequence: Synthetic probe
cgcggtgaccgtgcagtgcttgcggctaaatatgccagcaccaaacacacactgccgtca

SEQ ID NO: 6369 - DNA, 60 bp, Artificial Sequence
  Description of Artificial Sequence: Synthetic probe
gcgatccgcggtgaccgtgcagtgcttgcggctaaatatgccagcaccaaacacacactg

SEQ ID NO: 6370 - DNA, 60 bp, Artificial Sequence
  Description of Artificial Sequence: Synthetic probe
tcttgtccactgtttacaatggtgagtgcagctacaaaaaggagaccaccgcgatccgcg

SEQ ID NO: 6371 - DNA, 60 bp, Artificial Sequence
  Description of Artificial Sequence: Synthetic probe
cccgcttcgccatcccgttcacggctccgcacagactcttgtccactgtttacaatggtg

SEQ ID NO: 6372 - DNA, 60 bp, Artificial Sequence
  Description of Artificial Sequence: Synthetic probe
caaaaacggtgtcacccgcttcgccatcccgttcacggctccgcacagactcttgtccac

SEQ ID NO: 6373 - DNA, 60 bp, Artificial Sequence
  Description of Artificial Sequence: Synthetic probe
gcactcgtgggagcaatcctgagagcttcaacctactacttctgtgaccttgagattgcg

SEQ ID NO: 6374 - DNA, 60 bp, Artificial Sequence
  Description of Artificial Sequence: Synthetic probe
aaggaaaaagcactcgtgggagcaatcctgagagcttcaacctactacttctgtgacctt

SEQ ID NO: 6375 - DNA, 60 bp, Artificial Sequence
  Description of Artificial Sequence: Synthetic probe
ctgctggcggtggaggtgtcgtcacaggacaggcacaagcaaaagatcattgcacctgca

SEQ ID NO: 6376 - DNA, 58 bp, Artificial Sequence
  Description of Artificial Sequence: Synthetic probe
actgcctaccacaaggaaccgtttacgagactcgcgcttccttacaccgcgccgcacc

SEQ ID NO: 6377 - DNA, 60 bp, Artificial Sequence
  Description of Artificial Sequence: Synthetic probe
aaaatcaacccagtgactcccattcatgtcattgacctcatgcagacacaccagcacgcg

SEQ ID NO: 6378 - DNA, 60 bp, Artificial Sequence
  Description of Artificial Sequence: Synthetic probe
tgtctgacctccgacggttggtacgccattgacgacgaggacttttacccgtggacacca

SEQ ID NO: 6379 - DNA, 60 bp, Artificial Sequence
  Description of Artificial Sequence: Synthetic probe
cgcgactggagtgtttgggaccgcctacctcgtgcctcgtcaccttttcgctgagaagta

SEQ ID NO: 6380 - DNA, 60 bp, Artificial Sequence
  Description of Artificial Sequence: Synthetic probe
gccgcacagctccctgcgtctttcaactacggtgcactcaaggccacgaccatccacgag

SEQ ID NO: 6381 - DNA, 60 bp, Artificial Sequence
  Description of Artificial Sequence: Synthetic probe
acaccgcgtgctggcaacggtgtacaacgggacgaccaagtacgccacagaatcctcagg

SEQ ID NO: 6382 - DNA, 60 bp, Artificial Sequence
  Description of Artificial Sequence: Synthetic probe
gcaatctgacttgggtacccaacggtgcccccgagagtgctctcctgaacacgagcaacc

SEQ ID NO: 6383 - DNA, 60 bp, Artificial Sequence
  Description of Artificial Sequence: Synthetic probe
tgcagcaacctactacttctctgacttagagattgtggtgaggcacgagggcaatctgac

SEQ ID NO: 6384 - DNA, 60 bp, Artificial Sequence
  Description of Artificial Sequence: Synthetic probe
gcagactcaccaacacgggctggtgggtgcgatgctacgtgcagcaacctactacttctc

SEQ ID NO: 6385 - DNA, 60 bp, Artificial Sequence
  Description of Artificial Sequence: Synthetic probe
ttgtgaaagtgaacaatcccaaccccacacacgtcattgacctcatgcagactcaccaac

SEQ ID NO: 6386 - DNA, 60 bp, Artificial Sequence
  Description of Artificial Sequence: Synthetic probe
ctacggtggtgagacacaggtccaaagacgacaccacacgagcgtcggcttcattttgga

SEQ ID NO: 6387 - DNA, 60 bp, Artificial Sequence
  Description of Artificial Sequence: Synthetic probe
accactgctgcgggggaatctgcagacccggttaccaccactgttgaaaactacggtggt

SEQ ID NO: 6388 - DNA, 60 bp, Artificial Sequence
  Description of Artificial Sequence: Synthetic probe
acaactacctttaactatggcaggatttacacacaagctgaggttgacgtgtacgtcagg

SEQ ID NO: 6389 - DNA, 60 bp, Artificial Sequence
  Description of Artificial Sequence: Synthetic probe
tgagaactacggcggtgagacacaagtccagcggcgtcaccacactgacgtcagcttcat

SEQ ID NO: 6390 - DNA, 51 bp, Artificial Sequence
  Description of Artificial Sequence: Synthetic probe
gggtgactgaactgctttaccgcatgaagagggctgagacgtactgccccc

SEQ ID NO: 6391 - DNA, 50 bp, Artificial Sequence
  Description of Artificial Sequence: Synthetic probe
gggtgactgaactgctttaccgcatgaagagggctgagacgtactgcccc

SEQ ID NO: 6392 - DNA, 51 bp, Artificial Sequence
  Description of Artificial Sequence: Synthetic probe
gggtgactgaactgctttaccgcatgaagagggctgaaacgtactgccccc

SEQ ID NO: 6393 - DNA, 50 bp, Artificial Sequence
  Description of Artificial Sequence: Synthetic probe
gggtgactgaactgctttaccgcatgaagagggctgaaacgtactgcccc

SEQ ID NO: 6394 - DNA, 50 bp, Artificial Sequence
  Description of Artificial Sequence: Synthetic probe
tcggttgggttcctaacggtgcccctgtgcctaaggaagtgggcgacaac

SEQ ID NO: 6395 - DNA, 60 bp, Artificial Sequence
  Description of Artificial Sequence: Synthetic probe
gcgagagtcgctgcacaacttccttcatccttcaactacggagcactgcgcgctgagacc

SEQ ID NO: 6396 - DNA, 60 bp, Artificial Sequence
  Description of Artificial Sequence: Synthetic probe
atagacctcatgcaaactcaccaacacgggctggtgggtgcgctgttgcgttcagccacc

SEQ ID NO: 6397 - DNA, 60 bp, Artificial Sequence
  Description of Artificial Sequence: Synthetic probe
cttctctgacctagaaattgtggtgcgacacacaggcaacctgacatgggtgcccaacgg

SEQ ID NO: 6398 - DNA, 60 bp, Artificial Sequence
  Description of Artificial Sequence: Synthetic probe
cttctctgacttagagattgtggtgcgacacacaggcaacctgacatgggtgcccaacgg

SEQ ID NO: 6399 - DNA, 60 bp, Artificial Sequence
  Description of Artificial Sequence: Synthetic probe
cttctctgacctagagattgtggtgcgacacacaggcaacctgacatgggtgcccaacgg

SEQ ID NO: 6400 - DNA, 60 bp, Artificial Sequence
  Description of Artificial Sequence: Synthetic probe
gcaacggcgtgggctactgctcgtgcgtctcaaaatcgatgctcgatcagatgaaagccc

SEQ ID NO: 6401 - DNA, 60 bp, Artificial Sequence
  Description of Artificial Sequence: Synthetic probe
tcactctgcaggaggcaacggcgtgggctactgctcgtgcgtctcaaaatcgatgctcga

SEQ ID NO: 6402 - DNA, 60 bp, Artificial Sequence
  Description of Artificial Sequence: Synthetic probe
tcattggcactcactctgcgggtggcaacggcgtgggctactgctcgtgcgtctcaaaat

SEQ ID NO: 6403 - DNA, 60 bp, Artificial Sequence
  Description of Artificial Sequence: Synthetic probe
ggtgaaagtaaagggacaggacatgctctcagacgctgctctcatggttctgaaccgtgg

SEQ ID NO: 6404 - DNA, 57 bp, Artificial Sequence
  Description of Artificial Sequence: Synthetic probe
cacccgagcgaagctagacacaaacaaaagattgtggcacctgtgaaacagcttttg

SEQ ID NO: 6405 - DNA, 60 bp, Artificial Sequence
  Description of Artificial Sequence: Synthetic probe
gggcatccacctactacttctgtgacctggaaattgcctgtgtgggagaacacactcggg

SEQ ID NO: 6406 - DNA, 60 bp, Artificial Sequence
  Description of Artificial Sequence: Synthetic probe
cgcgtgttttggcagcccaacggtgcgcctaggaccacccaactcggggacaacccgatg

SEQ ID NO: 6407 - DNA, 60 bp, Artificial Sequence
  Description of Artificial Sequence: Synthetic probe
cgcgtgttttggcagcccaacggtgcgcctaggaccacccaacttggggacaacccgatg

SEQ ID NO: 6408 - DNA, 60 bp, Artificial Sequence
  Description of Artificial Sequence: Synthetic probe
cgcgtgttttggcagcccaacggtgcgcctaggactacccaacttggggacaacccaatg

SEQ ID NO: 6409 - DNA, 60 bp, Artificial Sequence
  Description of Artificial Sequence: Synthetic probe
aagatcaacagtctcagtcccacacatgtcatagacctcatgcagacccaccagcacggg

SEQ ID NO: 6410 - DNA, 60 bp, Artificial Sequence
  Description of Artificial Sequence: Synthetic probe
cgaccacgctggcaagaacaggtacaagaccaaactggtagcaccagccaaacagctctg

SEQ ID NO: 6411 - DNA, 60 bp, Artificial Sequence
  Description of Artificial Sequence: Synthetic probe
acgcactacgaccacgctggcaagaacaggtacaagaccaaactggtagcaccagccaaa

SEQ ID NO: 6412 - DNA, 60 bp, Artificial Sequence
  Description of Artificial Sequence: Synthetic probe
agcgggctgagacttactgtcccaggccactactgacgcactacgaccacgctggcaaga

SEQ ID NO: 6413 - DNA, 60 bp, Artificial Sequence
  Description of Artificial Sequence: Synthetic probe
tgtacgtgcggatgaagcgggctgagacttactgtcccaggccactactgacgcactacg

SEQ ID NO: 6414 - DNA, 52 bp, Artificial Sequence
  Description of Artificial Sequence: Synthetic probe
aagtaccaagaccagagcacaacaccgctcacccacgtccgtggggacttgg

SEQ ID NO: 6415 - DNA, 60 bp, Artificial Sequence
  Description of Artificial Sequence: Synthetic probe
gccgcacagagtcgtggcgacatcgtacaacggcaactgcaagtaccaagaccagagcac

SEQ ID NO: 6416 - DNA, 60 bp, Artificial Sequence
  Description of Artificial Sequence: Synthetic probe
gccgcacagagtcgtgggcacatcgtacaacggcaactgcaagtaccaagaccagagcac

SEQ ID NO: 6417 - DNA, 60 bp, Artificial Sequence
  Description of Artificial Sequence: Synthetic probe
cggcgctgtaaaggctgaaaacatcactgagctcttgatccgcatgaaacgcgcggagac

SEQ ID NO: 6418 - DNA, 60 bp, Artificial Sequence
  Description of Artificial Sequence: Synthetic probe
gtgccgaactctactgccctagaccactgttggcagaggaggtgtcgtcgcaagacagac

SEQ ID NO: 6419 - DNA, 60 bp, Artificial Sequence
  Description of Artificial Sequence: Synthetic probe
atgaagcgtgccgaactctactgccctagaccactgttggcagaggaggtgtcgtcgcac

SEQ ID NO: 6420 - DNA, 60 bp, Artificial Sequence
  Description of Artificial Sequence: Synthetic probe
ctgactgttttgacgttttgctcgagatcttccacaggttcagacagacgttcaagacag

SEQ ID NO: 6421 - DNA, 60 bp, Artificial Sequence
  Description of Artificial Sequence: Synthetic probe
actgactgttttgacgttttgctcgagatcttccacaggtttagacaaacaatcaagaca

SEQ ID NO: 6422 - DNA, 60 bp, Artificial Sequence
  Description of Artificial Sequence: Synthetic probe
atgaagacaactgactgttttgacgttttgctcgagatcttccacaggttcagacagacg

SEQ ID NO: 6423 - DNA, 60 bp, Artificial Sequence
  Description of Artificial Sequence: Synthetic probe
atgaagacaactgactgttttgacgttttgctcgagatcttccacaggtttagacaaaca

SEQ ID NO: 6424 - DNA, 60 bp, Artificial Sequence
  Description of Artificial Sequence: Synthetic probe
gttgctagctcttgacaccactcaggaccgccgtaaacaggagatcattgcacctgagaa

SEQ ID NO: 6425 - DNA, 60 bp, Artificial Sequence
  Description of Artificial Sequence: Synthetic probe
attcttgatctcatgcagatcccctcacacacgctggttggagccttactccggtccgcg

SEQ ID NO: 6426 - DNA, 60 bp, Artificial Sequence
  Description of Artificial Sequence: Synthetic probe
agaacacccagattcttgatctcatgcagatcccctcacacacgctggttggagcgttac

SEQ ID NO: 6427 - DNA, 60 bp, Artificial Sequence
  Description of Artificial Sequence: Synthetic probe
acgagcttctcgtgcgcatgaaacgtgctgaactctactgccccaggccactgctggcgg

SEQ ID NO: 6428 - DNA, 60 bp, Artificial Sequence
  Description of Artificial Sequence: Synthetic probe
gaactctactgtccgcgtcccattctgacacactacaaccacggtggtaaggatcgctac

SEQ ID NO: 6429 - DNA, 60 bp, Artificial Sequence
  Description of Artificial Sequence: Synthetic probe
cgtcttttctcacaacggcaccacccgctttgcactgccctacactgcgccacacagatg

SEQ ID NO: 6430 - DNA, 60 bp, Artificial Sequence
  Description of Artificial Sequence: Synthetic probe
ctaggttcgctgtgccatacactgcacctcaccgcctgctctcaactgtttacaacggtg

SEQ ID NO: 6431 - DNA, 60 bp, Artificial Sequence
  Description of Artificial Sequence: Synthetic probe
gtcactaggttcgctgtgccatacactgcacctcaccgcctgctctcaactgtttacaac

SEQ ID NO: 6432 - DNA, 60 bp, Artificial Sequence
  Description of Artificial Sequence: Synthetic probe
cctaacggcgcgcctagaaccacagagctcggggacaacccaatggttttctcgagcaac

SEQ ID NO: 6433 - DNA, 60 bp, Artificial Sequence
  Description of Artificial Sequence: Synthetic probe
tgcttgccacagtgtacaacggtgactgcaagtacaaacccactggcaccgcgccccgcg

SEQ ID NO: 6434 - DNA, 60 bp, Artificial Sequence
  Description of Artificial Sequence: Synthetic probe
tcaccgggtgctcgccacagtctacaacggtgactgcaagtacaaacccactggcaccga

SEQ ID NO: 6435 - DNA, 60 bp, Artificial Sequence
  Description of Artificial Sequence: Synthetic probe
accccaccggctgcttgccacagtgtacaacggtgactgcaagtacaaacccactggcac

SEQ ID NO: 6436 - DNA, 60 bp, Artificial Sequence
  Description of Artificial Sequence: Synthetic probe
ctactggcagtagaagtgtcttcgtcagacaggcacaaacagaagatcattgcacccgca

SEQ ID NO: 6437 - DNA, 60 bp, Artificial Sequence
  Description of Artificial Sequence: Synthetic probe
gccgcccaactccccgcatctttcaactatggtgcaattaaggccgagaccatccacgaa

SEQ ID NO: 6438 - DNA, 60 bp, Artificial Sequence
  Description of Artificial Sequence: Synthetic probe
accgcgtgctggcaacggtgtataacgggacgagcaagtactctgtgggcacctcaccca

SEQ ID NO: 6439 - DNA, 60 bp, Artificial Sequence
  Description of Artificial Sequence: Synthetic probe
acaaggccccgttcacgagactcgcacttccttacactgcgccgcaccgcgtgctggcaa

SEQ ID NO: 6440 - DNA, 60 bp, Artificial Sequence
  Description of Artificial Sequence: Synthetic probe
ttgtgaagataaacagcctcagccccacacacgtcatagacctcatgcagacccaccaac

SEQ ID NO: 6441 - DNA, 60 bp, Artificial Sequence
  Description of Artificial Sequence: Synthetic probe
ctacggcggtgacacacaagtcccgagacggcaacacacagatgtcgacttcatcatgga

SEQ ID NO: 6442 - DNA, 60 bp, Artificial Sequence
  Description of Artificial Sequence: Synthetic probe
ctaggtttgccgtaccctacactgcgccacaccggttgcttgcgaccaggtacaacggtg

SEQ ID NO: 6443 - DNA, 60 bp, Artificial Sequence
  Description of Artificial Sequence: Synthetic probe
ggatgaagcgtgctgaactttactgccccaggccacttctcccggcttacgaccacgttg

SEQ ID NO: 6444 - DNA, 60 bp, Artificial Sequence
  Description of Artificial Sequence: Synthetic probe
ctgctggcagtagaggtgtctgcgcaagacagacacaaacaaaagatcattgcacctgca

SEQ ID NO: 6445 - DNA, 60 bp, Artificial Sequence
  Description of Artificial Sequence: Synthetic probe
cactgctggcagtagaggtgtctgcgcaagacagacacaaacaaaagatcattgcacctg

SEQ ID NO: 6446 - DNA, 60 bp, Artificial Sequence
  Description of Artificial Sequence: Synthetic probe
gggcatcaacctactacttctgtgatctggagattgcttgcgttggcacacacaaacgtg

SEQ ID NO: 6447 - DNA, 60 bp, Artificial Sequence
  Description of Artificial Sequence: Synthetic probe
tctcagggcatcaacctactacttctgtgatctggagattgcttgcgttggcacacacaa

SEQ ID NO: 6448 - DNA, 58 bp, Artificial Sequence
  Description of Artificial Sequence: Synthetic probe
gccccaggccactcttgccagcgtacgaccaccaatcgcgccacagggttgatgcccc

SEQ ID NO: 6449 - DNA, 60 bp, Artificial Sequence
  Description of Artificial Sequence: Synthetic probe
gccccaggccactcttgccagcgtacgaccaccaatcgcgccacagggttgatgccccca

SEQ ID NO: 6450 - DNA, 60 bp, Artificial Sequence
  Description of Artificial Sequence: Synthetic probe
gccccaggccactcttgccagcgtacgaccaccagtcgcgcgacaggtttgatgcgccca

SEQ ID NO: 6451 - DNA, 60 bp, Artificial Sequence
  Description of Artificial Sequence: Synthetic probe
tgaaaaggagcgaactctactgccccaggccactcttgccagcgtacgaccaccaatcgc

SEQ ID NO: 6452 - DNA, 60 bp, Artificial Sequence
  Description of Artificial Sequence: Synthetic probe
tgtttgagtttgaggtgaaagtaaagggacaggacatgctctcggacgctgcactcatgg

SEQ ID NO: 6453 - DNA, 60 bp, Artificial Sequence
  Description of Artificial Sequence: Synthetic probe
tgtttgagtttgaggtgaaagtaaagggacaggacatgctctcagacgctgctctcatgg

SEQ ID NO: 6454 - DNA, 52 bp, Artificial Sequence
  Description of Artificial Sequence: Synthetic probe
cacccaggaccgccgtaaacaggagatcattgcacctgagaaacaggtactg

SEQ ID NO: 6455 - DNA, 51 bp, Artificial Sequence
  Description of Artificial Sequence: Synthetic probe
acgggtgacaggcacaagcaaccgcttatcgcgcctgcaaaacagctacta

SEQ ID NO: 6456 - DNA, 60 bp, Artificial Sequence
  Description of Artificial Sequence: Synthetic probe
agctttactgccctaggcccatcctgcctttccagcctacgggtgacaggcacaagcaac

SEQ ID NO: 6457 - DNA, 60 bp, Artificial Sequence
  Description of Artificial Sequence: Synthetic probe
tgaaacgcgcggagctttactgccctaggcccatcctgcctttccagcctacgggtgaca

SEQ ID NO: 6458 - DNA, 50 bp, Artificial Sequence
  Description of Artificial Sequence: Synthetic probe
ctgacgttgccttcgttcttgaccggtttgtgaaggtccatgtgtcggac

SEQ ID NO: 6459 - DNA, 60 bp, Artificial Sequence
  Description of Artificial Sequence: Synthetic probe
acatccgtggagacctcgcagctcttgcagcgaggatcgcaagtgagacacacattccaa

SEQ ID NO: 6460 - DNA, 60 bp, Artificial Sequence
  Description of Artificial Sequence: Synthetic probe
gcaagtacaaacccactggcacagccccacgtgaaaacatccgtggagacctcgcagctc

SEQ ID NO: 6461 - DNA, 60 bp, Artificial Sequence
  Description of Artificial Sequence: Synthetic probe
ctacaacggtgattgcaagtacaaacccactggcacagccccacgtgaaaacatccgtgg

SEQ ID NO: 6462 - DNA, 60 bp, Artificial Sequence
  Description of Artificial Sequence: Synthetic probe
gagctcctcgtgcgcatgaagcgtgctgagctctactgccccaggccactgctggcagta

SEQ ID NO: 6463 - DNA, 60 bp, Artificial Sequence
  Description of Artificial Sequence: Synthetic probe
actacgacctacaccgccagtacacgcggggatttggctcacctaacggcgacgcatgct

SEQ ID NO: 6464 - DNA, 60 bp, Artificial Sequence
  Description of Artificial Sequence: Synthetic probe
tgacaccattactgagcttttgatccgcatgaaacgcgcggagacatactgccctaggcc

SEQ ID NO: 6465 - DNA, 60 bp, Artificial Sequence
  Description of Artificial Sequence: Synthetic probe
atacgggctatgcacatccacgagcttctcgtgcgcatgaagcgtgccgagctctactgc

SEQ ID NO: 6466 - DNA, 60 bp, Artificial Sequence
  Description of Artificial Sequence: Synthetic probe
caacggtgattgcaagtacaaggcccagcccgtggagaacagagagatccgcggtgacct

SEQ ID NO: 6467 - DNA, 60 bp, Artificial Sequence
  Description of Artificial Sequence: Synthetic probe
cctacaacggtgattgcaagtacaaggcccagcccgtggagaacagagagatccgcggtg

SEQ ID NO: 6468 - DNA, 60 bp, Artificial Sequence
  Description of Artificial Sequence: Synthetic probe
cctacaacggagattgcaagtacaaggcccagcccgtggagaacagagagatccgcggtg

SEQ ID NO: 6469 - DNA, 60 bp, Artificial Sequence
  Description of Artificial Sequence: Synthetic probe
tggcaacaacctacaacggagattgcaagtacaaggcccagcccgtggagaacagagaga

SEQ ID NO: 6470 - DNA, 60 bp, Artificial Sequence
  Description of Artificial Sequence: Synthetic probe
gttggcaacaacctacaacggtgattgcaagtacaaggcccagcccgtggagaacagaga

SEQ ID NO: 6471 - DNA, 60 bp, Artificial Sequence
  Description of Artificial Sequence: Synthetic probe
cgacagcatcaaggaagagcttaagcccttgttggagcaaaccagcttcgccaaacgtgc

SEQ ID NO: 6472 - DNA, 60 bp, Artificial Sequence
  Description of Artificial Sequence: Synthetic probe
atggtgcacgacagcattaaagaggagcttaagcccttgttggagcaaaccagcttcgcc

SEQ ID NO: 6473 - DNA, 60 bp, Artificial Sequence
  Description of Artificial Sequence: Synthetic probe
tgcagccacgtactacttctccgacttggagattgttgtgcggcacgatggtaatctgac

SEQ ID NO: 6474 - DNA, 60 bp, Artificial Sequence
  Description of Artificial Sequence: Synthetic probe
cgacgaacccttcttcgactgggtctatgagtcgcctgaaaacctcacttttgaggcaat

SEQ ID NO: 6475 - DNA, 60 bp, Artificial Sequence
  Description of Artificial Sequence: Synthetic probe
tggttgaacaccatccttcagttgtttaggtacgtcgacgaacccttcttcgactgggtc

SEQ ID NO: 6476 - DNA, 60 bp, Artificial Sequence
  Description of Artificial Sequence: Synthetic probe
cactgtttctttcacgaacacgagggaagatggaattcacacttcacaacggtgagaaaa

SEQ ID NO: 6477 - DNA, 60 bp, Artificial Sequence
  Description of Artificial Sequence: Synthetic probe
taaaacactgtttctttcacgaacacgagggaagatggaattcacacttcacaacggtga

SEQ ID NO: 6478 - DNA, 58 bp, Artificial Sequence
  Description of Artificial Sequence: Synthetic probe
ttttatcgctctgttacacgctctcagagagattaaaacactgtttctttcacgaaca

SEQ ID NO: 6479 - DNA, 60 bp, Artificial Sequence
  Description of Artificial Sequence: Synthetic probe
gagcttcttgtgcgcatgaagcgtgctgagctctactgccccaggccactactggcagtg

SEQ ID NO: 6480 - DNA, 60 bp, Artificial Sequence
  Description of Artificial Sequence: Synthetic probe
ccctaggcccgtctctttccatcaacccacgggcgataggtacaagcagccgatcattgc

SEQ ID NO: 6481 - DNA, 60 bp, Artificial Sequence
  Description of Artificial Sequence: Synthetic probe
gcggagctttattgccctaggcccgtctctttccatcaacccacgggcgataggtacaag

SEQ ID NO: 6482 - DNA, 60 bp, Artificial Sequence
  Description of Artificial Sequence: Synthetic probe
agaccatcactgaactgttggtgcgtatgaaacgtgcggagctttattgccctaggcccg

SEQ ID NO: 6483 - DNA, 60 bp, Artificial Sequence
  Description of Artificial Sequence: Synthetic probe
gtgccatcaaagcagagaccatcactgaactgttggtgcgtatgaaacgtgcggagcttt

SEQ ID NO: 6484 - DNA, 60 bp, Artificial Sequence
  Description of Artificial Sequence: Synthetic probe
tcatttggcagcggcacacaagcggcgactacccacgtcgttcaactttggtgccatcaa

SEQ ID NO: 6485 - DNA, 60 bp, Artificial Sequence
  Description of Artificial Sequence: Synthetic probe
acttacaccactaccacacgtagaggggacatggctcatttggcagcggcacacaagcgg

SEQ ID NO: 6486 - DNA, 60 bp, Artificial Sequence
  Description of Artificial Sequence: Synthetic probe
tatactggtacaacaacttacaccactaccacacgtagaggggacatggctcatttggca

SEQ ID NO: 6487 - DNA, 60 bp, Artificial Sequence
  Description of Artificial Sequence: Synthetic probe
cacaggcccagcgacgtcaccacactgacgtcagcttcataatggacagattcgtgaagg

SEQ ID NO: 6488 - DNA, 60 bp, Artificial Sequence
  Description of Artificial Sequence: Synthetic probe
cactgagctcctgatccgcatgaaacgcgcggagacatactgccccaggcctctgttggc

SEQ ID NO: 6489 - DNA, 60 bp, Artificial Sequence
  Description of Artificial Sequence: Synthetic probe
gccccagaccgctgttggcagtggaggtgtcgtctcaagacagacacaaacagaagatca

SEQ ID NO: 6490 - DNA, 60 bp, Artificial Sequence
  Description of Artificial Sequence: Synthetic probe
ctgcctccttcaactttggtgcagttcgagccacgaccatccacgagcttctcgtgcgca

SEQ ID NO: 6491 - DNA, 60 bp, Artificial Sequence
  Description of Artificial Sequence: Synthetic probe
ggcaacactggaagtattatcaacaactactacatgcaacagtaccaaaactccatggac

SEQ ID NO: 6492 - DNA, 60 bp, Artificial Sequence
  Description of Artificial Sequence: Synthetic probe
accgcctacaacaaagcgccgttcacgagacttgccctcccctacactgcgccacaccgc

SEQ ID NO: 6493 - DNA, 60 bp, Artificial Sequence
  Description of Artificial Sequence: Synthetic probe
ccaccgcctacaacaaagcgccgttcacgagacttgccctcccctacactgcgccacacc

SEQ ID NO: 6494 - DNA, 60 bp, Artificial Sequence
  Description of Artificial Sequence: Synthetic probe
ggtacaaggtcgccctagttaaaccagagaaacaactgtgcaacttcgacctgttgaagt

SEQ ID NO: 6495 - DNA, 60 bp, Artificial Sequence
  Description of Artificial Sequence: Synthetic probe
ataggtacaaggtcgccctagttaaaccagagaaacaactgtgcaacttcgacctgttga

SEQ ID NO: 6496 - DNA, 60 bp, Artificial Sequence
  Description of Artificial Sequence: Synthetic probe
tcaaagacccaacgcgtgtctccccgacgtggcgaccttgccgcgttgtccgcacgcgtt

SEQ ID NO: 6497 - DNA, 60 bp, Artificial Sequence
  Description of Artificial Sequence: Synthetic probe
gtactcaaagacccaacgcgtgtctccccgacgtggcgaccttgccgcgttgtccgcacg

SEQ ID NO: 6498 - DNA, 60 bp, Artificial Sequence
  Description of Artificial Sequence: Synthetic probe
aaacggtgtaacccgattcgcgctgccttttactgcgccgcacggtgtcctctcaaccgt

SEQ ID NO: 6499 - DNA, 60 bp, Artificial Sequence
  Description of Artificial Sequence: Synthetic probe
cgttcactcgagaaacggtgtaacccgattcgcgctgccttttactgcgccgcacggtgt

SEQ ID NO: 6500 - DNA, 60 bp, Artificial Sequence
  Description of Artificial Sequence: Synthetic probe
cgctttgcactgccctacactgcgccacacagatgcctggcaacaacctacaacggtgac

SEQ ID NO: 6501 - DNA, 60 bp, Artificial Sequence
  Description of Artificial Sequence: Synthetic probe
acaacggcaccacccgctttgcactgccctacactgcgccacacagatgtttggcaacga

SEQ ID NO: 6502 - DNA, 60 bp, Artificial Sequence
  Description of Artificial Sequence: Synthetic probe
caacggcaccacccgctttgcactgccctacactgcgccacacagatgcctggcaacaac

SEQ ID NO: 6503 - DNA, 60 bp, Artificial Sequence
  Description of Artificial Sequence: Synthetic probe
gcaagtattggcccagaaggcggcaagaacgctgcctacctccttcaactacggtgccat

SEQ ID NO: 6504 - DNA, 60 bp, Artificial Sequence
  Description of Artificial Sequence: Synthetic probe
gcaagtgttagcccagaaggcggcaagaacgctgcctacctccttcaactacggtgccat

SEQ ID NO: 6505 - DNA, 60 bp, Artificial Sequence
  Description of Artificial Sequence: Synthetic probe
gcaagtgttggcccagaaggcggcaagaacgctgcctacctccttcaactacggtgccat

SEQ ID NO: 6506 - DNA, 60 bp, Artificial Sequence
  Description of Artificial Sequence: Synthetic probe
atctcaattccttcccaaaaatccgtgttgtacttcctcattgagaaaggccagcacgag

SEQ ID NO: 6507 - DNA, 60 bp, Artificial Sequence
  Description of Artificial Sequence: Synthetic probe
atctcaattccttcccaaaaatccgtgttgtacttcctcattgagaagggacaacacgag

SEQ ID NO: 6508 - DNA, 60 bp, Artificial Sequence
  Description of Artificial Sequence: Synthetic probe
cggacgtctcattcatattagacagatttgtgaaagtgacaccaaaagaccaaattaatg

SEQ ID NO: 6509 - DNA, 60 bp, Artificial Sequence
  Description of Artificial Sequence: Synthetic probe
acggacgtctcattcatattagacagatttgtgaaagtgacaccaaaagaccaaattaat

SEQ ID NO: 6510 - DNA, 60 bp, Artificial Sequence
  Description of Artificial Sequence: Synthetic probe
tgtggtggcagccgaacggggcaccgcggacaaacacgcttcgcgacaaccccatggtgt

SEQ ID NO: 6511 - DNA, 60 bp, Artificial Sequence
  Description of Artificial Sequence: Synthetic probe
cgtcaccacactgacgttgccttcgttcttgaccggtttgtgaaggtccctgtgtcggac

SEQ ID NO: 6512 - DNA, 60 bp, Artificial Sequence
  Description of Artificial Sequence: Synthetic probe
cgcttctccgcgcagccacatactacttctctgatctggaaatagcggtgacccacaccg

SEQ ID NO: 6513 - DNA, 60 bp, Artificial Sequence
  Description of Artificial Sequence: Synthetic probe
actctactgccctcggcccgttctcacgcactacgaccatgctggcaaggatcgctacaa

SEQ ID NO: 6514 - DNA, 60 bp, Artificial Sequence
  Description of Artificial Sequence: Synthetic probe
aactctactgccctcggcccgttctcacgcactacgaccacgctggcaaggaccgttaca

SEQ ID NO: 6515 - DNA, 60 bp, Artificial Sequence
  Description of Artificial Sequence: Synthetic probe
agagagcagaactctactgccctcggcccgttctcacgcactacgaccatgctggcaagg

SEQ ID NO: 6516 - DNA, 60 bp, Artificial Sequence
  Description of Artificial Sequence: Synthetic probe
ggatgaagagagcagaactctactgccctcggcccgttctcacgcactacgaccacgctg

SEQ ID NO: 6517 - DNA, 54 bp, Artificial Sequence
  Description of Artificial Sequence: Synthetic probe
ccccgcgaaaacgttcgcggcgacctcgcaaccctggctgcgcggattgctagt

SEQ ID NO: 6518 - DNA, 60 bp, Artificial Sequence
  Description of Artificial Sequence: Synthetic probe
tggacgtgtactacaggatgaagcgcgctgaattgtactgccccaggccacttctcccgg

SEQ ID NO: 6519 - DNA, 59 bp, Artificial Sequence
  Description of Artificial Sequence: Synthetic probe
tattgccccaggccgattcttccgattcagccaacgggcgacagacacaagcaaccgct

SEQ ID NO: 6520 - DNA, 60 bp, Artificial Sequence
  Description of Artificial Sequence: Synthetic probe
caggcgagacacacattccaaccactttcaactatggcaggatctacacagaagccgagg

SEQ ID NO: 6521 - DNA, 60 bp, Artificial Sequence
  Description of Artificial Sequence: Synthetic probe
ccgacgttttggtgtttgtcccgtacgatcaagaaccgctcaatggagaatggaaagcaa

SEQ ID NO: 6522 - DNA, 60 bp, Artificial Sequence
  Description of Artificial Sequence: Synthetic probe
tccgacgttttggtgtttgtcccgtacgatcaagaaccgctcaatggagaatggaaagca

SEQ ID NO: 6523 - DNA, 60 bp, Artificial Sequence
  Description of Artificial Sequence: Synthetic probe
gtccgacgttttggtgtttgtcccgtacgatcaagaaccgctcaatggagaattgaaagc

SEQ ID NO: 6524 - DNA, 60 bp, Artificial Sequence
  Description of Artificial Sequence: Synthetic probe
gtccgacgttttggtgtttgtcccgtacgatcaagaaccgctcaatggagaatggaaagc

SEQ ID NO: 6525 - DNA, 60 bp, Artificial Sequence
  Description of Artificial Sequence: Synthetic probe
ccgtccgacgttttggtgtttgtcccgtacgatcaagaaccgctcaatggagaatggaaa

SEQ ID NO: 6526 - DNA, 60 bp, Artificial Sequence
  Description of Artificial Sequence: Synthetic probe
ccgtccgacgttttggtgtttgtcccgtacgatcaagaaccgctcaatggagaattgaaa

SEQ ID NO: 6527 - DNA, 60 bp, Artificial Sequence
  Description of Artificial Sequence: Synthetic probe
cgccggacccgtccgacgttttggtgtttgtcccgtacgatcaagaaccgctcaatggag

SEQ ID NO: 6528 - DNA, 60 bp, Artificial Sequence
  Description of Artificial Sequence: Synthetic probe
gcccacgcccgctagcagtgaggtacacacacacaaccgacaggtacaagacaacactag

SEQ ID NO: 6529 - DNA, 60 bp, Artificial Sequence
  Description of Artificial Sequence: Synthetic probe
ctctactgcccacgcccgctagcagtgaggtacacacacacaaccgacaggtacaagaca

SEQ ID NO: 6530 - DNA, 60 bp, Artificial Sequence
  Description of Artificial Sequence: Synthetic probe
atggtggtgaagtgtactaccgcatgaagcgtgctgagctctactgcccacgcccgctag

SEQ ID NO: 6531 - DNA, 60 bp, Artificial Sequence
  Description of Artificial Sequence: Synthetic probe
gattgttgtgtgatggtggtgaagtgtactaccgcatgaagcgtgctgagctctactgcc

SEQ ID NO: 6532 - DNA, 60 bp, Artificial Sequence
  Description of Artificial Sequence: Synthetic probe
aacgcacaaccccacgccgaggtgacttgactgtgctgagccagcgcgttgagaatgaag

SEQ ID NO: 6533 - DNA, 60 bp, Artificial Sequence
  Description of Artificial Sequence: Synthetic probe
acccaacgcacaaccccacgccgaggtgacttgactgtgctgagccagcgcgttgagaat

SEQ ID NO: 6534 - DNA, 60 bp, Artificial Sequence
  Description of Artificial Sequence: Synthetic probe
ggcaactgtgtacaatggtaattgcaagtacaacaaaacccaacgcacaaccccacgccg

SEQ ID NO: 6535 - DNA, 60 bp, Artificial Sequence
  Description of Artificial Sequence: Synthetic probe
tgtttactcgaaaggttcggtagcccgcttcgcactgccctacaccgcaccacacggtgt

SEQ ID NO: 6536 - DNA, 60 bp, Artificial Sequence
  Description of Artificial Sequence: Synthetic probe
gggtgcctaacgggtgcccacacaccgacagagtggaagacaatccagttgtttactcga

SEQ ID NO: 6537 - DNA, 60 bp, Artificial Sequence
  Description of Artificial Sequence: Synthetic probe
tgggtgcctaacgggtgcccacacaccgacagagtggaagacaatccagttgtttactcg

SEQ ID NO: 6538 - DNA, 60 bp, Artificial Sequence
  Description of Artificial Sequence: Synthetic probe
ttcagagtgtttgagtttgagatcaaagtaaaaggacaggacatgctctcagacgccgca

SEQ ID NO: 6539 - DNA, 60 bp, Artificial Sequence
  Description of Artificial Sequence: Synthetic probe
ttcagagtgtttgagtttgagatcaaagtaaaaggacaggacatgctctcagacgccgct

SEQ ID NO: 6540 - DNA, 60 bp, Artificial Sequence
  Description of Artificial Sequence: Synthetic probe
tcaagccacgaccatccacgagctcctcgtgcgcatgaagcgtgccgaactctactgccc

SEQ ID NO: 6541 - DNA, 60 bp, Artificial Sequence
  Description of Artificial Sequence: Synthetic probe
gccccagaagactgcagacggtagaagtatcgtcgcaggacagacacaaacagaagatca

SEQ ID NO: 6542 - DNA, 60 bp, Artificial Sequence
  Description of Artificial Sequence: Synthetic probe
cgagcttctcgtaagcatgaagcgtgccgaactctactgccccagaagactgcagacggt

SEQ ID NO: 6543 - DNA, 60 bp, Artificial Sequence
  Description of Artificial Sequence: Synthetic probe
aagtactcgacaggtgcctcacccaggcgaggtgacctggggcctcttgcggcgagagtc

SEQ ID NO: 6544 - DNA, 60 bp, Artificial Sequence
  Description of Artificial Sequence: Synthetic probe
tggcacttccctacactgcaccacaccgcgtgttggcaacagtgtacaacggaacgagca

SEQ ID NO: 6545 - DNA, 60 bp, Artificial Sequence
  Description of Artificial Sequence: Synthetic probe
caaagcagagaccatcactgagctgttggtgcgcatgaaacgcgcggagctttactgccc

SEQ ID NO: 6546 - DNA, 60 bp, Artificial Sequence
  Description of Artificial Sequence: Synthetic probe
ggtgctatcaaagcagagaccatcactgagctgttggtgcgcatgaaacgcgcggagctt

SEQ ID NO: 6547 - DNA, 60 bp, Artificial Sequence
  Description of Artificial Sequence: Synthetic probe
caattttggtgctatcaaagcagagaccatcactgagctgttggtgcgcatgaaacgcgc

SEQ ID NO: 6548 - DNA, 60 bp, Artificial Sequence
  Description of Artificial Sequence: Synthetic probe
tcaactttggtgctatcaaagcagagaccatcactgagctgttggtgcgcatgaaacgcg

SEQ ID NO: 6549 - DNA, 60 bp, Artificial Sequence
  Description of Artificial Sequence: Synthetic probe
tcgttcaactttggtgctatcaaagcagagaccatcactgagctgttggtgcgcatgaaa

SEQ ID NO: 6550 - DNA, 58 bp, Artificial Sequence
  Description of Artificial Sequence: Synthetic probe
tccgcggagatctcgcgacccttgcggccaagatcgccaacgagacacacatcccaac

SEQ ID NO: 6551 - DNA, 54 bp, Artificial Sequence
  Description of Artificial Sequence: Synthetic probe
caggtgtctcgcaacatcctacaacggtgattgcaagtacaaacccgttggcgc

SEQ ID NO: 6552 - DNA, 60 bp, Artificial Sequence
  Description of Artificial Sequence: Synthetic probe
gatgacaagactcttgacgaggcggaaaagaacccactggagaccagcggtgccagcact

SEQ ID NO: 6553 - DNA, 60 bp, Artificial Sequence
  Description of Artificial Sequence: Synthetic probe
gatgacaagactcttgacgaggcggaaaagaaccctctggagaccagcggtgccagcact

SEQ ID NO: 6554 - DNA, 60 bp, Artificial Sequence
  Description of Artificial Sequence: Synthetic probe
atcaaggcccagaccatccacgagcttctcgtgcgcatgaaaagggcggagctctactgc

SEQ ID NO: 6555 - DNA, 60 bp, Artificial Sequence
  Description of Artificial Sequence: Synthetic probe
gcggagctttactgtccaagaccccttctccctggctacgatcacgcaaacagggacagg

SEQ ID NO: 6556 - DNA, 60 bp, Artificial Sequence
  Description of Artificial Sequence: Synthetic probe
agcggagctctactgtccaagaccccttctccctggctacgaacacgcagacagggatag

SEQ ID NO: 6557 - DNA, 54 bp, Artificial Sequence
  Description of Artificial Sequence: Synthetic probe
attgtcctaggccgattcttccgattcagccaacggacgatagacacaagcaac

SEQ ID NO: 6558 - DNA, 60 bp, Artificial Sequence
  Description of Artificial Sequence: Synthetic probe
aactctattgtcctaggccgattcttccgattcagccaacggacgatagacacaagcaac

SEQ ID NO: 6559 - DNA, 60 bp, Artificial Sequence
  Description of Artificial Sequence: Synthetic probe
cgcatgaagcgtgctgaactctattgtcctaggccgattcttccgattcagccaacgggc

SEQ ID NO: 6560 - DNA, 60 bp, Artificial Sequence
  Description of Artificial Sequence: Synthetic probe
gctcgtgcgcatgaagcgtgctgaactctattgtcctaggccgattcttccgattcagcc

SEQ ID NO: 6561 - DNA, 60 bp, Artificial Sequence
  Description of Artificial Sequence: Synthetic probe
cccagagacggcaccacacggatgtcggcttcataatggacagatttgtgaaagtgacca

SEQ ID NO: 6562 - DNA, 60 bp, Artificial Sequence
  Description of Artificial Sequence: Synthetic probe
ccagagacggcaccacacggacgtcggcttcataatggacagatttgtgaaagtgaccag

SEQ ID NO: 6563 - DNA, 60 bp, Artificial Sequence
  Description of Artificial Sequence: Synthetic probe
cccagagacggcaccacacggacgtcggcttcataatggacagatttgtgaaagtgacca

SEQ ID NO: 6564 - DNA, 60 bp, Artificial Sequence
  Description of Artificial Sequence: Synthetic probe
tggacacccaacttggtgacaacgccattagcggtggttccaatgagggtagcacagaca

SEQ ID NO: 6565 - DNA, 60 bp, Artificial Sequence
  Description of Artificial Sequence: Synthetic probe
tggacacccaacctggcgacaacgccattagcggtggttccaatgagggttcgactgaca

SEQ ID NO: 6566 - DNA, 60 bp, Artificial Sequence
  Description of Artificial Sequence: Synthetic probe
tcgtttgtatggacggtgacaccatgcctggactcttcgcgtaccgcgcagggaccaaag

SEQ ID NO: 6567 - DNA, 60 bp, Artificial Sequence
  Description of Artificial Sequence: Synthetic probe
tcgttcttgacaggtttgtgaaactcactgcacccaagaacactcagacccttgacctca

SEQ ID NO: 6568 - DNA, 53 bp, Artificial Sequence
  Description of Artificial Sequence: Synthetic probe
cttgggtcactgaactgctttaccgcatgaagagggccgaaacatactgcccc

SEQ ID NO: 6569 - DNA, 54 bp, Artificial Sequence
  Description of Artificial Sequence: Synthetic probe
cttgggtcactgaactgctttaccgcatgaagagggccgaaacatactgccccc

SEQ ID NO: 6570 - DNA, 60 bp, Artificial Sequence
  Description of Artificial Sequence: Synthetic probe
cactgcgccacaccgcgtgttggcaacagtgtacaacgggacgaacaagtactccgcggc

SEQ ID NO: 6571 - DNA, 60 bp, Artificial Sequence
  Description of Artificial Sequence: Synthetic probe
acactgcgccacaccgcgtgttggcaacagtgtacaacgggacgaacaagtactccgcgg

SEQ ID NO: 6572 - DNA, 60 bp, Artificial Sequence
  Description of Artificial Sequence: Synthetic probe
tgtactgtccaaggccacttctcccggcttaccagcacggaaaccgggacagattcgacg

SEQ ID NO: 6573 - DNA, 60 bp, Artificial Sequence
  Description of Artificial Sequence: Synthetic probe
ggcagagttgtactgtccaaggccacttctcccggcttaccagcacggaaaccgggacag

SEQ ID NO: 6574 - DNA, 60 bp, Artificial Sequence
  Description of Artificial Sequence: Synthetic probe
ggacatgtgaccgccgaccagccagtcgacgtttactacaggatgaagcgggcagagttg

SEQ ID NO: 6575 - DNA, 60 bp, Artificial Sequence
  Description of Artificial Sequence: Synthetic probe
caaccaagtacgccgactccagacacacgcttccatccaggttcaactttggacatgtga

SEQ ID NO: 6576 - DNA, 60 bp, Artificial Sequence
  Description of Artificial Sequence: Synthetic probe
aatacacagaccgggtctccgcaatccgcggtgatcgcgctgtgttggcaaccaagtacg

SEQ ID NO: 6577 - DNA, 60 bp, Artificial Sequence
  Description of Artificial Sequence: Synthetic probe
taaatacacagaccgggtctccgcaatccgcggtgatcgcgctgtgttggcaaccaagta

SEQ ID NO: 6578 - DNA, 60 bp, Artificial Sequence
  Description of Artificial Sequence: Synthetic probe
aaccccatggtgttcgcccacaatcgcgtcaccaggtttgccataccctacactgcgcca

SEQ ID NO: 6579 - DNA, 60 bp, Artificial Sequence
  Description of Artificial Sequence: Synthetic probe
tgggagacaaccccatggtgttcgcccacaatcgcgtcaccaggtttgccataccctaca

SEQ ID NO: 6580 - DNA, 55 bp, Artificial Sequence
  Description of Artificial Sequence: Synthetic probe
agcggacgtcgtcacgaccgacccctcgacacacggcggaagtgtagtggagaag

SEQ ID NO: 6581 - DNA, 60 bp, Artificial Sequence
  Description of Artificial Sequence: Synthetic probe
accaccagcgccggtgagggagcggacgtcgtcacgaccgacccctcgacacacggcgga

SEQ ID NO: 6582 - DNA, 60 bp, Artificial Sequence
  Description of Artificial Sequence: Synthetic probe
ccccactgcctacaacaaggcaccgttcacgagacttgctctcccttacactgcgccaca

SEQ ID NO: 6583 - DNA, 60 bp, Artificial Sequence
  Description of Artificial Sequence: Synthetic probe
ccagcaaccccaccgcctacaacaaagcgccgttcacgagacttggcctcccctacactg

SEQ ID NO: 6584 - DNA, 60 bp, Artificial Sequence
  Description of Artificial Sequence: Synthetic probe
taacctgacttgggtacccaacggtgcccctgaatcggccttgtccaacgccagcaaccc

SEQ ID NO: 6585 - DNA, 60 bp, Artificial Sequence
  Description of Artificial Sequence: Synthetic probe
attggtgggcgccctgttacgtgccgctacgtactacttctccgacctggagattgtggt

SEQ ID NO: 6586 - DNA, 58 bp, Artificial Sequence
  Description of Artificial Sequence: Synthetic probe
taacgggacgaacaagtatactgtgggtggttccgccaggcgaggtgatttggggtct

SEQ ID NO: 6587 - DNA, 52 bp, Artificial Sequence
  Description of Artificial Sequence: Synthetic probe
aattgttgtgaaacacgacggtaatctgacttgggtacctaacggtgctccc

SEQ ID NO: 6588 - DNA, 60 bp, Artificial Sequence
  Description of Artificial Sequence: Synthetic probe
cggtggtgggacacaagttcagagaaggcaccacacggacattggctttattatggacag

SEQ ID NO: 6589 - DNA, 60 bp, Artificial Sequence
  Description of Artificial Sequence: Synthetic probe
ctacggtggtgggacacaagttcagagaaggcaccacacggacattggctttattatgga

SEQ ID NO: 6590 - DNA, 55 bp, Artificial Sequence
  Description of Artificial Sequence: Synthetic probe
ccaccaaagcagggacaggttcgacgcccccattggcgtcgagaaacaactgtgc

SEQ ID NO: 6591 - DNA, 60 bp, Artificial Sequence
  Description of Artificial Sequence: Synthetic probe
ggtcactccattaccgatgtcactttcctcaaaaggcatttccacatggattatggaact

SEQ ID NO: 6592 - DNA, 60 bp, Artificial Sequence
  Description of Artificial Sequence: Synthetic probe
aaaggttttgttcttggtcactccattaccgatgtcactttcctcaaaaggcatttccac

SEQ ID NO: 6593 - DNA, 60 bp, Artificial Sequence
  Description of Artificial Sequence: Synthetic probe
ctttgctagctctcgacactacccaggaccgccgtaagcaggagatcattgcacctgaga

SEQ ID NO: 6594 - DNA, 60 bp, Artificial Sequence
  Description of Artificial Sequence: Synthetic probe
ttttgctagctctagacactactcaggaccgccgtaagcaggagatcattgcacctgaga

SEQ ID NO: 6595 - DNA, 60 bp, Artificial Sequence
  Description of Artificial Sequence: Synthetic probe
ccacactgggaagctcacatgggtgcccaacggtgcaccagtttctgcacttaacaacac

SEQ ID NO: 6596 - DNA, 60 bp, Artificial Sequence
  Description of Artificial Sequence: Synthetic probe
acccacactgggaagctcacatgggtgcccaacggtgcaccagtttctgcacttaacaac

SEQ ID NO: 6597 - DNA, 60 bp, Artificial Sequence
  Description of Artificial Sequence: Synthetic probe
gcagtgacccacactgggaagctcacatgggtgcccaacggtgcaccagtttctgcactt

SEQ ID NO: 6598 - DNA, 59 bp, Artificial Sequence
  Description of Artificial Sequence: Synthetic probe
aagtgacgtcgcaagacagacacaaacagaagatcattgcacctgcaaagcagctcctg

SEQ ID NO: 6599 - DNA, 60 bp, Artificial Sequence
  Description of Artificial Sequence: Synthetic probe
gcgcatgaagcgggccgaactttactgtcccaggcgctgcctggcggtggaagtgacgtc

SEQ ID NO: 6600 - DNA, 54 bp, Artificial Sequence
  Description of Artificial Sequence: Synthetic probe
gtcgccaacaagcttcctgcttctttcaacttcggtgcgattcgagccacgacc

SEQ ID NO: 6601 - DNA, 58 bp, Artificial Sequence
  Description of Artificial Sequence: Synthetic probe
gcgccgcaccgcgtgctggcaacagtgtacaacgggacaaccacgtactccacaggta

SEQ ID NO: 6602 - DNA, 60 bp, Artificial Sequence
  Description of Artificial Sequence: Synthetic probe
ataccacaagggaccattcacgaggctcgcgctcccctacaccgcgccgcaccgcgtgct

SEQ ID NO: 6603 - DNA, 60 bp, Artificial Sequence
  Description of Artificial Sequence: Synthetic probe
ccactgcataccacaagggaccattcacgaggctcgcgctcccctacaccgcgccgcacc

SEQ ID NO: 6604 - DNA, 60 bp, Artificial Sequence
  Description of Artificial Sequence: Synthetic probe
ttggagattgtggtgcgtcatgaggacaatttaacctgggtacccaatggagcacctgag

SEQ ID NO: 6605 - DNA, 60 bp, Artificial Sequence
  Description of Artificial Sequence: Synthetic probe
tgaaaacattcgcggggacctcgcaactcttgcggcgagaattgcaagcgagacacacat

SEQ ID NO: 6606 - DNA, 60 bp, Artificial Sequence
  Description of Artificial Sequence: Synthetic probe
taccgtcgagaactacggaggagaaacacaaactcagcgtcgccaccacaccgacgttgc

SEQ ID NO: 6607 - DNA, 60 bp, Artificial Sequence
  Description of Artificial Sequence: Synthetic probe
tgacagacagtgacttcagagtgtttgagtttgaggtaaaagtaaaaggacaggacatgc

SEQ ID NO: 6608 - DNA, 60 bp, Artificial Sequence
  Description of Artificial Sequence: Synthetic probe
cggccgcgccctaacagacagtgacttcagagtgtttgagtttgaggtaaaagtaaaagg

SEQ ID NO: 6609 - DNA, 60 bp, Artificial Sequence
  Description of Artificial Sequence: Synthetic probe
cctgctccttcaactttggtgcagttcgagccacgaccatccacgagcttctcgtgcgca

SEQ ID NO: 6610 - DNA, 60 bp, Artificial Sequence
  Description of Artificial Sequence: Synthetic probe
gcgacagcttcctgcctccttcaactttggtgcagttcgagccacgaccatccacgagct

SEQ ID NO: 6611 - DNA, 60 bp, Artificial Sequence
  Description of Artificial Sequence: Synthetic probe
ggcgacagcttcctgcctccttcaactttggtgcagttcgagccacgaccatccacgagc

SEQ ID NO: 6612 - DNA, 60 bp, Artificial Sequence
  Description of Artificial Sequence: Synthetic probe
cgcggcgcgagtagccgcacaactccctgcctccttcaattttggtgcaattcgagctac

SEQ ID NO: 6613 - DNA, 60 bp, Artificial Sequence
  Description of Artificial Sequence: Synthetic probe
ctcgcggcgcgagtagccgcacaactccctgcctccttcaattttggtgcaattcgagct

SEQ ID NO: 6614 - DNA, 60 bp, Artificial Sequence
  Description of Artificial Sequence: Synthetic probe
acaacccgagcaaccccactgcttaccacaaggcaccgttcacgaggcttgcactccctt

SEQ ID NO: 6615 - DNA, 55 bp, Artificial Sequence
  Description of Artificial Sequence: Synthetic probe
ggatcaagcctgtgagccccacacatgtcattgacctcatgcagacacaccaaca

SEQ ID NO: 6616 - DNA, 60 bp, Artificial Sequence
  Description of Artificial Sequence: Synthetic probe
ccaccggggaatcagcagaccctgtcacaaccaccgtcgagaactacggtggtgaaacac

SEQ ID NO: 6617 - DNA, 60 bp, Artificial Sequence
  Description of Artificial Sequence: Synthetic probe
gggccgagctctactgtcccaggccacttctagcaatagaggtgtcttcgcaagacaggc

SEQ ID NO: 6618 - DNA, 60 bp, Artificial Sequence
  Description of Artificial Sequence: Synthetic probe
cgcatgaaacgggccgagctctactgtcccaggccacttctagcaatagaggtgtcttcg

SEQ ID NO: 6619 - DNA, 60 bp, Artificial Sequence
  Description of Artificial Sequence: Synthetic probe
gcgcatgaaacgggccgagctctactgtcccaggccacttctagcaatagaggtgtcgtc

SEQ ID NO: 6620 - DNA, 60 bp, Artificial Sequence
  Description of Artificial Sequence: Synthetic probe
tcctcgtgcgcatgaaacgggccgagctctactgtcccaggccacttctagcaatagagg

SEQ ID NO: 6621 - DNA, 60 bp, Artificial Sequence
  Description of Artificial Sequence: Synthetic probe
gtgactacagagtgtttgagtttgagattaaagtaaaaggacaggacatgctctcagacg

SEQ ID NO: 6622 - DNA, 52 bp, Artificial Sequence
  Description of Artificial Sequence: Synthetic probe
ccctgaaaacgtactcgcgtacgtgccctacgaccaggaacccctggacgta

SEQ ID NO: 6623 - DNA, 60 bp, Artificial Sequence
  Description of Artificial Sequence: Synthetic probe
tggaaactagcggtgccagcaccgtcggcttcagagagagaactcctccaggtcagaagg

SEQ ID NO: 6624 - DNA, 60 bp, Artificial Sequence
  Description of Artificial Sequence: Synthetic probe
aaccctctggaaactagcggtgccagcaccgtcggcttcagagagagaactcctccaggt

SEQ ID NO: 6625 - DNA, 60 bp, Artificial Sequence
  Description of Artificial Sequence: Synthetic probe
tggccaacatagtggtcatgatccgcgatactcgcaagaggcagaagatggtggatgatg

SEQ ID NO: 6626 - DNA, 60 bp, Artificial Sequence
  Description of Artificial Sequence: Synthetic probe
tatgtttgaccctcttggccaacatagtggtcatgatccgcgatactcgcaagaggcaga

SEQ ID NO: 6627 - DNA, 60 bp, Artificial Sequence
  Description of Artificial Sequence: Synthetic probe
caagcgcttgaaggaaaactttgagatcgttgccctatgtttgaccctcttggccaacat

SEQ ID NO: 6628 - DNA, 60 bp, Artificial Sequence
  Description of Artificial Sequence: Synthetic probe
tgtgaaacgcgctttcaagcgcttgaaggaaaactttgagatcgttgccctatgtttgac

SEQ ID NO: 6629 - DNA, 60 bp, Artificial Sequence
  Description of Artificial Sequence: Synthetic probe
cgactccatcaaggaggagctccggcccctcatccaacacacctcatttgtgaaacgcgc

SEQ ID NO: 6630 - DNA, 60 bp, Artificial Sequence
  Description of Artificial Sequence: Synthetic probe
cacgactccatcaaggaggagctccggcccctcatccaacacacctcatttgtgaaacgc

SEQ ID NO: 6631 - DNA, 59 bp, Artificial Sequence
  Description of Artificial Sequence: Synthetic probe
gggcagctgcccacctccttcaactacggcgctgtaaggctgaaaccattactgagctc

SEQ ID NO: 6632 - DNA, 60 bp, Artificial Sequence
  Description of Artificial Sequence: Synthetic probe
gagtccgcagaccctgtcaccaccaccgtggagaactacggcggcggtacacaagtccag

SEQ ID NO: 6633 - DNA, 60 bp, Artificial Sequence
  Description of Artificial Sequence: Synthetic probe
gagtccgcagaccctgtcaccaccaccgtggagaactacggcggtgagacacaagtccag

SEQ ID NO: 6634 - DNA, 60 bp, Artificial Sequence
  Description of Artificial Sequence: Synthetic probe
tggcccagaaggcggcgagaacgctgcctacctccttcaactacggtgccatcaaagcta

SEQ ID NO: 6635 - DNA, 60 bp, Artificial Sequence
  Description of Artificial Sequence: Synthetic probe
aagtgttggcccagaaggcggcgagaacgctgcctacctccttcaactacggtgccatca

SEQ ID NO: 6636 - DNA, 60 bp, Artificial Sequence
  Description of Artificial Sequence: Synthetic probe
cctgggtgactgagctgctttaccgcataaaaagggctgagacatactgtcctcggcctc

SEQ ID NO: 6637 - DNA, 60 bp, Artificial Sequence
  Description of Artificial Sequence: Synthetic probe
ggccgctgcctacttctttcaactacggtgccatcaaagccacctgggtgactgagctgc

SEQ ID NO: 6638 - DNA, 60 bp, Artificial Sequence
  Description of Artificial Sequence: Synthetic probe
ggcggcgaggccgctgcctacttctttcaactacggtgccatcaaagccacctgggtgac

SEQ ID NO: 6639 - DNA, 60 bp, Artificial Sequence
  Description of Artificial Sequence: Synthetic probe
aacgtgagaggtgacctccaggtgctggctcagaaggcggcgaggccgctgcctacttct

SEQ ID NO: 6640 - DNA, 60 bp, Artificial Sequence
  Description of Artificial Sequence: Synthetic probe
gaaggctcgctgaccaacgtgagaggtgacctccaggtgctggctcagaaggcggcgagg

SEQ ID NO: 6641 - DNA, 60 bp, Artificial Sequence
  Description of Artificial Sequence: Synthetic probe
caccgcgtcttggccaccgtttacaacgggaactgcaaatatgccgaaggctcgctgacc

SEQ ID NO: 6642 - DNA, 60 bp, Artificial Sequence
  Description of Artificial Sequence: Synthetic probe
caccacaccgcgtcttggccaccgtttacaacgggaactgcaaatatgccgaaggctcgc

SEQ ID NO: 6643 - DNA, 60 bp, Artificial Sequence
  Description of Artificial Sequence: Synthetic probe
taccacaaagcaccactcactcggcttgcgctgccctacacggcaccacaccgcgtcttg

SEQ ID NO: 6644 - DNA, 60 bp, Artificial Sequence
  Description of Artificial Sequence: Synthetic probe
aacggcgtaccacaaagcaccactcactcggcttgcgctgccctacacggcaccacaccg

SEQ ID NO: 6645 - DNA, 50 bp, Artificial Sequence
  Description of Artificial Sequence: Synthetic probe
aaaacaaggggaacctcacctgggtaccaaatggagcacctgaaacagcc

SEQ ID NO: 6646 - DNA, 60 bp, Artificial Sequence
  Description of Artificial Sequence: Synthetic probe
ttcgctgacctagaagtggcggtcaaaaacaaggggaacctcacctgggtaccaaatgga

SEQ ID NO: 6647 - DNA, 60 bp, Artificial Sequence
  Description of Artificial Sequence: Synthetic probe
cccccgcccacaccttggtgggggcgctcctccgtactgccacttactatttcgctgacc

SEQ ID NO: 6648 - DNA, 52 bp, Artificial Sequence
  Description of Artificial Sequence: Synthetic probe
cgttcatattggacagatttgtgaaagttacacccaaagcccaaattaatgt

SEQ ID NO: 6649 - DNA, 60 bp, Artificial Sequence
  Description of Artificial Sequence: Synthetic probe
accgggacaggttcgacgctccgattggcgtcgagaaacaactgtgcaacttcgacctgt

SEQ ID NO: 6650 - DNA, 60 bp, Artificial Sequence
  Description of Artificial Sequence: Synthetic probe
actctggaagacagcacacactaccgtccacattcaactttggtcacgttacagctgaca

SEQ ID NO: 6651 - DNA, 60 bp, Artificial Sequence
  Description of Artificial Sequence: Synthetic probe
accgcaccccaccgcttgctgtcaaccgtctacaacggtgaatgcaagtatgacacgccc

SEQ ID NO: 6652 - DNA, 60 bp, Artificial Sequence
  Description of Artificial Sequence: Synthetic probe
acaccgcaccccaccgcttgctgtcaaccgtctacaacggtgaatgcaagtatgacacgc

SEQ ID NO: 6653 - DNA, 60 bp, Artificial Sequence
  Description of Artificial Sequence: Synthetic probe
tctccaacaagggtgtgacaaggtttgccgtgccatacaccgcaccccaccgcttgctgt

SEQ ID NO: 6654 - DNA, 60 bp, Artificial Sequence
  Description of Artificial Sequence: Synthetic probe
caacccgatggttttctccaacaagggtgtgacaaggtttgccgtgccatacaccgcacc

SEQ ID NO: 6655 - DNA, 60 bp, Artificial Sequence
  Description of Artificial Sequence: Synthetic probe
cggtgctataaaggccacacgggtgactgaactgctttaccgcatgaagagggccgagac

SEQ ID NO: 6656 - DNA, 60 bp, Artificial Sequence
  Description of Artificial Sequence: Synthetic probe
cacacaggctgctgtccactgtctacaatggcgagtgcacctacaacaaaaccgctaccg

SEQ ID NO: 6657 - DNA, 54 bp, Artificial Sequence
  Description of Artificial Sequence: Synthetic probe
cacacaggctgctgtccactgtctacaatggcgagtgcacctacagcaaaaccg

SEQ ID NO: 6658 - DNA, 60 bp, Artificial Sequence
  Description of Artificial Sequence: Synthetic probe
cgatcacccaaaccgggacaggttcgacgcccccatcggcgttgaaaaacaactgtgcaa

SEQ ID NO: 6659 - DNA, 60 bp, Artificial Sequence
  Description of Artificial Sequence: Synthetic probe
gaggattgcaagcgagacacacattccaaccaccttcaactacggtaggctctacacaca

SEQ ID NO: 6660 - DNA, 60 bp, Artificial Sequence
  Description of Artificial Sequence: Synthetic probe
cgtaaggatgaaacgcgcggagctctactgcccgcgtcccgtcctgacacactacgacca

SEQ ID NO: 6661 - DNA, 60 bp, Artificial Sequence
  Description of Artificial Sequence: Synthetic probe
cagcccaacggtgcgcctcggaccacccagcttggggacaacccgatggttttctccaac

SEQ ID NO: 6662 - DNA, 60 bp, Artificial Sequence
  Description of Artificial Sequence: Synthetic probe
ggtgagaagaagactttctactctagacccaacaaccatgacaactgctggttgaacacc

SEQ ID NO: 6663 - DNA, 60 bp, Artificial Sequence
  Description of Artificial Sequence: Synthetic probe
actgcgccgcaccgcgtgttggcgacggtgtacaacgggacgagcaagtactcgacaact

SEQ ID NO: 6664 - DNA, 60 bp, Artificial Sequence
  Description of Artificial Sequence: Synthetic probe
cgtgtactggcaacccaacggcgcacccagaaccacagagctcggggacaacccgatggt

SEQ ID NO: 6665 - DNA, 60 bp, Artificial Sequence
  Description of Artificial Sequence: Synthetic probe
cgtgtactggcaacccaacggcgcacccagaaccaacgagctcggggacaacccgatggt

SEQ ID NO: 6666 - DNA, 60 bp, Artificial Sequence
  Description of Artificial Sequence: Synthetic probe
cgcgtgtactggcaacccaacggcgcacccagaaccaccgaacttggggacaaccccatg

SEQ ID NO: 6667 - DNA, 56 bp, Artificial Sequence
  Description of Artificial Sequence: Synthetic probe
accatcactgagcttttgattcgcatgaaacgcgcggagacatactgccccaggcc

SEQ ID NO: 6668 - DNA, 60 bp, Artificial Sequence
  Description of Artificial Sequence: Synthetic probe
cgatttgtgaagataaacagcctgagccccacacatgtcattgacctcatgcaaacccac

SEQ ID NO: 6669 - DNA, 60 bp, Artificial Sequence
  Description of Artificial Sequence: Synthetic probe
gcactgaacacgctgtgttcgccctcaacacatccgagggctggtacgccattgatgatg

SEQ ID NO: 6670 - DNA, 60 bp, Artificial Sequence
  Description of Artificial Sequence: Synthetic probe
caccagcactcgccccagcgagatctgtgtaatcaacggggttgtcatgaccctggctga

SEQ ID NO: 6671 - DNA, 60 bp, Artificial Sequence
  Description of Artificial Sequence: Synthetic probe
tggaccacctgcactcgtgctctggcttatcaaggactgtcttcaaaccggtgttggcac

SEQ ID NO: 6672 - DNA, 60 bp, Artificial Sequence
  Description of Artificial Sequence: Synthetic probe
ctctcagattacaccaaacttgacctctcagatggtggaccacctgcactcgtgctctgg

SEQ ID NO: 6673 - DNA, 60 bp, Artificial Sequence
  Description of Artificial Sequence: Synthetic probe
gacatgatcaaacgactctcagattacaccaaacttgacctctcagatggtggaccacct

SEQ ID NO: 6674 - DNA, 54 bp, Artificial Sequence
  Description of Artificial Sequence: Synthetic probe
actctacaacggtgataagaaaaccttctacagcagacccaacacacacgggaa

SEQ ID NO: 6675 - DNA, 60 bp, Artificial Sequence
  Description of Artificial Sequence: Synthetic probe
gaactctactgtccgcggcccctcctgacacactacgatcatgccggtaaggatcgctac

SEQ ID NO: 6676 - DNA, 60 bp, Artificial Sequence
  Description of Artificial Sequence: Synthetic probe
acaagccgaggtcaaagtgtacatcaggatgaagcgcgcggaactctactgtccgcggcc

SEQ ID NO: 6677 - DNA, 60 bp, Artificial Sequence
  Description of Artificial Sequence: Synthetic probe
ggatttacacacaagccgaggtcaaagtgtacatcaggatgaagcgcgcggaactctact

SEQ ID NO: 6678 - DNA, 60 bp, Artificial Sequence
  Description of Artificial Sequence: Synthetic probe
tactcaaaaggcaacaccacccgtttcgcactgccctacactgccccacacaggtgcctg

SEQ ID NO: 6679 - DNA, 60 bp, Artificial Sequence
  Description of Artificial Sequence: Synthetic probe
cgtctactcaaaaggcaacaccacccgtttcgcactgccctacactgccccacacaggtg

SEQ ID NO: 6680 - DNA, 60 bp, Artificial Sequence
  Description of Artificial Sequence: Synthetic probe
gctccggagcttagcgaggtgggcgacaatccagtcgtctactcaaaaggcaacaccacc

SEQ ID NO: 6681 - DNA, 60 bp, Artificial Sequence
  Description of Artificial Sequence: Synthetic probe
tggactcccaacggagctccggagcttagcgaggtgggcgacaatccagtcgtctactca

SEQ ID NO: 6682 - DNA, 60 bp, Artificial Sequence
  Description of Artificial Sequence: Synthetic probe
ccctcctgagggcatccacctactacttctgtgacctggaaattgcctgtgtgggagaac

SEQ ID NO: 6683 - DNA, 60 bp, Artificial Sequence
  Description of Artificial Sequence: Synthetic probe
ccctcctgagggcctccacctactacttctgtgacctggaaattgcctgtgtgggcgaac

SEQ ID NO: 6684 - DNA, 60 bp, Artificial Sequence
  Description of Artificial Sequence: Synthetic probe
tgtcacctccaacgggtggtacgcgattgatgacgaggacttttacccctggacgccgga

SEQ ID NO: 6685 - DNA, 53 bp, Artificial Sequence
  Description of Artificial Sequence: Synthetic probe
cactgcgccgcaccgcgtgttggcgacagtgtacaacgggacgagcaagtact

SEQ ID NO: 6686 - DNA, 60 bp, Artificial Sequence
  Description of Artificial Sequence: Synthetic probe
ggtctagggtagtaagtcctcctcgcgtttcatgctggatcaacagctcagctgatggtg

SEQ ID NO: 6687 - DNA, 60 bp, Artificial Sequence
  Description of Artificial Sequence: Synthetic probe
tccagggccaacaaaggtctagggtagtaagtcctcctcgcgtttcatgctggatcaaca

SEQ ID NO: 6688 - DNA, 60 bp, Artificial Sequence
  Description of Artificial Sequence: Synthetic probe
tggaaaagtttcgacctgacgtcggagaagaagaagggcccggggtttgagctccacgtc

SEQ ID NO: 6689 - DNA, 60 bp, Artificial Sequence
  Description of Artificial Sequence: Synthetic probe
ctgttggccatccacccgagcgaaactagacacaaacaaaagattgtggcacctgtgaaa

SEQ ID NO: 6690 - DNA, 60 bp, Artificial Sequence
  Description of Artificial Sequence: Synthetic probe
caactacggtgctgtgaaggctgacaccatcacggagctgttgatccgcatgacgcgtgc

SEQ ID NO: 6691 - DNA, 60 bp, Artificial Sequence
  Description of Artificial Sequence: Synthetic probe
ttcaactacggtgctgtgaaggctgacaccatcacggagctgttgatccgcatgacgcgt

SEQ ID NO: 6692 - DNA, 60 bp, Artificial Sequence
  Description of Artificial Sequence: Synthetic probe
ctccttcaactacggtgctgtgaaggctgacaccatcacggagctgttgatccgcattaa

SEQ ID NO: 6693 - DNA, 60 bp, Artificial Sequence
  Description of Artificial Sequence: Synthetic probe
agcactcgccccagcgagatctgtgtgatcaacggggtcgccatgactctggctgatttc

SEQ ID NO: 6694 - DNA, 60 bp, Artificial Sequence
  Description of Artificial Sequence: Synthetic probe
caccagcactcgccccagcgagatctgtgtgatcaacggagtcaccatgactctggctga

SEQ ID NO: 6695 - DNA, 60 bp, Artificial Sequence
  Description of Artificial Sequence: Synthetic probe
ccgtacgtctcggccagtgacttctcctacacccacactgacacacctgcaatggccaca

SEQ ID NO: 6696 - DNA, 60 bp, Artificial Sequence
  Description of Artificial Sequence: Synthetic probe
gttcgccgtcccgtacgtctcggccagtgacttctcctacacccacactgacacacctgc

SEQ ID NO: 6697 - DNA, 60 bp, Artificial Sequence
  Description of Artificial Sequence: Synthetic probe
cacaaggcaaagttcatggtggcgtacatcccaccaggcattgagacagaaaagctgccc

SEQ ID NO: 6698 - DNA, 60 bp, Artificial Sequence
  Description of Artificial Sequence: Synthetic probe
cacacaccacaaggcaaagttcatggtggcgtacatcccaccaggcattgagacagaaaa

SEQ ID NO: 6699 - DNA, 60 bp, Artificial Sequence
  Description of Artificial Sequence: Synthetic probe
ccaactcaccacaaggcaaagttcatggtggcgtacatcccaccaggcattgacacagac

SEQ ID NO: 6700 - DNA, 60 bp, Artificial Sequence
  Description of Artificial Sequence: Synthetic probe
tctcaccacagagacacagatgaactccgggactgttgaggtatacgccaacattgcccc

SEQ ID NO: 6701 - DNA, 60 bp, Artificial Sequence
  Description of Artificial Sequence: Synthetic probe
tactgcccgcgacccctgcgggttagatacacgcacaccactgaccggtacaagattgca

SEQ ID NO: 6702 - DNA, 60 bp, Artificial Sequence
  Description of Artificial Sequence: Synthetic probe
gaggacggagctgtactgcccgcgacccctgcgggttagatacacgcacaccactgaccg

SEQ ID NO: 6703 - DNA, 60 bp, Artificial Sequence
  Description of Artificial Sequence: Synthetic probe
gttgtgtgacacaggtaacgtctactaccggatgaagaggacggagctgtactgcccgcg

SEQ ID NO: 6704 - DNA, 60 bp, Artificial Sequence
  Description of Artificial Sequence: Synthetic probe
aacttcgggagattgttgtgtgacacaggtaacgtctactaccggatgaagaggacggag

SEQ ID NO: 6705 - DNA, 60 bp, Artificial Sequence
  Description of Artificial Sequence: Synthetic probe
ccgcgccgcggcgacttagcggtgttagcgcaacgtgttgagaatgaaaccacaagatgc

SEQ ID NO: 6706 - DNA, 60 bp, Artificial Sequence
  Description of Artificial Sequence: Synthetic probe
ttacgccgcgccgcggcgacttagcggtgttagcgcaacgtgttgagaatgaaaccacaa

SEQ ID NO: 6707 - DNA, 60 bp, Artificial Sequence
  Description of Artificial Sequence: Synthetic probe
acaatctacaacggtaactgcaagtactccaaaacccaacacgttacgccgcgccgcggc

SEQ ID NO: 6708 - DNA, 60 bp, Artificial Sequence
  Description of Artificial Sequence: Synthetic probe
tcttgcaacaatctacaacggtaactgcaagtactccaaaacccaacacgttacgccgcg

SEQ ID NO: 6709 - DNA, 60 bp, Artificial Sequence
  Description of Artificial Sequence: Synthetic probe
gcccgttttgccctgccttacacagcaccacacagggttcttgcaacaatctacaacggt

SEQ ID NO: 6710 - DNA, 60 bp, Artificial Sequence
  Description of Artificial Sequence: Synthetic probe
aaaaacggtgtagcccgttttgccctgccttacacagcaccacacagggttcttgcaaca

SEQ ID NO: 6711 - DNA, 60 bp, Artificial Sequence
  Description of Artificial Sequence: Synthetic probe
acaccgcaccccaccggctgcttgccacagtgtacaacggtgactgcaagtacaaaccca

SEQ ID NO: 6712 - DNA, 60 bp, Artificial Sequence
  Description of Artificial Sequence: Synthetic probe
cggcccgtgctgacacactacgaccaccaaaacaaagatcgctacaaggtggccctcacc

SEQ ID NO: 6713 - DNA, 60 bp, Artificial Sequence
  Description of Artificial Sequence: Synthetic probe
tggacccccaatgggtcgcctgagttgagtgaggtcggcgacaacccagtcgttttctca

SEQ ID NO: 6714 - DNA, 60 bp, Artificial Sequence
  Description of Artificial Sequence: Synthetic probe
gagcggctgcccacctccttcaactacggcgctgtaaaggctgacaccatcactgagctt

SEQ ID NO: 6715 - DNA, 60 bp, Artificial Sequence
  Description of Artificial Sequence: Synthetic probe
tacaacggtgactgtaagtacaaacccgctggcactgccccacgcgagaacatccgtggg

SEQ ID NO: 6716 - DNA, 60 bp, Artificial Sequence
  Description of Artificial Sequence: Synthetic probe
tcttacaacggtgactgtaagtacaaacccgctggcactgccccacgcgagaacatccgt

SEQ ID NO: 6717 - DNA, 60 bp, Artificial Sequence
  Description of Artificial Sequence: Synthetic probe
cgctttgcgctgccctacacagcgccacacagatgtctggcgacatcttacaacggtgac

SEQ ID NO: 6718 - DNA, 60 bp, Artificial Sequence
  Description of Artificial Sequence: Synthetic probe
ccacccgctttgcgctgccctacacagcgccacacagatgtctggcgacatcttacaacg

SEQ ID NO: 6719 - DNA, 60 bp, Artificial Sequence
  Description of Artificial Sequence: Synthetic probe
tcctccccgcctacgaccacgcaagcagggacagatttgacgcccccattggcgtcgaga

SEQ ID NO: 6720 - DNA, 60 bp, Artificial Sequence
  Description of Artificial Sequence: Synthetic probe
ttactaccggatgaagagggctgaactctactgcccaaggcctctcctccccgcctacga

SEQ ID NO: 6721 - DNA, 60 bp, Artificial Sequence
  Description of Artificial Sequence: Synthetic probe
cgacgtttactaccggatgaagagggctgaactctactgcccaaggcctctcctccccgc

SEQ ID NO: 6722 - DNA, 60 bp, Artificial Sequence
  Description of Artificial Sequence: Synthetic probe
ggtacaacggtgagtgcaagtacacacaacagtccaccgcaattcgtggtgaccgtgctg

SEQ ID NO: 6723 - DNA, 60 bp, Artificial Sequence
  Description of Artificial Sequence: Synthetic probe
ctatcaaccaggtacaacggtgagtgcaagtacacacaacagtccaccgcaattcgtggt

SEQ ID NO: 6724 - DNA, 60 bp, Artificial Sequence
  Description of Artificial Sequence: Synthetic probe
acctgaggatgaagagagcggaactctactgccctcgaccccttctcacgcactacgacc

SEQ ID NO: 6725 - DNA, 54 bp, Artificial Sequence
  Description of Artificial Sequence: Synthetic probe
caacccagtcgtcttctcacacaacaacaccacccgttttgcaatcccttacac

SEQ ID NO: 6726 - DNA, 60 bp, Artificial Sequence
  Description of Artificial Sequence: Synthetic probe
gaggtgggcgacaacccagtcgtcttctcacacaacaacaccacccgttttgcaataccc

SEQ ID NO: 6727 - DNA, 60 bp, Artificial Sequence
  Description of Artificial Sequence: Synthetic probe
taagcgaggtgggcgacaacccagtcgtcttctcacacaacaacaccacccgttttgcaa

SEQ ID NO: 6728 - DNA, 60 bp, Artificial Sequence
  Description of Artificial Sequence: Synthetic probe
ccttcgttcttgacaggtttgtgaaactcactgcacccaagaacactcagacccttgacc

SEQ ID NO: 6729 - DNA, 60 bp, Artificial Sequence
  Description of Artificial Sequence: Synthetic probe
ccagttcacgttcgctgtgccctacgtctctgccagtgacttctcctacacccacacaga

SEQ ID NO: 6730 - DNA, 60 bp, Artificial Sequence
  Description of Artificial Sequence: Synthetic probe
accagttcatcaacccacggaccaacaccactgcacacatccaggttccctacctgggtg

SEQ ID NO: 6731 - DNA, 60 bp, Artificial Sequence
  Description of Artificial Sequence: Synthetic probe
accactaccgttgagaactacggaggagagactcaggtccaacgtcgccaccacaccgac

SEQ ID NO: 6732 - DNA, 60 bp, Artificial Sequence
  Description of Artificial Sequence: Synthetic probe
tggaaattgcttgcgttggcacacacacacgcgtgtggtggcaacccaacggtgcgccgc

SEQ ID NO: 6733 - DNA, 59 bp, Artificial Sequence
  Description of Artificial Sequence: Synthetic probe
ttgtcatggacaggttcacccacgtccacaccaacaagaccagcacagtgattgactta

SEQ ID NO: 6734 - DNA, 60 bp, Artificial Sequence
  Description of Artificial Sequence: Synthetic probe
ttcgtcatggacaggttcacccacgtccacaccaaccagactagcacagtgattgacttg

SEQ ID NO: 6735 - DNA, 60 bp, Artificial Sequence
  Description of Artificial Sequence: Synthetic probe
gacggagaagaggcgcatgcacaccgatgtcgcctttgtcatggacaggttcacccacgt

SEQ ID NO: 6736 - DNA, 60 bp, Artificial Sequence
  Description of Artificial Sequence: Synthetic probe
tgtgacggagaagaggcgcatgcacaccgatgtcgccttcgtcatggacaggttcaccca

SEQ ID NO: 6737 - DNA, 60 bp, Artificial Sequence
  Description of Artificial Sequence: Synthetic probe
ccacggtgggtccgtgacggagaagaggcgcatgcacaccgatgtcgcctttgtcatgga

SEQ ID NO: 6738 - DNA, 50 bp, Artificial Sequence
  Description of Artificial Sequence: Synthetic probe
agcacggacaccacgtccacgcataccaacaacacccagaacaacgattg

SEQ ID NO: 6739 - DNA, 59 bp, Artificial Sequence
  Description of Artificial Sequence: Synthetic probe
agtgttcggtactgcctacctcgtgcctcgccatcttttcgctgagaagtatgacaaga

SEQ ID NO: 6740 - DNA, 60 bp, Artificial Sequence
  Description of Artificial Sequence: Synthetic probe
ggagtgtttggtaccgcctatctcgtgcctcgccatcttttcgctgagaagtatgacaag

SEQ ID NO: 6741 - DNA, 60 bp, Artificial Sequence
  Description of Artificial Sequence: Synthetic probe
cactggagtgtttggtaccgcctatctcgtgcctcgccatcttttcgctgagaagtatga

SEQ ID NO: 6742 - DNA, 60 bp, Artificial Sequence
  Description of Artificial Sequence: Synthetic probe
ctactgcccacgctttctgctcaccacgtacgaccacgacggagctgacaggtacaagac

SEQ ID NO: 6743 - DNA, 60 bp, Artificial Sequence
  Description of Artificial Sequence: Synthetic probe
tgagaatgaagagggctgagctctactgcccacgctttctgctcaccacgtacgaccaca

SEQ ID NO: 6744 - DNA, 60 bp, Artificial Sequence
  Description of Artificial Sequence: Synthetic probe
gcgtcgctgaggagactcacatcccgaccactttcaactacgggatgatcttgaccgaaa

SEQ ID NO: 6745 - DNA, 60 bp, Artificial Sequence
  Description of Artificial Sequence: Synthetic probe
cgacgcatccgcgcacggaggtaacactcgccctacacggcgggttcacaccgacgtcgc

SEQ ID NO: 6746 - DNA, 60 bp, Artificial Sequence
  Description of Artificial Sequence: Synthetic probe
tcgtcacgaccgacgcatccgcgcacggaggtaacactcgccctacacggcgggttcaca

SEQ ID NO: 6747 - DNA, 60 bp, Artificial Sequence
  Description of Artificial Sequence: Synthetic probe
cacccgactgaagctagacacaagcagaagattgtggcacctgtgaaacagactttgaac

SEQ ID NO: 6748 - DNA, 60 bp, Artificial Sequence
  Description of Artificial Sequence: Synthetic probe
caaagcaactcgggtcactgagctgctctatcggatgaagagggctgaaacatactgccc

SEQ ID NO: 6749 - DNA, 60 bp, Artificial Sequence
  Description of Artificial Sequence: Synthetic probe
aactatggtgccatcaaagcaactcgggtcactgagctgctctatcggatgaagagggct

SEQ ID NO: 6750 - DNA, 60 bp, Artificial Sequence
  Description of Artificial Sequence: Synthetic probe
gctggctcacaaagcggcgcggtcactgcctacctccttcaactatggtgccatcaaagc

SEQ ID NO: 6751 - DNA, 60 bp, Artificial Sequence
  Description of Artificial Sequence: Synthetic probe
acctccaagcgctggctcacaaagcggcgcggtcactgcctacctccttcaactatggtg

SEQ ID NO: 6752 - DNA, 60 bp, Artificial Sequence
  Description of Artificial Sequence: Synthetic probe
ggtgcaggtacagcagagatgttgtgaccaacgtgataggagacctccaagcgctggctc

SEQ ID NO: 6753 - DNA, 60 bp, Artificial Sequence
  Description of Artificial Sequence: Synthetic probe
caacggtaggtgcaggtacagcagagatgttgtgaccaacgtgataggagacctccaagc

SEQ ID NO: 6754 - DNA, 60 bp, Artificial Sequence
  Description of Artificial Sequence: Synthetic probe
cgagggagacctcacttgggtcccgaacggggcgcctgaacaggcgttggacaacaccac

SEQ ID NO: 6755 - DNA, 60 bp, Artificial Sequence
  Description of Artificial Sequence: Synthetic probe
ctgatgcagatccctggacacaccttggtgggagcacttctccgcgcctccacatactac

SEQ ID NO: 6756 - DNA, 60 bp, Artificial Sequence
  Description of Artificial Sequence: Synthetic probe
taatgtattggacctgatgcagatccctggacacaccttggtgggagcacttctccgcgc

SEQ ID NO: 6757 - DNA, 55 bp, Artificial Sequence
  Description of Artificial Sequence: Synthetic probe
gacaacttctgcgggtgaatcagcagacccagtgacttccaccgttgagaattac

SEQ ID NO: 6758 - DNA, 60 bp, Artificial Sequence
  Description of Artificial Sequence: Synthetic probe
ctttgagttgagactgccggtggacgctcgcacacagacaacttctgcgggtgaatcagc

SEQ ID NO: 6759 - DNA, 60 bp, Artificial Sequence
  Description of Artificial Sequence: Synthetic probe
agcgctggaaaggactttgagttgagactgccggtggacgctcgcacacagacaacttct

SEQ ID NO: 6760 - DNA, 60 bp, Artificial Sequence
  Description of Artificial Sequence: Synthetic probe
cacggcaaggcagacggtgatgcactggtcgtactggctagcgctggaaaggactttgag

SEQ ID NO: 6761 - DNA, 60 bp, Artificial Sequence
  Description of Artificial Sequence: Synthetic probe
ttcaaattacacacggcaaggcagacggtgatgcactggtcgtactggctagcgctggaa

SEQ ID NO: 6762 - DNA, 60 bp, Artificial Sequence
  Description of Artificial Sequence: Synthetic probe
ggctgaaaccacaaacgtgcaggggtggatctgtttgtttcaaattacacacggcaaggc

SEQ ID NO: 6763 - DNA, 60 bp, Artificial Sequence
  Description of Artificial Sequence: Synthetic probe
cgcgtctgacgtggctgaaaccacaaacgtgcaggggtggatctgtttgtttcaaattac

SEQ ID NO: 6764 - DNA, 60 bp, Artificial Sequence
  Description of Artificial Sequence: Synthetic probe
gcggctgcccactgcatccatgctgagtgggacaccgggttgaattcaaagttcactttc

SEQ ID NO: 6765 - DNA, 60 bp, Artificial Sequence
  Description of Artificial Sequence: Synthetic probe
tatgccccaccgggcatggacccgcccaacacacctgaggcggctgcccactgcatccat

SEQ ID NO: 6766 - DNA, 60 bp, Artificial Sequence
  Description of Artificial Sequence: Synthetic probe
acatggttgcttatgccccaccgggcatggacccgcccaacacacctgaggcggctgccc

SEQ ID NO: 6767 - DNA, 60 bp, Artificial Sequence
  Description of Artificial Sequence: Synthetic probe
ttcatgttcacagggcccactgacgccaaggcgcgttacatggttgcttatgccccaccg

SEQ ID NO: 6768 - DNA, 60 bp, Artificial Sequence
  Description of Artificial Sequence: Synthetic probe
catcaacctgcacttcatgttcacagggcccactgacgccaaggcgcgttacatggttgc

SEQ ID NO: 6769 - DNA, 51 bp, Artificial Sequence
  Description of Artificial Sequence: Synthetic probe
cactgagcctttgatccgcatgaaacgcgcggagacatactgccccaggcc

SEQ ID NO: 6770 - DNA, 60 bp, Artificial Sequence
  Description of Artificial Sequence: Synthetic probe
gacagacataagcagaggatcattgcgcctgcaaaacagcttctgaactttgacctgctc

SEQ ID NO: 6771 - DNA, 60 bp, Artificial Sequence
  Description of Artificial Sequence: Synthetic probe
cggcacaggacagacataagcagaggatcattgcgcctgcaaaacagcttctgaacttcg

SEQ ID NO: 6772 - DNA, 60 bp, Artificial Sequence
  Description of Artificial Sequence: Synthetic probe
acgacacaggacagacataagcagaggatcattgcgcctgcaaaacagcttctgaacttt

SEQ ID NO: 6773 - DNA, 60 bp, Artificial Sequence
  Description of Artificial Sequence: Synthetic probe
aggtaacggcacaggacagacataagcagaggatcattgcgcctgcaaaacagcttctga

SEQ ID NO: 6774 - DNA, 60 bp, Artificial Sequence
  Description of Artificial Sequence: Synthetic probe
ggtgagaagaagactttctactctagacccaacaaccatgacaactgttggctgaacacc

SEQ ID NO: 6775 - DNA, 60 bp, Artificial Sequence
  Description of Artificial Sequence: Synthetic probe
acaacggtgagaagaagactttctactctagacccaacaaccatgacaactgttggctga

SEQ ID NO: 6776 - DNA, 60 bp, Artificial Sequence
  Description of Artificial Sequence: Synthetic probe
gcttgcgctcccctacactgcgccacaccgcgtgttggcaacagtgtacaacgggacaaa

SEQ ID NO: 6777 - DNA, 59 bp, Artificial Sequence
  Description of Artificial Sequence: Synthetic probe
cgggtgactgagctgctttatcgcatcaagcgggccgagacgtactgtcccaggcccct

SEQ ID NO: 6778 - DNA, 60 bp, Artificial Sequence
  Description of Artificial Sequence: Synthetic probe
cgggtgactgagctgctttatcgcatcaagcgggccgagacgtactgtcccaggcccctt

SEQ ID NO: 6779 - DNA, 60 bp, Artificial Sequence
  Description of Artificial Sequence: Synthetic probe
acacaccgtgaccaatgtgagaggggacctccaagtgttggcccaaaaggcagcgcggac

SEQ ID NO: 6780 - DNA, 60 bp, Artificial Sequence
  Description of Artificial Sequence: Synthetic probe
gcacacaccgtgaccaatgtgagaggggacctccaagtgttggcccaaaaggcagcgcgg

SEQ ID NO: 6781 - DNA, 56 bp, Artificial Sequence
  Description of Artificial Sequence: Synthetic probe
cgccgcaccgcgtgctggcgactgtgtacaacgggaactgcaggtacggtgcacac

SEQ ID NO: 6782 - DNA, 60 bp, Artificial Sequence
  Description of Artificial Sequence: Synthetic probe
cgccgcaccgcgtgctggcgactgtgtacaacgggaactgcaggtacggtgcacacaccg

SEQ ID NO: 6783 - DNA, 60 bp, Artificial Sequence
  Description of Artificial Sequence: Synthetic probe
aacagcctaccacaaggcaccccttactcgacttgctctgccctacacagcgccgcaccg

SEQ ID NO: 6784 - DNA, 60 bp, Artificial Sequence
  Description of Artificial Sequence: Synthetic probe
agctggctggcacacgagggaaacctcacctgggttcccaatggggccccagagacggcc

SEQ ID NO: 6785 - DNA, 51 bp, Artificial Sequence
  Description of Artificial Sequence: Synthetic probe
agctggctggcacacgagggaaacctcacctgggttcccaatggggcccca

SEQ ID NO: 6786 - DNA, 60 bp, Artificial Sequence
  Description of Artificial Sequence: Synthetic probe
gaaggcggcgagagcgctgcctacctccttcaactacggtgccattaaagctactcgggt

SEQ ID NO: 6787 - DNA, 53 bp, Artificial Sequence
  Description of Artificial Sequence: Synthetic probe
cgtcgcaaagcaggcacaaacaaaagatcattgcaccagcaaagcaacttctc

SEQ ID NO: 6788 - DNA, 60 bp, Artificial Sequence
  Description of Artificial Sequence: Synthetic probe
gaaacgcgccgaactttactgccccaggccactactggcagtagaggtatcgtcgcaaag

SEQ ID NO: 6789 - DNA, 60 bp, Artificial Sequence
  Description of Artificial Sequence: Synthetic probe
tcgggccacgaacatccaagagcttctcgtgcgcatgaaacgcgccgaactttactgccc

SEQ ID NO: 6790 - DNA, 60 bp, Artificial Sequence
  Description of Artificial Sequence: Synthetic probe
aactttggtgcaattcgggccacgaacatccaagagcttctcgtgcgcatgaaacgcgcc

SEQ ID NO: 6791 - DNA, 60 bp, Artificial Sequence
  Description of Artificial Sequence: Synthetic probe
aggcacgggttgccgcacagcttcctgcctctttcaactttggtgcaattcgggccacga

SEQ ID NO: 6792 - DNA, 60 bp, Artificial Sequence
  Description of Artificial Sequence: Synthetic probe
accccgggtctcttgaggcacgggttgccgcacagcttcctgcctctttcaactttggtg

SEQ ID NO: 6793 - DNA, 60 bp, Artificial Sequence
  Description of Artificial Sequence: Synthetic probe
caagcaaccgttcacgaggcttgcgctcccctacactgcaccacaccgtgtgttggcaac

SEQ ID NO: 6794 - DNA, 60 bp, Artificial Sequence
  Description of Artificial Sequence: Synthetic probe
gattgtggtgcgccatgaaggcaatctgacgtgggtgcccaatggaacgcccgaggtggc

SEQ ID NO: 6795 - DNA, 60 bp, Artificial Sequence
  Description of Artificial Sequence: Synthetic probe
ctgtgacccccacgcacgtcattgacctcatgcagactcaccagcacgcgttggtgggcg

SEQ ID NO: 6796 - DNA, 53 bp, Artificial Sequence
  Description of Artificial Sequence: Synthetic probe
accactgcgaccggggaatctgcagaccctgtcaccaccactgtagagaactt

SEQ ID NO: 6797 - DNA, 60 bp, Artificial Sequence
  Description of Artificial Sequence: Synthetic probe
cacgactgacacaaaccgtgcaacttgaagctccgcctggtctttccaggtctagagggg

SEQ ID NO: 6798 - DNA, 60 bp, Artificial Sequence
  Description of Artificial Sequence: Synthetic probe
caggattccacaactgacacaaaccgtgcaacttgaagctccgcctggtctttccaggtc

SEQ ID NO: 6799 - DNA, 60 bp, Artificial Sequence
  Description of Artificial Sequence: Synthetic probe
atctatgcaggtttccacgactgacacaaaccgtgcaacttgaagctccgcctggtcttt

SEQ ID NO: 6800 - DNA, 60 bp, Artificial Sequence
  Description of Artificial Sequence: Synthetic probe
gtcggcgcacgaaacgcgccgtcgcttgaggaagacttgtacaaacacgatctatgcagg

SEQ ID NO: 6801 - DNA, 60 bp, Artificial Sequence
  Description of Artificial Sequence: Synthetic probe
gtctgcgcacgaaacgcgccgtcccttgaggaagacttgtacaaacacgatctatgcagg

SEQ ID NO: 6802 - DNA, 60 bp, Artificial Sequence
  Description of Artificial Sequence: Synthetic probe
cgtctgcgcacgaaacgcgccgtcccttgaggaagacttgtacaaacacgatctatgcag

SEQ ID NO: 6803 - DNA, 60 bp, Artificial Sequence
  Description of Artificial Sequence: Synthetic probe
ttggacggccgcgccctgacagacagtgacttcagagtgtttgagttcgaggtaaaagta

SEQ ID NO: 6804 - DNA, 60 bp, Artificial Sequence
  Description of Artificial Sequence: Synthetic probe
aggtactgaactttgacctgctgaagttggcgggagacgtggagtccaaccctgggccct

SEQ ID NO: 6805 - DNA, 60 bp, Artificial Sequence
  Description of Artificial Sequence: Synthetic probe
tagcccagaaggcggcaagaacgctgcctacctccttcaactacggtgccatcaaggcca

SEQ ID NO: 6806 - DNA, 60 bp, Artificial Sequence
  Description of Artificial Sequence: Synthetic probe
ttgtgaaaataaacaacacaagtcccacccatgtcattgacctcatgcaaacccaccaac

SEQ ID NO: 6807 - DNA, 60 bp, Artificial Sequence
  Description of Artificial Sequence: Synthetic probe
tacttctcagacctggaggttgcgcttgtccacacaggccccgtcacatgggtgcccaat

SEQ ID NO: 6808 - DNA, 60 bp, Artificial Sequence
  Description of Artificial Sequence: Synthetic probe
tacttctcagacctggaggttgcgcttgtccacacgggcccggtcacgtgggtgcctaac

SEQ ID NO: 6809 - DNA, 57 bp, Artificial Sequence
  Description of Artificial Sequence: Synthetic probe
ccacaaggcaccgcttcacccggcttgcactgccttacacggcaccacaccgtgtat

SEQ ID NO: 6810 - DNA, 52 bp, Artificial Sequence
  Description of Artificial Sequence: Synthetic probe
agagttggatgaggtgggcgacaacccagtcgtcttctcacacaacggtgcc

SEQ ID NO: 6811 - DNA, 60 bp, Artificial Sequence
  Description of Artificial Sequence: Synthetic probe
gcgccagagttgaatgaggtgggcgacaacccagtcgtcttctcacacaacggtgccact

SEQ ID NO: 6812 - DNA, 60 bp, Artificial Sequence
  Description of Artificial Sequence: Synthetic probe
aacggagcgccagagttgaatgaggtgggcgacaacccagtcgtcttctcacgcaacggt

SEQ ID NO: 6813 - DNA, 60 bp, Artificial Sequence
  Description of Artificial Sequence: Synthetic probe
tggactccgaacggagcgccagagttgaatgaggtgggcgacaacccagtcgtcttctca

SEQ ID NO: 6814 - DNA, 60 bp, Artificial Sequence
  Description of Artificial Sequence: Synthetic probe
gagcttctcgtgcgcatgaaacgggccgagctctactgccccaggccactgctggcagta

SEQ ID NO: 6815 - DNA, 58 bp, Artificial Sequence
  Description of Artificial Sequence: Synthetic probe
gagataacccaatggtcttctcccacaacaacgtgacgcggtttgcgatcccgtacac

SEQ ID NO: 6816 - DNA, 59 bp, Artificial Sequence
  Description of Artificial Sequence: Synthetic probe
cggcctctcttggccattcacccgaatgaggctagacacaagcagaagattgtggcacc

SEQ ID NO: 6817 - DNA, 60 bp, Artificial Sequence
  Description of Artificial Sequence: Synthetic probe
cgccctctcctgacacactacgaccacggcggaaaggatcgctacaagatcgcgataacc

SEQ ID NO: 6818 - DNA, 60 bp, Artificial Sequence
  Description of Artificial Sequence: Synthetic probe
cgtcctctcctgacacactacgaccacggcggaaaggatcgctacaagactgcgattaca

SEQ ID NO: 6819 - DNA, 60 bp, Artificial Sequence
  Description of Artificial Sequence: Synthetic probe
cgccctctcctgacacactacgaccacggcggaaaggatcgctacaagactgcgataacc

SEQ ID NO: 6820 - DNA, 60 bp, Artificial Sequence
  Description of Artificial Sequence: Synthetic probe
ttggtgtgaacaagtgggtcggctggacccctaacggggcaccagagctcggagaggtgg

SEQ ID NO: 6821 - DNA, 60 bp, Artificial Sequence
  Description of Artificial Sequence: Synthetic probe
gttggtgtgaacaagtgggtcggctggacccctaacggggcaccagagctcggagaggtg

SEQ ID NO: 6822 - DNA, 60 bp, Artificial Sequence
  Description of Artificial Sequence: Synthetic probe
ctacggtggtgagacacaggtccagcggcgtcaccacactgatgtcggcttcataatgga

SEQ ID NO: 6823 - DNA, 60 bp, Artificial Sequence
  Description of Artificial Sequence: Synthetic probe
gtctgcgacgtactacttctcagacctggaggttgcgcttgttcacacaggcccagccac

SEQ ID NO: 6824 - DNA, 60 bp, Artificial Sequence
  Description of Artificial Sequence: Synthetic probe
gggacctcgcaactcttgcggcgaggattgcaagcgagacgcacatcccaaccaccttta

SEQ ID NO: 6825 - DNA, 60 bp, Artificial Sequence
  Description of Artificial Sequence: Synthetic probe
cattcgtggggacctcgcaactcttgcggcgaggattgcaagcgagacgcacatcccaac

SEQ ID NO: 6826 - DNA, 60 bp, Artificial Sequence
  Description of Artificial Sequence: Synthetic probe
cccgttttgcactgccttacactgccccacacaggtgcttggcaacatcgtacaacggtg

SEQ ID NO: 6827 - DNA, 60 bp, Artificial Sequence
  Description of Artificial Sequence: Synthetic probe
tcccaccaccttcaactacggcaggatttacacacaggctgaggttgacgtgtacgtcag

SEQ ID NO: 6828 - DNA, 60 bp, Artificial Sequence
  Description of Artificial Sequence: Synthetic probe
aagtgagacacacattcccaccaccttcaactacggcaggatttacacacaggctgaggt

SEQ ID NO: 6829 - DNA, 60 bp, Artificial Sequence
  Description of Artificial Sequence: Synthetic probe
tccgcggagacctcgcaactcttgcggcgaggattgcaagtgagacacacattcccacca

SEQ ID NO: 6830 - DNA, 60 bp, Artificial Sequence
  Description of Artificial Sequence: Synthetic probe
ccgcgtgagaacatccgcggagacctcgcaactcttgcggcgaggattgcaagtgagaca

SEQ ID NO: 6831 - DNA, 60 bp, Artificial Sequence
  Description of Artificial Sequence: Synthetic probe
aacggtgactgcaagtacaaacccactagcacagccccgcgtgagaacatccgcggagac

SEQ ID NO: 6832 - DNA, 60 bp, Artificial Sequence
  Description of Artificial Sequence: Synthetic probe
tcacatgggtgcccaacggtgcaccagtttctgcgcttgacaatacaagcaaccccactg

SEQ ID NO: 6833 - DNA, 60 bp, Artificial Sequence
  Description of Artificial Sequence: Synthetic probe
tggcaagctcacatgggtgcccaacggtgcaccagtttctgcgcttgacaacacaagcaa

SEQ ID NO: 6834 - DNA, 60 bp, Artificial Sequence
  Description of Artificial Sequence: Synthetic probe
tgacccacactggcaagctcacatgggtgcccaacggtgcaccagtttctgcgcttgaca

SEQ ID NO: 6835 - DNA, 60 bp, Artificial Sequence
  Description of Artificial Sequence: Synthetic probe
agaaggtgagtgatgacgtggactccgagcccaccgaacctgcgagagagcaaccacaag

SEQ ID NO: 6836 - DNA, 60 bp, Artificial Sequence
  Description of Artificial Sequence: Synthetic probe
caggacagaaggtgagtgatgacgtggactccgagcccaccgaacctgcgagagagcaac

SEQ ID NO: 6837 - DNA, 60 bp, Artificial Sequence
  Description of Artificial Sequence: Synthetic probe
tcaggagactagcagtgccagcactgttggcttcagagagaggactcttccaggacagaa

SEQ ID NO: 6838 - DNA, 60 bp, Artificial Sequence
  Description of Artificial Sequence: Synthetic probe
gtgaaacgtgcgttcagacgcctgaaggaaaactttgagattgttgccctatgtttgacc

SEQ ID NO: 6839 - DNA, 60 bp, Artificial Sequence
  Description of Artificial Sequence: Synthetic probe
caacagacctcatttgtgaaacgtgcgttcagacgcctgaaggaaaactttgagattgtt

SEQ ID NO: 6840 - DNA, 60 bp, Artificial Sequence
  Description of Artificial Sequence: Synthetic probe
ggggatggtcagtgactccgtcaaggaggagctccgacccctcatccaacagacctcatt

SEQ ID NO: 6841 - DNA, 60 bp, Artificial Sequence
  Description of Artificial Sequence: Synthetic probe
ttgaggggatggtcagtgactccgtcaaggaggagctccgacccctcatccaacagacct

SEQ ID NO: 6842 - DNA, 60 bp, Artificial Sequence
  Description of Artificial Sequence: Synthetic probe
cactgtttctcacacgagtcacaggaaagatggaattcacacttcacaacggtgagaaaa

SEQ ID NO: 6843 - DNA, 60 bp, Artificial Sequence
  Description of Artificial Sequence: Synthetic probe
caagacactgtttcttaaacgaaacacaggaaagatggaattcacacttcacaacggtga

SEQ ID NO: 6844 - DNA, 60 bp, Artificial Sequence
  Description of Artificial Sequence: Synthetic probe
caagacactgtttcttacacgaaacacaggaaagatggaattcacacttcacaacggtga

SEQ ID NO: 6845 - DNA, 60 bp, Artificial Sequence
  Description of Artificial Sequence: Synthetic probe
caaaacactgtttctcacacgagtcacaggaaagatggaattcacacttcacaacggtga

SEQ ID NO: 6846 - DNA, 60 bp, Artificial Sequence
  Description of Artificial Sequence: Synthetic probe
agaactacggaggagaaactcagacagccagacggcttcacactgacgttgcctttgttc

SEQ ID NO: 6847 - DNA, 60 bp, Artificial Sequence
  Description of Artificial Sequence: Synthetic probe
atactacttctctgccttggaaatagcagtgacccacactgggaagctcacatgggtgcc

SEQ ID NO: 6848 - DNA, 60 bp, Artificial Sequence
  Description of Artificial Sequence: Synthetic probe
cacatactacttctctgccttggaaatagcagtgacccacactgggaagctcacatgggt

SEQ ID NO: 6849 - DNA, 60 bp, Artificial Sequence
  Description of Artificial Sequence: Synthetic probe
cacgtactacttttctgacctggaaatagcagtgacccacactgggaagctcacatgggt

SEQ ID NO: 6850 - DNA, 60 bp, Artificial Sequence
  Description of Artificial Sequence: Synthetic probe
cacgtactacttttctgattcggaaatagcagtgacccacactgggaagctcacatgggt

SEQ ID NO: 6851 - DNA, 60 bp, Artificial Sequence
  Description of Artificial Sequence: Synthetic probe
gaacaagaccaccttcaacgtggacctcatggacaccaaggacaagaccctagtaggtgc

SEQ ID NO: 6852 - DNA, 60 bp, Artificial Sequence
  Description of Artificial Sequence: Synthetic probe
cgaacaagaccaccttcaacgtggacctcatggacaccaaggacaagaccctagtaggtg

SEQ ID NO: 6853 - DNA, 60 bp, Artificial Sequence
  Description of Artificial Sequence: Synthetic probe
acgcatgttcacacgaacaagaccaccttcaacgtggacctcatggacaccaaggacaag

SEQ ID NO: 6854 - DNA, 60 bp, Artificial Sequence
  Description of Artificial Sequence: Synthetic probe
agcgtgctgaactttactgccccagaccacttctcccggcctacgatcacgcaaaccggg

SEQ ID NO: 6855 - DNA, 60 bp, Artificial Sequence
  Description of Artificial Sequence: Synthetic probe
tgaagcgtgctgaactttactgccccagaccacttctctcggcctacgatcacgcaggcc

SEQ ID NO: 6856 - DNA, 60 bp, Artificial Sequence
  Description of Artificial Sequence: Synthetic probe
gatgaagcgtgctgaactttactgccccagaccacttctctcggcctacgatcacgcagg

SEQ ID NO: 6857 - DNA, 60 bp, Artificial Sequence
  Description of Artificial Sequence: Synthetic probe
ctcaggaggttgtcggacaaacccatgccggcttccgtgagagaaagctccccgggcaca

SEQ ID NO: 6858 - DNA, 60 bp, Artificial Sequence
  Description of Artificial Sequence: Synthetic probe
gcggagaagaaccctcaggaggttgtcggacaaacccatgccggcttccgtgagagaaag

SEQ ID NO: 6859 - DNA, 52 bp, Artificial Sequence
  Description of Artificial Sequence: Synthetic probe
gctgttggcaaacatcatcattatgatccgtgagactcgcaagagacagaag

SEQ ID NO: 6860 - DNA, 60 bp, Artificial Sequence
  Description of Artificial Sequence: Synthetic probe
agccgcttctcgagcaaaccagcttcgcgaagcgcgctttcaagcgcctgaaggagaact

SEQ ID NO: 6861 - DNA, 60 bp, Artificial Sequence
  Description of Artificial Sequence: Synthetic probe
tcaaggaagagcttaagccgcttctcgagcaaaccagcttcgcgaagcgcgctttcaagc

SEQ ID NO: 6862 - DNA, 60 bp, Artificial Sequence
  Description of Artificial Sequence: Synthetic probe
gcccgagccagcaattgaattttacgagggaatggtgaccgacagcatcaaggaagagct

SEQ ID NO: 6863 - DNA, 60 bp, Artificial Sequence
  Description of Artificial Sequence: Synthetic probe
acagcccgagccagcaattgaattttacgagggaatggtgaccgacagcatcaaggaaga

SEQ ID NO: 6864 - DNA, 60 bp, Artificial Sequence
  Description of Artificial Sequence: Synthetic probe
ccacatggattatggaactgggttttacaaacctgtgatggcctcgaagaccctcgaggc

SEQ ID NO: 6865 - DNA, 60 bp, Artificial Sequence
  Description of Artificial Sequence: Synthetic probe
ccgcatggactatggaactgggttttacaaacctgtgatggcctcaaagacccttgaggc

SEQ ID NO: 6866 - DNA, 60 bp, Artificial Sequence
  Description of Artificial Sequence: Synthetic probe
cctcgagggtcttcgaggccatcacaggtttgtaaaacccagttccatagtccatgtgga

SEQ ID NO: 6867 - DNA, 60 bp, Artificial Sequence
  Description of Artificial Sequence: Synthetic probe
gcatttccacatggattatggaactgggttttacaaacctgtgatggcctcgaagaccct

SEQ ID NO: 6868 - DNA, 60 bp, Artificial Sequence
  Description of Artificial Sequence: Synthetic probe
gacacttccacatggattatggaactgggttttacaaacctgtgatggcctcaaagaccc

SEQ ID NO: 6869 - DNA, 60 bp, Artificial Sequence
  Description of Artificial Sequence: Synthetic probe
tcaaaagacacttccgcatggactatggaactgggttttacaaacctgtgatggcctcaa

SEQ ID NO: 6870 - DNA, 58 bp, Artificial Sequence
  Description of Artificial Sequence: Synthetic probe
caacaaagtgacacgcttcgccatcccttacactgcacctcaccggttgcttgcaacc

SEQ ID NO: 6871 - DNA, 60 bp, Artificial Sequence
  Description of Artificial Sequence: Synthetic probe
ctcgcacaacaaagtgacacgcttcgccatcccttacactgcacctcaccggttgcttgc

SEQ ID NO: 6872 - DNA, 60 bp, Artificial Sequence
  Description of Artificial Sequence: Synthetic probe
ggtcttctcgcacaacaaagtgacacgcttcgccatcccttacactgcacctcaccggtt

SEQ ID NO: 6873 - DNA, 60 bp, Artificial Sequence
  Description of Artificial Sequence: Synthetic probe
gatggtcttctcgcacaacaaagtgacacgcttcgccatcccttacactgcacctcaccg

SEQ ID NO: 6874 - DNA, 58 bp, Artificial Sequence
  Description of Artificial Sequence: Synthetic probe
atctttcaactacggggcgctgcgtgccgaggccatccacgagcttctcgtgcgcatg

SEQ ID NO: 6875 - DNA, 60 bp, Artificial Sequence
  Description of Artificial Sequence: Synthetic probe
ccccacagcttaccacaaggcgccgtttacgagactggcacttccctacactgcaccaca

SEQ ID NO: 6876 - DNA, 60 bp, Artificial Sequence
  Description of Artificial Sequence: Synthetic probe
cgcaaacacgagcaaccccacagcttaccacaaggcgccgtttacgagactggcacttcc

SEQ ID NO: 6877 - DNA, 60 bp, Artificial Sequence
  Description of Artificial Sequence: Synthetic probe
caccaggggaacctgacctgggtgcccaacggcgccccggaggcagctctcgcaaacacg

SEQ ID NO: 6878 - DNA, 60 bp, Artificial Sequence
  Description of Artificial Sequence: Synthetic probe
atccacgagctcctcgtgcgcatgaaacgggccgaactctactgtcccaggccactcctg

SEQ ID NO: 6879 - DNA, 60 bp, Artificial Sequence
  Description of Artificial Sequence: Synthetic probe
cgccatccacgagctcctcgtgcgcatgaaacgggccgaactctactgtcccaggccact

SEQ ID NO: 6880 - DNA, 60 bp, Artificial Sequence
  Description of Artificial Sequence: Synthetic probe
acacccgaccctgaaaacgtgctcgcgtacgtgccctacgaccaggaacctttggacgta

SEQ ID NO: 6881 - DNA, 60 bp, Artificial Sequence
  Description of Artificial Sequence: Synthetic probe
ttcaaactggcgttggcaccagcactcgtcccagcgagatctgtgtgatcaacggggtcg

SEQ ID NO: 6882 - DNA, 60 bp, Artificial Sequence
  Description of Artificial Sequence: Synthetic probe
tgtcttcaaactggcgttggcaccagcactcgtcccagcgagatctgtgtgatcaacggg

SEQ ID NO: 6883 - DNA, 60 bp, Artificial Sequence
  Description of Artificial Sequence: Synthetic probe
atggtgggcctcccgccctcgtcctctggctgatcaaggattgtcttcaaactggcgttg

SEQ ID NO: 6884 - DNA, 60 bp, Artificial Sequence
  Description of Artificial Sequence: Synthetic probe
acttgtcggatggtgggcctcccgccctcgtcctctggctgatcaaggattgtcttcaaa

SEQ ID NO: 6885 - DNA, 56 bp, Artificial Sequence
  Description of Artificial Sequence: Synthetic probe
tacagctctttcgatacgtcgatgagcccctgttcgagtctgagtacttgtcacct

SEQ ID NO: 6886 - DNA, 60 bp, Artificial Sequence
  Description of Artificial Sequence: Synthetic probe
ggcctaacacacacgggaactgttggctcaactcgctcttacagctctttcgatacgtcg

SEQ ID NO: 6887 - DNA, 60 bp, Artificial Sequence
  Description of Artificial Sequence: Synthetic probe
cttctacagcaggcctaacacacacgggaactgttggctcaactcgctcttacagctctt

SEQ ID NO: 6888 - DNA, 50 bp, Artificial Sequence
  Description of Artificial Sequence: Synthetic probe
atgaagacaactgactgttttagcgttttgctcgagatcttccacaggtt

SEQ ID NO: 6889 - DNA, 60 bp, Artificial Sequence
  Description of Artificial Sequence: Synthetic probe
ggtcgacgtgtacgtcaggatgaagcgcgcggagctctactgcccgcgacctgttctcac

SEQ ID NO: 6890 - DNA, 60 bp, Artificial Sequence
  Description of Artificial Sequence: Synthetic probe
ttacacagaagctgaggtcgacgtgtacgtcaggatgaagcgcgcggagctctactgccc

SEQ ID NO: 6891 - DNA, 60 bp, Artificial Sequence
  Description of Artificial Sequence: Synthetic probe
ttacacagacactgaggtcgacgtgtacgtcaggatgaagcgcgcggagctctactgccc

SEQ ID NO: 6892 - DNA, 60 bp, Artificial Sequence
  Description of Artificial Sequence: Synthetic probe
ttacacagaagccgaggtcgacgtgtacgtcaggatgaagcgcgcggagctttactgccc

SEQ ID NO: 6893 - DNA, 60 bp, Artificial Sequence
  Description of Artificial Sequence: Synthetic probe
ggatttacacagacactgaggtcgacgtgtacgtcaggatgaagcgcgcggagctctact

SEQ ID NO: 6894 - DNA, 60 bp, Artificial Sequence
  Description of Artificial Sequence: Synthetic probe
ggatttacacagaagccgaggtcgacgtgtacgtcaggatgaagcgcgcggagctttact

SEQ ID NO: 6895 - DNA, 60 bp, Artificial Sequence
  Description of Artificial Sequence: Synthetic probe
ggatttacacagaagctgaggtcgacgtgtacgtcaggatgaagcgcgcggagctctact

SEQ ID NO: 6896 - DNA, 60 bp, Artificial Sequence
  Description of Artificial Sequence: Synthetic probe
gtcaccactaccgttgagaactacggaggagagactcaagtccaacgtcgccaccacacc

SEQ ID NO: 6897 - DNA, 60 bp, Artificial Sequence
  Description of Artificial Sequence: Synthetic probe
accccgtcaccactaccgttgagaactacggaggagagactcaggtccaacgtcgccacc

SEQ ID NO: 6898 - DNA, 60 bp, Artificial Sequence
  Description of Artificial Sequence: Synthetic probe
acacggtggaagtgtagtcgagaagagacgaatgcacacagacgttgcgttcgtgcttga

SEQ ID NO: 6899 - DNA, 60 bp, Artificial Sequence
  Description of Artificial Sequence: Synthetic probe
acacggcggaagtgtagtagagaagaggcgaatgcacacagacgttgcgttcgtgcttga

SEQ ID NO: 6900 - DNA, 60 bp, Artificial Sequence
  Description of Artificial Sequence: Synthetic probe
ggcggtgagacacaagtccagagacgccaccacacagacgtcggcttcatcatggacaga

SEQ ID NO: 6901 - DNA, 60 bp, Artificial Sequence
  Description of Artificial Sequence: Synthetic probe
ccggggagtctgcagaccccgtcaccaccactgttgagaactacggcggtgagacacagg

SEQ ID NO: 6902 - DNA, 60 bp, Artificial Sequence
  Description of Artificial Sequence: Synthetic probe
accacttcggccggggagtctgcagaccccgtcaccaccactgttgagaactacggcggt

SEQ ID NO: 6903 - DNA, 60 bp, Artificial Sequence
  Description of Artificial Sequence: Synthetic probe
cacgtcattgacctcatgcaaacccaccaacacgggttggtgggcgctctcctgcgtgct

SEQ ID NO: 6904 - DNA, 54 bp, Artificial Sequence
  Description of Artificial Sequence: Synthetic probe
ctctggtgactgaactgctttaccgcatgaagagggccgaaacatactgccccc

SEQ ID NO: 6905 - DNA, 60 bp, Artificial Sequence
  Description of Artificial Sequence: Synthetic probe
aggcaacctgacgtgggtgcccaacggggcaccagaggcagccctgagcaacgcgggcaa

SEQ ID NO: 6906 - DNA, 60 bp, Artificial Sequence
  Description of Artificial Sequence: Synthetic probe
tccgcagaccctgtcaccaccaccgtggagaactacggcggtgatacacaagtccagaga

SEQ ID NO: 6907 - DNA, 60 bp, Artificial Sequence
  Description of Artificial Sequence: Synthetic probe
gagtccgcagaccctgtcaccaccaccgtggagaactacggcggtgatacacaagtccag

SEQ ID NO: 6908 - DNA, 60 bp, Artificial Sequence
  Description of Artificial Sequence: Synthetic probe
tacgttaggatgaaacgcgcggagctctactgcccgcgccctctcctgacacactacgac

SEQ ID NO: 6909 - DNA, 60 bp, Artificial Sequence
  Description of Artificial Sequence: Synthetic probe
actgacgttgccttcgttcttgaccggtttgtgaaggtccaagtgtcgggcaaccaacac

SEQ ID NO: 6910 - DNA, 60 bp, Artificial Sequence
  Description of Artificial Sequence: Synthetic probe
ccggagtgtttggcactgcctacctcgtgcctcgtcatcttttcgcagagaagtacgaca

SEQ ID NO: 6911 - DNA, 60 bp, Artificial Sequence
  Description of Artificial Sequence: Synthetic probe
cgctgccgtccacattcaactttggtcacgtcacagccgacgcagcggttgacgtgtact

SEQ ID NO: 6912 - DNA, 60 bp, Artificial Sequence
  Description of Artificial Sequence: Synthetic probe
acaacacacgctgccgtccacattcaactttggtcacgtcacagccgacgcagcggttga

SEQ ID NO: 6913 - DNA, 60 bp, Artificial Sequence
  Description of Artificial Sequence: Synthetic probe
caacccgatggttttctccaacaacggtgtcaccaggttcgctgtgccatacaccgcgcc

SEQ ID NO: 6914 - DNA, 60 bp, Artificial Sequence
  Description of Artificial Sequence: Synthetic probe
cgcgtgttctggcagcccaacggtgcgcctcggaccacccagcttggggacaacccgatg

SEQ ID NO: 6915 - DNA, 60 bp, Artificial Sequence
  Description of Artificial Sequence: Synthetic probe
cggcagggccatgacagaccgtgacttcagagtgtttgagtttgagattaaagtaaaagg

SEQ ID NO: 6916 - DNA, 60 bp, Artificial Sequence
  Description of Artificial Sequence: Synthetic probe
cggcagagccatgacagaccgtgacttcagagtgtttgagtttgagattaaagtaaaagg

SEQ ID NO: 6917 - DNA, 58 bp, Artificial Sequence
  Description of Artificial Sequence: Synthetic probe
gctggctcaattcattgctgcagctctttcgatacgtcgatgaaccgctctttgaatc

SEQ ID NO: 6918 - DNA, 60 bp, Artificial Sequence
  Description of Artificial Sequence: Synthetic probe
ccctcgcggcacgagtcgcgaaggcacttcctgcttctttcaactacggtgcaatcaagg

SEQ ID NO: 6919 - DNA, 60 bp, Artificial Sequence
  Description of Artificial Sequence: Synthetic probe
ggctccctcgcggcacgagtcgcgaaggcacttcctgcttctttcaactacggtgcggtc

SEQ ID NO: 6920 - DNA, 60 bp, Artificial Sequence
  Description of Artificial Sequence: Synthetic probe
aagtacactgtgagtgggtcaagcagacgaggcgacttgggctccctcgcggcacgagtc

SEQ ID NO: 6921 - DNA, 60 bp, Artificial Sequence
  Description of Artificial Sequence: Synthetic probe
tacaacaaggcaccgttcacgagacttgccctcccctacaccgcgccacaccgcgtgttg

SEQ ID NO: 6922 - DNA, 60 bp, Artificial Sequence
  Description of Artificial Sequence: Synthetic probe
cgcggcagaaacacacattccaaccactttcaactacggtaggatctacactgaggcgga

SEQ ID NO: 6923 - DNA, 60 bp, Artificial Sequence
  Description of Artificial Sequence: Synthetic probe
catcgcggcagaaacacacattccaaccactttcaactacggtaggatctacactgaggc

SEQ ID NO: 6924 - DNA, 60 bp, Artificial Sequence
  Description of Artificial Sequence: Synthetic probe
aacgttcgcggagaccttgcggtgctcgcagagcgcatcgcggcagaaacacacattcca

SEQ ID NO: 6925 - DNA, 60 bp, Artificial Sequence
  Description of Artificial Sequence: Synthetic probe
caagccccgcgaaccaacgttcgcggagaccttgcggtgctcgcagagcgcatcgcggca

SEQ ID NO: 6926 - DNA, 60 bp, Artificial Sequence
  Description of Artificial Sequence: Synthetic probe
cccgtcgtctttgcacacaacaacaccacccgatttgctctaccgtacaccgctccacac

SEQ ID NO: 6927 - DNA, 60 bp, Artificial Sequence
  Description of Artificial Sequence: Synthetic probe
caaccccgtcgtctttgcacacaacaacaccacccgatttgctctaccgtacaccgctcc

SEQ ID NO: 6928 - DNA, 60 bp, Artificial Sequence
  Description of Artificial Sequence: Synthetic probe
gggttggttggactcctaacggagcaccagagttgagtgaagttggcgacaaccccgtcg

SEQ ID NO: 6929 - DNA, 60 bp, Artificial Sequence
  Description of Artificial Sequence: Synthetic probe
tgggttggttggactcctaacggagcaccagagttgagtgaagttggcgacaaccccgtc

SEQ ID NO: 6930 - DNA, 60 bp, Artificial Sequence
  Description of Artificial Sequence: Synthetic probe
gagctgctcgtgcgcatgaagcgtgccgaactctactgccccagaccattgttggcggtg

SEQ ID NO: 6931 - DNA, 60 bp, Artificial Sequence
  Description of Artificial Sequence: Synthetic probe
acgggaagacaacgtacggggaaacaacctcacggcgtggtgatatggcggcccttgcac

SEQ ID NO: 6932 - DNA, 60 bp, Artificial Sequence
  Description of Artificial Sequence: Synthetic probe
tacaacgggaagacaacgtacggggaaacaacctcacggcgtggtgatatggcggccctt

SEQ ID NO: 6933 - DNA, 60 bp, Artificial Sequence
  Description of Artificial Sequence: Synthetic probe
ccaacacgaagcagcaattgaattctttgaggggatggtgcacgactccattaaggagga

SEQ ID NO: 6934 - DNA, 54 bp, Artificial Sequence
  Description of Artificial Sequence: Synthetic probe
ccccacacacgctggttggagcactgcttcggtctgcgacgtactacttctcag

SEQ ID NO: 6935 - DNA, 60 bp, Artificial Sequence
  Description of Artificial Sequence: Synthetic probe
gctcccctacaccgctccccaccgtgtgctggcaacagtgtacaacgggaagacaacgta

SEQ ID NO: 6936 - DNA, 60 bp, Artificial Sequence
  Description of Artificial Sequence: Synthetic probe
tgcccacacaccgaccgcgtggaagacaacccagtcgttcacgcgaagaacggtgtcacc

SEQ ID NO: 6937 - DNA, 60 bp, Artificial Sequence
  Description of Artificial Sequence: Synthetic probe
gagaactacggcggtgagacacaagtccaaagacggcaccacacggatgtcgggttcatt

SEQ ID NO: 6938 - DNA, 58 bp, Artificial Sequence
  Description of Artificial Sequence: Synthetic probe
atcttcctgaaagggcaagagcatgccgtgtttgcctgtgtcacctctgacgggtggt

SEQ ID NO: 6939 - DNA, 58 bp, Artificial Sequence
  Description of Artificial Sequence: Synthetic probe
atcttcctgaaagggcaagagcatgccgtgtttgcctgtgtcacctccgacgggtggt

SEQ ID NO: 6940 - DNA, 60 bp, Artificial Sequence
  Description of Artificial Sequence: Synthetic probe
tgttttaccgctctgctgcacgctctcagagagatcaaaacactgtttctcacacgagac

SEQ ID NO: 6941 - DNA, 60 bp, Artificial Sequence
  Description of Artificial Sequence: Synthetic probe
tgttttatcgctctgctccacgctctcagagagatcaaaacactgtttctcacacgagac

SEQ ID NO: 6942 - DNA, 60 bp, Artificial Sequence
  Description of Artificial Sequence: Synthetic probe
tgtttcatcgctctgctgcacgctctcagagagatcaaaacactgtttctcacacgagtc

SEQ ID NO: 6943 - DNA, 60 bp, Artificial Sequence
  Description of Artificial Sequence: Synthetic probe
gtgtacgtcaggatgaagcgcgcggaactctactgtccgcggcccattctcacgcactac

SEQ ID NO: 6944 - DNA, 60 bp, Artificial Sequence
  Description of Artificial Sequence: Synthetic probe
cacacaagccgaggttgacgtgtacgtcaggatgaagcgcgcggaactctactgtccgag

SEQ ID NO: 6945 - DNA, 60 bp, Artificial Sequence
  Description of Artificial Sequence: Synthetic probe
ctgagaagcaagttttgaactttgacctgctgaagttggcgggagacgtggagtccaacc

SEQ ID NO: 6946 - DNA, 60 bp, Artificial Sequence
  Description of Artificial Sequence: Synthetic probe
ccaccttcaactttgggcacgttaccgctgacgaagcggttgacgtgtactacaggatga

SEQ ID NO: 6947 - DNA, 60 bp, Artificial Sequence
  Description of Artificial Sequence: Synthetic probe
ttccaccttcaactttgggcacgttaccgctgacgaagcggttgacgtgtactacaggat

SEQ ID NO: 6948 - DNA, 60 bp, Artificial Sequence
  Description of Artificial Sequence: Synthetic probe
aacacgcgcgtcaccgccatccgtggcgatcgcgctgcgctggcggccaaatacgccaac

SEQ ID NO: 6949 - DNA, 60 bp, Artificial Sequence
  Description of Artificial Sequence: Synthetic probe
tacaacacgcgcgtcaccgccatccgtggcgatcgcgctgcgctggcggccaaatacgcc

SEQ ID NO: 6950 - DNA, 60 bp, Artificial Sequence
  Description of Artificial Sequence: Synthetic probe
actacaggatgaagcgtgctgaactgtactgccccagaccacttctcccggcgtacgacc

SEQ ID NO: 6951 - DNA, 60 bp, Artificial Sequence
  Description of Artificial Sequence: Synthetic probe
tgctttaccgaatgaagagggccgagacatactgtcccaggcccctgctggcaatccacc

SEQ ID NO: 6952 - DNA, 60 bp, Artificial Sequence
  Description of Artificial Sequence: Synthetic probe
cactgaattgctttaccgaatgaagagggccgagacatactgtcccaggcccctgctggc

SEQ ID NO: 6953 - DNA, 60 bp, Artificial Sequence
  Description of Artificial Sequence: Synthetic probe
ctcgggtcactgaattgctttaccgaatgaagagggccgagacatactgtcccaggcccc

SEQ ID NO: 6954 - DNA, 60 bp, Artificial Sequence
  Description of Artificial Sequence: Synthetic probe
aactcgggtcactgaattgctttaccgaatgaagagggccgagacatactgtcccaggcc

SEQ ID NO: 6955 - DNA, 60 bp, Artificial Sequence
  Description of Artificial Sequence: Synthetic probe
accaacccaacggcttactacaagaaaccgctcacccgacttgccctgccctacacggca

SEQ ID NO: 6956 - DNA, 60 bp, Artificial Sequence
  Description of Artificial Sequence: Synthetic probe
ggacaacaccaccaacccaacggcttactacaagaaaccgctcacccgacttgccctgcc

SEQ ID NO: 6957 - DNA, 60 bp, Artificial Sequence
  Description of Artificial Sequence: Synthetic probe
gggaaacaccaccaacccaacggcttactacaagaaaccgctcactcgacttgccctgcc

SEQ ID NO: 6958 - DNA, 60 bp, Artificial Sequence
  Description of Artificial Sequence: Synthetic probe
ttggacctcatgcagataccgtctcacactctggtgggggcccttctccgcgcgtccact

SEQ ID NO: 6959 - DNA, 60 bp, Artificial Sequence
  Description of Artificial Sequence: Synthetic probe
accgcaaagccaaatcaacactttggacctcatgcagataccgtctcacactctggtggg

SEQ ID NO: 6960 - DNA, 60 bp, Artificial Sequence
  Description of Artificial Sequence: Synthetic probe
ttgtgaaagtgacaccgcaaagctcaatcaacactttggacctcatgcagataccgtctc

SEQ ID NO: 6961 - DNA, 60 bp, Artificial Sequence
  Description of Artificial Sequence: Synthetic probe
atttgtgaaggtaacaccgcaaagccaaatcaacactttggacctcatgcagataccgtc

SEQ ID NO: 6962 - DNA, 60 bp, Artificial Sequence
  Description of Artificial Sequence: Synthetic probe
ccgagctctactgtcccaggcctctgctgacagtggaagtgttgtcgcaggacagacaca

SEQ ID NO: 6963 - DNA, 60 bp, Artificial Sequence
  Description of Artificial Sequence: Synthetic probe
tgccgagctctactgtcccaggcctctgctgacagtggaagtgtctgtcgcaggacagac

SEQ ID NO: 6964 - DNA, 60 bp, Artificial Sequence
  Description of Artificial Sequence: Synthetic probe
attcgggccacgaccatccacgagctcctcgtacgcatgaaacgtgccgagctctactgt

SEQ ID NO: 6965 - DNA, 60 bp, Artificial Sequence
  Description of Artificial Sequence: Synthetic probe
ccggggagtcagtagaccctgtcaccaccactgtagagaactacggcggtgagacacaag

SEQ ID NO: 6966 - DNA, 55 bp, Artificial Sequence
  Description of Artificial Sequence: Synthetic probe
ctactgccctcgcccggtgctgactcactacgaccaccaggggaaggaccgctac

SEQ ID NO: 6967 - DNA, 60 bp, Artificial Sequence
  Description of Artificial Sequence: Synthetic probe
gcatcgccagcgagacgcacattccaactaccttcaactacggcaggatctacacggagg

SEQ ID NO: 6968 - DNA, 60 bp, Artificial Sequence
  Description of Artificial Sequence: Synthetic probe
accgcctacaacggcgattgcaagtacaagccagtcaacgaggtgccctcgacccacatc

SEQ ID NO: 6969 - DNA, 60 bp, Artificial Sequence
  Description of Artificial Sequence: Synthetic probe
ttgccaccgcctacaacggcgattgcaagtacaagccagtcaacgaggtgccctcgaccc

SEQ ID NO: 6970 - DNA, 60 bp, Artificial Sequence
  Description of Artificial Sequence: Synthetic probe
caatgggaccacccgatttgcactgccatacactgctccacacaggtgtcttgccaccgc

SEQ ID NO: 6971 - DNA, 60 bp, Artificial Sequence
  Description of Artificial Sequence: Synthetic probe
cgctgccagcgtgcacactctaccgcaaaccttcaacttcgggttcgtgaccgtcgacaa

SEQ ID NO: 6972 - DNA, 60 bp, Artificial Sequence
  Description of Artificial Sequence: Synthetic probe
aaaaccgccaccgccattcgtggagaccgcgcagcactcgcggcgaagtacgctgccagc

SEQ ID NO: 6973 - DNA, 60 bp, Artificial Sequence
  Description of Artificial Sequence: Synthetic probe
ggtgacaaccccatggtttacgccaagggcggtgtgacccgctttgctatcccgttcacg

SEQ ID NO: 6974 - DNA, 60 bp, Artificial Sequence
  Description of Artificial Sequence: Synthetic probe
aacttggtgacaaccccatggtttacgccaagggcggtgtaacccgctttgctatcccgt

SEQ ID NO: 6975 - DNA, 60 bp, Artificial Sequence
  Description of Artificial Sequence: Synthetic probe
cgaccacactagggtcttttggcagcctaacggggcaccgcggaccacccaacttggtga

SEQ ID NO: 6976 - DNA, 60 bp, Artificial Sequence
  Description of Artificial Sequence: Synthetic probe
ctgcgggcttccacttactacttttgtgaccttgagattgcatgtgtgggcgaccacact

SEQ ID NO: 6977 - DNA, 60 bp, Artificial Sequence
  Description of Artificial Sequence: Synthetic probe
gtggacctcatggacacaaagggaaaagcactcgtaggtgcgatcctgcgggcttccact

SEQ ID NO: 6978 - DNA, 60 bp, Artificial Sequence
  Description of Artificial Sequence: Synthetic probe
cgtgcaagagggccgacgcaagcacactgaagtcgccttccttcttgaccgcagtacaca

SEQ ID NO: 6979 - DNA, 60 bp, Artificial Sequence
  Description of Artificial Sequence: Synthetic probe
acacggcgggaacgtgcaagagggccgacgcaagcacactgaagtcgccttccttcttga

SEQ ID NO: 6980 - DNA, 60 bp, Artificial Sequence
  Description of Artificial Sequence: Synthetic probe
cggtgattgtaagtacaaacccactggcacacccccgcgcaccaacatccgcggggacct

SEQ ID NO: 6981 - DNA, 60 bp, Artificial Sequence
  Description of Artificial Sequence: Synthetic probe
aggaagttgcccacctccttcaactacggcgctgtgaaggctgacaccatcactgagctt

SEQ ID NO: 6982 - DNA, 60 bp, Artificial Sequence
  Description of Artificial Sequence: Synthetic probe
tcatcatggacagatttgtgaaaataaacagccttaaccccacacatgtcatagacctca

SEQ ID NO: 6983 - DNA, 60 bp, Artificial Sequence
  Description of Artificial Sequence: Synthetic probe
ggagctccggagttgaatgaagtgggcgacaatccagtcgtcttctcgaacaacggcacc

SEQ ID NO: 6984 - DNA, 60 bp, Artificial Sequence
  Description of Artificial Sequence: Synthetic probe
tggactcccaacggagctccggagttgaatgaagtgggcgacaatccagtcgtcttctcg

SEQ ID NO: 6985 - DNA, 54 bp, Artificial Sequence
  Description of Artificial Sequence: Synthetic probe
cttgtcagacccgaaaaacagctttgcaacttcgacctgttaaagctggccgga

SEQ ID NO: 6986 - DNA, 60 bp, Artificial Sequence
  Description of Artificial Sequence: Synthetic probe
gagccaacgcgttgagaatgaaaccacaaggtgcattcccacgactttcaacttcggaag

SEQ ID NO: 6987 - DNA, 60 bp, Artificial Sequence
  Description of Artificial Sequence: Synthetic probe
aacgtgttgtttcgcgccggggtgacctggccgcgttgagccaacgcgttgagaatgaaa

SEQ ID NO: 6988 - DNA, 60 bp, Artificial Sequence
  Description of Artificial Sequence: Synthetic probe
tacaacaaaacccaacgtgttgtttcgcgccggggtgacctggccgcgttgagccaacgc

SEQ ID NO: 6989 - DNA, 60 bp, Artificial Sequence
  Description of Artificial Sequence: Synthetic probe
ccgcaccacacggtgtcctggcaactgtgtacaacggtaactgcaagtacaacaaaaccc

SEQ ID NO: 6990 - DNA, 60 bp, Artificial Sequence
  Description of Artificial Sequence: Synthetic probe
acaccgcaccacacggtgtcctggcaactgtgtacaacggtaactgcaagtacaacaaaa

SEQ ID NO: 6991 - DNA, 60 bp, Artificial Sequence
  Description of Artificial Sequence: Synthetic probe
cccaacggtgcgcctaggaccacccaacttggggacaacccgatggttttctccaacaag

SEQ ID NO: 6992 - DNA, 60 bp, Artificial Sequence
  Description of Artificial Sequence: Synthetic probe
cccaacggtgcgcctcggaccacccagcttggggacaacccgatggttttctccaacaac

SEQ ID NO: 6993 - DNA, 60 bp, Artificial Sequence
  Description of Artificial Sequence: Synthetic probe
ctcacacaacaacgttacccggtttgccgtgccatacaccgcaccacaccgtttgttgtc

SEQ ID NO: 6994 - DNA, 60 bp, Artificial Sequence
  Description of Artificial Sequence: Synthetic probe
gcgtgttctggcagccgaatggcgcaccaaggactacacagcttggagataacccgatgg

SEQ ID NO: 6995 - DNA, 60 bp, Artificial Sequence
  Description of Artificial Sequence: Synthetic probe
gtgtgttctggcagccgaatggcgcaccaaggactacacagcttggagacaacccgatgg

SEQ ID NO: 6996 - DNA, 60 bp, Artificial Sequence
  Description of Artificial Sequence: Synthetic probe
gtgtgttctggcagccgaatggcgcaccaaggactacacagcttggagataacccgatgg

SEQ ID NO: 6997 - DNA, 60 bp, Artificial Sequence
  Description of Artificial Sequence: Synthetic probe
cgtgtgttctggcagccgaatggcgcaccaaggactacacagcttggagacaacccgatg

SEQ ID NO: 6998 - DNA, 60 bp, Artificial Sequence
  Description of Artificial Sequence: Synthetic probe
cgcgtgttctggcagccgaatggcgcaccaaggactacacagcttggagataacccgatg

SEQ ID NO: 6999 - DNA, 60 bp, Artificial Sequence
  Description of Artificial Sequence: Synthetic probe
cgtgtgttctggcagccgaatggcgcaccaaggactacacagcttggagataacccgatg

SEQ ID NO: 7000 - DNA, 60 bp, Artificial Sequence
  Description of Artificial Sequence: Synthetic probe
cagcaccacacagtgttcttgcaacagtctacaatggcaactgcaaatactccaagaccc

SEQ ID NO: 7001 - DNA, 60 bp, Artificial Sequence
  Description of Artificial Sequence: Synthetic probe
cttacacagcaccacacagtgttcttgcaacagtctacaatggcaactgcaaatactcca

SEQ ID NO: 7002 - DNA, 60 bp, Artificial Sequence
  Description of Artificial Sequence: Synthetic probe
ttgctctgccttacacagcaccacacagtgttcttgcaacagtctacaatggcaactgca

SEQ ID NO: 7003 - DNA, 60 bp, Artificial Sequence
  Description of Artificial Sequence: Synthetic probe
gcccgttttgctctgccttacacagcaccacacagtgttcttgcaacagtctacaatggc

SEQ ID NO: 7004 - DNA, 60 bp, Artificial Sequence
  Description of Artificial Sequence: Synthetic probe
tcgcccgttttgctctgccttacacagcaccacacagtgttcttgcaacagtctacaatg

SEQ ID NO: 7005 - DNA, 60 bp, Artificial Sequence
  Description of Artificial Sequence: Synthetic probe
ccgattcttccgattcagccaacgggcgatagacacaagcaaccgctcgtcgcacctgca

SEQ ID NO: 7006 - DNA, 60 bp, Artificial Sequence
  Description of Artificial Sequence: Synthetic probe
aggccgattcttccgattcagccaacgggcgatagacacaagcaaccgctcgtcgcacct

SEQ ID NO: 7007 - DNA, 60 bp, Artificial Sequence
  Description of Artificial Sequence: Synthetic probe
gaccaagctggtagcacctgataaacaactgtgcaacttcgacctgttaaagttggctgg

SEQ ID NO: 7008 - DNA, 60 bp, Artificial Sequence
  Description of Artificial Sequence: Synthetic probe
agaccaagctggtagcacctgataaacaactgtgcaacttcgacctgttaaagttggctg

SEQ ID NO: 7009 - DNA, 60 bp, Artificial Sequence
  Description of Artificial Sequence: Synthetic probe
attctgactgaagcagaggtggacgtctacgtgcgcatgaagcgggcggagctttactgc

SEQ ID NO: 7010 - DNA, 60 bp, Artificial Sequence
  Description of Artificial Sequence: Synthetic probe
tcgccctgcccttcaccgctccacaccgtgttctggcaacagtctacaacggtgattgca

SEQ ID NO: 7011 - DNA, 60 bp, Artificial Sequence
  Description of Artificial Sequence: Synthetic probe
acgggacgacccgcttcgccctgcccttcaccgctccacaccgtgttctggcaacagtct

SEQ ID NO: 7012 - DNA, 60 bp, Artificial Sequence
  Description of Artificial Sequence: Synthetic probe
acgggacgacccgcttcgccctgcccttcaccgctccacaccgtgttctggcaacagttt

SEQ ID NO: 7013 - DNA, 60 bp, Artificial Sequence
  Description of Artificial Sequence: Synthetic probe
gggagacgcaagtccaacgtcgccaccacactgacgttgccttcgttcttgaccggtttg

SEQ ID NO: 7014 - DNA, 58 bp, Artificial Sequence
  Description of Artificial Sequence: Synthetic probe
caagtgggttggctggacgccgaatggcgcgccggaacttgctgaggtgggcgacaat

SEQ ID NO: 7015 - DNA, 60 bp, Artificial Sequence
  Description of Artificial Sequence: Synthetic probe
aacaagtgggttggctggacgccgaatggcgcgccagaacttagtgaggtcggcgacaat

SEQ ID NO: 7016 - DNA, 60 bp, Artificial Sequence
  Description of Artificial Sequence: Synthetic probe
cgaacaagtgggttggctggacgccgaatggcgcgccagaacttagtgaggtcggcgaca

SEQ ID NO: 7017 - DNA, 60 bp, Artificial Sequence
  Description of Artificial Sequence: Synthetic probe
tgaagctattactgagctcctgatccgcatgaaacgcgcggagacatactgccctaggcc

SEQ ID NO: 7018 - DNA, 60 bp, Artificial Sequence
  Description of Artificial Sequence: Synthetic probe
gctggctcaactcactgttgcagctctttcgatacgtcgatgagccgctctttgagccag

SEQ ID NO: 7019 - DNA, 60 bp, Artificial Sequence
  Description of Artificial Sequence: Synthetic probe
cgggaactgctggctcaattcactgttgcagctctttcgatacgtcgatgagccgctctt

SEQ ID NO: 7020 - DNA, 60 bp, Artificial Sequence
  Description of Artificial Sequence: Synthetic probe
cacggcaactgctggctcaacacgctgttgcagctctttcgatacgtcgatgagccgctc

SEQ ID NO: 7021 - DNA, 60 bp, Artificial Sequence
  Description of Artificial Sequence: Synthetic probe
gcaggttgacgtttactacagaatgaagcgtgctgaattgtactgccccaggccacttct

SEQ ID NO: 7022 - DNA, 60 bp, Artificial Sequence
  Description of Artificial Sequence: Synthetic probe
cgttaccgctgacaagcaggttgacgtttactacagaatgaagcgtgctgaattgtactg

SEQ ID NO: 7023 - DNA, 56 bp, Artificial Sequence
  Description of Artificial Sequence: Synthetic probe
cgcaaccgtgttactcggttcgccgtgccatacaccgcaccacatcgcctgctctc

SEQ ID NO: 7024 - DNA, 56 bp, Artificial Sequence
  Description of Artificial Sequence: Synthetic probe
cgcaaccgtgtcactcggttcgccgtgccatacaccgcaccacatcgcctgctctc

SEQ ID NO: 7025 - DNA, 60 bp, Artificial Sequence
  Description of Artificial Sequence: Synthetic probe
ccgtggtgaccttgcaacactcgctgagcgcattgccagcgagactcatattccaaccac

SEQ ID NO: 7026 - DNA, 60 bp, Artificial Sequence
  Description of Artificial Sequence: Synthetic probe
tactcgaccggttcaccctggttgggaagactgtgaacaacagactgacactggacctgc

SEQ ID NO: 7027 - DNA, 60 bp, Artificial Sequence
  Description of Artificial Sequence: Synthetic probe
ccgttcaaggctgggtaggtgtttaccagatcacagacacacatgagaaagacggtgcag

SEQ ID NO: 7028 - DNA, 60 bp, Artificial Sequence
  Description of Artificial Sequence: Synthetic probe
tcgcacagtactacacacagtactcgggcacactaaacctgcactttatgtacactggcc

SEQ ID NO: 7029 - DNA, 60 bp, Artificial Sequence
  Description of Artificial Sequence: Synthetic probe
acgtcaacatcgcaccgaccaacgtgtatgttgccggagagaagccagcaaaacagggca

SEQ ID NO: 7030 - DNA, 60 bp, Artificial Sequence
  Description of Artificial Sequence: Synthetic probe
ctggaactacccacagaccacaaaggcatctacggccaacttgtcgattcccactcgtac

SEQ ID NO: 7031 - DNA, 60 bp, Artificial Sequence
  Description of Artificial Sequence: Synthetic probe
tcacaacaagtcacgggaccaccacctctaccacacagagctcggtcggcgtcacctacg

SEQ ID NO: 7032 - DNA, 60 bp, Artificial Sequence
  Description of Artificial Sequence: Synthetic probe
cccgctttgcactgccttacaccgcgccacacagatgtctggcaacaacctacaacggtg

SEQ ID NO: 7033 - DNA, 60 bp, Artificial Sequence
  Description of Artificial Sequence: Synthetic probe
accacccgctttgcgctgccctacactgcgccacacagatgtctggcaacaacctacaac

SEQ ID NO: 7034 - DNA, 60 bp, Artificial Sequence
  Description of Artificial Sequence: Synthetic probe
ctacggcggcgatacacaggtccagaggcgccaacacacggacgtctcgttcatcatgga

SEQ ID NO: 7035 - DNA, 60 bp, Artificial Sequence
  Description of Artificial Sequence: Synthetic probe
gcgtccttcaactacggtgcacttaaggcccaggacattcacgaacttctcgtgcgcatg

SEQ ID NO: 7036 - DNA, 52 bp, Artificial Sequence
  Description of Artificial Sequence: Synthetic probe
gcggcgagagtcgccgcgcagctccctgcgtccttcaactacggtgcactta

SEQ ID NO: 7037 - DNA, 60 bp, Artificial Sequence
  Description of Artificial Sequence: Synthetic probe
ggcgaggcgacctgggggccctcgcggcgagagtcgccgcgcagctccctgcgtccttca

SEQ ID NO: 7038 - DNA, 60 bp, Artificial Sequence
  Description of Artificial Sequence: Synthetic probe
aaccccactgcctaccacaaggcacccttcacgagacttgcacttccctacaccgcacca

SEQ ID NO: 7039 - DNA, 60 bp, Artificial Sequence
  Description of Artificial Sequence: Synthetic probe
catgagcaaccccactgcctaccacaaggcacccttcacgagacttgcacttccctacac

SEQ ID NO: 7040 - DNA, 60 bp, Artificial Sequence
  Description of Artificial Sequence: Synthetic probe
ttgggtgcctaacggcgcccctgaggccgctctccagaacatgagcaaccccactgccta

SEQ ID NO: 7041 - DNA, 60 bp, Artificial Sequence
  Description of Artificial Sequence: Synthetic probe
ggcaacctgacttgggtgcctaacggcgcccctgaggccgctctccagaacatgagcaac

SEQ ID NO: 7042 - DNA, 60 bp, Artificial Sequence
  Description of Artificial Sequence: Synthetic probe
agatccaatctacggttacgtgtacaacccgtctcggaacgactgtcacggcaggtactc

SEQ ID NO: 7043 - DNA, 60 bp, Artificial Sequence
  Description of Artificial Sequence: Synthetic probe
cgcagatccgatctacggttacgtgtacaacccgtctcggaacgactgtcacggcaggta

SEQ ID NO: 7044 - DNA, 60 bp, Artificial Sequence
  Description of Artificial Sequence: Synthetic probe
gatcccaagaccgcagatccgatctacggttacgtgtacaacccgtctcggaacgactgt

SEQ ID NO: 7045 - DNA, 60 bp, Artificial Sequence
  Description of Artificial Sequence: Synthetic probe
tggcaacatcatacaacggtgattgcaagtacaaacccgctggcacggctccgcgcaaca

SEQ ID NO: 7046 - DNA, 60 bp, Artificial Sequence
  Description of Artificial Sequence: Synthetic probe
ctgaaaccatcactgcgcttttgctccgcatgaaacgcgcggagacatactgccctaggc

SEQ ID NO: 7047 - DNA, 60 bp, Artificial Sequence
  Description of Artificial Sequence: Synthetic probe
gtgacctcgcaaccctggctgcgcggattgctagtgagacccacatcccgacaacattca

SEQ ID NO: 7048 - DNA, 60 bp, Artificial Sequence
  Description of Artificial Sequence: Synthetic probe
aaacaccttctccacaccggaatcggcactgcctcgcgccccagcgaggtgtgtatggtg

SEQ ID NO: 7049 - DNA, 60 bp, Artificial Sequence
  Description of Artificial Sequence: Synthetic probe
tcgtcatctggaacatcaaacaccttctccacaccggaatcggcactgcctcgcgcccca

SEQ ID NO: 7050 - DNA, 60 bp, Artificial Sequence
  Description of Artificial Sequence: Synthetic probe
gctctcgtcatctggaacatcaaacaccttctccacaccggaatcggcactgcctcgcgc

SEQ ID NO: 7051 - DNA, 60 bp, Artificial Sequence
  Description of Artificial Sequence: Synthetic probe
gtcttgaactacacgagggtggaccgcccgctctcgtcatctggaacatcaaacaccttc

SEQ ID NO: 7052 - DNA, 60 bp, Artificial Sequence
  Description of Artificial Sequence: Synthetic probe
aaacacaggagagatggaattcacacttcacaacggtgagaagaagaccttctactctag

SEQ ID NO: 7053 - DNA, 60 bp, Artificial Sequence
  Description of Artificial Sequence: Synthetic probe
gaaacacaggagagatggaattcacacttcacaacggtgagaagaagaccttctactcta

SEQ ID NO: 7054 - DNA, 60 bp, Artificial Sequence
  Description of Artificial Sequence: Synthetic probe
cttaaacgaaacacaggaaagatggaattcacacttcacaacggtgagaagaagaccttc

SEQ ID NO: 7055 - DNA, 60 bp, Artificial Sequence
  Description of Artificial Sequence: Synthetic probe
cacgccctcagagagatcaagacactgtttcttaaacgaaacacagggaaaatggaattc

SEQ ID NO: 7056 - DNA, 60 bp, Artificial Sequence
  Description of Artificial Sequence: Synthetic probe
ctctgctagctcttgacaccactcaggaccgccgtaaacaggagattattgcacctgaga

SEQ ID NO: 7057 - DNA, 60 bp, Artificial Sequence
  Description of Artificial Sequence: Synthetic probe
gctgcccacctccttcaactacggtgctgtgaaggctgacaccatcacggagctgttgat

SEQ ID NO: 7058 - DNA, 60 bp, Artificial Sequence
  Description of Artificial Sequence: Synthetic probe
ggctgcccacctccttcaactacggtgctgtgaaggctgacaccatcacggagctgttga

SEQ ID NO: 7059 - DNA, 60 bp, Artificial Sequence
  Description of Artificial Sequence: Synthetic probe
ggcaggatttacactgaggccgaagtggacgtgtacgtcagggtgaaacgcgcagaactc

SEQ ID NO: 7060 - DNA, 60 bp, Artificial Sequence
  Description of Artificial Sequence: Synthetic probe
ggcaggatttacactgaggccgaagtggacgtgtacgtcaggatgaaacgcgcggaactc

SEQ ID NO: 7061 - DNA, 60 bp, Artificial Sequence
  Description of Artificial Sequence: Synthetic probe
cggcaggatttacactgaggccgaagtggacgtgtacgttaggatgaaacgcgcggaact

SEQ ID NO: 7062 - DNA, 60 bp, Artificial Sequence
  Description of Artificial Sequence: Synthetic probe
taactacggcaggatttacactgaggccgaagtggacgtgtacgttaggatgaaacgcgc

SEQ ID NO: 7063 - DNA, 60 bp, Artificial Sequence
  Description of Artificial Sequence: Synthetic probe
acttttaactacggcaggatttacactgaggccgaagtggacgtgtacgtcagggtgaaa

SEQ ID NO: 7064 - DNA, 60 bp, Artificial Sequence
  Description of Artificial Sequence: Synthetic probe
cacagaggcagaagtcgatgtgtatgtgaggatgaagcgggcggaagtctactgtccacg

SEQ ID NO: 7065 - DNA, 60 bp, Artificial Sequence
  Description of Artificial Sequence: Synthetic probe
caacgtgtacgttaggatgaagcgcgcagaactctactgcccgcgccctctcttgacaca

SEQ ID NO: 7066 - DNA, 53 bp, Artificial Sequence
  Description of Artificial Sequence: Synthetic probe
ccactcaggaccgccgcgaacaggagatcattgcacctgaaaagcagatgatg

SEQ ID NO: 7067 - DNA, 60 bp, Artificial Sequence
  Description of Artificial Sequence: Synthetic probe
tgttagctcttgacaccactcaggaccgccgtaaacaggagatcattgcacctgaaaagc

SEQ ID NO: 7068 - DNA, 60 bp, Artificial Sequence
  Description of Artificial Sequence: Synthetic probe
cacactacgatcacaaaggactggatcgctacaaaaccgcgataaccaaacctgccaaac

SEQ ID NO: 7069 - DNA, 60 bp, Artificial Sequence
  Description of Artificial Sequence: Synthetic probe
ttcacgaggcttgcgctcccctacaccgcgccacaccgtgtgttggcaacagtgtacaac

SEQ ID NO: 7070 - DNA, 60 bp, Artificial Sequence
  Description of Artificial Sequence: Synthetic probe
ggttgacgtgtacgttaggatgaagcgcgcagaactctactgtccgcgccctctcctgac

SEQ ID NO: 7071 - DNA, 60 bp, Artificial Sequence
  Description of Artificial Sequence: Synthetic probe
acgctggcacaacaacctacactactacacgtggagatttggcccagctggcgacgtccc

SEQ ID NO: 7072 - DNA, 60 bp, Artificial Sequence
  Description of Artificial Sequence: Synthetic probe
gtacgctggcacaacaacctacactactacacgtggagatttggcccagctggcgacgtc

SEQ ID NO: 7073 - DNA, 60 bp, Artificial Sequence
  Description of Artificial Sequence: Synthetic probe
acccatggacgcctgaccctgagaacgtacttgcgtacgtgccctacgaccaggaacccc

SEQ ID NO: 7074 - DNA, 60 bp, Artificial Sequence
  Description of Artificial Sequence: Synthetic probe
gcgagatctgtgtgatcaacggggtcgccatgactctggctgatttccacgccggcatct

SEQ ID NO: 7075 - DNA, 60 bp, Artificial Sequence
  Description of Artificial Sequence: Synthetic probe
tacaccaaacttgacctctcagacggtgggccgcccgcactcgtgttgtggctcatcaag

SEQ ID NO: 7076 - DNA, 60 bp, Artificial Sequence
  Description of Artificial Sequence: Synthetic probe
acaactttcagattacaccaaacttgacctctcagacggtgggccgcccgcactcgtgtt

SEQ ID NO: 7077 - DNA, 60 bp, Artificial Sequence
  Description of Artificial Sequence: Synthetic probe
cgcgcggagctttattgccctaggcccatctttcctatccagcttacgggtgacaggcac

SEQ ID NO: 7078 - DNA, 60 bp, Artificial Sequence
  Description of Artificial Sequence: Synthetic probe
gtgagacacaggcccagcggcgtcaccacactgatgtcggcttcataatggacagatttg

SEQ ID NO: 7079 - DNA, 60 bp, Artificial Sequence
  Description of Artificial Sequence: Synthetic probe
tgtgagaatgaagcgggcggagctttactgccctcgcccggtgctgacccactatgatca

SEQ ID NO: 7080 - DNA, 60 bp, Artificial Sequence
  Description of Artificial Sequence: Synthetic probe
atgtgagaatgaagcgggcggagctttactgccctcgcccggtgctgacccactatgatc

SEQ ID NO: 7081 - DNA, 60 bp, Artificial Sequence
  Description of Artificial Sequence: Synthetic probe
caacccagtcgttttctctcacaacgggaccacccgatttgctttgccatacactgctcc

SEQ ID NO: 7082 - DNA, 60 bp, Artificial Sequence
  Description of Artificial Sequence: Synthetic probe
caacccagtcgttttctctcacaacgggaccacccgatttgcactgccatacactgcccc

SEQ ID NO: 7083 - DNA, 60 bp, Artificial Sequence
  Description of Artificial Sequence: Synthetic probe
cagtgaagtaggcgacaacccagtcgttttctctcacaacgggaccacccgatttgcttt

SEQ ID NO: 7084 - DNA, 60 bp, Artificial Sequence
  Description of Artificial Sequence: Synthetic probe
tagtgaagtgggcgacaacccagtcgttttctctcacaacgggaccacccgatttgcact

SEQ ID NO: 7085 - DNA, 60 bp, Artificial Sequence
  Description of Artificial Sequence: Synthetic probe
gtgttggcaccagcactcgccccagcgagatctgtgtaatcaacggggttgtcatgaccc

SEQ ID NO: 7086 - DNA, 60 bp, Artificial Sequence
  Description of Artificial Sequence: Synthetic probe
cccgatactgctggctgggttggtcaaagtcgcctcgagtttcttccggtcaacacccga

SEQ ID NO: 7087 - DNA, 60 bp, Artificial Sequence
  Description of Artificial Sequence: Synthetic probe
acagatttgtgaagattaacaacaccagccccacacacgtcattgacctcatgcaaaccc

SEQ ID NO: 7088 - DNA, 60 bp, Artificial Sequence
  Description of Artificial Sequence: Synthetic probe
atggacagatttgtgaagattaacaacaccagccccacacacgtcattgacctcatgcag

SEQ ID NO: 7089 - DNA, 60 bp, Artificial Sequence
  Description of Artificial Sequence: Synthetic probe
tgcggtctgcgacgtactacttctcagacctggaggttgcgcttgtccacacaggcccag

SEQ ID NO: 7090 - DNA, 51 bp, Artificial Sequence
  Description of Artificial Sequence: Synthetic probe
cactgagctcctgatccgcatgaaacgcgcggagacgtactgccctaggcc

SEQ ID NO: 7091 - DNA, 53 bp, Artificial Sequence
  Description of Artificial Sequence: Synthetic probe
atcactgagctcctgatccgcatgaaacgcgcggagacgtactgccctaggcc

SEQ ID NO: 7092 - DNA, 60 bp, Artificial Sequence
  Description of Artificial Sequence: Synthetic probe
acttccacgctggcatcttcctgaaagggcaagaacacgccgtgttcgcctgtgtcacct

SEQ ID NO: 7093 - DNA, 60 bp, Artificial Sequence
  Description of Artificial Sequence: Synthetic probe
aaacaacctcacggcgtggtgatatggcggcccttgcacaaagattgagcgggcggctgc

SEQ ID NO: 7094 - DNA, 54 bp, Artificial Sequence
  Description of Artificial Sequence: Synthetic probe
acttcgacctgctcaagttggcgggagacgtcgagtccaaccctgggcccttca

SEQ ID NO: 7095 - DNA, 60 bp, Artificial Sequence
  Description of Artificial Sequence: Synthetic probe
ccaaccactttcaactacggcaggatttacacagaggctgaggtcgacgtgtatgttagg

SEQ ID NO: 7096 - DNA, 60 bp, Artificial Sequence
  Description of Artificial Sequence: Synthetic probe
aacaagtgctggagaaggtgccgatgtcgtcacgaccgacgcatccgcgcacggaggtaa

SEQ ID NO: 7097 - DNA, 60 bp, Artificial Sequence
  Description of Artificial Sequence: Synthetic probe
acaacaagtgctggagaaggtgccgatgtcgtcacgaccgacgcatccgcgcacggaggt

SEQ ID NO: 7098 - DNA, 51 bp, Artificial Sequence
  Description of Artificial Sequence: Synthetic probe
acttcgacctgctcaagttggcgggagacgttgagtccaaccctgggccct

SEQ ID NO: 7099 - DNA, 57 bp, Artificial Sequence
  Description of Artificial Sequence: Synthetic probe
agcggttgcccaccgaccgacttgcaaaagatggtcatggcaaacgtcaagcccgtc

SEQ ID NO: 7100 - DNA, 60 bp, Artificial Sequence
  Description of Artificial Sequence: Synthetic probe
gaaccactggacgtagattggcaggaccgggctggtctgttcctccgcggtgcaggccag

SEQ ID NO: 7101 - DNA, 60 bp, Artificial Sequence
  Description of Artificial Sequence: Synthetic probe
caggaaccactggacgtagattggcaggaccgggctggtctgttcctccgcggtgcaggc

SEQ ID NO: 7102 - DNA, 60 bp, Artificial Sequence
  Description of Artificial Sequence: Synthetic probe
accctgagaacgtgctcgcgtacgtgccatacgaccaggaaccactggacgtagattggc

SEQ ID NO: 7103 - DNA, 60 bp, Artificial Sequence
  Description of Artificial Sequence: Synthetic probe
ctgagggctggtacgccattgatgacgaggtgttttacccatggacacccgaccctgaga

SEQ ID NO: 7104 - DNA, 60 bp, Artificial Sequence
  Description of Artificial Sequence: Synthetic probe
ctcgccccagcgagatctgtgtcatcaacggagttaccatgactctggctgacttccacg

SEQ ID NO: 7105 - DNA, 60 bp, Artificial Sequence
  Description of Artificial Sequence: Synthetic probe
gacaactgactgttttgacgttttgttcgagatctttcacaggtttagacacacgttcaa

SEQ ID NO: 7106 - DNA, 60 bp, Artificial Sequence
  Description of Artificial Sequence: Synthetic probe
atgaagacaactgactgttttgacgttttgttcgagatctttcacaggtttagacacacg

SEQ ID NO: 7107 - DNA, 60 bp, Artificial Sequence
  Description of Artificial Sequence: Synthetic probe
acagcgaatcgcgagtgaaacacacatcccaaccaccttcaactacggtaggatctacac

SEQ ID NO: 7108 - DNA, 60 bp, Artificial Sequence
  Description of Artificial Sequence: Synthetic probe
gctgaacaagccccacggaccaacatccgtggagacctcgcgacgctcgcacagcgaatc

SEQ ID NO: 7109 - DNA, 60 bp, Artificial Sequence
  Description of Artificial Sequence: Synthetic probe
ttcgccctgccttacactgccccacacaggtgtcttgcgaccacctacaacggtgactgc

SEQ ID NO: 7110 - DNA, 60 bp, Artificial Sequence
  Description of Artificial Sequence: Synthetic probe
aacggtaccacccgcttcgccctgccttacactgccccacacaggtgtcttgcgaccacc

SEQ ID NO: 7111 - DNA, 60 bp, Artificial Sequence
  Description of Artificial Sequence: Synthetic probe
ttctcacacaacggcactacccgcttcgccctgccttacactgccccacacaggtgtctt

SEQ ID NO: 7112 - DNA, 60 bp, Artificial Sequence
  Description of Artificial Sequence: Synthetic probe
cgtcttctcacacaacggcactacccgcttcgccctgccttacactgccccacacaggtg

SEQ ID NO: 7113 - DNA, 60 bp, Artificial Sequence
  Description of Artificial Sequence: Synthetic probe
gcaggcgtggtgacatggggtccctcgcggcacgagtcgcgaaacaacttcctgcttcat

SEQ ID NO: 7114 - DNA, 60 bp, Artificial Sequence
  Description of Artificial Sequence: Synthetic probe
aggcaggcgtggtgacatggggtccctcgcggcacgagtcgcggaacagcttcctgcttc

SEQ ID NO: 7115 - DNA, 60 bp, Artificial Sequence
  Description of Artificial Sequence: Synthetic probe
ccgtgggtggttcaggcaggcgtggtgacatggggtccctcgcggcacgagtcgcgaaac

SEQ ID NO: 7116 - DNA, 60 bp, Artificial Sequence
  Description of Artificial Sequence: Synthetic probe
caccgtgggtggttcaggcaggcgtggtgacatggggtccctcgcggcacgagtcgcgga

SEQ ID NO: 7117 - DNA, 60 bp, Artificial Sequence
  Description of Artificial Sequence: Synthetic probe
gctggcaacagtgtacaacgggacaagcaaatacaccgtgggtggttcaggcaggcgtgg

SEQ ID NO: 7118 - DNA, 60 bp, Artificial Sequence
  Description of Artificial Sequence: Synthetic probe
ggcaccacaccgtgtgctggcaacagtgtacaacgggacaagcaaatacaccgtgggtgg

SEQ ID NO: 7119 - DNA, 60 bp, Artificial Sequence
  Description of Artificial Sequence: Synthetic probe
acggcaccacaccgtgtgctggcaacagtgtacaacgggacaagcaaatacaccgtgggt

SEQ ID NO: 7120 - DNA, 60 bp, Artificial Sequence
  Description of Artificial Sequence: Synthetic probe
tgcggccacgtactacttctctgacctagagattgtggtgcgccacacaggcaacctgac

SEQ ID NO: 7121 - DNA, 60 bp, Artificial Sequence
  Description of Artificial Sequence: Synthetic probe
cgtgcggccacgtactacttctctgacctagagattgtggtgcgccacacaggcaacctg

SEQ ID NO: 7122 - DNA, 60 bp, Artificial Sequence
  Description of Artificial Sequence: Synthetic probe
tgccttgcttcgtgcggccacgtactacttctctgacctagagattgtggtgcgccacac

SEQ ID NO: 7123 - DNA, 60 bp, Artificial Sequence
  Description of Artificial Sequence: Synthetic probe
cgcatcgctagcgagacacacattccaaccaccttcaactacggcaggatctacacggag

SEQ ID NO: 7124 - DNA, 60 bp, Artificial Sequence
  Description of Artificial Sequence: Synthetic probe
caccgcctacaacggcgactgcaagtacaaaccaaaccatgagacaccgcggacacacat

SEQ ID NO: 7125 - DNA, 60 bp, Artificial Sequence
  Description of Artificial Sequence: Synthetic probe
cagatgtcttgctactgcctacaacggcgactgcaagtacaaaccaaacagtgaggcacc

SEQ ID NO: 7126 - DNA, 60 bp, Artificial Sequence
  Description of Artificial Sequence: Synthetic probe
aacgtcgtcaccacactgacgttgccttcgttcttgaccggtttgtgaaggtccatgtgt

SEQ ID NO: 7127 - DNA, 60 bp, Artificial Sequence
  Description of Artificial Sequence: Synthetic probe
acgccggacccgtccgacgttttggtgtttgtcccgtacgatcaagaaccgctcaacgga

SEQ ID NO: 7128 - DNA, 60 bp, Artificial Sequence
  Description of Artificial Sequence: Synthetic probe
cacaaccatccacgaacttctcgtgcgcatgaagcgggccgagctctactgccctagacc

SEQ ID NO: 7129 - DNA, 60 bp, Artificial Sequence
  Description of Artificial Sequence: Synthetic probe
actgcccacctccttcaactacggcgctgtaaaggctgacaccattactgagcttttgat

SEQ ID NO: 7130 - DNA, 60 bp, Artificial Sequence
  Description of Artificial Sequence: Synthetic probe
aagaacggtgtcacccgctttgccctgccgtacacagcaccacacagggttcttgccaca

SEQ ID NO: 7131 - DNA, 60 bp, Artificial Sequence
  Description of Artificial Sequence: Synthetic probe
cgttcacgcgaagaacggtgtcacccgctttgccctgccgtacacagcaccacacagggt

SEQ ID NO: 7132 - DNA, 55 bp, Artificial Sequence
  Description of Artificial Sequence: Synthetic probe
accaatcccacacatgtcattgacctcatgcaaacccaccaacacgggctggtgg

SEQ ID NO: 7133 - DNA, 60 bp, Artificial Sequence
  Description of Artificial Sequence: Synthetic probe
cagcggttgacgtgtactacaggatgaagcgtgctgaactgtactgccccagaccacttc

SEQ ID NO: 7134 - DNA, 60 bp, Artificial Sequence
  Description of Artificial Sequence: Synthetic probe
accgggtgcttgccacagtgtacaacggtgactgtaagtacaaacccactggcaccgcgc

SEQ ID NO: 7135 - DNA, 60 bp, Artificial Sequence
  Description of Artificial Sequence: Synthetic probe
acaccgcgccccaccgggtgcttgccacagtgtacaacggtgactgtaagtacaaaccca

SEQ ID NO: 7136 - DNA, 60 bp, Artificial Sequence
  Description of Artificial Sequence: Synthetic probe
gggcggctgcccacctccttcaactacggcgctgtaaaggctgaaaacatcactgagctc

SEQ ID NO: 7137 - DNA, 51 bp, Artificial Sequence
  Description of Artificial Sequence: Synthetic probe
cacaaggaaccattcacgagacttgcactcccttacaccgcgccacaccgc

SEQ ID NO: 7138 - DNA, 60 bp, Artificial Sequence
  Description of Artificial Sequence: Synthetic probe
actgcctaccacaaagcaccgtttacgagacttgcactcccttacaccgcgccacaccgc

SEQ ID NO: 7139 - DNA, 60 bp, Artificial Sequence
  Description of Artificial Sequence: Synthetic probe
actgcttaccacaaagcaccgttcacgagacttgcactcccttacaccgcgccacaccgc

SEQ ID NO: 7140 - DNA, 60 bp, Artificial Sequence
  Description of Artificial Sequence: Synthetic probe
ggagatccaacaactcctcgtgcgcatgaagcgtgccgagctctactgccccaggccact

SEQ ID NO: 7141 - DNA, 60 bp, Artificial Sequence
  Description of Artificial Sequence: Synthetic probe
gtggccatctgctgtgctaccggagtgtttggcactgcctacctcgtgcctcgtcatctt

SEQ ID NO: 7142 - DNA, 55 bp, Artificial Sequence
  Description of Artificial Sequence: Synthetic probe
agtagccatctgttgtgctactggagtgtttggcactgcctacctcgtgcctcgt

SEQ ID NO: 7143 - DNA, 60 bp, Artificial Sequence
  Description of Artificial Sequence: Synthetic probe
acgatcacgcaaaccgggacagattcgacgcacccatcggcgttgaaaagcaactgtgta

SEQ ID NO: 7144 - DNA, 58 bp, Artificial Sequence
  Description of Artificial Sequence: Synthetic probe
gctggcgtccaagtacgctgatgcgcgacacacgcttccgcccacgttcaactttggg

SEQ ID NO: 7145 - DNA, 60 bp, Artificial Sequence
  Description of Artificial Sequence: Synthetic probe
tacaaaacgcgcgtgaccgccatccgcggtgaccggcccgtgctgggctccaagtacgct

SEQ ID NO: 7146 - DNA, 60 bp, Artificial Sequence
  Description of Artificial Sequence: Synthetic probe
gagtgtgagtacaaaacgcgcgtgaccgccatccgcggtgaccgcgccgtgctggcgtcc

SEQ ID NO: 7147 - DNA, 60 bp, Artificial Sequence
  Description of Artificial Sequence: Synthetic probe
tctcacgcaacggtgtcactcggttcgctgtgccatacactgcaccacaccgtctgctct

SEQ ID NO: 7148 - DNA, 60 bp, Artificial Sequence
  Description of Artificial Sequence: Synthetic probe
catggttttctcacgcaacggtgtcactcggttcgctgtgccatacactgcaccacaccg

SEQ ID NO: 7149 - DNA, 60 bp, Artificial Sequence
  Description of Artificial Sequence: Synthetic probe
caaccccatggttttctcacgcaacggtgtcactcggttcgctgtgccatacactgcacc

SEQ ID NO: 7150 - DNA, 60 bp, Artificial Sequence
  Description of Artificial Sequence: Synthetic probe
gctcggagacaaccccatggttttctcacgcaacggtgtcactcggttcgctgtgccata

SEQ ID NO: 7151 - DNA, 60 bp, Artificial Sequence
  Description of Artificial Sequence: Synthetic probe
acccaacggcgcacccagaaccactcagctcggagacaaccccatggttttctcacgcaa

SEQ ID NO: 7152 - DNA, 60 bp, Artificial Sequence
  Description of Artificial Sequence: Synthetic probe
gtgttttggcaacccaacggcgcacccagaaccactcagctcggagacaaccccatggtt

SEQ ID NO: 7153 - DNA, 60 bp, Artificial Sequence
  Description of Artificial Sequence: Synthetic probe
cgcgtgttttggcaacccaacggcgcacccagaaccactcagctcggagacaaccccatg

SEQ ID NO: 7154 - DNA, 58 bp, Artificial Sequence
  Description of Artificial Sequence: Synthetic probe
ctacgaccaggaacctttggacgtagattggcaggaccgggcaggtctgttcctccgc

SEQ ID NO: 7155 - DNA, 60 bp, Artificial Sequence
  Description of Artificial Sequence: Synthetic probe
cacctctttcaactacggcgctgttaaggctgacaccatcactgagcttttgatccgcat

SEQ ID NO: 7156 - DNA, 60 bp, Artificial Sequence
  Description of Artificial Sequence: Synthetic probe
aacggttggtacgccattgacgacgaggacttctacccgtggacaccggacccgtccaat

SEQ ID NO: 7157 - DNA, 60 bp, Artificial Sequence
  Description of Artificial Sequence: Synthetic probe
gtacagagcacgctgtgttcgcctgcttgacctccaacggttggtacgccattgacgacg

SEQ ID NO: 7158 - DNA, 60 bp, Artificial Sequence
  Description of Artificial Sequence: Synthetic probe
gtgtgcatggtcgacggtacagacatgtgtcttgctgacttccacgcaggaatctttctg

SEQ ID NO: 7159 - DNA, 60 bp, Artificial Sequence
  Description of Artificial Sequence: Synthetic probe
ggtgtgcatggtcgacggtacagacatgtgtcttgctgacttccacgcaggaatctttct

SEQ ID NO: 7160 - DNA, 60 bp, Artificial Sequence
  Description of Artificial Sequence: Synthetic probe
accactgcaacgggggaatctgcagaccctgtcaccaccactgttgagaactacggcggt

SEQ ID NO: 7161 - DNA, 60 bp, Artificial Sequence
  Description of Artificial Sequence: Synthetic probe
gtgggctactgcccacctccttcaactacggcgctgtaaaggctgacaccatcactgagc

SEQ ID NO: 7162 - DNA, 60 bp, Artificial Sequence
  Description of Artificial Sequence: Synthetic probe
cacagaagctgaggttgacgtgtacgttaggatgaagcgcgcagaactctactgtccgcg

SEQ ID NO: 7163 - DNA, 60 bp, Artificial Sequence
  Description of Artificial Sequence: Synthetic probe
atacgcaaatgcaaagcatgagcttccctccaccttcaacttcgggtacttgaccgccga

SEQ ID NO: 7164 - DNA, 60 bp, Artificial Sequence
  Description of Artificial Sequence: Synthetic probe
atctggagttccgattcccgattgacccggtgcggcagaccacatcgtcaggtgagggag

SEQ ID NO: 7165 - DNA, 60 bp, Artificial Sequence
  Description of Artificial Sequence: Synthetic probe
taccaagtgaccgacacccacacggcggaggcagccgttgttgtgtctgtgagcgccgga

SEQ ID NO: 7166 - DNA, 60 bp, Artificial Sequence
  Description of Artificial Sequence: Synthetic probe
ccttcctggcgggtcttgcggactactacacgcagtaccaaggctcattgaactaccact

SEQ ID NO: 7167 - DNA, 60 bp, Artificial Sequence
  Description of Artificial Sequence: Synthetic probe
caaggcatcattccagttgcttgctcagacggctatggcgggttccaaaacactgacccg

SEQ ID NO: 7168 - DNA, 60 bp, Artificial Sequence
  Description of Artificial Sequence: Synthetic probe
caccaggcgtggtctctggttgtcatggttctcacgcctcttaccaccgaggcacagatg

SEQ ID NO: 7169 - DNA, 60 bp, Artificial Sequence
  Description of Artificial Sequence: Synthetic probe
ttactctgtacccacaccagttcatcaacccacggaccaacaccactgcacacatccagg

SEQ ID NO: 7170 - DNA, 60 bp, Artificial Sequence
  Description of Artificial Sequence: Synthetic probe
acgagcacgcaattcaacggcggttcgcttctcgtggccatggtcccagagctgtgctca

SEQ ID NO: 7171 - DNA, 60 bp, Artificial Sequence
  Description of Artificial Sequence: Synthetic probe
tcggcccgggcctaacacgtccgggttggagacacgtgtcaaacaggcagagcgattctt

SEQ ID NO: 7172 - DNA, 60 bp, Artificial Sequence
  Description of Artificial Sequence: Synthetic probe
cactctgcttgaggaccgcatcgtgacaacaagacacggtacgaccacctccaccacgca

SEQ ID NO: 7173 - DNA, 60 bp, Artificial Sequence
  Description of Artificial Sequence: Synthetic probe
tccactcacaccaacaacactcaaaacaacgattggttttccaaattggcccagtcggct

SEQ ID NO: 7174 - DNA, 60 bp, Artificial Sequence
  Description of Artificial Sequence: Synthetic probe
actacgaccacggtggtaaggatcgctacaagaccgcgataaccaaacctgtcaaacaac

SEQ ID NO: 7175 - DNA, 60 bp, Artificial Sequence
  Description of Artificial Sequence: Synthetic probe
aacggtgattgtaagtacaagcccgctggcacggccccgcgtggaaacattcgtggggac

SEQ ID NO: 7176 - DNA, 60 bp, Artificial Sequence
  Description of Artificial Sequence: Synthetic probe
caatccagtcgtcttttcgcacaacggtaccacccgctttgcgctgccttacactgcgcc

SEQ ID NO: 7177 - DNA, 60 bp, Artificial Sequence
  Description of Artificial Sequence: Synthetic probe
gaacgaagtgtgcgacaatccagtcgtcttttcgcacaacggtaccacccgctttgcgct

SEQ ID NO: 7178 - DNA, 60 bp, Artificial Sequence
  Description of Artificial Sequence: Synthetic probe
cctgttacgtgctgctacgtactacttctctgacctggagattgtggtacgccatgacgg

SEQ ID NO: 7179 - DNA, 60 bp, Artificial Sequence
  Description of Artificial Sequence: Synthetic probe
cgctctgttgcgtgcggctacgtactacttctctgacctggagattgtggtacgccatga

SEQ ID NO: 7180 - DNA, 60 bp, Artificial Sequence
  Description of Artificial Sequence: Synthetic probe
gcgctctgttgcgtgcggctacgtactacttctctgacctggagattgtggtacgccatg

SEQ ID NO: 7181 - DNA, 60 bp, Artificial Sequence
  Description of Artificial Sequence: Synthetic probe
taggtgccctgttacgtgctgctacgtactacttctctgacctggagattgtggtacgcc

SEQ ID NO: 7182 - DNA, 60 bp, Artificial Sequence
  Description of Artificial Sequence: Synthetic probe
tccttctggacaggttcacactggtgggaaaaacacaggacaacaaaatggtacttgaca

SEQ ID NO: 7183 - DNA, 54 bp, Artificial Sequence
  Description of Artificial Sequence: Synthetic probe
gtagactgttgtgtgacactggcacggcttactaccgcatgaagagagctgagc

SEQ ID NO: 7184 - DNA, 58 bp, Artificial Sequence
  Description of Artificial Sequence: Synthetic probe
gcacgccgaggcgacttggcggtgctgtcacagcgtgtggagagtgaaaccacaagat

SEQ ID NO: 7185 - DNA, 60 bp, Artificial Sequence
  Description of Artificial Sequence: Synthetic probe
aaacccaccacgtctcagcacgccgaggcgacttggcggtgctgtcacagcgtgtggaga

SEQ ID NO: 7186 - DNA, 53 bp, Artificial Sequence
  Description of Artificial Sequence: Synthetic probe
aaaacggtgtcgcccgctttgccctaccatacactgcaccacacagagttctt

SEQ ID NO: 7187 - DNA, 60 bp, Artificial Sequence
  Description of Artificial Sequence: Synthetic probe
cgtccacgctaaaaacggtgtcgcccgctttgccctaccatacactgcaccacacagagt

SEQ ID NO: 7188 - DNA, 60 bp, Artificial Sequence
  Description of Artificial Sequence: Synthetic probe
gtacctaacggctgcccacacaccgaccgtgtggaagacaacccagtcgtccacgctaaa

SEQ ID NO: 7189 - DNA, 60 bp, Artificial Sequence
  Description of Artificial Sequence: Synthetic probe
tgggtacctaacggctgcccacacaccgaccgtgtggaagacaacccagtcgtccacgct

SEQ ID NO: 7190 - DNA, 60 bp, Artificial Sequence
  Description of Artificial Sequence: Synthetic probe
gcctgtcgagctcatcctcgatgggaagacggtggccatctgctgtgctaccggagtgtt

SEQ ID NO: 7191 - DNA, 60 bp, Artificial Sequence
  Description of Artificial Sequence: Synthetic probe
tccacgagcttctcgtgcgaatgaagcgtgccgagctctactgccccaggccactgctgg

SEQ ID NO: 7192 - DNA, 60 bp, Artificial Sequence
  Description of Artificial Sequence: Synthetic probe
tgcgaatgaagcgtgccgagctctactgccccaggccactgctggcggtggaggtgttgt

SEQ ID NO: 7193 - DNA, 60 bp, Artificial Sequence
  Description of Artificial Sequence: Synthetic probe
aacaaaacacggacccgactttaaccggttggtcaccgcgtttgaggaattggccactgg

SEQ ID NO: 7194 - DNA, 60 bp, Artificial Sequence
  Description of Artificial Sequence: Synthetic probe
gtcaacaaaacacggacccgactttaaccggttggtcaccgcgtttgaggaattggccac

SEQ ID NO: 7195 - DNA, 60 bp, Artificial Sequence
  Description of Artificial Sequence: Synthetic probe
gtcaacaaaacacggacccgactttaaccggttggtgtccgccatttgaggagttggcca

SEQ ID NO: 7196 - DNA, 60 bp, Artificial Sequence
  Description of Artificial Sequence: Synthetic probe
agtaggtgccctcctaagggcgtccacctactacttctgtgacctggaaattgcatgtgt

SEQ ID NO: 7197 - DNA, 60 bp, Artificial Sequence
  Description of Artificial Sequence: Synthetic probe
gccatgacagacagtgactacagagtgtttgagtttgagattaaagtaaaaggacaggac

SEQ ID NO: 7198 - DNA, 60 bp, Artificial Sequence
  Description of Artificial Sequence: Synthetic probe
ctcgacaccactcaggaccgccgtaaacaggagatcattgcacctgagaaacaggtactg

SEQ ID NO: 7199 - DNA, 60 bp, Artificial Sequence
  Description of Artificial Sequence: Synthetic probe
ttggccacaacgtacactggtacaacggcctacagcgctggtgcgcgtaggggagatcta

SEQ ID NO: 7200 - DNA, 60 bp, Artificial Sequence
  Description of Artificial Sequence: Synthetic probe
gtgttggccacaacgtacactggtacaacggcctacagcgctggtgcgcgtaggggagat

SEQ ID NO: 7201 - DNA, 60 bp, Artificial Sequence
  Description of Artificial Sequence: Synthetic probe
cgtgttggccacaacgtacactggtacaacggcctacactactggtgcgcgtaggggaga

SEQ ID NO: 7202 - DNA, 60 bp, Artificial Sequence
  Description of Artificial Sequence: Synthetic probe
caaccactttcaactacggcaggatctacacggaggcggaagtcgacgtgtacgtgagga

SEQ ID NO: 7203 - DNA, 60 bp, Artificial Sequence
  Description of Artificial Sequence: Synthetic probe
ccaaccaccttcaactacggcaggatctacacggaggcggaagtcgacgtgtacgtgaga

SEQ ID NO: 7204 - DNA, 60 bp, Artificial Sequence
  Description of Artificial Sequence: Synthetic probe
tgctgccacgtactacttctcagacctggagattgtggtgcgccacgaaggcaacctgac

SEQ ID NO: 7205 - DNA, 60 bp, Artificial Sequence
  Description of Artificial Sequence: Synthetic probe
cgtgctgccacgtactacttctcagacctggagattgtggtgcgccacgaaggcaacctg

SEQ ID NO: 7206 - DNA, 60 bp, Artificial Sequence
  Description of Artificial Sequence: Synthetic probe
ttcaggccacgaccatccacgagctcctcgtgcgcatgaaacgtgccgagctttactgtc

SEQ ID NO: 7207 - DNA, 60 bp, Artificial Sequence
  Description of Artificial Sequence: Synthetic probe
ggcgagtgatgacgtgaactccgagcccgccagatccgtagaggaacaaccacaagctga

SEQ ID NO: 7208 - DNA, 60 bp, Artificial Sequence
  Description of Artificial Sequence: Synthetic probe
cgggacaaaaggcgagtgatgacgtgaactccgagcccgccagatccgtagaggaacaac

SEQ ID NO: 7209 - DNA, 60 bp, Artificial Sequence
  Description of Artificial Sequence: Synthetic probe
ctctgagatcattggtgccagcactgttggcttcagagagaggactctcccgggacaaaa

SEQ ID NO: 7210 - DNA, 60 bp, Artificial Sequence
  Description of Artificial Sequence: Synthetic probe
ggatgacaagactcttgacgaggcggaaaagaacccctctgagatcattggtgccagcac

SEQ ID NO: 7211 - DNA, 60 bp, Artificial Sequence
  Description of Artificial Sequence: Synthetic probe
cgcctgaaggagaactttgagattgttgccctgtgtttgaccctcttggcaaacatagtg

SEQ ID NO: 7212 - DNA, 60 bp, Artificial Sequence
  Description of Artificial Sequence: Synthetic probe
gaggagctccgaccccttatccaacagacctcatttgtgaaacgcgcttttaagcgcctg

SEQ ID NO: 7213 - DNA, 60 bp, Artificial Sequence
  Description of Artificial Sequence: Synthetic probe
ttaaggaggagctccgaccccttatccaacagacctcatttgtgaaacgcgcttttaagc

SEQ ID NO: 7214 - DNA, 60 bp, Artificial Sequence
  Description of Artificial Sequence: Synthetic probe
ctcttccaggacaactagcgagtgatgacgtgaactccgagcccgctaagaccatggagg

SEQ ID NO: 7215 - DNA, 60 bp, Artificial Sequence
  Description of Artificial Sequence: Synthetic probe
ccagtggtgccagcaccgttggcttcagagagagaactcttccaggacaactagcgagtg

SEQ ID NO: 7216 - DNA, 60 bp, Artificial Sequence
  Description of Artificial Sequence: Synthetic probe
gaaccccctggaaaccagtggtgccagcaccgttggcttcagagagagaactcttccagg

SEQ ID NO: 7217 - DNA, 60 bp, Artificial Sequence
  Description of Artificial Sequence: Synthetic probe
tcttggcaaacatagtgattatggtccgcgagactcgtaagagacaacagatggtggatg

SEQ ID NO: 7218 - DNA, 60 bp, Artificial Sequence
  Description of Artificial Sequence: Synthetic probe
ctcttggcaaacatagtgattatggtccgcgagactcgtaagagacaacagatggtggat

SEQ ID NO: 7219 - DNA, 60 bp, Artificial Sequence
  Description of Artificial Sequence: Synthetic probe
ccatccacgagcttctcgtgcgcatgaagcgtgctgagctctactgccccaggccactgc

SEQ ID NO: 7220 - DNA, 60 bp, Artificial Sequence
  Description of Artificial Sequence: Synthetic probe
agaggtgacctacaagtgttggcccagaaggcggctagaacgctgcccacctccttcaac

SEQ ID NO: 7221 - DNA, 60 bp, Artificial Sequence
  Description of Artificial Sequence: Synthetic probe
aacctcacctgggtcccgaatggggcgcccgagacagcgttggacaacaccacaaatcca

SEQ ID NO: 7222 - DNA, 60 bp, Artificial Sequence
  Description of Artificial Sequence: Synthetic probe
aacacgaggggaacctcacctgggtcccgaatggggcgcccgagacagcgttggacaaca

SEQ ID NO: 7223 - DNA, 60 bp, Artificial Sequence
  Description of Artificial Sequence: Synthetic probe
ccatcaccgatgtcactttcctcaaaagacacttccacatggattatggaactgggtttt

SEQ ID NO: 7224 - DNA, 60 bp, Artificial Sequence
  Description of Artificial Sequence: Synthetic probe
ccattactgacgtcactttcctcaaaagacacttccacatggattatggcactgggtttt

SEQ ID NO: 7225 - DNA, 60 bp, Artificial Sequence
  Description of Artificial Sequence: Synthetic probe
caaaacccggaccttgcttatggccgaaacaccaaggttggcaatcgaaccggtgcagac

SEQ ID NO: 7226 - DNA, 60 bp, Artificial Sequence
  Description of Artificial Sequence: Synthetic probe
ggacgccttccatcaaaacccggaccttgcttatggccgaaacaccaaggttggcaatcg

SEQ ID NO: 7227 - DNA, 60 bp, Artificial Sequence
  Description of Artificial Sequence: Synthetic probe
cccaacgtgagacttcaggtgttggctcaagtggcacggacgccttccatcaaaacccgg

SEQ ID NO: 7228 - DNA, 60 bp, Artificial Sequence
  Description of Artificial Sequence: Synthetic probe
cagcagaaatgctcccaacgtgagacttcaggtgttggctcaagtggcacggacgccttc

SEQ ID NO: 7229 - DNA, 60 bp, Artificial Sequence
  Description of Artificial Sequence: Synthetic probe
gccctgcccaccgcgccccgcgtgttggcaaccgtgggtgagtgcaggtacagcagaaat

SEQ ID NO: 7230 - DNA, 60 bp, Artificial Sequence
  Description of Artificial Sequence: Synthetic probe
gaaatcaggcgccaagacgtctcgttcatcatggacaaagtgccgcaaaacattaacatt

SEQ ID NO: 7231 - DNA, 60 bp, Artificial Sequence
  Description of Artificial Sequence: Synthetic probe
tggtgtgacccgctttgccatcccgttcacggccccacacaggctgctgtctactgttta

SEQ ID NO: 7232 - DNA, 60 bp, Artificial Sequence
  Description of Artificial Sequence: Synthetic probe
cggtgtgacccgctttgccatcccgttcacggccccacacaggctgctgtctactgtcta

SEQ ID NO: 7233 - DNA, 60 bp, Artificial Sequence
  Description of Artificial Sequence: Synthetic probe
caagggcggtgtgacccgctttgccatcccgttcacggccccacacaggttgctgtctac

SEQ ID NO: 7234 - DNA, 60 bp, Artificial Sequence
  Description of Artificial Sequence: Synthetic probe
gttttcgccaagggcggtgtgacccgctttgccatcccgttcacggccccacacaggctg

SEQ ID NO: 7235 - DNA, 60 bp, Artificial Sequence
  Description of Artificial Sequence: Synthetic probe
ggttttcgccaagggtggtgtgacccgctttgccatcccgttcacggccccacacaggct

SEQ ID NO: 7236 - DNA, 60 bp, Artificial Sequence
  Description of Artificial Sequence: Synthetic probe
ggttttcgccaagggcggtgtgacccgctttgccatcccgttcacggccccacacaggct

SEQ ID NO: 7237 - DNA, 60 bp, Artificial Sequence
  Description of Artificial Sequence: Synthetic probe
ccccatggttttcgccaagggcggtgtgacccgctttgccatcccgttcacggccccaca

SEQ ID NO: 7238 - DNA, 60 bp, Artificial Sequence
  Description of Artificial Sequence: Synthetic probe
aaccctaccgcctacaacaaagcgccgttcacgaggcttgcgctcccctacactgcgcca

SEQ ID NO: 7239 - DNA, 60 bp, Artificial Sequence
  Description of Artificial Sequence: Synthetic probe
ccgccgacaaaccagtcgacgtttactaccggatgaagcgcgctgagctctactgtccac

SEQ ID NO: 7240 - DNA, 52 bp, Artificial Sequence
  Description of Artificial Sequence: Synthetic probe
ggccactcctccctgcctacgaccaggagaccagggacaggttcgacgcccc

SEQ ID NO: 7241 - DNA, 60 bp, Artificial Sequence
  Description of Artificial Sequence: Synthetic probe
ggccactcctccctgcctacgaccaggagaccagggacaggttcgacgcccccatcggcg

SEQ ID NO: 7242 - DNA, 60 bp, Artificial Sequence
  Description of Artificial Sequence: Synthetic probe
cttcagaatgaagaggaccgagctctactgttcaaggccactcctccctgcctacgacca

SEQ ID NO: 7243 - DNA, 60 bp, Artificial Sequence
  Description of Artificial Sequence: Synthetic probe
tacactgcgccacaccgcgtgctggcaacagtgtacaacgggacgagcaagtactccgcg

SEQ ID NO: 7244 - DNA, 60 bp, Artificial Sequence
  Description of Artificial Sequence: Synthetic probe
agtggaagtgttgtcgcaggacagacacaagcaaaagatcattgcacctgcaaagcaact

SEQ ID NO: 7245 - DNA, 60 bp, Artificial Sequence
  Description of Artificial Sequence: Synthetic probe
tccgcggtgaccgcgctgtgttagcggccaaatacgcgaacacacgccacacgcttcctt

SEQ ID NO: 7246 - DNA, 60 bp, Artificial Sequence
  Description of Artificial Sequence: Synthetic probe
tacagaacacatgtcaccgccatccgcggtgaccgcgctgtgttagcggccaaatacgca

SEQ ID NO: 7247 - DNA, 56 bp, Artificial Sequence
  Description of Artificial Sequence: Synthetic probe
accgtttgttgtcaactgtctacaacggtgagtgtgtgtacagtaaacctgtcacc

SEQ ID NO: 7248 - DNA, 60 bp, Artificial Sequence
  Description of Artificial Sequence: Synthetic probe
acactgcgccacaccgtttgttgtcaactgtctacaacggtgagtgcgggtacagaacac

SEQ ID NO: 7249 - DNA, 60 bp, Artificial Sequence
  Description of Artificial Sequence: Synthetic probe
acaagccagtcgacgtttactaccggatgaagagagcggagctttactgtccgaggcctc

SEQ ID NO: 7250 - DNA, 60 bp, Artificial Sequence
  Description of Artificial Sequence: Synthetic probe
cgtgaccgccgacaaaccagtcgacgtttactaccggatgaagagggcggagctctactg

SEQ ID NO: 7251 - DNA, 51 bp, Artificial Sequence
  Description of Artificial Sequence: Synthetic probe
ggtaaccaacacacactcgacgtgatgcaggcacacaaagacaatatcgtg

SEQ ID NO: 7252 - DNA, 60 bp, Artificial Sequence
  Description of Artificial Sequence: Synthetic probe
ggtacgccattgatgatgaggtgttctatccatggacacctgaccccgcggacgtactcg

SEQ ID NO: 7253 - DNA, 60 bp, Artificial Sequence
  Description of Artificial Sequence: Synthetic probe
gtgatgacactggctgacttccacgctggcatcttcatcagaggcaccgagcacgcagtg

SEQ ID NO: 7254 - DNA, 60 bp, Artificial Sequence
  Description of Artificial Sequence: Synthetic probe
gtgatcaacggcgttgtgatgacactggctgacttccacgctggcatcttcatcagaggc

SEQ ID NO: 7255 - DNA, 60 bp, Artificial Sequence
  Description of Artificial Sequence: Synthetic probe
ggtgggccacccgcacttgtgctttggctcatcaaagattgtctcaacactggcgttggc

SEQ ID NO: 7256 - DNA, 60 bp, Artificial Sequence
  Description of Artificial Sequence: Synthetic probe
gagaacaagacactggatatgatcaaacaactttctgactacaccggacttgacctctca

SEQ ID NO: 7257 - DNA, 60 bp, Artificial Sequence
  Description of Artificial Sequence: Synthetic probe
gatacgtcgatgagccgcttttcgagtctgagtacctgtcacccgagaacaagacactgg

SEQ ID NO: 7258 - DNA, 54 bp, Artificial Sequence
  Description of Artificial Sequence: Synthetic probe
cccgtccaatgtcctgtgctttgtcccgtatgacatggaaccattcaacggaga

SEQ ID NO: 7259 - DNA, 54 bp, Artificial Sequence
  Description of Artificial Sequence: Synthetic probe
cccatctgatgtcctgtgttttgtcccgtatgacatggaaccattcaacggaga

SEQ ID NO: 7260 - DNA, 60 bp, Artificial Sequence
  Description of Artificial Sequence: Synthetic probe
cccgtccaatgtcctgtgctttgtcccgtatgacatggaaccattcaacggagacgcgat

SEQ ID NO: 7261 - DNA, 60 bp, Artificial Sequence
  Description of Artificial Sequence: Synthetic probe
cccatctgatgtcctgtgttttgtcccgtatgacatggaaccattcaacggagacgcaat

SEQ ID NO: 7262 - DNA, 60 bp, Artificial Sequence
  Description of Artificial Sequence: Synthetic probe
ccattgacgacgaggacttctacccgtggacaccggacccgtccaatgtcctgtgctttg

SEQ ID NO: 7263 - DNA, 60 bp, Artificial Sequence
  Description of Artificial Sequence: Synthetic probe
gtacgccattgacgacgaggacttctacccgtggacaccagacccatctgatgtcctgtg

SEQ ID NO: 7264 - DNA, 60 bp, Artificial Sequence
  Description of Artificial Sequence: Synthetic probe
cccactgcataccacaagggaccgctgactcgactggctctcccatacaccgcgccacat

SEQ ID NO: 7265 - DNA, 60 bp, Artificial Sequence
  Description of Artificial Sequence: Synthetic probe
cccactgcataccacaagggaccgctgactcgactggctctcccatacaccgcgccacac

SEQ ID NO: 7266 - DNA, 60 bp, Artificial Sequence
  Description of Artificial Sequence: Synthetic probe
gctggcacacccccgcgcgagaacattcgcggggacctcgcgacccttgcgcagaggatt

SEQ ID NO: 7267 - DNA, 60 bp, Artificial Sequence
  Description of Artificial Sequence: Synthetic probe
cccgctttgcactgccctacactgcgccacacagatgtctggcaacaacctacaacggtg

SEQ ID NO: 7268 - DNA, 60 bp, Artificial Sequence
  Description of Artificial Sequence: Synthetic probe
cccacctccttcaactacggtgccatcaaggccactcgggtgacagaactgctttaccgc

SEQ ID NO: 7269 - DNA, 60 bp, Artificial Sequence
  Description of Artificial Sequence: Synthetic probe
cggaggagaaacacaaatccaacgtcgccaccacactgacgttgccttcgttcttgaccg

SEQ ID NO: 7270 - DNA, 60 bp, Artificial Sequence
  Description of Artificial Sequence: Synthetic probe
acacagaagctgaggttgacgtgtacgtcaggatgaagcgcgcagagctctactgcccgc

SEQ ID NO: 7271 - DNA, 60 bp, Artificial Sequence
  Description of Artificial Sequence: Synthetic probe
tctcccggcatatgaacacaacgaccgggacaggtacgacggccccatcggcgtcgaaaa

SEQ ID NO: 7272 - DNA, 60 bp, Artificial Sequence
  Description of Artificial Sequence: Synthetic probe
cttctcccggcatatgaacacaacgaccgggacaggtacgacggccccatcggcgtcgaa

SEQ ID NO: 7273 - DNA, 60 bp, Artificial Sequence
  Description of Artificial Sequence: Synthetic probe
gacgtgtactacaggatgaagcgtgcggagctgtattgccccagaccacttctcccggca

SEQ ID NO: 7274 - DNA, 60 bp, Artificial Sequence
  Description of Artificial Sequence: Synthetic probe
ttgacgtgtactacaggatgaagcgtgcggagctgtattgccccagaccacttctcccgg

SEQ ID NO: 7275 - DNA, 60 bp, Artificial Sequence
  Description of Artificial Sequence: Synthetic probe
ggcacagaagtatgccaacaccaaacactcactcccatccaccttcaactttggtcacgt

SEQ ID NO: 7276 - DNA, 60 bp, Artificial Sequence
  Description of Artificial Sequence: Synthetic probe
gggcggtgttggcacagaagtatgccaacaccaaacactcactcccatccaccttcaact

SEQ ID NO: 7277 - DNA, 60 bp, Artificial Sequence
  Description of Artificial Sequence: Synthetic probe
cggtgagtgcacttatgtacacaagacacaagccatccgtggtgacagggcggtgttggc

SEQ ID NO: 7278 - DNA, 60 bp, Artificial Sequence
  Description of Artificial Sequence: Synthetic probe
caacggtgagtgcacttatgtacacaagacacaagccatccgtggtgacagggcggtgtt

SEQ ID NO: 7279 - DNA, 60 bp, Artificial Sequence
  Description of Artificial Sequence: Synthetic probe
gccgtcccctacacagcacctcaccggctgctttcaacagtgtacaacggtgagtgcact

SEQ ID NO: 7280 - DNA, 60 bp, Artificial Sequence
  Description of Artificial Sequence: Synthetic probe
cggtttgccgtcccctacacagcacctcaccggctgctttcaacagtgtacaacggtgag

SEQ ID NO: 7281 - DNA, 60 bp, Artificial Sequence
  Description of Artificial Sequence: Synthetic probe
ggataacccgatggttttcccgcacaacaaagtcacacggtttgccgtcccctacacagc

SEQ ID NO: 7282 - DNA, 60 bp, Artificial Sequence
  Description of Artificial Sequence: Synthetic probe
caaccgtgttgggggataacccgatggttttcccgcacaacaaagtcacacggtttgccg

SEQ ID NO: 7283 - DNA, 60 bp, Artificial Sequence
  Description of Artificial Sequence: Synthetic probe
gccctgctacgggcttccacctactatttctgtgacctggaaatcgcgtgtgtgggggac

SEQ ID NO: 7284 - DNA, 57 bp, Artificial Sequence
  Description of Artificial Sequence: Synthetic probe
gccctgctacgggcttccacctactatttctgtgacctggaaatcgcgtgtgtgggg

SEQ ID NO: 7285 - DNA, 54 bp, Artificial Sequence
  Description of Artificial Sequence: Synthetic probe
accaccagtgctggcgagggcgcagacgtcgtcacgactgacccctcaacgcac

SEQ ID NO: 7286 - DNA, 60 bp, Artificial Sequence
  Description of Artificial Sequence: Synthetic probe
atgagccattcttcgactgggtttacgactcgcccgagaacctcacgctccaagcaattg

SEQ ID NO: 7287 - DNA, 60 bp, Artificial Sequence
  Description of Artificial Sequence: Synthetic probe
acgtactacttctcagacctggaggttgcgcttgtccacacaggcccggtcacgtgggtg

SEQ ID NO: 7288 - DNA, 60 bp, Artificial Sequence
  Description of Artificial Sequence: Synthetic probe
tgtctgacctccaacggttggtacgccattgacgacgaggacttctacccgtggacgcca

SEQ ID NO: 7289 - DNA, 58 bp, Artificial Sequence
  Description of Artificial Sequence: Synthetic probe
cccgcctggcactcccctacacagcgccccaccgtgtgctggcaacagtgtacaacgg

SEQ ID NO: 7290 - DNA, 60 bp, Artificial Sequence
  Description of Artificial Sequence: Synthetic probe
cgatttgtgaagataaacagcctgagccccacacatgtcattgacctcatgcacacccac

SEQ ID NO: 7291 - DNA, 60 bp, Artificial Sequence
  Description of Artificial Sequence: Synthetic probe
atggaccgatttgtgaagataaacagcctgagccccacacatgtcattgacctcatgcac

SEQ ID NO: 7292 - DNA, 60 bp, Artificial Sequence
  Description of Artificial Sequence: Synthetic probe
tcatcatggaccgatttgtgaagataaacagcctgagccccacacatgtcattgacctca

SEQ ID NO: 7293 - DNA, 60 bp, Artificial Sequence
  Description of Artificial Sequence: Synthetic probe
ccacacggacgtcggcttcattatggaccgatttgtgaagataaacagcctgagccccac

SEQ ID NO: 7294 - DNA, 60 bp, Artificial Sequence
  Description of Artificial Sequence: Synthetic probe
atccaacagcatatcacaaggcaccgctcacccggcttgcactgccttacacggcaccac

SEQ ID NO: 7295 - DNA, 50 bp, Artificial Sequence
  Description of Artificial Sequence: Synthetic probe
ggggatctgcggaccctgtcaccaccacggttgagaactacggtggtaac

SEQ ID NO: 7296 - DNA, 50 bp, Artificial Sequence
  Description of Artificial Sequence: Synthetic probe
tcggttgggttcctaacggtgctcctgtgcctaagggagtgggcgacaac

SEQ ID NO: 7297 - DNA, 59 bp, Artificial Sequence
  Description of Artificial Sequence: Synthetic probe
gcacggaggtaacactcgccctacacgacgggttcacaccgacgtcgcgtttctcttgg

SEQ ID NO: 7298 - DNA, 60 bp, Artificial Sequence
  Description of Artificial Sequence: Synthetic probe
cttctccgacttggagattgttgtgcggcacgatggtaatctgacctgggtgcccaacgg

SEQ ID NO: 7299 - DNA, 57 bp, Artificial Sequence
  Description of Artificial Sequence: Synthetic probe
ccacaccggaatcggcaccgcctcgcgacccagcgaggtgtgcatggtcgacggtac

SEQ ID NO: 7300 - DNA, 60 bp, Artificial Sequence
  Description of Artificial Sequence: Synthetic probe
caactttgggcacgttactgcagaccaagcagttgacgtgtactacaggatgaagcgtgc

SEQ ID NO: 7301 - DNA, 60 bp, Artificial Sequence
  Description of Artificial Sequence: Synthetic probe
gaccgtcgacaagccagtcgacgtttactaccggatgaagagggctgagctgtactgtcc

SEQ ID NO: 7302 - DNA, 60 bp, Artificial Sequence
  Description of Artificial Sequence: Synthetic probe
ccgggacagattcgacgcacccatcggcgttgaaaagcaactgtgtaacttcgacctgtt

SEQ ID NO: 7303 - DNA, 60 bp, Artificial Sequence
  Description of Artificial Sequence: Synthetic probe
aaaacgcgcgtgaccgccatccgcggtgaccggcccgtgctgggctccaagtacgctgat

SEQ ID NO: 7304 - DNA, 60 bp, Artificial Sequence
  Description of Artificial Sequence: Synthetic probe
atcaagaaccgctcaatggagaatggaaagcaaaggttcagaagcgactcaagggagctg

SEQ ID NO: 7305 - DNA, 60 bp, Artificial Sequence
  Description of Artificial Sequence: Synthetic probe
gatcaagaaccgctcaatggagaatggaaagcaaaggttcagaagcgactcaagggagct

SEQ ID NO: 7306 - DNA, 60 bp, Artificial Sequence
  Description of Artificial Sequence: Synthetic probe
ctgttacgggcagccacgtactacttctctgacctggagattgtggtgcgccacgaaggc

SEQ ID NO: 7307 - DNA, 60 bp, Artificial Sequence
  Description of Artificial Sequence: Synthetic probe
ggttggtaggtgccctgttacgggcagccacgtactacttctctgacctggagattgtgg

SEQ ID NO: 7308 - DNA, 60 bp, Artificial Sequence
  Description of Artificial Sequence: Synthetic probe
ctgacaccatcactgagcttttgatccgcatgaaacgcgcggagacatactgccctaggc

SEQ ID NO: 7309 - DNA, 60 bp, Artificial Sequence
  Description of Artificial Sequence: Synthetic probe
cccaaccacctttaactacggcaggatttacactgaagccgaggttgacgtgtacgtaag

SEQ ID NO: 7310 - DNA, 60 bp, Artificial Sequence
  Description of Artificial Sequence: Synthetic probe
gagacacacatcccaaccacctttaactacggcaggatttacactgaagccgaggttgac

SEQ ID NO: 7311 - DNA, 60 bp, Artificial Sequence
  Description of Artificial Sequence: Synthetic probe
ttgtcttcagaccggcgttggcaccagcactcgccccagcgagatctgtgtcataaacgg

SEQ ID NO: 7312 - DNA, 60 bp, Artificial Sequence
  Description of Artificial Sequence: Synthetic probe
ctgatcaaagattgtcttcagaccggcgttggcaccagcactcgccccagcgagatctgt

SEQ ID NO: 7313 - DNA, 60 bp, Artificial Sequence
  Description of Artificial Sequence: Synthetic probe
ggtcgcacttgtgtcaccagccaaacaactgtgcaacttcgacctgttaaagttggccgg

SEQ ID NO: 7314 - DNA, 60 bp, Artificial Sequence
  Description of Artificial Sequence: Synthetic probe
atacaaggtcgcacttgtgtcaccagccaaacaactgtgcaacttcgacctgttaaagtt

SEQ ID NO: 7315 - DNA, 60 bp, Artificial Sequence
  Description of Artificial Sequence: Synthetic probe
caggtgatgtgtattaccggatgaagcggactgaattctactgtccacgtccgctgatgg

SEQ ID NO: 7316 - DNA, 60 bp, Artificial Sequence
  Description of Artificial Sequence: Synthetic probe
gattgttgtgtgaatcaggtgatgtgtattaccggatgaagcggactgaattctactgtc

SEQ ID NO: 7317 - DNA, 57 bp, Artificial Sequence
  Description of Artificial Sequence: Synthetic probe
gacgcaacgtgtcaactcacgccgtggcgacatggcctcactggcacagcgcgttga

SEQ ID NO: 7318 - DNA, 60 bp, Artificial Sequence
  Description of Artificial Sequence: Synthetic probe
cgctgatgcaagtgttgacgtgtactacaggatgaagcgtgctgaactttactgccccag

SEQ ID NO: 7319 - DNA, 60 bp, Artificial Sequence
  Description of Artificial Sequence: Synthetic probe
cttcgggcatgttaccgctgatgcaagtgttgacgtgtactacaggatgaagcgtgctga

SEQ ID NO: 7320 - DNA, 60 bp, Artificial Sequence
  Description of Artificial Sequence: Synthetic probe
ggcgcacctagaactacccaactcggagacaacccgatggttttctcgaacaagggtgtc

SEQ ID NO: 7321 - DNA, 60 bp, Artificial Sequence
  Description of Artificial Sequence: Synthetic probe
ggcgcacctaggaccacccaactcagagacaacccgatggttttctcgaacaagggtgtt

SEQ ID NO: 7322 - DNA, 60 bp, Artificial Sequence
  Description of Artificial Sequence: Synthetic probe
cggcgcacctagaactacccaactcggagacaacccgatggttttctcgaacaagggtgt

SEQ ID NO: 7323 - DNA, 60 bp, Artificial Sequence
  Description of Artificial Sequence: Synthetic probe
accaccctgaccggggagtccgcagaccctgtcaccaccaccgtggagaactacggcggt

SEQ ID NO: 7324 - DNA, 60 bp, Artificial Sequence
  Description of Artificial Sequence: Synthetic probe
ggaagtcgacgtgtacgtgagaatgaaacgggcggagctttactgcccccgcccggtgtt

SEQ ID NO: 7325 - DNA, 54 bp, Artificial Sequence
  Description of Artificial Sequence: Synthetic probe
gaggcggatgtcgacgtgtacgtgagaatgaaacgggcggagctttactgcccc

SEQ ID NO: 7326 - DNA, 60 bp, Artificial Sequence
  Description of Artificial Sequence: Synthetic probe
gaggcggatgtcgacgtgtacgtgagaatgaaacgggcggagctttactgcccccgtccg

SEQ ID NO: 7327 - DNA, 55 bp, Artificial Sequence
  Description of Artificial Sequence: Synthetic probe
ggaggcggatgtcgacgtgtacgtgagaatgaaacgggcggagctttactgcccc

SEQ ID NO: 7328 - DNA, 60 bp, Artificial Sequence
  Description of Artificial Sequence: Synthetic probe
ggaggcggatgtcgacgtgtacgtgagaatgaaacgggcggagctttactgcccccgtcc

SEQ ID NO: 7329 - DNA, 60 bp, Artificial Sequence
  Description of Artificial Sequence: Synthetic probe
atggacacgactgactgttttatcgctctgttacacgctcttagagagattaaaacactc

SEQ ID NO: 7330 - DNA, 57 bp, Artificial Sequence
  Description of Artificial Sequence: Synthetic probe
atgtctcgttcatattggacagatttgtgaaagtgacaccaaaagaccaaattaatg

SEQ ID NO: 7331 - DNA, 60 bp, Artificial Sequence
  Description of Artificial Sequence: Synthetic probe
taaagtaaaaggacaggacatgctctcagacgccgctctcatggtgctgcaccgtgggaa

SEQ ID NO: 7332 - DNA, 60 bp, Artificial Sequence
  Description of Artificial Sequence: Synthetic probe
taaagtaaaaggacaggacatgctctcagacgccgctctcatggtgctacaccgtgggaa

SEQ ID NO: 7333 - DNA, 60 bp, Artificial Sequence
  Description of Artificial Sequence: Synthetic probe
attaaagtaaaaggacaggacatgctctcagacgccgcgctcatggtgcttcaccgtggg

SEQ ID NO: 7334 - DNA, 60 bp, Artificial Sequence
  Description of Artificial Sequence: Synthetic probe
tttgagatcaaagtaaaaggacaggacatgctctcagacgccgcactcatggtgctgcac

SEQ ID NO: 7335 - DNA, 60 bp, Artificial Sequence
  Description of Artificial Sequence: Synthetic probe
ttctttcaactacggcgccgtgaaggctgagaacatcactgagcttttgatccgcatgaa

SEQ ID NO: 7336 - DNA, 50 bp, Artificial Sequence
  Description of Artificial Sequence: Synthetic probe
cgcggtgatatggcggtccttgcacagatgctgagtgggcagttgcccac

SEQ ID NO: 7337 - DNA, 60 bp, Artificial Sequence
  Description of Artificial Sequence: Synthetic probe
cgcggtgatatggcggtccttgcacagatgctgagtgggcagttgcccacttctttcaac

SEQ ID NO: 7338 - DNA, 60 bp, Artificial Sequence
  Description of Artificial Sequence: Synthetic probe
ggcgacagccttcctgctccttcaactttggtgcagttcgagccacgaccatccacgagc

SEQ ID NO: 7339 - DNA, 60 bp, Artificial Sequence
  Description of Artificial Sequence: Synthetic probe
ggcccttacctacaaggacattgtagtgtgcatggatggagacaccatgcctggcctctt

SEQ ID NO: 7340 - DNA, 60 bp, Artificial Sequence
  Description of Artificial Sequence: Synthetic probe
tactgtccccgccccgttctcacgcactacgaccacggaggcaaagaccgttacaaaacg

SEQ ID NO: 7341 - DNA, 60 bp, Artificial Sequence
  Description of Artificial Sequence: Synthetic probe
aactctactgtccccgccccgttctcacgcactacgaccacggaggcaaagaccgttaca

SEQ ID NO: 7342 - DNA, 60 bp, Artificial Sequence
  Description of Artificial Sequence: Synthetic probe
acgcgagaacattcgcggtgacctcgcaactctggctacgcggattgctagtgagaccca

SEQ ID NO: 7343 - DNA, 60 bp, Artificial Sequence
  Description of Artificial Sequence: Synthetic probe
cactagcgcaccaccacgcgagaacattcgcggtgacctcgcaactctggctacgcggat

SEQ ID NO: 7344 - DNA, 60 bp, Artificial Sequence
  Description of Artificial Sequence: Synthetic probe
gccacagcctacaacggtgactgcaagtacaagcccactagcgcaccaccacgcgagaac

SEQ ID NO: 7345 - DNA, 60 bp, Artificial Sequence
  Description of Artificial Sequence: Synthetic probe
ccccaccgggtcgtcgccacagcctacaacggtgactgcaagtacaagcccactagcgca

SEQ ID NO: 7346 - DNA, 60 bp, Artificial Sequence
  Description of Artificial Sequence: Synthetic probe
attgggaacaacgcatgggtgggctggactcccaacggcagtccggagctgacggaagtg

SEQ ID NO: 7347 - DNA, 60 bp, Artificial Sequence
  Description of Artificial Sequence: Synthetic probe
gacacacgcttccatccacgttcaactttggacatgtgaccgccgaccagccggttgacg

SEQ ID NO: 7348 - DNA, 60 bp, Artificial Sequence
  Description of Artificial Sequence: Synthetic probe
ccagacacacgcttccatccacgttcaactttggacatgtgaccgccgaccagccggttg

SEQ ID NO: 7349 - DNA, 57 bp, Artificial Sequence
  Description of Artificial Sequence: Synthetic probe
ctttcatcgtcggcactcactccgcgggaggaaatggtgttggatattgctcgtgcg

SEQ ID NO: 7350 - DNA, 60 bp, Artificial Sequence
  Description of Artificial Sequence: Synthetic probe
tggaggagctgttcttgcaaaagacggagctgacactttcatcgtcggcactcactccgc

SEQ ID NO: 7351 - DNA, 60 bp, Artificial Sequence
  Description of Artificial Sequence: Synthetic probe
caaggctggttactgtggaggagctgttcttgcaaaagacggagctgacactttcatcgt

SEQ ID NO: 7352 - DNA, 60 bp, Artificial Sequence
  Description of Artificial Sequence: Synthetic probe
tacgatcaagaaccgctcaacggagaatggaaagcaagagttcagaggcgactcaagggg

SEQ ID NO: 7353 - DNA, 60 bp, Artificial Sequence
  Description of Artificial Sequence: Synthetic probe
gtctgcgacgtactacttctcagacctggaggttgcgcttgtacacacaggcccagccac

SEQ ID NO: 7354 - DNA, 58 bp, Artificial Sequence
  Description of Artificial Sequence: Synthetic probe
caacgggacgaacaggtacactgtgagtggctcaacaagacggggcgacttgggctcc

SEQ ID NO: 7355 - DNA, 60 bp, Artificial Sequence
  Description of Artificial Sequence: Synthetic probe
aaccccactgcctacaacaaagcgccgttcactagacttgccctcccctacacggcgcca

SEQ ID NO: 7356 - DNA, 60 bp, Artificial Sequence
  Description of Artificial Sequence: Synthetic probe
cagcaaccccactgcctacaacaaagcgccgttcactagacttgccctcccctacacggc

SEQ ID NO: 7357 - DNA, 60 bp, Artificial Sequence
  Description of Artificial Sequence: Synthetic probe
tcagcaaccccactgcctacaacaaagcgccgttcactagacttgccctcccctacacgg

SEQ ID NO: 7358 - DNA, 60 bp, Artificial Sequence
  Description of Artificial Sequence: Synthetic probe
acatcagcaaccccactgcctacaacaaagcgccgttcactagacttgccctcccctaca

SEQ ID NO: 7359 - DNA, 60 bp, Artificial Sequence
  Description of Artificial Sequence: Synthetic probe
gggtacccaatggcgcccctgaatcggccttgtctaacatcagcaaccccactgcctaca

SEQ ID NO: 7360 - DNA, 60 bp, Artificial Sequence
  Description of Artificial Sequence: Synthetic probe
gggtacccaatggcgctcctgaatcggccttgtctaacatcagcaaccccactgcctaca

SEQ ID NO: 7361 - DNA, 60 bp, Artificial Sequence
  Description of Artificial Sequence: Synthetic probe
aacctgacttgggtacccaatggcgcccctgaatcggccttgtctaacatcagcaacccc

SEQ ID NO: 7362 - DNA, 60 bp, Artificial Sequence
  Description of Artificial Sequence: Synthetic probe
gtgaaacccacccatgtcattgacctcatgcaaacccaccagcatggtctagtgggtgcg

SEQ ID NO: 7363 - DNA, 60 bp, Artificial Sequence
  Description of Artificial Sequence: Synthetic probe
gtggaacccacccatgtcattgacctcatgcaaacccaccagcatggtctagtgggtgcg

SEQ ID NO: 7364 - DNA, 60 bp, Artificial Sequence
  Description of Artificial Sequence: Synthetic probe
atgtgaaacccacccatgtcattgacctcatgcaaacccaccagcatggtctagtgggtg

SEQ ID NO: 7365 - DNA, 60 bp, Artificial Sequence
  Description of Artificial Sequence: Synthetic probe
gctcacatgggtgcccaacggcgccccagtttctgcactcaacaacacaaccaatcccac

SEQ ID NO: 7366 - DNA, 60 bp, Artificial Sequence
  Description of Artificial Sequence: Synthetic probe
aaagctcacatgggtgcccaacggcgccccagtttctgcacttgacaacacagccaaccc

SEQ ID NO: 7367 - DNA, 60 bp, Artificial Sequence
  Description of Artificial Sequence: Synthetic probe
tgggaagctcacatgggtgcccaacggcgccccagtttctgcacttgacaacacagccaa

SEQ ID NO: 7368 - DNA, 60 bp, Artificial Sequence
  Description of Artificial Sequence: Synthetic probe
ccacaccggaaagctcacatgggtgcccaacggcgccccagtttctgcacttgacaacac

SEQ ID NO: 7369 - DNA, 60 bp, Artificial Sequence
  Description of Artificial Sequence: Synthetic probe
ccacactggaaagcttacatgggtgcccaacggcgccccagtttctgcactcaacaacac

SEQ ID NO: 7370 - DNA, 60 bp, Artificial Sequence
  Description of Artificial Sequence: Synthetic probe
gacccacactggaaagctcacatgggtgcccaacggcgccccagtttctgcactcaacaa

SEQ ID NO: 7371 - DNA, 60 bp, Artificial Sequence
  Description of Artificial Sequence: Synthetic probe
tgacccacactggaaagcttacatgggtgcccaacggcgccccagtttctgcactcaaca

SEQ ID NO: 7372 - DNA, 60 bp, Artificial Sequence
  Description of Artificial Sequence: Synthetic probe
gagcttaaaccgcttctcgagcaaaccagcttcgcgaagcgtgccttcaagcgcctgaag

SEQ ID NO: 7373 - DNA, 60 bp, Artificial Sequence
  Description of Artificial Sequence: Synthetic probe
atttccattccttcccaaaagtctgtgctttacttcctcattgagaaaggacagcccgag

SEQ ID NO: 7374 - DNA, 60 bp, Artificial Sequence
  Description of Artificial Sequence: Synthetic probe
atttccattccttcccaaaagtctgtgctttacttcctcattgagaaaggacagcacgaa

SEQ ID NO: 7375 - DNA, 53 bp, Artificial Sequence
  Description of Artificial Sequence: Synthetic probe
atttccattccttcccaaaagtctgtgctttacttcctcattgagaaaggaca

SEQ ID NO: 7376 - DNA, 60 bp, Artificial Sequence
  Description of Artificial Sequence: Synthetic probe
ggggacctcgcgacactcgcggagaggattgccagtgagacacacattccaaccactttc

SEQ ID NO: 7377 - DNA, 60 bp, Artificial Sequence
  Description of Artificial Sequence: Synthetic probe
cgcggggacctcgcgactctagctcagaggattgccagtgagacacacattccaaccact

SEQ ID NO: 7378 - DNA, 60 bp, Artificial Sequence
  Description of Artificial Sequence: Synthetic probe
cccggcttatgaacacgagagccgagacagatttgacgcacccattggcgtcgagaaaca

SEQ ID NO: 7379 - DNA, 60 bp, Artificial Sequence
  Description of Artificial Sequence: Synthetic probe
tcccggcttatgaacacgagagccgagacagatttgacgcacccattggcgtcgagaaac

SEQ ID NO: 7380 - DNA, 60 bp, Artificial Sequence
  Description of Artificial Sequence: Synthetic probe
ctgccctaggccacttctcccggcttatgaacacaatagccgagacagatttgacgcacc

SEQ ID NO: 7381 - DNA, 60 bp, Artificial Sequence
  Description of Artificial Sequence: Synthetic probe
gaaacgtgcggaattgtactgccctaggccacttctcccggcttatgaacacgagagccg

SEQ ID NO: 7382 - DNA, 60 bp, Artificial Sequence
  Description of Artificial Sequence: Synthetic probe
cgtgtactacagaatgaaacgtgcggaattgtactgccctaggccacttctcccggctta

SEQ ID NO: 7383 - DNA, 60 bp, Artificial Sequence
  Description of Artificial Sequence: Synthetic probe
ctcaccggttgctgtcaaccgtgtacaacggtgagtgtgagtacacacggaaagcacaag

SEQ ID NO: 7384 - DNA, 60 bp, Artificial Sequence
  Description of Artificial Sequence: Synthetic probe
ctcaccggttgctgtcaaccgtgtacaacggtgagtgtgggtacacacggaaagcacaag

SEQ ID NO: 7385 - DNA, 60 bp, Artificial Sequence
  Description of Artificial Sequence: Synthetic probe
cagcgtgacgcgttttgccatcccttacaccgcacctcaccggttgctgtcaaccgtgta

SEQ ID NO: 7386 - DNA, 60 bp, Artificial Sequence
  Description of Artificial Sequence: Synthetic probe
caacgtgacgcggtttgccatcccttacaccgcacctcaccggttgctgtcaaccgtgta

SEQ ID NO: 7387 - DNA, 60 bp, Artificial Sequence
  Description of Artificial Sequence: Synthetic probe
ggttttctcacacaacagcgtgacgcgttttgccatcccttacaccgcacctcaccggtt

SEQ ID NO: 7388 - DNA, 60 bp, Artificial Sequence
  Description of Artificial Sequence: Synthetic probe
ggttttctcacacaacaacgtgacgcggtttgccatcccttacaccgcacctcaccggtt

SEQ ID NO: 7389 - DNA, 60 bp, Artificial Sequence
  Description of Artificial Sequence: Synthetic probe
taacggcgcgccccggacaactgcgttgggagacaacccgatggttttctcacacaacag

SEQ ID NO: 7390 - DNA, 60 bp, Artificial Sequence
  Description of Artificial Sequence: Synthetic probe
cctaacggcgcgccccggacaactgtgttgggagacaacccgatggttttctcacacaac

SEQ ID NO: 7391 - DNA, 60 bp, Artificial Sequence
  Description of Artificial Sequence: Synthetic probe
aaccctaccgcctacaacaaagcgccgttcacgaggcttgcgctcccctacaccgcgcca

SEQ ID NO: 7392 - DNA, 60 bp, Artificial Sequence
  Description of Artificial Sequence: Synthetic probe
cggggcgacctggccgtgttgtctcgacgcgttgagaatgaaaccacaagatgcattccc

SEQ ID NO: 7393 - DNA, 60 bp, Artificial Sequence
  Description of Artificial Sequence: Synthetic probe
catgtcattgacctcatgcaaactcaccaacacgggttggtgggcgccctgttacgtgct

SEQ ID NO: 7394 - DNA, 60 bp, Artificial Sequence
  Description of Artificial Sequence: Synthetic probe
cgcagacgaaccggtcgaagtgtattacaggatgaagcgggctgaactgtactgccccag

SEQ ID NO: 7395 - DNA, 60 bp, Artificial Sequence
  Description of Artificial Sequence: Synthetic probe
ggacacgtgaccgcagacgaaccggtcgaagtgtattacaggatgaagcgggctgaactg

SEQ ID NO: 7396 - DNA, 60 bp, Artificial Sequence
  Description of Artificial Sequence: Synthetic probe
gcccaacggtgcacccagaaccacccagcttggagacaacccaatggtcttctcgcacaa

SEQ ID NO: 7397 - DNA, 60 bp, Artificial Sequence
  Description of Artificial Sequence: Synthetic probe
tggcagcccaacggtgcacccagaaccacccagcttggagacaacccaatggtcttctcg

SEQ ID NO: 7398 - DNA, 60 bp, Artificial Sequence
  Description of Artificial Sequence: Synthetic probe
ctacgggatgatctacacacaggcagaagtggacgtgtacctgaggatgaagagagcaga

SEQ ID NO: 7399 - DNA, 52 bp, Artificial Sequence
  Description of Artificial Sequence: Synthetic probe
gctgtgagggctgaaaacatcactgagcttttgctccgcatgaagcgcgcgg

SEQ ID NO: 7400 - DNA, 60 bp, Artificial Sequence
  Description of Artificial Sequence: Synthetic probe
gacctggagattgtggtgcgtcacgacggcaacctgacatgggtacccaatggagcgccc

SEQ ID NO: 7401 - DNA, 60 bp, Artificial Sequence
  Description of Artificial Sequence: Synthetic probe
cggcaggatctacacggaggcggaagtcgacgtgtatgtgaggatgaaacgagcggagct

SEQ ID NO: 7402 - DNA, 60 bp, Artificial Sequence
  Description of Artificial Sequence: Synthetic probe
tacggcaggatctacacggaggcggaagtcgacgtgtatgtgagaatgaagcgggcggag

SEQ ID NO: 7403 - DNA, 60 bp, Artificial Sequence
  Description of Artificial Sequence: Synthetic probe
caactacggcaggatctacacggaggcggaagtcgacgtgtatgtgaggatgaaacgagc

SEQ ID NO: 7404 - DNA, 60 bp, Artificial Sequence
  Description of Artificial Sequence: Synthetic probe
aaccacctttaactacggcaggatctacacggaggcggaagtcgacgtgtatgtgagaat

SEQ ID NO: 7405 - DNA, 60 bp, Artificial Sequence
  Description of Artificial Sequence: Synthetic probe
aaggctgagcggacggctgcccacctctttcaactacggcgctgtaaaggctgacaccat

SEQ ID NO: 7406 - DNA, 50 bp, Artificial Sequence
  Description of Artificial Sequence: Synthetic probe
tgtcaccagctaagcaactgtgcaatttcgacctgttaaagttggccgga

SEQ ID NO: 7407 - DNA, 60 bp, Artificial Sequence
  Description of Artificial Sequence: Synthetic probe
ctcctcacacactacgaccacggtggtagggatcgctacaagaccgcgatcaccaagcct

SEQ ID NO: 7408 - DNA, 60 bp, Artificial Sequence
  Description of Artificial Sequence: Synthetic probe
gcgacctctcctcacacactacgaccacggtggtagggatcgctacaagaccgcgatcac

SEQ ID NO: 7409 - DNA, 60 bp, Artificial Sequence
  Description of Artificial Sequence: Synthetic probe
ccgaggttgatgtgtatgtcaggatgaagcgcgcggaactttactgtccgcgacctctcc

SEQ ID NO: 7410 - DNA, 60 bp, Artificial Sequence
  Description of Artificial Sequence: Synthetic probe
gccgaggttgatgtgtatgtcaggatgaagcgcgcggaactttactgtccgcgacctctc

SEQ ID NO: 7411 - DNA, 60 bp, Artificial Sequence
  Description of Artificial Sequence: Synthetic probe
gcgagacacacattccaaccaccttcaactatggtaggctgtacacacaagccgaggttg

SEQ ID NO: 7412 - DNA, 60 bp, Artificial Sequence
  Description of Artificial Sequence: Synthetic probe
cgcggggacctcgcaactcttgctgcgaggattgaaagcgagacacacattccaaccacc

SEQ ID NO: 7413 - DNA, 60 bp, Artificial Sequence
  Description of Artificial Sequence: Synthetic probe
gcgtgagaacattcgcggggacctcgcaactcttgctgcgaggattgaaagcgagacaca

SEQ ID NO: 7414 - DNA, 60 bp, Artificial Sequence
  Description of Artificial Sequence: Synthetic probe
ccgttttgcgctgccttacactgccccacacaggtgcctggcaacactgtacaacggtga

SEQ ID NO: 7415 - DNA, 60 bp, Artificial Sequence
  Description of Artificial Sequence: Synthetic probe
acggcaccgcccgttttgcgctgccttacactgccccacacaggtgcctggcaacactgt

SEQ ID NO: 7416 - DNA, 60 bp, Artificial Sequence
  Description of Artificial Sequence: Synthetic probe
cgtcttctcgcacaacggtaccacccgcttcgcactgccttacactgcaccacacaggtc

SEQ ID NO: 7417 - DNA, 60 bp, Artificial Sequence
  Description of Artificial Sequence: Synthetic probe
ttgaacgaggttggcgacaatccagtcgtcttctcgcacaacggtaccacccgcttcgcc

SEQ ID NO: 7418 - DNA, 58 bp, Artificial Sequence
  Description of Artificial Sequence: Synthetic probe
ccccgagttggacgaagtgggcgacaatccagtcgtcttctcgcacaacggtaccacc

SEQ ID NO: 7419 - DNA, 60 bp, Artificial Sequence
  Description of Artificial Sequence: Synthetic probe
gagcaccagagttgaacgaggttggcgacaatccagtcgtcttctcgcacaacggtacca

SEQ ID NO: 7420 - DNA, 60 bp, Artificial Sequence
  Description of Artificial Sequence: Synthetic probe
tgacaccattactgagcttttgatccgcatgaaacgcggagagacatactgccctaggcc

SEQ ID NO: 7421 - DNA, 60 bp, Artificial Sequence
  Description of Artificial Sequence: Synthetic probe
taaaggctgacaccattactgagcttttgatccgcatgaaacgcggagagacatactgcc

SEQ ID NO: 7422 - DNA, 60 bp, Artificial Sequence
  Description of Artificial Sequence: Synthetic probe
tccactgtttacaacggtaagtgtgcttacagcaaacctgtgagcgcaatccgtggcgac

SEQ ID NO: 7423 - DNA, 60 bp, Artificial Sequence
  Description of Artificial Sequence: Synthetic probe
tgctgtccactgtttacaacggtaagtgtgcttacagcaaacctgtgagcgcaatccgtg

SEQ ID NO: 7424 - DNA, 60 bp, Artificial Sequence
  Description of Artificial Sequence: Synthetic probe
gctgggagacaaccccatgatcttctcccacaacaaggtcacgcgttttgccatccccta

SEQ ID NO: 7425 - DNA, 60 bp, Artificial Sequence
  Description of Artificial Sequence: Synthetic probe
agctgggagacaaccccatgatcttctcccacaacaaggtcacgcgttttgccatcccct

SEQ ID NO: 7426 - DNA, 60 bp, Artificial Sequence
  Description of Artificial Sequence: Synthetic probe
ccacactgatgtggccttccttctcgaccgcagcacacacgtgcacactcagaagaccag

SEQ ID NO: 7427 - DNA, 60 bp, Artificial Sequence
  Description of Artificial Sequence: Synthetic probe
tccacactgatgtggccttccttctcgaccgcagcacacacgtgcacactcagaagacca

SEQ ID NO: 7428 - DNA, 60 bp, Artificial Sequence
  Description of Artificial Sequence: Synthetic probe
cacccgagtgaagccaggcacaaacaaaagattgtggcacctgtgaaacagcttctgaac

SEQ ID NO: 7429 - DNA, 50 bp, Artificial Sequence
  Description of Artificial Sequence: Synthetic probe
acgggacgagcaagtacactgtgagtgggtcaagcagacgaggcgacttg

SEQ ID NO: 7430 - DNA, 60 bp, Artificial Sequence
  Description of Artificial Sequence: Synthetic probe
gacagatttgtgaaaataaacagcccaaaatccacccatgttattgacctcatgcaaacc

SEQ ID NO: 7431 - DNA, 60 bp, Artificial Sequence
  Description of Artificial Sequence: Synthetic probe
tcatggacagatttgtgaaaataaacagcccaaaatccacccatgtcattgacctcatgc

SEQ ID NO: 7432 - DNA, 60 bp, Artificial Sequence
  Description of Artificial Sequence: Synthetic probe
cgttgagaatgaagccgcaagatgcattcccacgacattcaacttcgggagattgttgtg

SEQ ID NO: 7433 - DNA, 58 bp, Artificial Sequence
  Description of Artificial Sequence: Synthetic probe
tcggtggagacctcgcaactctcgcggcgaggatcgcaagtgagacacacattccaac

SEQ ID NO: 7434 - DNA, 60 bp, Artificial Sequence
  Description of Artificial Sequence: Synthetic probe
catccgtggagacctcgcagctcttgcagcgaggatcgcaagtgagacacacattccaac

SEQ ID NO: 7435 - DNA, 60 bp, Artificial Sequence
  Description of Artificial Sequence: Synthetic probe
tgggcgcgctgttgcgtgcagccacgtactacttctctgacttgcagattgttgtgcggc

SEQ ID NO: 7436 - DNA, 60 bp, Artificial Sequence
  Description of Artificial Sequence: Synthetic probe
cgggctggtgggtgcgctgttgcgtgcagccacgtactacttctctgacttggagattgt

SEQ ID NO: 7437 - DNA, 60 bp, Artificial Sequence
  Description of Artificial Sequence: Synthetic probe
ccagcacgggctggtgggtgcgctgttgcgtgcagccacgtactacttctctgacttgga

SEQ ID NO: 7438 - DNA, 60 bp, Artificial Sequence
  Description of Artificial Sequence: Synthetic probe
gtgaccttgctgttcttgcacagcgggtaagcaacaggctgcccacctccttcaactacg

SEQ ID NO: 7439 - DNA, 60 bp, Artificial Sequence
  Description of Artificial Sequence: Synthetic probe
ggcagctgcccacctctttcaactacggcgctgtaaaggctgacaccatcactgagcttt

SEQ ID NO: 7440 - DNA, 60 bp, Artificial Sequence
  Description of Artificial Sequence: Synthetic probe
gggcagctgcccacctctttcaactacggcgctgtaaaggctgacaccatcactgagctt

SEQ ID NO: 7441 - DNA, 60 bp, Artificial Sequence
  Description of Artificial Sequence: Synthetic probe
agaaggcggcaagaacctgcctacctccttcaactacggtgccatcaaggccacccgggt

SEQ ID NO: 7442 - DNA, 60 bp, Artificial Sequence
  Description of Artificial Sequence: Synthetic probe
gcgctaccttacactgcgccacacaggtgcttggcaacaacctacaacggtgactgtaag

SEQ ID NO: 7443 - DNA, 60 bp, Artificial Sequence
  Description of Artificial Sequence: Synthetic probe
gctctgccctacaccgcaccacacaggtgcttggcaacaacctacaacggtgactgtaag

SEQ ID NO: 7444 - DNA, 60 bp, Artificial Sequence
  Description of Artificial Sequence: Synthetic probe
gcgctgccttacactgcgccacacaggtgcttggcaacaacctacaacggtgattgtaag

SEQ ID NO: 7445 - DNA, 60 bp, Artificial Sequence
  Description of Artificial Sequence: Synthetic probe
cccgctttgcactgccttacaccgcaccacacaggtgcttggcaacaacctacaacggtg

SEQ ID NO: 7446 - DNA, 60 bp, Artificial Sequence
  Description of Artificial Sequence: Synthetic probe
ctgaggttgacgtgtacgttaggatgaaacgcgcggagctctactgcccgcgccctctcc

SEQ ID NO: 7447 - DNA, 60 bp, Artificial Sequence
  Description of Artificial Sequence: Synthetic probe
acagaagccgaggttgacgtgtacgttaggatgaaacgcgcggagctgtactgcccacgc

SEQ ID NO: 7448 - DNA, 60 bp, Artificial Sequence
  Description of Artificial Sequence: Synthetic probe
atctacacagaagccgaggttgacgtgtacgttaggatgaaacgcgcggagctgtactgc

SEQ ID NO: 7449 - DNA, 60 bp, Artificial Sequence
  Description of Artificial Sequence: Synthetic probe
ggatctacacagaggccgaggttgacgtgtacgttaggatgaaacgcgcggaactctact

SEQ ID NO: 7450 - DNA, 60 bp, Artificial Sequence
  Description of Artificial Sequence: Synthetic probe
cgccctctcctgacacactacgatcacaaaggactggatcgctacaagaccgcgataacc

SEQ ID NO: 7451 - DNA, 60 bp, Artificial Sequence
  Description of Artificial Sequence: Synthetic probe
gcgccctctcctgacacactacgatcacaaaggactggatcgctacaagaccgcgataac

SEQ ID NO: 7452 - DNA, 60 bp, Artificial Sequence
  Description of Artificial Sequence: Synthetic probe
acttcggaagactgttgtgtgattcaggtgacgtctactaccggatgaagcgtactgagc

SEQ ID NO: 7453 - DNA, 60 bp, Artificial Sequence
  Description of Artificial Sequence: Synthetic probe
cagcgcgttgagaatgaaaccacaagatgcatacctacaacattcaacttcggaagactg

SEQ ID NO: 7454 - DNA, 60 bp, Artificial Sequence
  Description of Artificial Sequence: Synthetic probe
gtcacagcgcgttgagaatgaaaccacaagatgcatacctacaacattcaacttcggaag

SEQ ID NO: 7455 - DNA, 60 bp, Artificial Sequence
  Description of Artificial Sequence: Synthetic probe
ctacatgcaacagtaccaaaattccatggacacacagctgggtgacaacgccatcagtgg

SEQ ID NO: 7456 - DNA, 60 bp, Artificial Sequence
  Description of Artificial Sequence: Synthetic probe
agcataattaacaactattatatgcaacagtaccaaaattccatggacacacagcttggt

SEQ ID NO: 7457 - DNA, 60 bp, Artificial Sequence
  Description of Artificial Sequence: Synthetic probe
cctgtgaagcaactcctgaactttgacctgctcaagttggcgggagacgtggagtccaac

SEQ ID NO: 7458 - DNA, 60 bp, Artificial Sequence
  Description of Artificial Sequence: Synthetic probe
gaggttactggccttgagctacacgagggtggaccacccgctctcgtcatttggaacatc

SEQ ID NO: 7459 - DNA, 60 bp, Artificial Sequence
  Description of Artificial Sequence: Synthetic probe
agaggttactggccttgagctacacgagggtggaccacccgctctcgtcatttggaacat

SEQ ID NO: 7460 - DNA, 60 bp, Artificial Sequence
  Description of Artificial Sequence: Synthetic probe
ctccttcaactttggtgcagttcgagccacgaccatccacgagcttctcgtgcgcatgaa

SEQ ID NO: 7461 - DNA, 60 bp, Artificial Sequence
  Description of Artificial Sequence: Synthetic probe
cctccttcaactttggtgcagttcgagccacgaccatccacgagcttctcgtgcgcatga

SEQ ID NO: 7462 - DNA, 60 bp, Artificial Sequence
  Description of Artificial Sequence: Synthetic probe
gcctccttcaactttggtgcagttcgagccacgaccatccacgagcttctcgtgcgcatg

SEQ ID NO: 7463 - DNA, 60 bp, Artificial Sequence
  Description of Artificial Sequence: Synthetic probe
acgtgtatgttaggatgaagcgcgcagaactctactgcccgcgccctctcctgacgcact

SEQ ID NO: 7464 - DNA, 60 bp, Artificial Sequence
  Description of Artificial Sequence: Synthetic probe
ggtcgacgtgtatgttaggatgaagcgcgcagaactctactgcccgcgccctctcttgac

SEQ ID NO: 7465 - DNA, 60 bp, Artificial Sequence
  Description of Artificial Sequence: Synthetic probe
actgtggtcgacgtgtatgttaggatgaagcgcgcagaactctactgcccgcgccctctc

SEQ ID NO: 7466 - DNA, 60 bp, Artificial Sequence
  Description of Artificial Sequence: Synthetic probe
acggccgcgccctaacagacagtgacttcagagtgtttgagtttgaggtaaaagtaaaag

SEQ ID NO: 7467 - DNA, 60 bp, Artificial Sequence
  Description of Artificial Sequence: Synthetic probe
caccgcctgctttcaactgtttacaacggtgaatgtaaatacgagacgcccgtcaccgcc

SEQ ID NO: 7468 - DNA, 60 bp, Artificial Sequence
  Description of Artificial Sequence: Synthetic probe
caccgcctgctttcaactgtttacaacggtgaatgtaagtatgagacgcccgtcaccgcc

SEQ ID NO: 7469 - DNA, 60 bp, Artificial Sequence
  Description of Artificial Sequence: Synthetic probe
ccaccgcctgctttcaactgtttacaacggtgaatgcaaatacgagacgcccgtcaccgc

SEQ ID NO: 7470 - DNA, 60 bp, Artificial Sequence
  Description of Artificial Sequence: Synthetic probe
actgcaccccaccgcctgctttcaactgtttacaacggtgaatgtaaatacgagacgccc

SEQ ID NO: 7471 - DNA, 60 bp, Artificial Sequence
  Description of Artificial Sequence: Synthetic probe
actgcaccccaccgcctgctttcaactgtttacaacggtgaatgtaagtatgagacgccc

SEQ ID NO: 7472 - DNA, 60 bp, Artificial Sequence
  Description of Artificial Sequence: Synthetic probe
acactgcaccccaccgcctgctttcaactgtttacaacggtgaatgtaagtatgagacgc

SEQ ID NO: 7473 - DNA, 60 bp, Artificial Sequence
  Description of Artificial Sequence: Synthetic probe
acactgcaccccaccgcctgctttcaactgtttacaacggtgaatgtaaatacgagacgc

SEQ ID NO: 7474 - DNA, 60 bp, Artificial Sequence
  Description of Artificial Sequence: Synthetic probe
acactgcaccccaccgcctgctttcaactgtttacaacggtgaatgcaaatacgagacgc

SEQ ID NO: 7475 - DNA, 60 bp, Artificial Sequence
  Description of Artificial Sequence: Synthetic probe
gccatacactgcaccccaccgcctgctttcaactgtttacaacggtgaatgcaaatacga

SEQ ID NO: 7476 - DNA, 60 bp, Artificial Sequence
  Description of Artificial Sequence: Synthetic probe
acccgatggttttctcgaacaaaggtgtcaccaggttcgctgtgccatacactgcacccc

SEQ ID NO: 7477 - DNA, 60 bp, Artificial Sequence
  Description of Artificial Sequence: Synthetic probe
acccgatggtcttctcgaacaaaggtgtcaccaggttcgctgtgccatacactgcacccc

SEQ ID NO: 7478 - DNA, 60 bp, Artificial Sequence
  Description of Artificial Sequence: Synthetic probe
caacccgatggttttctcgaacaaacgtgtcaccaggttcgctgtgccatacactgcacc

SEQ ID NO: 7479 - DNA, 60 bp, Artificial Sequence
  Description of Artificial Sequence: Synthetic probe
caatggagcacctgtagaagccttggccaacacaggcaaccccaccgcctaccacaaaca

SEQ ID NO: 7480 - DNA, 60 bp, Artificial Sequence
  Description of Artificial Sequence: Synthetic probe
tggcaacttgacgtgggtgcccaatggagcacctgtaggagccttggccaacacaggcaa

SEQ ID NO: 7481 - DNA, 60 bp, Artificial Sequence
  Description of Artificial Sequence: Synthetic probe
gcgtcatgatggcaacttgacgtgggtgcccaatggagcacctgtaggagccttggccaa

SEQ ID NO: 7482 - DNA, 60 bp, Artificial Sequence
  Description of Artificial Sequence: Synthetic probe
tgcaaacacacccgcacgcgctggtgggtgcccttttgcgtgcagccacgtactacttct

SEQ ID NO: 7483 - DNA, 60 bp, Artificial Sequence
  Description of Artificial Sequence: Synthetic probe
gacctcatgcaaattccctcgcacacgctggttggagcactgcttcggtctgcgacgtac

SEQ ID NO: 7484 - DNA, 60 bp, Artificial Sequence
  Description of Artificial Sequence: Synthetic probe
attgatgatgaggtgttctacccatggacaccggatccagaaaacgtactcgcgtacgtg

SEQ ID NO: 7485 - DNA, 60 bp, Artificial Sequence
  Description of Artificial Sequence: Synthetic probe
ggcaacaccggtagtatcattaacaactactacatgcaacagtaccaaaattcaatggac

SEQ ID NO: 7486 - DNA, 60 bp, Artificial Sequence
  Description of Artificial Sequence: Synthetic probe
atctggcaacaccggtagtatcattaacaactactacatgcaacagtaccaaaattcaat

SEQ ID NO: 7487 - DNA, 60 bp, Artificial Sequence
  Description of Artificial Sequence: Synthetic probe
acacacattccaactactttcaactatggcaggatttacacagacactgtggtcgacgtg

SEQ ID NO: 7488 - DNA, 60 bp, Artificial Sequence
  Description of Artificial Sequence: Synthetic probe
gttttgcattgccctacactgctccacacaggtgcttggcaacagcctacaacggtgact

SEQ ID NO: 7489 - DNA, 60 bp, Artificial Sequence
  Description of Artificial Sequence: Synthetic probe
gggcgacaacccagtcgtcttttccaaaggtggaaccacccgttttgcattgccctacac

SEQ ID NO: 7490 - DNA, 60 bp, Artificial Sequence
  Description of Artificial Sequence: Synthetic probe
gcttttaagcgcctgaaggagaactttgagattgttgccctgtgtttgaccctcttggca

SEQ ID NO: 7491 - DNA, 60 bp, Artificial Sequence
  Description of Artificial Sequence: Synthetic probe
gacctcatttgtgaagcgcgcgtttaagcgcctgaaggagaactttgagattgttgccct

SEQ ID NO: 7492 - DNA, 60 bp, Artificial Sequence
  Description of Artificial Sequence: Synthetic probe
attgatctcatgcaaactcaccaacacggcctagtgggtgcactgctgcgtgcggccacc

SEQ ID NO: 7493 - DNA, 60 bp, Artificial Sequence
  Description of Artificial Sequence: Synthetic probe
atgttattgacctcatgcaaactcaccaacacggcctagtgggcgcgctattgcgtgcgg

SEQ ID NO: 7494 - DNA, 60 bp, Artificial Sequence
  Description of Artificial Sequence: Synthetic probe
tctactgccccaggccgattcttccgattcagccaacgggcgacagacacaagcaaccgc

SEQ ID NO: 7495 - DNA, 60 bp, Artificial Sequence
  Description of Artificial Sequence: Synthetic probe
gcggcacacaagcggcgactacccacgtcgttcaactttggtgccatcaaagcagagacc

SEQ ID NO: 7496 - DNA, 60 bp, Artificial Sequence
  Description of Artificial Sequence: Synthetic probe
gggcagttgcccacctctttcaactacggcgctgtgaaggctgacaccatcactgagctt

SEQ ID NO: 7497 - DNA, 60 bp, Artificial Sequence
  Description of Artificial Sequence: Synthetic probe
aggcagttgcccacctctttcaactacggcgctgtgaaggctgacaccatcactgagctt

SEQ ID NO: 7498 - DNA, 60 bp, Artificial Sequence
  Description of Artificial Sequence: Synthetic probe
atctcaatcccttcccaaaaatccgtgttgtacttcctcattgagaaaggccaacacgaa

SEQ ID NO: 7499 - DNA, 60 bp, Artificial Sequence
  Description of Artificial Sequence: Synthetic probe
cttacctcgtgcctcgtcatcttttcgcagagaagtatgacaagatcatgctggacggcc

SEQ ID NO: 7500 - DNA, 60 bp, Artificial Sequence
  Description of Artificial Sequence: Synthetic probe
gatcacaaaggactggatcgctacaaaaccgcgataaccaaacctgccaaacaactgtgc

SEQ ID NO: 7501 - DNA, 60 bp, Artificial Sequence
  Description of Artificial Sequence: Synthetic probe
aaggccacccgggtgactgaactgctttaccgcatgaagagggccgagacatactgccct

SEQ ID NO: 7502 - DNA, 60 bp, Artificial Sequence
  Description of Artificial Sequence: Synthetic probe
aaggctacacgggtgactgaactgctttaccgcatgaagagggctgagacatactgcccc

SEQ ID NO: 7503 - DNA, 60 bp, Artificial Sequence
  Description of Artificial Sequence: Synthetic probe
gctgcccacctccttcaactacggcgctgtaaaggctgacaccatcactgagctgttgat

SEQ ID NO: 7504 - DNA, 60 bp, Artificial Sequence
  Description of Artificial Sequence: Synthetic probe
ttggtgcaattcgggccacgaccatccacgagctcctcgtacgcatgaaacgtgccgagc

SEQ ID NO: 7505 - DNA, 60 bp, Artificial Sequence
  Description of Artificial Sequence: Synthetic probe
cacgcgcttccatccacgttcaactttggacatgtgaccgccgacgaaccagtcgacgtc

SEQ ID NO: 7506 - DNA, 60 bp, Artificial Sequence
  Description of Artificial Sequence: Synthetic probe
ggcacacgcttccatccacgttcaactttggacatgtgaccgccgaccaaccggttgacg

SEQ ID NO: 7507 - DNA, 60 bp, Artificial Sequence
  Description of Artificial Sequence: Synthetic probe
tccagacacgcgcttccatccacgttcaactttggacatgtgaccgccgacgaaccagtc

SEQ ID NO: 7508 - DNA, 59 bp, Artificial Sequence
  Description of Artificial Sequence: Synthetic probe
cctacgacatggaaccattcaacggagatgtcgtcgcgaaagcgacagcatacgtgaaa

SEQ ID NO: 7509 - DNA, 60 bp, Artificial Sequence
  Description of Artificial Sequence: Synthetic probe
ccgggctcgagttgcacgagggtggaccccccgctctcgtgatttggagcatcaagcact

SEQ ID NO: 7510 - DNA, 52 bp, Artificial Sequence
  Description of Artificial Sequence: Synthetic probe
ccacccatgttattgacctcatgcaaacccaccaacacggcctagtgggagc

SEQ ID NO: 7511 - DNA, 60 bp, Artificial Sequence
  Description of Artificial Sequence: Synthetic probe
tacaacggtgactgtaagtacaagcccgctggcacagccccgcgtgagaacattcgtggg

SEQ ID NO: 7512 - DNA, 60 bp, Artificial Sequence
  Description of Artificial Sequence: Synthetic probe
caacagcctacaacggtgactgtaagtacaagcccgctggcactggcccgcgtgagaaca

SEQ ID NO: 7513 - DNA, 60 bp, Artificial Sequence
  Description of Artificial Sequence: Synthetic probe
caacgtcatacaacggtgactgtaagtacaagcccgctggcacagccccgcgcgagaaca

SEQ ID NO: 7514 - DNA, 59 bp, Artificial Sequence
  Description of Artificial Sequence: Synthetic probe
accggtacaagaccaagctggtagcacctgaaaaacaactgtgtaactttgacctgtta

SEQ ID NO: 7515 - DNA, 60 bp, Artificial Sequence
  Description of Artificial Sequence: Synthetic probe
gcccacgacccttacaggttaggtacacgcacaccactgaccggtacaagaccaagctgg

SEQ ID NO: 7516 - DNA, 60 bp, Artificial Sequence
  Description of Artificial Sequence: Synthetic probe
tgagctgtactgcccacgacccttacaggttaggtacacgcacaccactgaccggtacaa

SEQ ID NO: 7517 - DNA, 60 bp, Artificial Sequence
  Description of Artificial Sequence: Synthetic probe
gtgaaactggtgaagtctactaccggatgaagagagctgagctgtactgcccacgaccct

SEQ ID NO: 7518 - DNA, 60 bp, Artificial Sequence
  Description of Artificial Sequence: Synthetic probe
gggagactgttgtgtgaaactggtgaagtctactaccggatgaagagagctgagctgtac

SEQ ID NO: 7519 - DNA, 60 bp, Artificial Sequence
  Description of Artificial Sequence: Synthetic probe
ggcgtcacccgttttgctctgccgtacacggcgccacacggagttcttgctacagtttac

SEQ ID NO: 7520 - DNA, 60 bp, Artificial Sequence
  Description of Artificial Sequence: Synthetic probe
aagggaggcgtcacccgttttgctctgccgtacacggcgccacacggagttcttgctaca

SEQ ID NO: 7521 - DNA, 60 bp, Artificial Sequence
  Description of Artificial Sequence: Synthetic probe
gttgcgtgctgccacgtactacttctccgacctggagattgtggttcgtcacgacggcaa

SEQ ID NO: 7522 - DNA, 60 bp, Artificial Sequence
  Description of Artificial Sequence: Synthetic probe
gggtacgtgactgtcgacaatccagtcgacatttactaccgaatgaagagggcagagctc

SEQ ID NO: 7523 - DNA, 60 bp, Artificial Sequence
  Description of Artificial Sequence: Synthetic probe
atgtgaggcacgagctcccctccaccttcaacttcgggtacgtgactgtcgacaatccag

SEQ ID NO: 7524 - DNA, 60 bp, Artificial Sequence
  Description of Artificial Sequence: Synthetic probe
cagccaagtacgcaaatgtgaggcacgagctcccctccaccttcaacttcgggtacgtga

SEQ ID NO: 7525 - DNA, 60 bp, Artificial Sequence
  Description of Artificial Sequence: Synthetic probe
agacgtcaaccgccatccgcggtgaccgcgctgtgttggcagccaagtacgcaaatgtga

SEQ ID NO: 7526 - DNA, 60 bp, Artificial Sequence
  Description of Artificial Sequence: Synthetic probe
caagtacacacagacgtcaaccgccatccgcggtgaccgcgctgtgttggcagccaagta

SEQ ID NO: 7527 - DNA, 60 bp, Artificial Sequence
  Description of Artificial Sequence: Synthetic probe
tgttttcacacaacaacgtcacgcgttttgccctgccattcactgcaccacaccgtctcc

SEQ ID NO: 7528 - DNA, 60 bp, Artificial Sequence
  Description of Artificial Sequence: Synthetic probe
gatggtgttttcacacaacaacgtcacgcgttttgccctgccattcactgcaccacaccg

SEQ ID NO: 7529 - DNA, 58 bp, Artificial Sequence
  Description of Artificial Sequence: Synthetic probe
gggagcagacgtggtcacgactgacccctcaacccacggtgggtccgtgacggagaag

SEQ ID NO: 7530 - DNA, 60 bp, Artificial Sequence
  Description of Artificial Sequence: Synthetic probe
accacatcgtcaggtgagggagcagacgtggtcacgactgacccctcaacccacggtggg

SEQ ID NO: 7531 - DNA, 60 bp, Artificial Sequence
  Description of Artificial Sequence: Synthetic probe
cggctactgctcgtgcgtttcacgctcgagtttactccaactcaaggcacacatcgatcc

SEQ ID NO: 7532 - DNA, 60 bp, Artificial Sequence
  Description of Artificial Sequence: Synthetic probe
gaacggtgtcggctactgctcgtgcgtttcacgctcgagtttactccaactcaaggcaca

SEQ ID NO: 7533 - DNA, 58 bp, Artificial Sequence
  Description of Artificial Sequence: Synthetic probe
cactgtgatcatcggcacacactctgccggtgggaacggtgtcggctactgctcgtgc

SEQ ID NO: 7534 - DNA, 60 bp, Artificial Sequence
  Description of Artificial Sequence: Synthetic probe
acaaaggacggcgcccacactgtgatcatcggcacacactctgccggtgggaacggtgtc

SEQ ID NO: 7535 - DNA, 60 bp, Artificial Sequence
  Description of Artificial Sequence: Synthetic probe
cagggaccaaggtgggatactgtggaggagccgtcatgacaaaggacggcgcccacactg

SEQ ID NO: 7536 - DNA, 60 bp, Artificial Sequence
  Description of Artificial Sequence: Synthetic probe
tcgcgtaccgcgcagggaccaaggtgggatactgtggaggagccgtcatgacaaaggacg

SEQ ID NO: 7537 - DNA, 60 bp, Artificial Sequence
  Description of Artificial Sequence: Synthetic probe
gtagggagactcatcttctcaggagatgccttgacgtacaaggacgtcgtcgtctgcatg

SEQ ID NO: 7538 - DNA, 60 bp, Artificial Sequence
  Description of Artificial Sequence: Synthetic probe
atcaacaacgctgatgtagggagactcatcttctcaggagatgccttgacgtacaaggac

SEQ ID NO: 7539 - DNA, 50 bp, Artificial Sequence
  Description of Artificial Sequence: Synthetic probe
aaaagggaaccccgtcattggtgtcatcaacaacgctgatgtagggagac

SEQ ID NO: 7540 - DNA, 60 bp, Artificial Sequence
  Description of Artificial Sequence: Synthetic probe
acttccgcgatcaggtacacattaaaaaagggaaccccgtcattggtgtcatcaacaacg

SEQ ID NO: 7541 - DNA, 58 bp, Artificial Sequence
  Description of Artificial Sequence: Synthetic probe
tgctgtgcgactggagtcttcggcactgcctacctcgtcccccgtcatcttttcgctg

SEQ ID NO: 7542 - DNA, 60 bp, Artificial Sequence
  Description of Artificial Sequence: Synthetic probe
cgaacgtcaagcccgttgagctgatactcgacggtaagacggttgcactctgctgtgcga

SEQ ID NO: 7543 - DNA, 60 bp, Artificial Sequence
  Description of Artificial Sequence: Synthetic probe
ggtgttctacccttggacacctgaccctgaaaacgtgctcgcgtacgtgccttacgacca

SEQ ID NO: 7544 - DNA, 60 bp, Artificial Sequence
  Description of Artificial Sequence: Synthetic probe
ccctggctgatttccacgccggcattttcatcaaaggtactgaacacgctgtgtttgccc

SEQ ID NO: 7545 - DNA, 60 bp, Artificial Sequence
  Description of Artificial Sequence: Synthetic probe
accatgaccctggctgatttccacgccggcattttcatcaaaggtactgaacacgctgtg

SEQ ID NO: 7546 - DNA, 60 bp, Artificial Sequence
  Description of Artificial Sequence: Synthetic probe
actcgcccgagcgagatctgcgtgatcaacggagtcaccatgaccctggctgatttccac

SEQ ID NO: 7547 - DNA, 60 bp, Artificial Sequence
  Description of Artificial Sequence: Synthetic probe
gcgtcggcaccagcactcgcccgagcgagatctgcgtgatcaacggagtcaccatgaccc

SEQ ID NO: 7548 - DNA, 60 bp, Artificial Sequence
  Description of Artificial Sequence: Synthetic probe
ttgtgctttggctcatcaaagactgccttcaaaccggcgtcggcaccagcactcgcccga

SEQ ID NO: 7549 - DNA, 60 bp, Artificial Sequence
  Description of Artificial Sequence: Synthetic probe
tgggcccccggcacttgtgctttggctcatcaaagactgccttcaaaccggcgtcggcac

SEQ ID NO: 7550 - DNA, 58 bp, Artificial Sequence
  Description of Artificial Sequence: Synthetic probe
gacatgatcaaacaactttctgactacaccaagcttgacctctcagacggtgggcccc

SEQ ID NO: 7551 - DNA, 60 bp, Artificial Sequence
  Description of Artificial Sequence: Synthetic probe
gacatgatcaaacaactttctgactacaccaagcttgacctctcagacggtgggcccccg

SEQ ID NO: 7552 - DNA, 54 bp, Artificial Sequence
  Description of Artificial Sequence: Synthetic probe
actgtacaacggtgaaaagaagaccttctatagcaggcctaacacacatggcaa

SEQ ID NO: 7553 - DNA, 60 bp, Artificial Sequence
  Description of Artificial Sequence: Synthetic probe
acaagcaaccccactgcctaccacaaggaaccattcacgagacttgcgcttccctacact

SEQ ID NO: 7554 - DNA, 60 bp, Artificial Sequence
  Description of Artificial Sequence: Synthetic probe
ctgcctaccacaaggcaccattcacgaggcttgcactcccttacaccgcgccacaccgtg

SEQ ID NO: 7555 - DNA, 58 bp, Artificial Sequence
  Description of Artificial Sequence: Synthetic probe
caggtacaaaaccccgttggtcaagcctgagaaacaactgtgcaatttcgacctgtta

SEQ ID NO: 7556 - DNA, 60 bp, Artificial Sequence
  Description of Artificial Sequence: Synthetic probe
acgcccgctccgagtgaggtacacacacacgaccgacaggtacaaaaccccgttggtcaa

SEQ ID NO: 7557 - DNA, 60 bp, Artificial Sequence
  Description of Artificial Sequence: Synthetic probe
gagctttactgcccacgcccgctccgagtgaggtacacacacacgaccgacaggtacaaa

SEQ ID NO: 7558 - DNA, 60 bp, Artificial Sequence
  Description of Artificial Sequence: Synthetic probe
tgttgtgcgagaagggtgaggtgtactaccgcatgaagcgcgccgagctttactgcccac

SEQ ID NO: 7559 - DNA, 60 bp, Artificial Sequence
  Description of Artificial Sequence: Synthetic probe
ggagactgttgtgcgagaagggtgaggtgtactaccgcatgaagcgcgccgagctttact

SEQ ID NO: 7560 - DNA, 60 bp, Artificial Sequence
  Description of Artificial Sequence: Synthetic probe
acgccggggcgacctggccgcgttggctcaacgcgttgggaatgaaaccacaagatgttt

SEQ ID NO: 7561 - DNA, 60 bp, Artificial Sequence
  Description of Artificial Sequence: Synthetic probe
ccaacacgtgacctcacgccggggcgacctggccgcgttggctcaacgcgttgggaatga

SEQ ID NO: 7562 - DNA, 60 bp, Artificial Sequence
  Description of Artificial Sequence: Synthetic probe
accgtctacaacggtaactgtaggtacagtaaaacccaacacgtgacctcacgccggggc

SEQ ID NO: 7563 - DNA, 60 bp, Artificial Sequence
  Description of Artificial Sequence: Synthetic probe
cacggtgtcctggcaaccgtctacaacggtaactgtaggtacagtaaaacccaacacgtg

SEQ ID NO: 7564 - DNA, 60 bp, Artificial Sequence
  Description of Artificial Sequence: Synthetic probe
tgcccacacaccgataggtgggaggacaacccagtcgtccactcgaagggatcggtcgcc

SEQ ID NO: 7565 - DNA, 60 bp, Artificial Sequence
  Description of Artificial Sequence: Synthetic probe
tgggtgcccaacgggtgcccacacaccgataggtgggaggacaacccagtcgtccactcg

SEQ ID NO: 7566 - DNA, 55 bp, Artificial Sequence
  Description of Artificial Sequence: Synthetic probe
acaaccaaccccactgcctaccacaaggggccgctaactcggctggctctcccgt

SEQ ID NO: 7567 - DNA, 60 bp, Artificial Sequence
  Description of Artificial Sequence: Synthetic probe
cacactggacgttatgcagacacacaaggatagtatagtaggcgcgctcctccgcgcagc

SEQ ID NO: 7568 - DNA, 60 bp, Artificial Sequence
  Description of Artificial Sequence: Synthetic probe
caaccaacacacactggacgttatgcagacacacaaggatagtatagtaggcgcgctcct

SEQ ID NO: 7569 - DNA, 60 bp, Artificial Sequence
  Description of Artificial Sequence: Synthetic probe
gtggacctgatgcaaacccctgcccacactttggtgggttcgctcctccgtactgctact

SEQ ID NO: 7570 - DNA, 60 bp, Artificial Sequence
  Description of Artificial Sequence: Synthetic probe
ccacacacgaactcccgtctaccttcaatttcggttacgtgaccgccgacaagccagtcg

SEQ ID NO: 7571 - DNA, 60 bp, Artificial Sequence
  Description of Artificial Sequence: Synthetic probe
ccaacaccacacacgaactcccgtctaccttcaatttcggttacgtgaccgccgacaagc

SEQ ID NO: 7572 - DNA, 50 bp, Artificial Sequence
  Description of Artificial Sequence: Synthetic probe
tggaaattgcctgtcttggcgagcacacacgcgtgtggtggcaaccaaac

SEQ ID NO: 7573 - DNA, 60 bp, Artificial Sequence
  Description of Artificial Sequence: Synthetic probe
cgctgctgcgtgcggccacatactatttctgtgacctggaaattgcctgtcttggcgagc

SEQ ID NO: 7574 - DNA, 60 bp, Artificial Sequence
  Description of Artificial Sequence: Synthetic probe
gaccctagtaggtgcgctgctgcgtgcggccacatactatttctgtgacctggaaattgc

SEQ ID NO: 7575 - DNA, 60 bp, Artificial Sequence
  Description of Artificial Sequence: Synthetic probe
ggtggtgccgtcacggagaagagacgcatgcacacagacgtggcatttgtcatggacaga

SEQ ID NO: 7576 - DNA, 60 bp, Artificial Sequence
  Description of Artificial Sequence: Synthetic probe
ccatggtggtgccgtcacggagaagagacgcatgcacacagacgtggcatttgtcatgga

SEQ ID NO: 7577 - DNA, 56 bp, Artificial Sequence
  Description of Artificial Sequence: Synthetic probe
gagcggacgtcgtgacgaccgatccttcgacccatggtggtgccgtcacggagaag

SEQ ID NO: 7578 - DNA, 60 bp, Artificial Sequence
  Description of Artificial Sequence: Synthetic probe
accaccagctcgggagaaggagcggacgtcgtgacgaccgatccttcgacccatggtggt

SEQ ID NO: 7579 - DNA, 60 bp, Artificial Sequence
  Description of Artificial Sequence: Synthetic probe
tcgtcatttggaacatcaagcacctgctccacaccgggaacggcactgcctcgcgaccca

SEQ ID NO: 7580 - DNA, 60 bp, Artificial Sequence
  Description of Artificial Sequence: Synthetic probe
cgctgtcgtcatttggaacatcaagcacctgctccacacgggaatcggcaccgcctcgcg

SEQ ID NO: 7581 - DNA, 60 bp, Artificial Sequence
  Description of Artificial Sequence: Synthetic probe
ccgcccttgtcatttggaacatcaagcacctgctccacaccggaatcggcactgcctcgc

SEQ ID NO: 7582 - DNA, 60 bp, Artificial Sequence
  Description of Artificial Sequence: Synthetic probe
ggctgtgaaggtctcgtcgcaagacagacacaaacagaagatcattgcacctgcaaaaca

SEQ ID NO: 7583 - DNA, 60 bp, Artificial Sequence
  Description of Artificial Sequence: Synthetic probe
tggtcgtttgtatggacggtgacaccatgcctggactcttcgcataccgcgcagggacca

SEQ ID NO: 7584 - DNA, 60 bp, Artificial Sequence
  Description of Artificial Sequence: Synthetic probe
agcctcacgccccagtgaggtatgcatggtggacgggacggatatgtgcttggctgactt

SEQ ID NO: 7585 - DNA, 60 bp, Artificial Sequence
  Description of Artificial Sequence: Synthetic probe
caccggaatcggcacagcctcacgccccagtgaggtatgcatggtggacgggacggatat

SEQ ID NO: 7586 - DNA, 60 bp, Artificial Sequence
  Description of Artificial Sequence: Synthetic probe
cgtagacgaacctttctttgactgggtctacaactcacctgagaacctcactcttgaggc

SEQ ID NO: 7587 - DNA, 60 bp, Artificial Sequence
  Description of Artificial Sequence: Synthetic probe
ttgttcaggtacgtagacgaacctttctttgactgggtctacaactcacctgagaacctc

SEQ ID NO: 7588 - DNA, 60 bp, Artificial Sequence
  Description of Artificial Sequence: Synthetic probe
ccaggccaaataacaatgacaactgttggcttaacaccattttgcagttgttcaggtacg

SEQ ID NO: 7589 - DNA, 60 bp, Artificial Sequence
  Description of Artificial Sequence: Synthetic probe
actccaggccaaataacaatgacaactgttggcttaacaccattttgcagttgttcaggt

SEQ ID NO: 7590 - DNA, 60 bp, Artificial Sequence
  Description of Artificial Sequence: Synthetic probe
ctgcgaaacagctcctgaactttgacctgctcaagttggcgggagacgttgagtccaacc

SEQ ID NO: 7591 - DNA, 60 bp, Artificial Sequence
  Description of Artificial Sequence: Synthetic probe
cgcgccacacagatgtctggcaacaacctacaacggtgactgtaagtacaaacccactgg

SEQ ID NO: 7592 - DNA, 60 bp, Artificial Sequence
  Description of Artificial Sequence: Synthetic probe
ggctactgtggaggagccgttctcgccaaggacggagccgacacattcatcgttggcaca

SEQ ID NO: 7593 - DNA, 50 bp, Artificial Sequence
  Description of Artificial Sequence: Synthetic probe
actgagcttttgattcgcatgaaacgcgcggagacatactgccctaggcc

SEQ ID NO: 7594 - DNA, 60 bp, Artificial Sequence
  Description of Artificial Sequence: Synthetic probe
aagacccctgttcccagcctacgaccacgcaaacagggacagatttgacgctccgatcgg

SEQ ID NO: 7595 - DNA, 60 bp, Artificial Sequence
  Description of Artificial Sequence: Synthetic probe
tctactgtccaagacccctgttcccagcctacgaccacgcaaacagggacagatttgacg

SEQ ID NO: 7596 - DNA, 60 bp, Artificial Sequence
  Description of Artificial Sequence: Synthetic probe
agtcgacgtgtactaccgtatgaagagggccgagctctactgtccaagacccctgttccc

SEQ ID NO: 7597 - DNA, 60 bp, Artificial Sequence
  Description of Artificial Sequence: Synthetic probe
aaccgccgacaatccagtcgacgtgtactaccgtatgaagagggccgagctctactgtcc

SEQ ID NO: 7598 - DNA, 53 bp, Artificial Sequence
  Description of Artificial Sequence: Synthetic probe
ggtgagtgcgagtacgcacagccggtcgccgctattcgtggtgaccgcgccgt

SEQ ID NO: 7599 - DNA, 52 bp, Artificial Sequence
  Description of Artificial Sequence: Synthetic probe
ggtgagtgcgagtacgcacagccggtcgccgctattcgtggtgaccgcgccg

SEQ ID NO: 7600 - DNA, 60 bp, Artificial Sequence
  Description of Artificial Sequence: Synthetic probe
ggtgttttcacacaacaaagtcacacgctttgctctgccttacaccgcaccacaccggct

SEQ ID NO: 7601 - DNA, 60 bp, Artificial Sequence
  Description of Artificial Sequence: Synthetic probe
ccaacggtgcgccgcgaacaacccagcttcgcgacaacccgatggtgttttcacacaaca

SEQ ID NO: 7602 - DNA, 60 bp, Artificial Sequence
  Description of Artificial Sequence: Synthetic probe
tggcagcccaacggtgcgccgcgaacaacccagcttcgcgacaacccgatggtgttttca

SEQ ID NO: 7603 - DNA, 60 bp, Artificial Sequence
  Description of Artificial Sequence: Synthetic probe
actttcgtgacacagcaagaatgaagaaaggcacccccgttgtcggtgtgattaacaacg

SEQ ID NO: 7604 - DNA, 60 bp, Artificial Sequence
  Description of Artificial Sequence: Synthetic probe
accggggaatcagcagaccctgtcaccaccaccgttgagaactacggtggcgagacacag

SEQ ID NO: 7605 - DNA, 60 bp, Artificial Sequence
  Description of Artificial Sequence: Synthetic probe
agacgatgtgcccgcgtatgtcccgtacacacctgaaccactggctgttgattggcaggg

SEQ ID NO: 7606 - DNA, 60 bp, Artificial Sequence
  Description of Artificial Sequence: Synthetic probe
tgctgtgtttgccctcctgaccagcgaggggtggtacgcgatagacgacgagtgcttcta

SEQ ID NO: 7607 - DNA, 60 bp, Artificial Sequence
  Description of Artificial Sequence: Synthetic probe
aacatgctgtgtttgccctcctgaccagcgaggggtggtacgcgatagacgacgagtgct

SEQ ID NO: 7608 - DNA, 60 bp, Artificial Sequence
  Description of Artificial Sequence: Synthetic probe
gccgacttccacgccggcatcttcctgaaaggtactgaacatgctgtgtttgccctcctg

SEQ ID NO: 7609 - DNA, 60 bp, Artificial Sequence
  Description of Artificial Sequence: Synthetic probe
acaaatgtgcttggccgacttccacgccggcatcttcctgaaaggtactgaacatgctgt

SEQ ID NO: 7610 - DNA, 60 bp, Artificial Sequence
  Description of Artificial Sequence: Synthetic probe
cgtcatttgggccataaaagacattttgatgaccggtgtcggcatctccactcgccccag

SEQ ID NO: 7611 - DNA, 60 bp, Artificial Sequence
  Description of Artificial Sequence: Synthetic probe
cggaccccccgctctcgtcatttgggccataaaagacattttgatgaccggtgtcggcat

SEQ ID NO: 7612 - DNA, 60 bp, Artificial Sequence
  Description of Artificial Sequence: Synthetic probe
cgcatgattgaacaactcatggaacacaccgggatggacttgaaacagggcggacccccc

SEQ ID NO: 7613 - DNA, 58 bp, Artificial Sequence
  Description of Artificial Sequence: Synthetic probe
cgcatgattgaacaactcatggaacacaccgggatggacttgaaacagggcggacccc

SEQ ID NO: 7614 - DNA, 60 bp, Artificial Sequence
  Description of Artificial Sequence: Synthetic probe
cgagcctctgtttgaaagtgagtaccttgcgcccgaaaacctgacaggtcgcatgattga

SEQ ID NO: 7615 - DNA, 60 bp, Artificial Sequence
  Description of Artificial Sequence: Synthetic probe
acgagcctctgtttgaaagtgagtaccttgcgcccgaaaacctgacaggtcgcatgattg

SEQ ID NO: 7616 - DNA, 60 bp, Artificial Sequence
  Description of Artificial Sequence: Synthetic probe
cacgataactgctggttgaatgcaattctgcagctcttcaggtatgttgacgagcctctg

SEQ ID NO: 7617 - DNA, 60 bp, Artificial Sequence
  Description of Artificial Sequence: Synthetic probe
gcacgataactgctggttgaatgcaattctgcagctcttcaggtatgttgacgagcctct

SEQ ID NO: 7618 - DNA, 60 bp, Artificial Sequence
  Description of Artificial Sequence: Synthetic probe
gtccttgcacagaggattgccggcgagacacacattccaaccactttcaactacggcagg

SEQ ID NO: 7619 - DNA, 55 bp, Artificial Sequence
  Description of Artificial Sequence: Synthetic probe
cactggtagtatcattaacaactactacatgcaacagtaccaaaactccatggac

SEQ ID NO: 7620 - DNA, 60 bp, Artificial Sequence
  Description of Artificial Sequence: Synthetic probe
gacccgttctcacacactacgaccacaaaggcaaggaccgttaccagacggccctcgtca

SEQ ID NO: 7621 - DNA, 60 bp, Artificial Sequence
  Description of Artificial Sequence: Synthetic probe
aactctactgtccgcgacccgttctcacacactacgaccacaaaggcaaggaccgttacc

SEQ ID NO: 7622 - DNA, 56 bp, Artificial Sequence
  Description of Artificial Sequence: Synthetic probe
gtgacttggcagtcctggctgcccgaatcgctagtgagacacacatcccgacaacc

SEQ ID NO: 7623 - DNA, 60 bp, Artificial Sequence
  Description of Artificial Sequence: Synthetic probe
caatcccgtcgtcttctcacacaacggcaccactcgttttgcacttccctacactgcacc

SEQ ID NO: 7624 - DNA, 60 bp, Artificial Sequence
  Description of Artificial Sequence: Synthetic probe
cctaacggcagtccagagctgacggaagtgggcgacaatcccgtcgtcttctcacacaac

SEQ ID NO: 7625 - DNA, 60 bp, Artificial Sequence
  Description of Artificial Sequence: Synthetic probe
tgggtgggctggacccctaacggcagtccagagctgacggaagtgggcgacaatcccgtc

SEQ ID NO: 7626 - DNA, 60 bp, Artificial Sequence
  Description of Artificial Sequence: Synthetic probe
acatccaggagcttctcgtgcgcatgaaacgtgccgagctctattgccccaggccactgc

SEQ ID NO: 7627 - DNA, 60 bp, Artificial Sequence
  Description of Artificial Sequence: Synthetic probe
tgagctctactgtccaagaccccttctccctgcctacgaccacggaagcagggacaggtt

SEQ ID NO: 7628 - DNA, 60 bp, Artificial Sequence
  Description of Artificial Sequence: Synthetic probe
agggctgagctctactgtccaagaccccttctccctgcctacgaccacggaagcagggac

SEQ ID NO: 7629 - DNA, 60 bp, Artificial Sequence
  Description of Artificial Sequence: Synthetic probe
gaccgctgacaaaccagtcgacatttactaccgaatgaagagggctgagctctactgtcc

SEQ ID NO: 7630 - DNA, 60 bp, Artificial Sequence
  Description of Artificial Sequence: Synthetic probe
tcggttttgtgaccgctgacaaaccagtcgacatttactaccgaatgaagagggctgagc

SEQ ID NO: 7631 - DNA, 60 bp, Artificial Sequence
  Description of Artificial Sequence: Synthetic probe
aactaggtacaacggtgaatgcaagtacacgcagccctccaacgccatccgtggcgatcg

SEQ ID NO: 7632 - DNA, 60 bp, Artificial Sequence
  Description of Artificial Sequence: Synthetic probe
gctcctgtcaactaggtacaacggtgaatgcaagtacacgcagccctccaacgccatccg

SEQ ID NO: 7633 - DNA, 60 bp, Artificial Sequence
  Description of Artificial Sequence: Synthetic probe
acaacaacgtcacgcgtttcgccctgccctacactgcaccacaccggctcctgtcaacta

SEQ ID NO: 7634 - DNA, 60 bp, Artificial Sequence
  Description of Artificial Sequence: Synthetic probe
tcacacaacaacgtcacgcgtttcgccctgccctacactgcaccacaccggctcctgtca

SEQ ID NO: 7635 - DNA, 60 bp, Artificial Sequence
  Description of Artificial Sequence: Synthetic probe
ccccgaccgacttgcaaaagatggtcatgggcaacaccaagcctgttgagctcatcctcg

SEQ ID NO: 7636 - DNA, 60 bp, Artificial Sequence
  Description of Artificial Sequence: Synthetic probe
ggcgccccaccgaccgacttgcaaaagatggtcatgggcaacaccaagcctgttgagctt

SEQ ID NO: 7637 - DNA, 60 bp, Artificial Sequence
  Description of Artificial Sequence: Synthetic probe
ggtgccccaccgaccgacttgcaaaagatggtcatgggcaacactaaacctgtcgagctc

SEQ ID NO: 7638 - DNA, 60 bp, Artificial Sequence
  Description of Artificial Sequence: Synthetic probe
agtggtgccccaccgaccgacttgcaaaagatggtcatgggcaacactaaacctgtcgag

SEQ ID NO: 7639 - DNA, 60 bp, Artificial Sequence
  Description of Artificial Sequence: Synthetic probe
agtggcgccccaccgaccgacttgcaaaagatggtcatgggcaacaccaagcctgttgag

SEQ ID NO: 7640 - DNA, 60 bp, Artificial Sequence
  Description of Artificial Sequence: Synthetic probe
actaccggatgaagagggcggagctctactgccccaggccgctcttgcctgcgtacgacc

SEQ ID NO: 7641 - DNA, 57 bp, Artificial Sequence
  Description of Artificial Sequence: Synthetic probe
actaccggatgaagagggcggagctctactgccccaggccgctcttgcctgcgtacg

SEQ ID NO: 7642 - DNA, 60 bp, Artificial Sequence
  Description of Artificial Sequence: Synthetic probe
tgggtacgtgaccgccgacaagccagtcgatgtttactaccggatgaagagggcggagct

SEQ ID NO: 7643 - DNA, 60 bp, Artificial Sequence
  Description of Artificial Sequence: Synthetic probe
ccgtccaccttcaattttgggtacgtgaccgccgacaagccagtcgatgtttactaccgg

SEQ ID NO: 7644 - DNA, 60 bp, Artificial Sequence
  Description of Artificial Sequence: Synthetic probe
gtccaccttcaattttgggtacgtgaccgccgacaagccagtcgatgtttactaccggat

SEQ ID NO: 7645 - DNA, 60 bp, Artificial Sequence
  Description of Artificial Sequence: Synthetic probe
cggtgagtgtaagtatgatacaactgtgcaaccaatacgtggagacagggcggttttggc

SEQ ID NO: 7646 - DNA, 60 bp, Artificial Sequence
  Description of Artificial Sequence: Synthetic probe
cggtgagtgtaagtataacacaactgtacaaccaatacgtggagacagggcggttttggc

SEQ ID NO: 7647 - DNA, 60 bp, Artificial Sequence
  Description of Artificial Sequence: Synthetic probe
tctggcagcccaacggcgcgcccaggaccactcaattgggagataacccaatggtcttct

SEQ ID NO: 7648 - DNA, 60 bp, Artificial Sequence
  Description of Artificial Sequence: Synthetic probe
aagagttttctggcagcccaacggcgcgcccaggaccactcaattgggagacaacccgat

SEQ ID NO: 7649 - DNA, 60 bp, Artificial Sequence
  Description of Artificial Sequence: Synthetic probe
cacaagagttttctggcagcccaacggcgcgcccaggaccactcaattgggagataaccc

SEQ ID NO: 7650 - DNA, 60 bp, Artificial Sequence
  Description of Artificial Sequence: Synthetic probe
gcaagagttttctggcagcccaacggcgcgcccaggaccactcaattgggagacaacccg

SEQ ID NO: 7651 - DNA, 60 bp, Artificial Sequence
  Description of Artificial Sequence: Synthetic probe
ccactcgggtgaccgaattgctttaccgcatgaagagggctgagacatactgcccccgac

SEQ ID NO: 7652 - DNA, 60 bp, Artificial Sequence
  Description of Artificial Sequence: Synthetic probe
cacactacgaccacagcgggaaggaccgctacaaggtcgcgttgaccaaacctgccaaac

SEQ ID NO: 7653 - DNA, 60 bp, Artificial Sequence
  Description of Artificial Sequence: Synthetic probe
gacacactacgaccacagcgggaaggaccgctacaaggtcgcgttgaccaaacctgccaa

SEQ ID NO: 7654 - DNA, 60 bp, Artificial Sequence
  Description of Artificial Sequence: Synthetic probe
actatggcaggatttacacacaagctgaggtcgacgtgtatgttaggatgaaacgcgcag

SEQ ID NO: 7655 - DNA, 60 bp, Artificial Sequence
  Description of Artificial Sequence: Synthetic probe
ttccaactacctttaactatggcaggatttacacacaagctgaggtcgacgtgtatgtta

SEQ ID NO: 7656 - DNA, 60 bp, Artificial Sequence
  Description of Artificial Sequence: Synthetic probe
gcggagatctcgcgaccctcgcgggcagaattgccagtgagacacacattccaactacct

SEQ ID NO: 7657 - DNA, 60 bp, Artificial Sequence
  Description of Artificial Sequence: Synthetic probe
ccgcggagatctcgcgaccctcgcgggcagaattgccagtgagacacacattccaactac

SEQ ID NO: 7658 - DNA, 60 bp, Artificial Sequence
  Description of Artificial Sequence: Synthetic probe
gcactgccctacactgcaccacacaggtgtctcgctacatcctacaacggtgactgcaag

SEQ ID NO: 7659 - DNA, 60 bp, Artificial Sequence
  Description of Artificial Sequence: Synthetic probe
gcttcgcactgccctacactgcaccacacaggtgtctcgctacatcctacaacggtgact

SEQ ID NO: 7660 - DNA, 60 bp, Artificial Sequence
  Description of Artificial Sequence: Synthetic probe
cggagctgtattgccctaggcctattcttcctatccagcctgcgggtgacaggcacaagc

SEQ ID NO: 7661 - DNA, 60 bp, Artificial Sequence
  Description of Artificial Sequence: Synthetic probe
acgcgcggagctgtattgccctaggcctattcttcctatccagcctgcgggtgacaggca

SEQ ID NO: 7662 - DNA, 60 bp, Artificial Sequence
  Description of Artificial Sequence: Synthetic probe
aacttacgccaccaccacacgcagaggggacttggctcacttggtagcaacacacagccg

SEQ ID NO: 7663 - DNA, 60 bp, Artificial Sequence
  Description of Artificial Sequence: Synthetic probe
tacacaggtacaacaacttacgccaccaccacacgcagaggggacttggctcacttggta

SEQ ID NO: 7664 - DNA, 60 bp, Artificial Sequence
  Description of Artificial Sequence: Synthetic probe
acctgggtgcccaacggcgccccggaggcagctctcgcaaacacgagcaaccccacagct

SEQ ID NO: 7665 - DNA, 59 bp, Artificial Sequence
  Description of Artificial Sequence: Synthetic probe
ggcaactgcaaatactccaagacccaacacgttgcaccacgtcgcggcgatctagcggc

SEQ ID NO: 7666 - DNA, 60 bp, Artificial Sequence
  Description of Artificial Sequence: Synthetic probe
ctggcagcataattaacaactactacatgcagcagtatcagaactccatggacacacagc

SEQ ID NO: 7667 - DNA, 60 bp, Artificial Sequence
  Description of Artificial Sequence: Synthetic probe
ttggtcatgtgacggctgacgcacccgtcgacgtgtactataggatgaaacgtgctgagt

SEQ ID NO: 7668 - DNA, 60 bp, Artificial Sequence
  Description of Artificial Sequence: Synthetic probe
caagcactttcaactttggtcatgtgacggctgacgcacccgtcgacgtgtactatagga

SEQ ID NO: 7669 - DNA, 60 bp, Artificial Sequence
  Description of Artificial Sequence: Synthetic probe
ctgtatacaacggtgagtgcgactacaagaaagcctctaccgccatccgcggtgacaggg

SEQ ID NO: 7670 - DNA, 60 bp, Artificial Sequence
  Description of Artificial Sequence: Synthetic probe
accggttgctttccactgtatacaacggtgagtgcgactacaagaaagcctctaccgcca

SEQ ID NO: 7671 - DNA, 60 bp, Artificial Sequence
  Description of Artificial Sequence: Synthetic probe
gcacaacggagtcactagatttgccattccgtacacggcaccgcaccggttgctttccac

SEQ ID NO: 7672 - DNA, 60 bp, Artificial Sequence
  Description of Artificial Sequence: Synthetic probe
gtactcgcacaacggagtcactagatttgccattccgtacacggcaccgcaccggttgct

SEQ ID NO: 7673 - DNA, 60 bp, Artificial Sequence
  Description of Artificial Sequence: Synthetic probe
gcgcccagaacaacaacgctgggtgacaaccccatggtgtactcgcacaacggagtcact

SEQ ID NO: 7674 - DNA, 60 bp, Artificial Sequence
  Description of Artificial Sequence: Synthetic probe
caaccgaatggggcgcccagaacaacaacgctgggtgacaaccccatggtgtactcgcac

SEQ ID NO: 7675 - DNA, 60 bp, Artificial Sequence
  Description of Artificial Sequence: Synthetic probe
ctggtaggggccatactgcgctcagccacgtactacttctgtgacctggagatcgcgtgt

SEQ ID NO: 7676 - DNA, 60 bp, Artificial Sequence
  Description of Artificial Sequence: Synthetic probe
acaaaggagaaggcactggtaggggccatactgcgctcagccacgtactacttctgtgac

SEQ ID NO: 7677 - DNA, 60 bp, Artificial Sequence
  Description of Artificial Sequence: Synthetic probe
tgagggcgctgacgtcgtgaccattgaccccaccacacacggcgggtccgtgacaccggc

SEQ ID NO: 7678 - DNA, 60 bp, Artificial Sequence
  Description of Artificial Sequence: Synthetic probe
accacttcggccggtgagggcgctgacgtcgtgaccattgaccccaccacacacggcggg

SEQ ID NO: 7679 - DNA, 60 bp, Artificial Sequence
  Description of Artificial Sequence: Synthetic probe
acggcggtgagacacaggtccagcgacgtcaccacactgacgtcagcttcataatggaca

SEQ ID NO: 7680 - DNA, 60 bp, Artificial Sequence
  Description of Artificial Sequence: Synthetic probe
tacggcggtgagacacaagttcagcggcgtcaccacactgacgtcagcttcataatggac

SEQ ID NO: 7681 - DNA, 60 bp, Artificial Sequence
  Description of Artificial Sequence: Synthetic probe
ctacggcggtgagacacaggtccagcgacgtcaccacactgacgtcagcttcataatgga

SEQ ID NO: 7682 - DNA, 60 bp, Artificial Sequence
  Description of Artificial Sequence: Synthetic probe
gaggtgtcgtctcaagacagacacaaacagaagatcattgcaccagcaaaacaactcctg

SEQ ID NO: 7683 - DNA, 60 bp, Artificial Sequence
  Description of Artificial Sequence: Synthetic probe
tagaccactcctcccggcatacgaacacgcagaccgggacagattcgacggccccatcgg

SEQ ID NO: 7684 - DNA, 60 bp, Artificial Sequence
  Description of Artificial Sequence: Synthetic probe
ctgccctagaccactcctcccggcatacgaacacgcagaccgggacagattcgacggccc

SEQ ID NO: 7685 - DNA, 60 bp, Artificial Sequence
  Description of Artificial Sequence: Synthetic probe
gacgtgtactacaggatgaagcgcgcagagctttactgccctagaccactcctcccggca

SEQ ID NO: 7686 - DNA, 60 bp, Artificial Sequence
  Description of Artificial Sequence: Synthetic probe
gccgacaaggtagtcgacgtgtactacaggatgaagcgcgcagagctttactgccctaga

SEQ ID NO: 7687 - DNA, 60 bp, Artificial Sequence
  Description of Artificial Sequence: Synthetic probe
cacgcgctgccgtccaccttcaactttggtcacgttactgccgacaaggtagtcgacgtg

SEQ ID NO: 7688 - DNA, 60 bp, Artificial Sequence
  Description of Artificial Sequence: Synthetic probe
ctaacacccagcacgcgctgccgtccaccttcaactttggtcacgttactgccgacaagg

SEQ ID NO: 7689 - DNA, 60 bp, Artificial Sequence
  Description of Artificial Sequence: Synthetic probe
gctcgcgaccgtgtacaacggtgagtgtaagtacacacagagaacccaagccatccgtgg

SEQ ID NO: 7690 - DNA, 60 bp, Artificial Sequence
  Description of Artificial Sequence: Synthetic probe
cgcaccggttgctcgcgaccgtgtacaacggtgagtgtaagtacacacagagaacccaag

SEQ ID NO: 7691 - DNA, 60 bp, Artificial Sequence
  Description of Artificial Sequence: Synthetic probe
ttctcccacaacaacgtgacgcgatttgccatcccctacactgcaccgcaccggttgctc

SEQ ID NO: 7692 - DNA, 60 bp, Artificial Sequence
  Description of Artificial Sequence: Synthetic probe
ggtcttctcccacaacaacgtgacgcgatttgccatcccctacactgcaccgcaccggtt

SEQ ID NO: 7693 - DNA, 60 bp, Artificial Sequence
  Description of Artificial Sequence: Synthetic probe
tggcatcccaacggcgcgccccggacaaccgtgttgggagacaacccaatggtcttctcc

SEQ ID NO: 7694 - DNA, 53 bp, Artificial Sequence
  Description of Artificial Sequence: Synthetic probe
tcacgaggcttgcgctcccctacactgcgccacaccgcgtgttggcaacagtg

SEQ ID NO: 7695 - DNA, 60 bp, Artificial Sequence
  Description of Artificial Sequence: Synthetic probe
cccgcgacccattctcacgcactacgaccacggtgacaaagatcgctacaagaccgcgat

SEQ ID NO: 7696 - DNA, 60 bp, Artificial Sequence
  Description of Artificial Sequence: Synthetic probe
tcgacgtgtacatcaggatgaaacgcgcggagctttactgcccgcgacccattctcacgc

SEQ ID NO: 7697 - DNA, 60 bp, Artificial Sequence
  Description of Artificial Sequence: Synthetic probe
acacagaagccgaggtcgacgtgtacatcaggatgaaacgcgcggagctttactgcccgc

SEQ ID NO: 7698 - DNA, 60 bp, Artificial Sequence
  Description of Artificial Sequence: Synthetic probe
cccgtttcgctttgccctataccgcaccacacagatgtctagcaacaacctacaacggtg

SEQ ID NO: 7699 - DNA, 60 bp, Artificial Sequence
  Description of Artificial Sequence: Synthetic probe
tggtactgcccgtttcgctttgccctataccgcaccacacagatgtctagcaacaaccta

SEQ ID NO: 7700 - DNA, 60 bp, Artificial Sequence
  Description of Artificial Sequence: Synthetic probe
gaggtgggcgacaatccagtcgtcttctccaggaatggtactgcccgtttcgctttgccc

SEQ ID NO: 7701 - DNA, 60 bp, Artificial Sequence
  Description of Artificial Sequence: Synthetic probe
gctccggaactttccgaggtgggcgacaatccagtcgtcttctccaggaatggtactgcc

SEQ ID NO: 7702 - DNA, 54 bp, Artificial Sequence
  Description of Artificial Sequence: Synthetic probe
cacgtactacttttctgatttggaaatagcagtgacccacactgggaagctcac

SEQ ID NO: 7703 - DNA, 60 bp, Artificial Sequence
  Description of Artificial Sequence: Synthetic probe
ccgcggacaaccacgcttcgcgacaaccccatggtgttttcacacaacaacgtcacgcgt

SEQ ID NO: 7704 - DNA, 60 bp, Artificial Sequence
  Description of Artificial Sequence: Synthetic probe
ccgcggacaaccacgcttcgcgacaaccccatggtgttttcacacaacaatgtcacgcgt

SEQ ID NO: 7705 - DNA, 60 bp, Artificial Sequence
  Description of Artificial Sequence: Synthetic probe
gggcaccgcggacaaccacgcttcgcgacaaccccatggtgttttcacacaacaatgtca

SEQ ID NO: 7706 - DNA, 60 bp, Artificial Sequence
  Description of Artificial Sequence: Synthetic probe
gggcaccgcggacaaccacgcttcgcgacaaccccatggtgttttcacacaacaacgtca

SEQ ID NO: 7707 - DNA, 60 bp, Artificial Sequence
  Description of Artificial Sequence: Synthetic probe
ttacgaccaggaaccactggacgttgattggcaggacagagccggtctgttcctccgtgg

SEQ ID NO: 7708 - DNA, 59 bp, Artificial Sequence
  Description of Artificial Sequence: Synthetic probe
cttacgaccaggaaccactggacgttgattggcaggacagggccggtctgttcctccgc

SEQ ID NO: 7709 - DNA, 56 bp, Artificial Sequence
  Description of Artificial Sequence: Synthetic probe
agcctaccggtgacaggcacaagcaaccgatcgtcgcacctgcaaaacagcttcta

SEQ ID NO: 7710 - DNA, 60 bp, Artificial Sequence
  Description of Artificial Sequence: Synthetic probe
ggagctttattgccctaggcccatcctgcctatccagcctaccggtgacaggcacaagca

SEQ ID NO: 7711 - DNA, 60 bp, Artificial Sequence
  Description of Artificial Sequence: Synthetic probe
gcgcatgaaatgcgcggagctttattgccctaggcccatcctgcctatccagcctaccgg

SEQ ID NO: 7712 - DNA, 60 bp, Artificial Sequence
  Description of Artificial Sequence: Synthetic probe
tgctcgtgcgcatgaagcgtgccgaactctactgccccagaccattgttggcggtggagg

SEQ ID NO: 7713 - DNA, 54 bp, Artificial Sequence
  Description of Artificial Sequence: Synthetic probe
ggcgtatgaacacaacgaccgggacagatacgacggccccatcggcgtcgaaaa

SEQ ID NO: 7714 - DNA, 60 bp, Artificial Sequence
  Description of Artificial Sequence: Synthetic probe
ggcgtatgaacacaacgaccgggacagatacgacggccccatcggcgtcgaaaaacaatt

SEQ ID NO: 7715 - DNA, 57 bp, Artificial Sequence
  Description of Artificial Sequence: Synthetic probe
tcgacgtgtactacaggatgaagcgtgcggaattgtactgccccagaccacttctcc

SEQ ID NO: 7716 - DNA, 60 bp, Artificial Sequence
  Description of Artificial Sequence: Synthetic probe
gacagggcagtgctggcgcagaaatacgccaacaccagacactcacttccgtccaccttc

SEQ ID NO: 7717 - DNA, 60 bp, Artificial Sequence
  Description of Artificial Sequence: Synthetic probe
tgacagggcagtgctggcgcagaaatacgccaacaccagacactcacttccgtccacctt

SEQ ID NO: 7718 - DNA, 60 bp, Artificial Sequence
  Description of Artificial Sequence: Synthetic probe
gagtgcaggtacacacagaagacacaagccattcgtggtgacagggcagtgctggcgcag

SEQ ID NO: 7719 - DNA, 60 bp, Artificial Sequence
  Description of Artificial Sequence: Synthetic probe
gtgtacaacggtgagtgcaggtacacacagaagacacaagccattcgtggtgacagggca

SEQ ID NO: 7720 - DNA, 60 bp, Artificial Sequence
  Description of Artificial Sequence: Synthetic probe
cgcggtttgctatcccctatacagcacctcaccggttgctctcaacagtgtacaacggtg

SEQ ID NO: 7721 - DNA, 60 bp, Artificial Sequence
  Description of Artificial Sequence: Synthetic probe
ttacgcggtttgctatcccctatacagcacctcaccggttgctctcaacagtgtacaacg

SEQ ID NO: 7722 - DNA, 60 bp, Artificial Sequence
  Description of Artificial Sequence: Synthetic probe
tgtgacctggaaatcgcgtgtgttggggagcacaagcgtgtcttttggcagcccaacggc

SEQ ID NO: 7723 - DNA, 60 bp, Artificial Sequence
  Description of Artificial Sequence: Synthetic probe
ctatttttgtgacctggaaatcgcgtgtgttggggagcacaagcgtgtcttttggcagcc

SEQ ID NO: 7724 - DNA, 60 bp, Artificial Sequence
  Description of Artificial Sequence: Synthetic probe
tcacacatgtccacaccagcaagacaacattcaacgtggacctgatggagaccaaggaca

SEQ ID NO: 7725 - DNA, 60 bp, Artificial Sequence
  Description of Artificial Sequence: Synthetic probe
tcgtgcttgacagattcacacatgtccacaccagcaagacaacattcaacgtggacctga

SEQ ID NO: 7726 - DNA, 60 bp, Artificial Sequence
  Description of Artificial Sequence: Synthetic probe
gcgagggcgcagacgtcgttacgactgatccctcaacacacggtggaagtgtagtcgaga

SEQ ID NO: 7727 - DNA, 60 bp, Artificial Sequence
  Description of Artificial Sequence: Synthetic probe
accaccagtgctggcgagggcgcagacgtcgttacgactgatccctcaacacacggtgga

SEQ ID NO: 7728 - DNA, 60 bp, Artificial Sequence
  Description of Artificial Sequence: Synthetic probe
cccgtccgacgtcctggtgttcgtcccgtacgatcaagaaccactcaacggggaatggaa

SEQ ID NO: 7729 - DNA, 60 bp, Artificial Sequence
  Description of Artificial Sequence: Synthetic probe
cttcggtctgcgacgtactacttctcagacctggaggttgcgcttgttcacacaggccca

SEQ ID NO: 7730 - DNA, 60 bp, Artificial Sequence
  Description of Artificial Sequence: Synthetic probe
acgagcaaccccacagcctaccacaaggcaccgttcacgagacttgcgctcccgtacacc

SEQ ID NO: 7731 - DNA, 60 bp, Artificial Sequence
  Description of Artificial Sequence: Synthetic probe
ccccagaggcagctctcgcgaacacgagcaaccccacagcctaccacaaggcaccgttca

SEQ ID NO: 7732 - DNA, 60 bp, Artificial Sequence
  Description of Artificial Sequence: Synthetic probe
gccccaggccactgctggcagtagaggtgtcttctcaagacagacacaaacagaagatca

SEQ ID NO: 7733 - DNA, 60 bp, Artificial Sequence
  Description of Artificial Sequence: Synthetic probe
ttgatctccgtggcaggactcgccgtgcattctgggcctgacgagtcccggcgtctgttt

SEQ ID NO: 7734 - DNA, 60 bp, Artificial Sequence
  Description of Artificial Sequence: Synthetic probe
ctcacttcaaatctctcggtcaaaccatcactccagctgacaaaagcgacaaaggttttg

SEQ ID NO: 7735 - DNA, 60 bp, Artificial Sequence
  Description of Artificial Sequence: Synthetic probe
aaactgacgttgccttcgttcttgacaggtttgtgaaactcactgcacccaagaacattc

SEQ ID NO: 7736 - DNA, 60 bp, Artificial Sequence
  Description of Artificial Sequence: Synthetic probe
cgggagtgttcgggacggcttacctcgtgcctcgtcatcttttcgcagagaagtatgaca

SEQ ID NO: 7737 - DNA, 60 bp, Artificial Sequence
  Description of Artificial Sequence: Synthetic probe
tggtgcaattcgggccacgaccatccacgagcttctcgtgcgcatgaaacgtgccgagct

SEQ ID NO: 7738 - DNA, 60 bp, Artificial Sequence
  Description of Artificial Sequence: Synthetic probe
caccagacccgtctgacgtcttgtgttttgtcccctacgacatggaaccattcaacggag

SEQ ID NO: 7739 - DNA, 60 bp, Artificial Sequence
  Description of Artificial Sequence: Synthetic probe
gtggacaccagacccgtctgacgtcttgtgttttgtcccctacgacatggaaccattcaa

SEQ ID NO: 7740 - DNA, 60 bp, Artificial Sequence
  Description of Artificial Sequence: Synthetic probe
ggttggtacgccattgacgacgaggacttttacccgtggacaccagacccgtctgacgtc

SEQ ID NO: 7741 - DNA, 60 bp, Artificial Sequence
  Description of Artificial Sequence: Synthetic probe
agatggaattcacactctacaacggtgaaaagaaaacactctactccagacccaaccgcc

SEQ ID NO: 7742 - DNA, 60 bp, Artificial Sequence
  Description of Artificial Sequence: Synthetic probe
tcaaaggttcaaagaagatggaattcacactctacaacggtgaaaagaaaacactctact

SEQ ID NO: 7743 - DNA, 60 bp, Artificial Sequence
  Description of Artificial Sequence: Synthetic probe
ttggtgggcgccctgctgcgggcagccacgtactacttctccgacctggagattgtggtg

SEQ ID NO: 7744 - DNA, 60 bp, Artificial Sequence
  Description of Artificial Sequence: Synthetic probe
gctcttgacaccactcaggaccgccgtaaacaggagattattgcacctgagaagcagctt

SEQ ID NO: 7745 - DNA, 60 bp, Artificial Sequence
  Description of Artificial Sequence: Synthetic probe
tgcggccacctactacttctctgacttggaaatcgtcgtgcgacacgacggcaacctgac

SEQ ID NO: 7746 - DNA, 60 bp, Artificial Sequence
  Description of Artificial Sequence: Synthetic probe
gcgcgttgctgcgtgcggccacctactacttctctgacttggaaattgttgtgaaacacg

SEQ ID NO: 7747 - DNA, 60 bp, Artificial Sequence
  Description of Artificial Sequence: Synthetic probe
ctagtaggcgcgttgctgcgtgcggccacctactacttctctgacttggaaattgttgtg

SEQ ID NO: 7748 - DNA, 60 bp, Artificial Sequence
  Description of Artificial Sequence: Synthetic probe
gctgcacacggcggtaaccagagacggacacgccgcgttcacacggacgtggcgttcctt

SEQ ID NO: 7749 - DNA, 60 bp, Artificial Sequence
  Description of Artificial Sequence: Synthetic probe
acaccgctgcacacggcggtaaccagagacggacacgccgcgttcacacggacgtggcgt

SEQ ID NO: 7750 - DNA, 60 bp, Artificial Sequence
  Description of Artificial Sequence: Synthetic probe
ctgtctgactacaccaaacttgacctctcagacggtgggccaccagcactcgtgctttgg

SEQ ID NO: 7751 - DNA, 60 bp, Artificial Sequence
  Description of Artificial Sequence: Synthetic probe
ctgtctgactacaccaaacttgacctctcagacggtgggccaccggcactcgtgctttgg

SEQ ID NO: 7752 - DNA, 60 bp, Artificial Sequence
  Description of Artificial Sequence: Synthetic probe
gacatgatcaaacaactgtctgactacaccaaacttgacctctcagacggtgggccaccg

SEQ ID NO: 7753 - DNA, 60 bp, Artificial Sequence
  Description of Artificial Sequence: Synthetic probe
gacatgatcaaacaactgtctgactacaccaaacttgacctctcagacggtgggccacca

SEQ ID NO: 7754 - DNA, 60 bp, Artificial Sequence
  Description of Artificial Sequence: Synthetic probe
ctacaccgctccccaccgtgtgctggcaacagtgtacaacgggaagacaacgtacgggac

SEQ ID NO: 7755 - DNA, 56 bp, Artificial Sequence
  Description of Artificial Sequence: Synthetic probe
ccagcacgaggctgcaattgagttctttgaggggatggtgcacgactccatcaagg

SEQ ID NO: 7756 - DNA, 60 bp, Artificial Sequence
  Description of Artificial Sequence: Synthetic probe
ccactggtgaatctgctgaccctgttaccactaccgttgagaactacggaggcgagacgc

SEQ ID NO: 7757 - DNA, 60 bp, Artificial Sequence
  Description of Artificial Sequence: Synthetic probe
gaaggctgacaccatcacggagctgttgatccgcatgaagcgtgcggagacatactgccc

SEQ ID NO: 7758 - DNA, 52 bp, Artificial Sequence
  Description of Artificial Sequence: Synthetic probe
catacgatcatgcaaaccgggacaggttcgacgctccgattggcgttgaaaa

SEQ ID NO: 7759 - DNA, 60 bp, Artificial Sequence
  Description of Artificial Sequence: Synthetic probe
catacgatcacgcaaaccgggacaggttcgacgctccgattggcgtcgagaaacaactgt

SEQ ID NO: 7760 - DNA, 60 bp, Artificial Sequence
  Description of Artificial Sequence: Synthetic probe
catacgatcatgcaaaccgggacaggttcgacgctccgattggcgttgaaaaacaactct

SEQ ID NO: 7761 - DNA, 60 bp, Artificial Sequence
  Description of Artificial Sequence: Synthetic probe
ccttcgttcttgacaggtttgtgaaactcactgcacccaagaacattcagactcttgacc

SEQ ID NO: 7762 - DNA, 60 bp, Artificial Sequence
  Description of Artificial Sequence: Synthetic probe
agccgttctcgcaaaggacggagccgagactttcatcgtcggcactcactccgcaggcgg

SEQ ID NO: 7763 - DNA, 60 bp, Artificial Sequence
  Description of Artificial Sequence: Synthetic probe
tggagaactgcttcggtctgcgacgtactacttctcagacctggaggttgcgcttgtcca

SEQ ID NO: 7764 - DNA, 60 bp, Artificial Sequence
  Description of Artificial Sequence: Synthetic probe
cgccaacgcacgccacacgcttccttccaccttcaattttgggcatgtcaccgctgacaa

SEQ ID NO: 7765 - DNA, 60 bp, Artificial Sequence
  Description of Artificial Sequence: Synthetic probe
caaatacgccaacgcacgccacacgcttccttccaccttcaattttgggcatgtcaccgc

SEQ ID NO: 7766 - DNA, 60 bp, Artificial Sequence
  Description of Artificial Sequence: Synthetic probe
gtgagacacaggcccagcgacgtcaccacactgatgtcggcttcataatggacagatttg

SEQ ID NO: 7767 - DNA, 60 bp, Artificial Sequence
  Description of Artificial Sequence: Synthetic probe
tgacgaacggtgacttcagagtgtttgagtttgaggtgaaagtaaagggacaggacatgc

SEQ ID NO: 7768 - DNA, 60 bp, Artificial Sequence
  Description of Artificial Sequence: Synthetic probe
ataccatgcctggcctcttcgcgtaccgcgctgggaccaaggtaggatactgtggagctg

SEQ ID NO: 7769 - DNA, 60 bp, Artificial Sequence
  Description of Artificial Sequence: Synthetic probe
acaccatgcctggactcttcgcgtaccgcgctgggaccaaggtaggatactgcggagctg

SEQ ID NO: 7770 - DNA, 60 bp, Artificial Sequence
  Description of Artificial Sequence: Synthetic probe
gacaccatgcctggactcttcgcgtaccgcgctgggaccaaggtaggatactgcggagct

SEQ ID NO: 7771 - DNA, 60 bp, Artificial Sequence
  Description of Artificial Sequence: Synthetic probe
gataccatgcctggtcttttcgcgtaccgcgctgggaccaaggtaggatactgtggggct

SEQ ID NO: 7772 - DNA, 60 bp, Artificial Sequence
  Description of Artificial Sequence: Synthetic probe
agcaaccccacggcctaccacaaggccccgttcacgagactggcactgccctacaccgcg

SEQ ID NO: 7773 - DNA, 60 bp, Artificial Sequence
  Description of Artificial Sequence: Synthetic probe
gagcaaccccacggcctaccacaaggccccgttcacgagactggcactgccctacaccgc

SEQ ID NO: 7774 - DNA, 60 bp, Artificial Sequence
  Description of Artificial Sequence: Synthetic probe
acgcgagcaaccccacggcctaccacaaggccccgttcacgagactagcactgccttata

SEQ ID NO: 7775 - DNA, 60 bp, Artificial Sequence
  Description of Artificial Sequence: Synthetic probe
acgcgagcaaccccacggcctaccacaaggccccgttcacgagacttgcgctgccttaca

SEQ ID NO: 7776 - DNA, 60 bp, Artificial Sequence
  Description of Artificial Sequence: Synthetic probe
tccagaacgcgagcaaccccacggcctaccacaaggccccgttcaccagacttgcactgc

SEQ ID NO: 7777 - DNA, 60 bp, Artificial Sequence
  Description of Artificial Sequence: Synthetic probe
ctccagaacgcgagcaaccccacggcctaccacaaggccccgttcaccagacttgcactg

SEQ ID NO: 7778 - DNA, 60 bp, Artificial Sequence
  Description of Artificial Sequence: Synthetic probe
tcttcagaacgcgagcaaccccacggcctaccacaaggccccgttcacgagactagcact

SEQ ID NO: 7779 - DNA, 60 bp, Artificial Sequence
  Description of Artificial Sequence: Synthetic probe
gagcgctctccagaacgcgagcaaccccacggcctaccacaaggccccgttcacgagact

SEQ ID NO: 7780 - DNA, 60 bp, Artificial Sequence
  Description of Artificial Sequence: Synthetic probe
aagcgctctccagaacgcgagcaaccccacggcctaccacaaggccccgttcacgagact

SEQ ID NO: 7781 - DNA, 60 bp, Artificial Sequence
  Description of Artificial Sequence: Synthetic probe
cgtacacacaccaggacagggacaggttcgacgcgcccatcggcgtcgagaagcaacttt

SEQ ID NO: 7782 - DNA, 60 bp, Artificial Sequence
  Description of Artificial Sequence: Synthetic probe
gtgcgctacttcccgcgtacacacaccaggacagggacaggttcgacgcgcccatcggcg

SEQ ID NO: 7783 - DNA, 60 bp, Artificial Sequence
  Description of Artificial Sequence: Synthetic probe
ctaccgaatgaaacgcgcagagttgtactgtccccgtgcgctacttcccgcgtacacaca

SEQ ID NO: 7784 - DNA, 60 bp, Artificial Sequence
  Description of Artificial Sequence: Synthetic probe
gccagtcgacgtttactaccgaatgaaacgcgcagagttgtactgtccccgtgcgctact

SEQ ID NO: 7785 - DNA, 55 bp, Artificial Sequence
  Description of Artificial Sequence: Synthetic probe
ccgagaagaccatcgccattcgtggcgatagggctgtgctggcacaaaagtatgc

SEQ ID NO: 7786 - DNA, 60 bp, Artificial Sequence
  Description of Artificial Sequence: Synthetic probe
cacaggctgctgtccacggtgtacaacggggagtgtaaatacaccgagaagaccatcgcc

SEQ ID NO: 7787 - DNA, 60 bp, Artificial Sequence
  Description of Artificial Sequence: Synthetic probe
ggcacctcacaggctgctgtccacggtgtacaacggggagtgtaaatacaccgagaagac

SEQ ID NO: 7788 - DNA, 60 bp, Artificial Sequence
  Description of Artificial Sequence: Synthetic probe
aagtgacccggtttgcaattccgttcacggcacctcacaggctgctgtccacggtgtaca

SEQ ID NO: 7789 - DNA, 60 bp, Artificial Sequence
  Description of Artificial Sequence: Synthetic probe
cacaagaaagtgacccggtttgcaattccgttcacggcacctcacaggctgctgtccacg

SEQ ID NO: 7790 - DNA, 60 bp, Artificial Sequence
  Description of Artificial Sequence: Synthetic probe
tcttctcacacaagaaagtgacccggtttgcaattccgttcacggcacctcacaggctgc

SEQ ID NO: 7791 - DNA, 60 bp, Artificial Sequence
  Description of Artificial Sequence: Synthetic probe
ccaatggtcttctcacacaagaaagtgacccggtttgcaattccgttcacggcacctcac

SEQ ID NO: 7792 - DNA, 60 bp, Artificial Sequence
  Description of Artificial Sequence: Synthetic probe
atcgcttgtgttggtgaacacaaacgtgtgttctggcagcccaatggagcgccacgcaca

SEQ ID NO: 7793 - DNA, 60 bp, Artificial Sequence
  Description of Artificial Sequence: Synthetic probe
cctggaaatcgcgtgtgtgggtgaacacaaacgtgtgttctggcagcccaatggagcacc

SEQ ID NO: 7794 - DNA, 60 bp, Artificial Sequence
  Description of Artificial Sequence: Synthetic probe
ttctgtgacctggaaatcgcttgtgttggtgaacacaaacgtgtgttctggcagcccaat

SEQ ID NO: 7795 - DNA, 60 bp, Artificial Sequence
  Description of Artificial Sequence: Synthetic probe
tggagagggagccgatgttgtcaccactgacccatccactcacggcggaacagtcatggc

SEQ ID NO: 7796 - DNA, 60 bp, Artificial Sequence
  Description of Artificial Sequence: Synthetic probe
tggagagggagccgatgttgtcaccactgacccaaccactcacggcgggacagtcacagc

SEQ ID NO: 7797 - DNA, 60 bp, Artificial Sequence
  Description of Artificial Sequence: Synthetic probe
accacctccgctggagagggagccgatgttgtcaccactgacccatccactcacggcgga

SEQ ID NO: 7798 - DNA, 60 bp, Artificial Sequence
  Description of Artificial Sequence: Synthetic probe
accacgtccgctggagagggagccgatgttgtcaccactgacccaaccactcacggcggg

SEQ ID NO: 7799 - DNA, 60 bp, Artificial Sequence
  Description of Artificial Sequence: Synthetic probe
gactacagagtgtttgagtttgagataaaagtaaaaggacaggacatgctctcagacgcc

SEQ ID NO: 7800 - DNA, 60 bp, Artificial Sequence
  Description of Artificial Sequence: Synthetic probe
tgattatagagtgtttgagtttgagatcaaagtaaaaggacaggacatgctctcagacgc

SEQ ID NO: 7801 - DNA, 60 bp, Artificial Sequence
  Description of Artificial Sequence: Synthetic probe
gagcactgcttcggtctgcgacgtactacttctcagacttggaggttgcgcttgttcaca

SEQ ID NO: 7802 - DNA, 60 bp, Artificial Sequence
  Description of Artificial Sequence: Synthetic probe
gtacgttaggatgaagcgcgcagaactctactgcccgcgccctctcctgacacactacga

SEQ ID NO: 7803 - DNA, 60 bp, Artificial Sequence
  Description of Artificial Sequence: Synthetic probe
ggttaaagtaaaagggcaggacatgatgtcggacgcagcactcatggttctcaaccgcgg

SEQ ID NO: 7804 - DNA, 60 bp, Artificial Sequence
  Description of Artificial Sequence: Synthetic probe
tgaggttaaagtaaaagggcaggacatgatgtcggacgcggcactcatggttctcaaccg

SEQ ID NO: 7805 - DNA, 60 bp, Artificial Sequence
  Description of Artificial Sequence: Synthetic probe
ttgaggttaaagtaaaagggcaggacatgatgtcggacgctgcactcatggttctcaacc

SEQ ID NO: 7806 - DNA, 60 bp, Artificial Sequence
  Description of Artificial Sequence: Synthetic probe
gtgtttgagtttgaggttaaagtaaaagggcaggacatgatgtcggacgcagcactcatg

SEQ ID NO: 7807 - DNA, 60 bp, Artificial Sequence
  Description of Artificial Sequence: Synthetic probe
tcagagtgtttgagtttgaggttaaagtaaaagggcaggacatgatgtcggacgctgcac

SEQ ID NO: 7808 - DNA, 60 bp, Artificial Sequence
  Description of Artificial Sequence: Synthetic probe
gtgcccaacggtgcccctgaagcagctttgtcaaacaccagcaaccccactgcctacaac

SEQ ID NO: 7809 - DNA, 60 bp, Artificial Sequence
  Description of Artificial Sequence: Synthetic probe
ggctgaaaccatcactgagcttttgatccgcatgaaacgcgcggagacatactgccccag

SEQ ID NO: 7810 - DNA, 60 bp, Artificial Sequence
  Description of Artificial Sequence: Synthetic probe
cttctccgacttggagattgtggttcgtcacgacggcaacctgacatgggtacccaatgg

SEQ ID NO: 7811 - DNA, 60 bp, Artificial Sequence
  Description of Artificial Sequence: Synthetic probe
acccttggacacccgaccctgagaacgtgctcgcgtacgtcccttacgaccaggaacccc

SEQ ID NO: 7812 - DNA, 60 bp, Artificial Sequence
  Description of Artificial Sequence: Synthetic probe
acccatggacacccgaccctgagaacgtgctcgcgtacgtgccatacgaccaggaaccac

SEQ ID NO: 7813 - DNA, 60 bp, Artificial Sequence
  Description of Artificial Sequence: Synthetic probe
acggtgattgcaagtacaaacccgctggcacggctccgcgcaacaacatccgtggagatc

SEQ ID NO: 7814 - DNA, 60 bp, Artificial Sequence
  Description of Artificial Sequence: Synthetic probe
ggtgtctagcaacatcatacaacggtgattgcaagtacaaacccgctggcacggctccgc

SEQ ID NO: 7815 - DNA, 60 bp, Artificial Sequence
  Description of Artificial Sequence: Synthetic probe
acactgcgccacacaggtgtctagcaacatcatacaacggtgattgcaagtacaaacccg

SEQ ID NO: 7816 - DNA, 60 bp, Artificial Sequence
  Description of Artificial Sequence: Synthetic probe
gcggccacctactacttctctgatttggaaattgtcgtgaaacacgacggtaatctgacc

SEQ ID NO: 7817 - DNA, 60 bp, Artificial Sequence
  Description of Artificial Sequence: Synthetic probe
gcggccacctactacttctctgatttggaaattgtcgtgaaacacgacggcaatctgacc

SEQ ID NO: 7818 - DNA, 60 bp, Artificial Sequence
  Description of Artificial Sequence: Synthetic probe
gttgcgtgcggccacctactacttctctgatttggaaattgtcgtgaaacacgacggtaa

SEQ ID NO: 7819 - DNA, 60 bp, Artificial Sequence
  Description of Artificial Sequence: Synthetic probe
gttgcgtgcggccacctactacttctctgatttggaaattgtcgtgaaacacgacggcaa

SEQ ID NO: 7820 - DNA, 60 bp, Artificial Sequence
  Description of Artificial Sequence: Synthetic probe
acacgagcttctcgtgcgcatgaaacgggccgaactctactgccctagaccactgctggc

SEQ ID NO: 7821 - DNA, 60 bp, Artificial Sequence
  Description of Artificial Sequence: Synthetic probe
gtctgcaacgtactacttctcagacctggaggttgcgcttgtccacacgggcccagccac

SEQ ID NO: 7822 - DNA, 60 bp, Artificial Sequence
  Description of Artificial Sequence: Synthetic probe
gaattgtactgccccagaccacttctcccggcgtacgaacatggagaccgggacaggttc

SEQ ID NO: 7823 - DNA, 60 bp, Artificial Sequence
  Description of Artificial Sequence: Synthetic probe
caacggtgtcaccaggttcgctgtgccatacaccgcgcctcaccgcttgttgtcaactgt

SEQ ID NO: 7824 - DNA, 60 bp, Artificial Sequence
  Description of Artificial Sequence: Synthetic probe
ctccaacaacggtgttaccaggttcgctgtgccatacaccgcgcctcaccgcttgttgtc

SEQ ID NO: 7825 - DNA, 60 bp, Artificial Sequence
  Description of Artificial Sequence: Synthetic probe
tctccaacaacggtgtcaccaggttcgctgtgccatacaccgcgcctcaccgcttgttgt

SEQ ID NO: 7826 - DNA, 60 bp, Artificial Sequence
  Description of Artificial Sequence: Synthetic probe
tttctccaacaacggtgtcaccaggttcgctgtgccatacaccgcgcctcaccgcttgtt

SEQ ID NO: 7827 - DNA, 57 bp, Artificial Sequence
  Description of Artificial Sequence: Synthetic probe
gcgctgttgcgtgcagccacgtactacttctctgacttggagattgttgtgcggcat

SEQ ID NO: 7828 - DNA, 60 bp, Artificial Sequence
  Description of Artificial Sequence: Synthetic probe
gggcgcgctgttgcgtgcagccacgtactacttctctgacttggagattgttgtgcggca

SEQ ID NO: 7829 - DNA, 60 bp, Artificial Sequence
  Description of Artificial Sequence: Synthetic probe
gggcacgttactgcagaccaagcagttgacgtgtactacaggatgaagcgtgctgaactg

SEQ ID NO: 7830 - DNA, 60 bp, Artificial Sequence
  Description of Artificial Sequence: Synthetic probe
actttgggcacgttactgcggaacaaccagttgacgtgtactacaggatgaagcgtgctg

SEQ ID NO: 7831 - DNA, 60 bp, Artificial Sequence
  Description of Artificial Sequence: Synthetic probe
ccccccaccgtgtactggcgacagtgtacaacgggaagactacgtacggggaaacaactt

SEQ ID NO: 7832 - DNA, 60 bp, Artificial Sequence
  Description of Artificial Sequence: Synthetic probe
cggcgctgtaaaggctgacaacataactgagcttttgatccgcatgaagcgcgcggagac

SEQ ID NO: 7833 - DNA, 60 bp, Artificial Sequence
  Description of Artificial Sequence: Synthetic probe
ccccactgtctaccccaagcaaccgttcacgaggcttgcgctcccctacactgcaccaca

SEQ ID NO: 7834 - DNA, 60 bp, Artificial Sequence
  Description of Artificial Sequence: Synthetic probe
gagaacaccagcaaccccactgcctacaacaaggcaccattcacgagactcgctctcccc

SEQ ID NO: 7835 - DNA, 52 bp, Artificial Sequence
  Description of Artificial Sequence: Synthetic probe
cactgggaagaccacattcgaggtcaacttgatggacaccaaggagaaagcc

SEQ ID NO: 7836 - DNA, 60 bp, Artificial Sequence
  Description of Artificial Sequence: Synthetic probe
ggtcaacccacgttcacaccgggaagaccacattcgaggtcaacttgatggacaccaagg

SEQ ID NO: 7837 - DNA, 60 bp, Artificial Sequence
  Description of Artificial Sequence: Synthetic probe
gttgcttttctcctggacaggtcaacccacgttcacactgggaagaccacattcgaggtc

SEQ ID NO: 7838 - DNA, 60 bp, Artificial Sequence
  Description of Artificial Sequence: Synthetic probe
cgcaaacacactgacgttgcttttctcctggacaggtcaacccacgttcacactgggaag

SEQ ID NO: 7839 - DNA, 60 bp, Artificial Sequence
  Description of Artificial Sequence: Synthetic probe
ggtggggcagtcacaaacccgcgacgcaaacacactgacgttgcttttctcctggacagg

SEQ ID NO: 7840 - DNA, 60 bp, Artificial Sequence
  Description of Artificial Sequence: Synthetic probe
acacggtggggcagtcacaaacccgcgacgcaaacacactgacgttgcttttctcctgga

SEQ ID NO: 7841 - DNA, 60 bp, Artificial Sequence
  Description of Artificial Sequence: Synthetic probe
cccaaccacacacggtggggcagtcacaaacccgcgacgcaaacacactgacgttgcttt

SEQ ID NO: 7842 - DNA, 60 bp, Artificial Sequence
  Description of Artificial Sequence: Synthetic probe
tgagaactacggtggtgagacacaggtccagcggcgtcaccacactgatgttggcttcat

SEQ ID NO: 7843 - DNA, 60 bp, Artificial Sequence
  Description of Artificial Sequence: Synthetic probe
cagaaggcggcaagaacgctgcctacctccttcaactacggtgccatcaaagcgactcgg

SEQ ID NO: 7844 - DNA, 60 bp, Artificial Sequence
  Description of Artificial Sequence: Synthetic probe
gcccagaaggcggcaagaacgctgcctacctccttcaactacggtgccatcaaagccact

SEQ ID NO: 7845 - DNA, 60 bp, Artificial Sequence
  Description of Artificial Sequence: Synthetic probe
aaccacccgctttgctttgccctacactgccccacacaggtgtcttgccaccgcctacaa

SEQ ID NO: 7846 - DNA, 60 bp, Artificial Sequence
  Description of Artificial Sequence: Synthetic probe
ggaaccacccgctttgctttgccctacactgccccacacaggtgtcttgccaccgcctac

SEQ ID NO: 7847 - DNA, 60 bp, Artificial Sequence
  Description of Artificial Sequence: Synthetic probe
ggcccagtactacacacagtacgctgggacaatcaacttgcacttcatgtttactgggct

SEQ ID NO: 7848 - DNA, 60 bp, Artificial Sequence
  Description of Artificial Sequence: Synthetic probe
tctggcccagtactacacacagtacgctgggacaatcaacctgcacttcatgttcactgg

SEQ ID NO: 7849 - DNA, 60 bp, Artificial Sequence
  Description of Artificial Sequence: Synthetic probe
tttggcccagtactacacacagtacgctgggacaatcaacttgcacttcatgtttactgg

SEQ ID NO: 7850 - DNA, 60 bp, Artificial Sequence
  Description of Artificial Sequence: Synthetic probe
cctacttggccggcttggcccagtactacacacagtacgctgggacaatcaacttgcact

SEQ ID NO: 7851 - DNA, 60 bp, Artificial Sequence
  Description of Artificial Sequence: Synthetic probe
catgtcaaacacctacttggccggcttggcccagtactacacacagtacgctgggacaat

SEQ ID NO: 7852 - DNA, 60 bp, Artificial Sequence
  Description of Artificial Sequence: Synthetic probe
gcctttgttcttgacaggtttgtgaaactcactgcacccaagaacatccagacccttgac

SEQ ID NO: 7853 - DNA, 60 bp, Artificial Sequence
  Description of Artificial Sequence: Synthetic probe
cccgaacggggcgcctgaaacagcgctggacaacaccaccaacccaacagcataccacaa

SEQ ID NO: 7854 - DNA, 60 bp, Artificial Sequence
  Description of Artificial Sequence: Synthetic probe
cctgtgaccgctgtgagaggtgacctacaagtgttggcccagaaggcggctagaacgctg

SEQ ID NO: 7855 - DNA, 60 bp, Artificial Sequence
  Description of Artificial Sequence: Synthetic probe
gcaggacagacacaagcaaaagatcattgcacctgcaaagcaactcctgaacttcgacct

SEQ ID NO: 7856 - DNA, 60 bp, Artificial Sequence
  Description of Artificial Sequence: Synthetic probe
gcaggacagacacaagcaaaagatcattgcacctgcaaagcagctcctgaacttcgacct

SEQ ID NO: 7857 - DNA, 56 bp, Artificial Sequence
  Description of Artificial Sequence: Synthetic probe
agcccacgggtgacaggcacaagcaaccgttagttgcacctgcaaagcagctacta

SEQ ID NO: 7858 - DNA, 60 bp, Artificial Sequence
  Description of Artificial Sequence: Synthetic probe
ggagctttattgccctaggcctcatctccctatccagcccacgggtgacaggcacaagca

SEQ ID NO: 7859 - DNA, 60 bp, Artificial Sequence
  Description of Artificial Sequence: Synthetic probe
gcggatgaaacgggcggagctttattgccctaggcctcatctccctatccagcccacggg

SEQ ID NO: 7860 - DNA, 60 bp, Artificial Sequence
  Description of Artificial Sequence: Synthetic probe
aaaacatccgtggagacctcgcaactctcgcggcgaggattgcaagtgagacacacattc

SEQ ID NO: 7861 - DNA, 60 bp, Artificial Sequence
  Description of Artificial Sequence: Synthetic probe
tgcggaagtgggcgacaacccagtcgtcttttccaaaggtggaaccacccgttttgcatt

SEQ ID NO: 7862 - DNA, 60 bp, Artificial Sequence
  Description of Artificial Sequence: Synthetic probe
aacaaatgggtcggctggactcccaacggagctccagaacttgcggaagtgggcgacaac

SEQ ID NO: 7863 - DNA, 60 bp, Artificial Sequence
  Description of Artificial Sequence: Synthetic probe
gcgtgtgtgggtgacaacaaatgggtcggctggactcccaacggagctccagaacttgcg

SEQ ID NO: 7864 - DNA, 60 bp, Artificial Sequence
  Description of Artificial Sequence: Synthetic probe
gtgggtgacaacaaatgggtcggctggactcccaacggagctccagaacttgcggaagtg

SEQ ID NO: 7865 - DNA, 60 bp, Artificial Sequence
  Description of Artificial Sequence: Synthetic probe
tggcaccacccgctttgcactgccctacaccgcgccacacagatgcctggcgacatctta

SEQ ID NO: 7866 - DNA, 60 bp, Artificial Sequence
  Description of Artificial Sequence: Synthetic probe
aaccagcgcaggtgaaggggcagacgtggtgaccgtcgacaccgctgcacacggcggtaa

SEQ ID NO: 7867 - DNA, 60 bp, Artificial Sequence
  Description of Artificial Sequence: Synthetic probe
acaaccagcgcaggtgaaggggcagacgtggtgaccgtcgacaccgctgcacacggcggt

SEQ ID NO: 7868 - DNA, 60 bp, Artificial Sequence
  Description of Artificial Sequence: Synthetic probe
acaaccagcgcaggtgaaggggcagacgtggtgaccgtcgacgccgccgcacacggtggt

SEQ ID NO: 7869 - DNA, 60 bp, Artificial Sequence
  Description of Artificial Sequence: Synthetic probe
acaaccagcgcaggtgaaggggcagacgtggtgaccgtcgacaccgctgcacacggtggt

SEQ ID NO: 7870 - DNA, 60 bp, Artificial Sequence
  Description of Artificial Sequence: Synthetic probe
cgctgccctacaccgcgccacacagatgcctggcgacatcttacaacggtgattgcaagt

SEQ ID NO: 7871 - DNA, 60 bp, Artificial Sequence
  Description of Artificial Sequence: Synthetic probe
gacacaggtccaaaggcggcaccacacggatgtcggcttcataatggacagatttgtgaa

SEQ ID NO: 7872 - DNA, 60 bp, Artificial Sequence
  Description of Artificial Sequence: Synthetic probe
cctcctgacacactacgatcacaatggcaaggatcgctacaagaccgcgataaccaaacc

SEQ ID NO: 7873 - DNA, 60 bp, Artificial Sequence
  Description of Artificial Sequence: Synthetic probe
gcacacactccgcaggtggcaatggagttggatactgttcttgcgttcccaggtccatgc

SEQ ID NO: 7874 - DNA, 60 bp, Artificial Sequence
  Description of Artificial Sequence: Synthetic probe
gcactcactccgcaggtggcaatggagttggatactgctcctgcgtttccaggtccatgc

SEQ ID NO: 7875 - DNA, 60 bp, Artificial Sequence
  Description of Artificial Sequence: Synthetic probe
cgttggcacacactccgcaggtggcaatggagttggatactgttcttgcgttcccaggtc

SEQ ID NO: 7876 - DNA, 60 bp, Artificial Sequence
  Description of Artificial Sequence: Synthetic probe
atggagcgcctgaaaaggcgttggacactgctaaggcactcacccggcttgccctgccca

SEQ ID NO: 7877 - DNA, 60 bp, Artificial Sequence
  Description of Artificial Sequence: Synthetic probe
ccagattccatcacacactttggtggcgctcctacgcgcgtccacttactctttgatagc

SEQ ID NO: 7878 - DNA, 60 bp, Artificial Sequence
  Description of Artificial Sequence: Synthetic probe
ccaggttccatcacacactttggtggcgctcctacgcgcgtccacttactctttgatagc

SEQ ID NO: 7879 - DNA, 60 bp, Artificial Sequence
  Description of Artificial Sequence: Synthetic probe
taacattttgctccaggttccatcacacactttggtggcgctcctacgcgcgtccactta

SEQ ID NO: 7880 - DNA, 60 bp, Artificial Sequence
  Description of Artificial Sequence: Synthetic probe
cattaacattttgctccagattccatcacacactttggtggcgctcctacgcgcgtccac

SEQ ID NO: 7881 - DNA, 60 bp, Artificial Sequence
  Description of Artificial Sequence: Synthetic probe
ggcgccaagacgtctcgttcattatggacaaagtgccgcaaaacattaacattttgctcc

SEQ ID NO: 7882 - DNA, 60 bp, Artificial Sequence
  Description of Artificial Sequence: Synthetic probe
ggcgccaagacgtctcgttcatcatggacaaagtgccgcaaaacattaacattttgctcc

SEQ ID NO: 7883 - DNA, 60 bp, Artificial Sequence
  Description of Artificial Sequence: Synthetic probe
atcaggcgccaagacgtctcgttcattatggacaaagtgccgcaaaacattaacattttg

SEQ ID NO: 7884 - DNA, 60 bp, Artificial Sequence
  Description of Artificial Sequence: Synthetic probe
gcattgccctacactgctccacacaggtgcttggcaacagcctacaacggtgactgtaag

SEQ ID NO: 7885 - DNA, 60 bp, Artificial Sequence
  Description of Artificial Sequence: Synthetic probe
cgctttgcactgccctacactgctccacacaggtgcttggcaacatcatacaacggtgat

SEQ ID NO: 7886 - DNA, 60 bp, Artificial Sequence
  Description of Artificial Sequence: Synthetic probe
aatctgccgaccctgttaccactaccgttgagaactacggaggagagacgcaagtccaac

SEQ ID NO: 7887 - DNA, 60 bp, Artificial Sequence
  Description of Artificial Sequence: Synthetic probe
ccactggtgaatctgccgaccctgttaccactaccgttgagaactacggaggagagacgc

SEQ ID NO: 7888 - DNA, 60 bp, Artificial Sequence
  Description of Artificial Sequence: Synthetic probe
tcacatgggtgcccaacggtgcaccagtttctgcacttgacaacacaaccaatcccactg

SEQ ID NO: 7889 - DNA, 60 bp, Artificial Sequence
  Description of Artificial Sequence: Synthetic probe
cgaccacggtgggaaagatcgctacaagaccgcgatcaccaagcctgtcaaacaactgtg

SEQ ID NO: 7890 - DNA, 60 bp, Artificial Sequence
  Description of Artificial Sequence: Synthetic probe
gacacactacgaccacggtgggaaagatcgctacaagaccgcgatcaccaagcctgtcaa

SEQ ID NO: 7891 - DNA, 60 bp, Artificial Sequence
  Description of Artificial Sequence: Synthetic probe
gcgacctctcctgacacactacgaccacggtgggaaagatcgctacaagaccgcgatcac

SEQ ID NO: 7892 - DNA, 60 bp, Artificial Sequence
  Description of Artificial Sequence: Synthetic probe
gtgtacatcaggatgaagcgcgcggagctctactgtccgcgacctctcctgacacactac

SEQ ID NO: 7893 - DNA, 60 bp, Artificial Sequence
  Description of Artificial Sequence: Synthetic probe
tagcgtggacgtgtacatcaggatgaagcgcgcggagctctactgtccgcgacctctcct

SEQ ID NO: 7894 - DNA, 60 bp, Artificial Sequence
  Description of Artificial Sequence: Synthetic probe
tagtgaggtgggcgacaacccagtcgtcttctccactaacggcaccacccgttttgcact

SEQ ID NO: 7895 - DNA, 60 bp, Artificial Sequence
  Description of Artificial Sequence: Synthetic probe
aatggatgggtcggttggacccctaacggggcacccgaacttagtgaggtgggcgacaac

SEQ ID NO: 7896 - DNA, 60 bp, Artificial Sequence
  Description of Artificial Sequence: Synthetic probe
ctgggtgagaatggatgggtcggttggacccctaacggggcacccgaacttagtgaggtg

SEQ ID NO: 7897 - DNA, 60 bp, Artificial Sequence
  Description of Artificial Sequence: Synthetic probe
ccaccgcctacaacaaggcaccgttcacgagacttgccctcccctacaccgcgccacacc

SEQ ID NO: 7898 - DNA, 60 bp, Artificial Sequence
  Description of Artificial Sequence: Synthetic probe
acacccgaccctgaaaacgtgcttgcgtacgtgccctacgaccaggagccactggacgta

SEQ ID NO: 7899 - DNA, 58 bp, Artificial Sequence
  Description of Artificial Sequence: Synthetic probe
tggacatgatcaaacagttatctgactacaccaaacgtgacctctcggacggtgggcc

SEQ ID NO: 7900 - DNA, 60 bp, Artificial Sequence
  Description of Artificial Sequence: Synthetic probe
gatgagccgctctttgagtctgagtatctttcaccagaggacaagacattggacatgatc

SEQ ID NO: 7901 - DNA, 60 bp, Artificial Sequence
  Description of Artificial Sequence: Synthetic probe
cgatgagccgctctttgagtctgagtatctttcaccagaggacaagacattggacatgat

SEQ ID NO: 7902 - DNA, 60 bp, Artificial Sequence
  Description of Artificial Sequence: Synthetic probe
acgcacggcaactgctggctcaacacgctgttgcagctctttcgatacgtcgatgagccg

SEQ ID NO: 7903 - DNA, 60 bp, Artificial Sequence
  Description of Artificial Sequence: Synthetic probe
ccccggacagaaagactgcgatgaagtgaactctgagcagcctaaacccgcggagaaacc

SEQ ID NO: 7904 - DNA, 60 bp, Artificial Sequence
  Description of Artificial Sequence: Synthetic probe
tgagagaaagctccccggacagaaagactgcgatgaagtgaactctgagcagcctaaacc

SEQ ID NO: 7905 - DNA, 60 bp, Artificial Sequence
  Description of Artificial Sequence: Synthetic probe
cctcaagaggttgtcgacaaacccactgtcggcttccgtgagagaaagctccccggacag

SEQ ID NO: 7906 - DNA, 60 bp, Artificial Sequence
  Description of Artificial Sequence: Synthetic probe
gcggaaaagaaccctcaagaggttgtcgacaaacccactgtcggcttccgtgagagaaag

SEQ ID NO: 7907 - DNA, 60 bp, Artificial Sequence
  Description of Artificial Sequence: Synthetic probe
ggacagcacgaagctgcaattgaattctatgaagggatggtgcacgacagcatcaaggaa

SEQ ID NO: 7908 - DNA, 60 bp, Artificial Sequence
  Description of Artificial Sequence: Synthetic probe
cacttctggcaatagaggtgtcttcacaagacagacacaaacagaagatcattgcacccg

SEQ ID NO: 7909 - DNA, 60 bp, Artificial Sequence
  Description of Artificial Sequence: Synthetic probe
tacgaacatttaagccgggacaggttcgacggccccatcggcgtcgagaagcaattgtgc

SEQ ID NO: 7910 - DNA, 60 bp, Artificial Sequence
  Description of Artificial Sequence: Synthetic probe
ggcatacgaacatttaagccgggacaggttcgacggccccatcggcgtcgagaagcaatt

SEQ ID NO: 7911 - DNA, 60 bp, Artificial Sequence
  Description of Artificial Sequence: Synthetic probe
ggcatacgaacattcaaaccgggacaggttcgacggccccatcggcgtcgagaagcaatt

SEQ ID NO: 7912 - DNA, 52 bp, Artificial Sequence
  Description of Artificial Sequence: Synthetic probe
gagtgtaagtacacgcaggaagcaagggccattcgtggcgaccgggcagtgc

SEQ ID NO: 7913 - DNA, 60 bp, Artificial Sequence
  Description of Artificial Sequence: Synthetic probe
caacaggttacaacggcgagtgtaagtacacgcaggaagcaagggccattcgtggcgacc

SEQ ID NO: 7914 - DNA, 60 bp, Artificial Sequence
  Description of Artificial Sequence: Synthetic probe
ccatcccttacactgcacctcaccggttgcttgcaaccaggtacaacggtgagtgtaagt

SEQ ID NO: 7915 - DNA, 60 bp, Artificial Sequence
  Description of Artificial Sequence: Synthetic probe
gtctgcgacgtactacttctcagacctggaggtggcgcttgttcacacaggcccagccac

SEQ ID NO: 7916 - DNA, 60 bp, Artificial Sequence
  Description of Artificial Sequence: Synthetic probe
gcaggtgcacaaggacagtattgtgggagcgcttctccgcgcagccacgtactacttctc

SEQ ID NO: 7917 - DNA, 60 bp, Artificial Sequence
  Description of Artificial Sequence: Synthetic probe
gacgtgatgcaggtacacaaggacagtattgtgggagcgcttctccgcgcagccacgtac

SEQ ID NO: 7918 - DNA, 60 bp, Artificial Sequence
  Description of Artificial Sequence: Synthetic probe
cactggacgtgatgcaggtacacaaggacagtattgtgggagcgcttctccgcgcagcca

SEQ ID NO: 7919 - DNA, 60 bp, Artificial Sequence
  Description of Artificial Sequence: Synthetic probe
acacactggacgtgatgcaggtacacaaggacagtattgtgggagcgcttctccgcgcag

SEQ ID NO: 7920 - DNA, 60 bp, Artificial Sequence
  Description of Artificial Sequence: Synthetic probe
acaacacacactggacgtgatgcaggtacacaaggacagtattgtgggagcgcttctccg

SEQ ID NO: 7921 - DNA, 60 bp, Artificial Sequence
  Description of Artificial Sequence: Synthetic probe
cggacaacaacacacactggacgtgatgcaggtacacaaggacagtattgtgggagcgct

SEQ ID NO: 7922 - DNA, 53 bp, Artificial Sequence
  Description of Artificial Sequence: Synthetic probe
tagccctcactaaacctgccaagcaactgtgcaacttcaacctgctaaagttg

SEQ ID NO: 7923 - DNA, 60 bp, Artificial Sequence
  Description of Artificial Sequence: Synthetic probe
cgcgagtgaaacacacatcccaaccaccttcaactacggtaggatctacacggaggcgga

SEQ ID NO: 7924 - DNA, 60 bp, Artificial Sequence
  Description of Artificial Sequence: Synthetic probe
acggaccaacatccgtggagacctcgcgacgctcgcacagcgaatcgcgagtgaaacaca

SEQ ID NO: 7925 - DNA, 60 bp, Artificial Sequence
  Description of Artificial Sequence: Synthetic probe
gcgaccgtctacaacggtgactgcaagtacaagccagctgaacaagccccacggaccaac

SEQ ID NO: 7926 - DNA, 60 bp, Artificial Sequence
  Description of Artificial Sequence: Synthetic probe
cacacaggtgtcttgcgaccgtctacaacggtgactgcaagtacaagccagctgaacaag

SEQ ID NO: 7927 - DNA, 60 bp, Artificial Sequence
  Description of Artificial Sequence: Synthetic probe
cggagcaccagagttgaacgaggttggcgacaacccagtcgtcttctcacacaacggcac

SEQ ID NO: 7928 - DNA, 60 bp, Artificial Sequence
  Description of Artificial Sequence: Synthetic probe
tggactcctaacggagcaccagagttgaacgaggttggcgacaacccagtcgtcttctca

SEQ ID NO: 7929 - DNA, 60 bp, Artificial Sequence
  Description of Artificial Sequence: Synthetic probe
cgccggatccgtccgacgttttggtgtttgttccgtatgatcaagaaccactcaacggag

SEQ ID NO: 7930 - DNA, 58 bp, Artificial Sequence
  Description of Artificial Sequence: Synthetic probe
tctgaacttcgacctgctcaagttggcgggagacgtggagtccaaccctgggcccttc

SEQ ID NO: 7931 - DNA, 60 bp, Artificial Sequence
  Description of Artificial Sequence: Synthetic probe
ccttggccgacttccacgccgggattttcatcaaaggtaccgaacacgcagtgttcgctc

SEQ ID NO: 7932 - DNA, 60 bp, Artificial Sequence
  Description of Artificial Sequence: Synthetic probe
tgaccttggccgacttccacgccgggattttcatcaaaggtaccgaacacgcagtgttcg

SEQ ID NO: 7933 - DNA, 60 bp, Artificial Sequence
  Description of Artificial Sequence: Synthetic probe
actcgccccagcgagatctgcgtgatcaacggggtcaccatgaccttggccgacttccac

SEQ ID NO: 7934 - DNA, 60 bp, Artificial Sequence
  Description of Artificial Sequence: Synthetic probe
tggcaccagcactcgccccagcgagatctgcgtgatcaacggggtcaccatgaccttggc

SEQ ID NO: 7935 - DNA, 60 bp, Artificial Sequence
  Description of Artificial Sequence: Synthetic probe
ccaccggctctcgtgctctggctcatcaaggattgtcttcaaaccggcgttggcaccagc

SEQ ID NO: 7936 - DNA, 60 bp, Artificial Sequence
  Description of Artificial Sequence: Synthetic probe
cacgggaactgctggctcaactcattgttgcagctctttcgatacgtcgatgaaccgctc

SEQ ID NO: 7937 - DNA, 60 bp, Artificial Sequence
  Description of Artificial Sequence: Synthetic probe
gctccggtctgcgacgtactacttctcagacctagaggttgcgcttgcgcacacaggccc

SEQ ID NO: 7938 - DNA, 60 bp, Artificial Sequence
  Description of Artificial Sequence: Synthetic probe
tacgtgccctacgaccaggaacccctggacgttgactggcaggatcgtgcaggcctgttc

SEQ ID NO: 7939 - DNA, 60 bp, Artificial Sequence
  Description of Artificial Sequence: Synthetic probe
cgcgtacgtgccctacgaccaggaacccctggacgttgactggcaggatcgtgcaggcct

SEQ ID NO: 7940 - DNA, 60 bp, Artificial Sequence
  Description of Artificial Sequence: Synthetic probe
tgaccctgagaacgtacttgcgtacgtgccctacgaccaggaacccctggacgttgactg

SEQ ID NO: 7941 - DNA, 60 bp, Artificial Sequence
  Description of Artificial Sequence: Synthetic probe
gcccagtgcttacccactacaaccaccagggaaaggaccgctacaaaacggccctgacca

SEQ ID NO: 7942 - DNA, 60 bp, Artificial Sequence
  Description of Artificial Sequence: Synthetic probe
actgtccacgcccagtgcttacccactacaaccaccagggaaaggaccgctacaaaacgg

SEQ ID NO: 7943 - DNA, 60 bp, Artificial Sequence
  Description of Artificial Sequence: Synthetic probe
cgatgtgtatgtgaggatgaagcgggcggaagtctactgtccacgcccagtgcttaccca

SEQ ID NO: 7944 - DNA, 50 bp, Artificial Sequence
  Description of Artificial Sequence: Synthetic probe
gagtcaccgcggacccacatacgcggtgatctcgcgacgctcgccgagcg

SEQ ID NO: 7945 - DNA, 60 bp, Artificial Sequence
  Description of Artificial Sequence: Synthetic probe
caaaccaaccaccgagtcaccgcggacccacatacgcggtgatctcgcgacgctcgccga

SEQ ID NO: 7946 - DNA, 60 bp, Artificial Sequence
  Description of Artificial Sequence: Synthetic probe
ccccgcacaggtgtcttgccactgtttacaacggtgactgcaggtacaaaccaaccaccg

SEQ ID NO: 7947 - DNA, 60 bp, Artificial Sequence
  Description of Artificial Sequence: Synthetic probe
accgccccgcacaggtgtcttgccactgtttacaacggtgactgcaggtacaaaccaacc

SEQ ID NO: 7948 - DNA, 60 bp, Artificial Sequence
  Description of Artificial Sequence: Synthetic probe
ttttctcacaatgggaccacccgttttgccctgccctacaccgccccgcacaggtgtctt

SEQ ID NO: 7949 - DNA, 60 bp, Artificial Sequence
  Description of Artificial Sequence: Synthetic probe
acccagtcgtcttttctcacaatgggaccacccgttttgccctgccctacaccgccccgc

SEQ ID NO: 7950 - DNA, 60 bp, Artificial Sequence
  Description of Artificial Sequence: Synthetic probe
gcgtcgccacgtactatttctcggacttggaggtggcgtgtgttggcgagaacaaatggg

SEQ ID NO: 7951 - DNA, 60 bp, Artificial Sequence
  Description of Artificial Sequence: Synthetic probe
gcgcgtcgccacgtactatttctcggacttggaggtggcgtgtgttggcgagaacaaatg

SEQ ID NO: 7952 - DNA, 60 bp, Artificial Sequence
  Description of Artificial Sequence: Synthetic probe
gcgagtgacgacgtgaacactgagcccgccaaacccgtggaagagcaaccacaagctgaa

SEQ ID NO: 7953 - DNA, 60 bp, Artificial Sequence
  Description of Artificial Sequence: Synthetic probe
agcaattgaatttttcgaggggatggtacacgactccatcaaggaggaactccgacccct

SEQ ID NO: 7954 - DNA, 60 bp, Artificial Sequence
  Description of Artificial Sequence: Synthetic probe
catgtcattgaccttatgcaaacccaccaacacgggctggtgggtgccctgttgcgtgct

SEQ ID NO: 7955 - DNA, 60 bp, Artificial Sequence
  Description of Artificial Sequence: Synthetic probe
tcttttggcaaacatagtgatcatgatccgcgagactcgcaagagacagcagatggtgga

SEQ ID NO: 7956 - DNA, 60 bp, Artificial Sequence
  Description of Artificial Sequence: Synthetic probe
ctctactggcaaacatagtgatcatgatccgcgagactcgcaagagacagcagatggtgg

SEQ ID NO: 7957 - DNA, 60 bp, Artificial Sequence
  Description of Artificial Sequence: Synthetic probe
actctcctggcaaacatagtgatcatgatccgcgagactcgcaagagacaacggatggtg

SEQ ID NO: 7958 - DNA, 60 bp, Artificial Sequence
  Description of Artificial Sequence: Synthetic probe
ccctgtgtttgactcttctggcaaacatagtgatcatgatccgcgagactcgcaagagac

SEQ ID NO: 7959 - DNA, 60 bp, Artificial Sequence
  Description of Artificial Sequence: Synthetic probe
ccctatgtttgactcttctggcaaacatagtgatcatgatccgcgagactcgcaagagac

SEQ ID NO: 7960 - DNA, 60 bp, Artificial Sequence
  Description of Artificial Sequence: Synthetic probe
ccctatgtttgactctcttggcaaacatagtgatcatgatccgcgagactcgcaagagac

SEQ ID NO: 7961 - DNA, 60 bp, Artificial Sequence
  Description of Artificial Sequence: Synthetic probe
gttgccctatgtttgactctcctggcaaacatagtgatcatgatccgcgagactcgcaag

SEQ ID NO: 7962 - DNA, 60 bp, Artificial Sequence
  Description of Artificial Sequence: Synthetic probe
tgtttgagtttgaggtaaaagtaaaaggacaggacatgctctcagatgccgcgctcatgg

SEQ ID NO: 7963 - DNA, 60 bp, Artificial Sequence
  Description of Artificial Sequence: Synthetic probe
cagagtgtttgagtttgaggtaaaagtaaaaggacaggacatgctctcagatgccgcgct

SEQ ID NO: 7964 - DNA, 60 bp, Artificial Sequence
  Description of Artificial Sequence: Synthetic probe
aggagactccccgggcacaagaatgacgatgaagtgaacactgagcccagtcaagcccgg

SEQ ID NO: 7965 - DNA, 60 bp, Artificial Sequence
  Description of Artificial Sequence: Synthetic probe
tcgggcttccgggagaggagactccccgggcacaagaatgacgatgaagtgaacactgag

SEQ ID NO: 7966 - DNA, 60 bp, Artificial Sequence
  Description of Artificial Sequence: Synthetic probe
gcgcctgaaggaaaacttcgagatcgttgctctcgtcgttgggctgttggcaaacatggt

SEQ ID NO: 7967 - DNA, 60 bp, Artificial Sequence
  Description of Artificial Sequence: Synthetic probe
tcaaggaagagcttaaaccgcttctcgagcaaaccagcttcgcgaagcgtgccttcaagc

SEQ ID NO: 7968 - DNA, 60 bp, Artificial Sequence
  Description of Artificial Sequence: Synthetic probe
cgacctgttctcacgcactacgaccacagcggcaaggaccgttacaagacggctctcgtt

SEQ ID NO: 7969 - DNA, 60 bp, Artificial Sequence
  Description of Artificial Sequence: Synthetic probe
tacttctctgacctggaggtggcgtgtgttgggaccaacgcgtgggtgggctggactccc

SEQ ID NO: 7970 - DNA, 60 bp, Artificial Sequence
  Description of Artificial Sequence: Synthetic probe
gccccgactttgagttcaggatgcccattagcccattgcgccagacaacctctgcaggtg

SEQ ID NO: 7971 - DNA, 60 bp, Artificial Sequence
  Description of Artificial Sequence: Synthetic probe
gcatacatcccacccggcacaaaccctctccccaaaacaccggagatggcatcacactgc

SEQ ID NO: 7972 - DNA, 60 bp, Artificial Sequence
  Description of Artificial Sequence: Synthetic probe
aatactgaccccaaaacttcggaccccatttacgggcacgtgtacaacccggcgcgcacg

SEQ ID NO: 7973 - DNA, 60 bp, Artificial Sequence
  Description of Artificial Sequence: Synthetic probe
cacagaccacaagggtatctacgggcagctggttgactctcacgcgtacatccgcaacgg

SEQ ID NO: 7974 - DNA, 60 bp, Artificial Sequence
  Description of Artificial Sequence: Synthetic probe
tggacacccagcttggtgacaacgccatctcgggtggttccaatgaggggtcgaccgaca

SEQ ID NO: 7975 - DNA, 60 bp, Artificial Sequence
  Description of Artificial Sequence: Synthetic probe
gaaggcggcaagaacgctgcctacctccttcaactacggtgccatcaaagccactcgggt

SEQ ID NO: 7976 - DNA, 60 bp, Artificial Sequence
  Description of Artificial Sequence: Synthetic probe
accaccactgtcggggagtctgcagaccccgtcaccaccactgttgagaactacggtggt

SEQ ID NO: 7977 - DNA, 60 bp, Artificial Sequence
  Description of Artificial Sequence: Synthetic probe
ggcagaagtggacgtctacctgaggatgaagagggcggaactttactgccctcggcctgt

SEQ ID NO: 7978 - DNA, 60 bp, Artificial Sequence
  Description of Artificial Sequence: Synthetic probe
cacaggcagaagtggacgtctacctgaggatgaagagggcggaactttactgccctcggc

SEQ ID NO: 7979 - DNA, 60 bp, Artificial Sequence
  Description of Artificial Sequence: Synthetic probe
tgctagtgagacccacatcccaacaacatttaactacgggatgatctacacacaggcaga

SEQ ID NO: 7980 - DNA, 60 bp, Artificial Sequence
  Description of Artificial Sequence: Synthetic probe
gcgccccgcgaaaacatccgcggcgacctcgcaaccttggctgcgcggattgctagtgag

SEQ ID NO: 7981 - DNA, 60 bp, Artificial Sequence
  Description of Artificial Sequence: Synthetic probe
ccgaccggtacaaaattggcctggtagcacctggtaagcaactgtgcaatttcgacccgt

SEQ ID NO: 7982 - DNA, 60 bp, Artificial Sequence
  Description of Artificial Sequence: Synthetic probe
cacaccaccgaccggtacaaaattggcctggtagcacctggtaagcaactgtgcaatttc

SEQ ID NO: 7983 - DNA, 60 bp, Artificial Sequence
  Description of Artificial Sequence: Synthetic probe
cacgttacaccacgccgtggcgacatggcggtactggcacaacgtgttgagactgaaacc

SEQ ID NO: 7984 - DNA, 60 bp, Artificial Sequence
  Description of Artificial Sequence: Synthetic probe
gacccaacacgttacaccacgccgtggcgacatggcggtactggcacaacgtgttgagac

SEQ ID NO: 7985 - DNA, 60 bp, Artificial Sequence
  Description of Artificial Sequence: Synthetic probe
gccaccgtctacaacgggaactgtaaatactccaagacccaacacgttacaccacgccgt

SEQ ID NO: 7986 - DNA, 60 bp, Artificial Sequence
  Description of Artificial Sequence: Synthetic probe
ccacacggagttcttgccaccgtctacaacgggaactgtaaatactccaagacccaacac

SEQ ID NO: 7987 - DNA, 60 bp, Artificial Sequence
  Description of Artificial Sequence: Synthetic probe
aaacggtgttgcccgctttgccctgccctacacggcaccacacggagttcttgccaccgt

SEQ ID NO: 7988 - DNA, 60 bp, Artificial Sequence
  Description of Artificial Sequence: Synthetic probe
ttgttcatgcgaaaaacggtgttgcccgctttgccctgccctacacggcaccacacggag

SEQ ID NO: 7989 - DNA, 60 bp, Artificial Sequence
  Description of Artificial Sequence: Synthetic probe
gcaaaagatcattgcacctgcaaagcaactcctgaacttcgacctgctcaagttggcggg

SEQ ID NO: 7990 - DNA, 60 bp, Artificial Sequence
  Description of Artificial Sequence: Synthetic probe
tgcccacctccttcaactacggtgccatcaaggccacccgggtgaccgaactgctttacc

SEQ ID NO: 7991 - DNA, 60 bp, Artificial Sequence
  Description of Artificial Sequence: Synthetic probe
tgcccacctccttcaactacggtgccatcaaggccacccgggtgactgaactgctttacc

SEQ ID NO: 7992 - DNA, 60 bp, Artificial Sequence
  Description of Artificial Sequence: Synthetic probe
tgtcttctccgctaacggcaccacccgttttgcactgccctacaccgcaccacacagatg

SEQ ID NO: 7993 - DNA, 60 bp, Artificial Sequence
  Description of Artificial Sequence: Synthetic probe
gcgtttcacgctccagcctactccaactaaaggctcacattgatccggaacctcgcacgg

SEQ ID NO: 7994 - DNA, 60 bp, Artificial Sequence
  Description of Artificial Sequence: Synthetic probe
gatactgctcctgcgtttcacgctccagcctactccaactaaaggctcacattgatccgg

SEQ ID NO: 7995 - DNA, 60 bp, Artificial Sequence
  Description of Artificial Sequence: Synthetic probe
tcatcatcggcacacactctgccggtggaaacggcgtcggatactgctcctgcgtttcac

SEQ ID NO: 7996 - DNA, 60 bp, Artificial Sequence
  Description of Artificial Sequence: Synthetic probe
tgcccacactgtcatcatcggcacacactctgccggtggaaacggcgtcggatactgctc

SEQ ID NO: 7997 - DNA, 60 bp, Artificial Sequence
  Description of Artificial Sequence: Synthetic probe
gggttactgtggcggagctatcatgacgaaggatggtgcccacactgtcatcatcggcac

SEQ ID NO: 7998 - DNA, 60 bp, Artificial Sequence
  Description of Artificial Sequence: Synthetic probe
gccggtacaaaagtgggttactgtggcggagctatcatgacgaaggatggtgcccacact

SEQ ID NO: 7999 - DNA, 60 bp, Artificial Sequence
  Description of Artificial Sequence: Synthetic probe
ctgcatggacggtgacaccatgcctggtttattcgcataccgggccggtacaaaagtggg

SEQ ID NO: 8000 - DNA, 60 bp, Artificial Sequence
  Description of Artificial Sequence: Synthetic probe
tcgtcgtctgcatggacggtgacaccatgcctggtttattcgcataccgggccggtacaa

SEQ ID NO: 8001 - DNA, 60 bp, Artificial Sequence
  Description of Artificial Sequence: Synthetic probe
cgatgtcgggagacttatcttctcaggtgacgcactgacctacaaggacgtcgtcgtctg

SEQ ID NO: 8002 - DNA, 50 bp, Artificial Sequence
  Description of Artificial Sequence: Synthetic probe
ccgtaattggcgtgatcaacaacgccgatgtcgggagacttatcttctca

SEQ ID NO: 8003 - DNA, 60 bp, Artificial Sequence
  Description of Artificial Sequence: Synthetic probe
caggtacacataaggaaaggaacccccgtaattggcgtgatcaacaacgccgatgtcggg

SEQ ID NO: 8004 - DNA, 60 bp, Artificial Sequence
  Description of Artificial Sequence: Synthetic probe
ccgcggccagcgcgtgcgagacatcacgatgcacttccgagatcaggtacacataaggaa

SEQ ID NO: 8005 - DNA, 60 bp, Artificial Sequence
  Description of Artificial Sequence: Synthetic probe
ttctcaaccgcggccagcgcgtgcgagacatcacgatgcacttccgagatcaggtacaca

SEQ ID NO: 8006 - DNA, 60 bp, Artificial Sequence
  Description of Artificial Sequence: Synthetic probe
aagtaaaagggcaggacatgatgtcggacgcggcactcatggttctcaaccgcggccagc

SEQ ID NO: 8007 - DNA, 60 bp, Artificial Sequence
  Description of Artificial Sequence: Synthetic probe
cttggacggcagacagctagacaacagtgattttagagtgtttgagtttgaggttaaagt

SEQ ID NO: 8008 - DNA, 60 bp, Artificial Sequence
  Description of Artificial Sequence: Synthetic probe
gtcttggacggcagacagctagacaacagtgattttagagtgtttgagtttgaggttaaa

SEQ ID NO: 8009 - DNA, 60 bp, Artificial Sequence
  Description of Artificial Sequence: Synthetic probe
gctcatactcgacggcaagactgttgcgctctgttgcgcgacaggagtgtttggcactgc

SEQ ID NO: 8010 - DNA, 60 bp, Artificial Sequence
  Description of Artificial Sequence: Synthetic probe
accagtcgagctcatactcgacggcaagactgttgcgctctgttgcgcgacaggagtgtt

SEQ ID NO: 8011 - DNA, 60 bp, Artificial Sequence
  Description of Artificial Sequence: Synthetic probe
gcgctccgccgaccgacttgcaaaagatggtcatggcgaacgtcaaaccagtcgagctca

SEQ ID NO: 8012 - DNA, 60 bp, Artificial Sequence
  Description of Artificial Sequence: Synthetic probe
gcgcatgaagcgtgccgaactctactgccccagaccattgttggcggtggaggtgtcgtc

SEQ ID NO: 8013 - DNA, 60 bp, Artificial Sequence
  Description of Artificial Sequence: Synthetic probe
aggtgcttggcaacatcctacaacggtgactgtaagtacaaacccactggcacagcccgc

SEQ ID NO: 8014 - DNA, 60 bp, Artificial Sequence
  Description of Artificial Sequence: Synthetic probe
ggcagcccaatggagcaccacgcacaacccagttgggtgacaacccaatggtcttctcac

SEQ ID NO: 8015 - DNA, 60 bp, Artificial Sequence
  Description of Artificial Sequence: Synthetic probe
tgttctggcagcccaatggagcaccacgcacaacccagttgggtgacaacccaatggtct

SEQ ID NO: 8016 - DNA, 60 bp, Artificial Sequence
  Description of Artificial Sequence: Synthetic probe
gtactacttctgtgacctggaaatcgcgtgtgtgggtgaacacaaacgtgtgttctggca

SEQ ID NO: 8017 - DNA, 60 bp, Artificial Sequence
  Description of Artificial Sequence: Synthetic probe
agtcacagcggcccgccgcgttcacacagacgtggcttttctcctcgatcgcagcacaca

SEQ ID NO: 8018 - DNA, 60 bp, Artificial Sequence
  Description of Artificial Sequence: Synthetic probe
tcacggcgggacagtcacagcggcccgccgcgttcacacagacgtggcttttctcctcga

SEQ ID NO: 8019 - DNA, 60 bp, Artificial Sequence
  Description of Artificial Sequence: Synthetic probe
gtcctaggccgattcttccgattcagccaacgggcgatagacacaagcaaccgctcgtcg

SEQ ID NO: 8020 - DNA, 60 bp, Artificial Sequence
  Description of Artificial Sequence: Synthetic probe
gatcgctgcccacctccttcaactacggtgccatcaaggctactcgggtgacagaactgc

SEQ ID NO: 8021 - DNA, 60 bp, Artificial Sequence
  Description of Artificial Sequence: Synthetic probe
gcgagatcgctgcccacctccttcaactacggtgccatcaaggctactcgggtgacagaa

SEQ ID NO: 8022 - DNA, 60 bp, Artificial Sequence
  Description of Artificial Sequence: Synthetic probe
ggtgttctacccatggacacctgaccctgagaacgtgcttgcgtacgtgccttacgacca

SEQ ID NO: 8023 - DNA, 60 bp, Artificial Sequence
  Description of Artificial Sequence: Synthetic probe
agcactcgtgttgtggctcatcaaggactgccttcaaaccggcgttggcaccagcactcg

SEQ ID NO: 8024 - DNA, 60 bp, Artificial Sequence
  Description of Artificial Sequence: Synthetic probe
gcggtgcgccaccgaccgacttgcaaaagatggtcatggctaacgtcaagcctgttgagc

SEQ ID NO: 8025 - DNA, 60 bp, Artificial Sequence
  Description of Artificial Sequence: Synthetic probe
gcggtgcgccaccgaccgacttgcaaaagatggtcatggccaatgttaagcccgtcgagt

SEQ ID NO: 8026 - DNA, 60 bp, Artificial Sequence
  Description of Artificial Sequence: Synthetic probe
agcggtgcgccaccgaccgacttgcaaaagatggtcatggccaatgttaagcccgtcgag

SEQ ID NO: 8027 - DNA, 60 bp, Artificial Sequence
  Description of Artificial Sequence: Synthetic probe
gacacacgcttccgtccacattcaactttgggcacgttaccgctgacacaagcgttgacg

SEQ ID NO: 8028 - DNA, 60 bp, Artificial Sequence
  Description of Artificial Sequence: Synthetic probe
ccgcgccgcgttggcgtccaaatacgccagcgcgcgacacacgcttccgtccacattcaa

SEQ ID NO: 8029 - DNA, 60 bp, Artificial Sequence
  Description of Artificial Sequence: Synthetic probe
atggttttctcgcacaaccgtgtcactcggttcgccgtgccattcaccgcaccacatcgc

SEQ ID NO: 8030 - DNA, 60 bp, Artificial Sequence
  Description of Artificial Sequence: Synthetic probe
ccccatggttttctcgcacaaccgtgtcactcggttcgccgtgccattcaccgcaccaca

SEQ ID NO: 8031 - DNA, 60 bp, Artificial Sequence
  Description of Artificial Sequence: Synthetic probe
tcccttccacgttcaactttgggcacgttactgcggaacaaccagttgacgtgtactaca

SEQ ID NO: 8032 - DNA, 60 bp, Artificial Sequence
  Description of Artificial Sequence: Synthetic probe
ggccaagtacgcaagcacacgccacacgctcccttccacgttcaactttgggcacgttac

SEQ ID NO: 8033 - DNA, 60 bp, Artificial Sequence
  Description of Artificial Sequence: Synthetic probe
gtgttggcggccaagtacgcaagcacacgccacacgctcccttccacgttcaactttggg

SEQ ID NO: 8034 - DNA, 60 bp, Artificial Sequence
  Description of Artificial Sequence: Synthetic probe
tgtgttagcggccaagtacgcagacacgcgccacacgctcccttccacgttcaactttgg

SEQ ID NO: 8035 - DNA, 60 bp, Artificial Sequence
  Description of Artificial Sequence: Synthetic probe
tgttactcggtttgccgtgccatacactgcgccacaccgcttgttgtcaactgtttacaa

SEQ ID NO: 8036 - DNA, 60 bp, Artificial Sequence
  Description of Artificial Sequence: Synthetic probe
gaacagtgttacccggtttgccgtgccatacactgcgccacaccgcttgttgtcaactgt

SEQ ID NO: 8037 - DNA, 60 bp, Artificial Sequence
  Description of Artificial Sequence: Synthetic probe
agaacagtgttacccggtttgccgtgccatacactgcgccacaccgcttgttgtcaactg

SEQ ID NO: 8038 - DNA, 60 bp, Artificial Sequence
  Description of Artificial Sequence: Synthetic probe
cccagaaccacccaacttggggacaaccctatggttttctctaagaacggtgttactcgg

SEQ ID NO: 8039 - DNA, 60 bp, Artificial Sequence
  Description of Artificial Sequence: Synthetic probe
cggcgcacccagagccactcaacttggggacaaccctatggttttctctaagaacagtgt

SEQ ID NO: 8040 - DNA, 60 bp, Artificial Sequence
  Description of Artificial Sequence: Synthetic probe
agggcgtccacctactacttctgtgacctggaaattgcatgtgtgggcacgcaccagcgc

SEQ ID NO: 8041 - DNA, 60 bp, Artificial Sequence
  Description of Artificial Sequence: Synthetic probe
aagggcgtccacctactacttctgtgacctggaaattgcatgtgtgggcacgcaccggca

SEQ ID NO: 8042 - DNA, 60 bp, Artificial Sequence
  Description of Artificial Sequence: Synthetic probe
gcccgcgacctctcctgacacactacgaccacaatggactagatcgctacaaaaccgcga

SEQ ID NO: 8043 - DNA, 60 bp, Artificial Sequence
  Description of Artificial Sequence: Synthetic probe
gaactctactgcccgcgacctctcctgacacactacgaccacaatggactagatcgctac

SEQ ID NO: 8044 - DNA, 60 bp, Artificial Sequence
  Description of Artificial Sequence: Synthetic probe
aaaacatccgcggggatctcgcgaccctagcggccaggatttccgacgagacacacattc

SEQ ID NO: 8045 - DNA, 60 bp, Artificial Sequence
  Description of Artificial Sequence: Synthetic probe
cgcgaaaacatccgcggggatctcgcgaccctagcggccaggatttccgacgagacacac

SEQ ID NO: 8046 - DNA, 60 bp, Artificial Sequence
  Description of Artificial Sequence: Synthetic probe
acttacaacggtgactgcaagtacaagcccgttggcacagccccgcgcgaaaacatccgc

SEQ ID NO: 8047 - DNA, 60 bp, Artificial Sequence
  Description of Artificial Sequence: Synthetic probe
caacaacttacaacggtgactgcaagtacaagcccgttggcacagccccgcgcgaaaaca

SEQ ID NO: 8048 - DNA, 60 bp, Artificial Sequence
  Description of Artificial Sequence: Synthetic probe
tttcgcactgccctacaccgcgccgcacaggtgtctcgcaacaacttacaacggtgactg

SEQ ID NO: 8049 - DNA, 60 bp, Artificial Sequence
  Description of Artificial Sequence: Synthetic probe
cggcaccacccgtttcgcactgccctacaccgcgccgcacaggtgtctcgcaacaactta

SEQ ID NO: 8050 - DNA, 60 bp, Artificial Sequence
  Description of Artificial Sequence: Synthetic probe
gctcatcaaggactgtcttcaaaccggcgttggcactagcactcgccccagcgagatctg

SEQ ID NO: 8051 - DNA, 60 bp, Artificial Sequence
  Description of Artificial Sequence: Synthetic probe
cgtgctttggctcatcaaggactgtcttcaaaccggcgttggtaccagcactcgccccag

SEQ ID NO: 8052 - DNA, 60 bp, Artificial Sequence
  Description of Artificial Sequence: Synthetic probe
cactcgtgttgtggctcatcaaggactgtcttcaaaccggcgttggcactagcactcgcc

SEQ ID NO: 8053 - DNA, 60 bp, Artificial Sequence
  Description of Artificial Sequence: Synthetic probe
tgggccaccggcactcgtgctttggctcatcaaggactgtcttcaaaccggcgttggtac

SEQ ID NO: 8054 - DNA, 50 bp, Artificial Sequence
  Description of Artificial Sequence: Synthetic probe
gagcgttgacgtctactacagaatgaagcgtgctgaattgtactgcccca

SEQ ID NO: 8055 - DNA, 60 bp, Artificial Sequence
  Description of Artificial Sequence: Synthetic probe
gctgacaaaagcgacaaaggttttgttcttggtcactccattactgacgtcactttcctc

SEQ ID NO: 8056 - DNA, 60 bp, Artificial Sequence
  Description of Artificial Sequence: Synthetic probe
cactccagctgacaaaagcgacaaaggttttgttcttggtcactccattaccgatgtcac

SEQ ID NO: 8057 - DNA, 60 bp, Artificial Sequence
  Description of Artificial Sequence: Synthetic probe
aaccattactccagctgacaaaagcgacaaaggttttgttcttggtcactccattactga

SEQ ID NO: 8058 - DNA, 60 bp, Artificial Sequence
  Description of Artificial Sequence: Synthetic probe
ctcggtcaaaccatcactccagctgacaaaagcgacaaaggttttgttcttggtcactcc

SEQ ID NO: 8059 - DNA, 60 bp, Artificial Sequence
  Description of Artificial Sequence: Synthetic probe
acgggacgacccgcttcgccctgcccttcacagccccacaccgtgttctggcaacagttt

SEQ ID NO: 8060 - DNA, 60 bp, Artificial Sequence
  Description of Artificial Sequence: Synthetic probe
agacggacacgccgcgttcacacggacgtggcgttccttctggacaggttcacactggtg

SEQ ID NO: 8061 - DNA, 53 bp, Artificial Sequence
  Description of Artificial Sequence: Synthetic probe
ctactcaggaccgccgtaaacaggagatcattgcacctgaaaagcagatgatg

SEQ ID NO: 8062 - DNA, 53 bp, Artificial Sequence
  Description of Artificial Sequence: Synthetic probe
ccactcaggaccgccgtaaacaggagatcattgcacctgaaaagcagatgata

SEQ ID NO: 8063 - DNA, 60 bp, Artificial Sequence
  Description of Artificial Sequence: Synthetic probe
gaatctttctgaaaggtacagagcacgctgtgttcgcctgcttgacctccaacggttggt

SEQ ID NO: 8064 - DNA, 60 bp, Artificial Sequence
  Description of Artificial Sequence: Synthetic probe
ctggtctagaacttcacgagggtggaccccccgctctcgtgatctggaacatcaaacacc

SEQ ID NO: 8065 - DNA, 60 bp, Artificial Sequence
  Description of Artificial Sequence: Synthetic probe
ctgcagctgtttcggtatgtcgacgagccgttcttcgactgggtctacaactcacccgag

SEQ ID NO: 8066 - DNA, 56 bp, Artificial Sequence
  Description of Artificial Sequence: Synthetic probe
actctacaacggtgagaagaagactttctactccagacccaaccgccacgacaact

SEQ ID NO: 8067 - DNA, 60 bp, Artificial Sequence
  Description of Artificial Sequence: Synthetic probe
atgaacacgcctgactgttttatcgctttggtacaggctatcagagagatcaaacaactg

SEQ ID NO: 8068 - DNA, 60 bp, Artificial Sequence
  Description of Artificial Sequence: Synthetic probe
cagcaattgaattctttgaggggatggttcacgactccattaaggaggagctccgacccc

SEQ ID NO: 8069 - DNA, 60 bp, Artificial Sequence
  Description of Artificial Sequence: Synthetic probe
ccagcacgaggctgcaattgaattctttgaggggatggttcacgactccatcaaagagga

SEQ ID NO: 8070 - DNA, 60 bp, Artificial Sequence
  Description of Artificial Sequence: Synthetic probe
gccaacacgaggcagcaattgaattctttgaggggatggttcacgactctatcaaggagg

SEQ ID NO: 8071 - DNA, 60 bp, Artificial Sequence
  Description of Artificial Sequence: Synthetic probe
gccaacacgaggcagcaattgaattctttgaggggatggttcacgactctattaaggagg

SEQ ID NO: 8072 - DNA, 60 bp, Artificial Sequence
  Description of Artificial Sequence: Synthetic probe
tgccgacgtcgttcaacttcggtgcagtcaaagcggacacagtcactgagttactggtgc

SEQ ID NO: 8073 - DNA, 60 bp, Artificial Sequence
  Description of Artificial Sequence: Synthetic probe
tgccgacatcgttcaacttcggtgcagtcaaagcggacacagtcactgagttactggtgc

SEQ ID NO: 8074 - DNA, 60 bp, Artificial Sequence
  Description of Artificial Sequence: Synthetic probe
ccgcttgccgacatcgttcaacttcggtgcagtcaaagcggacacagtcactgagttact

SEQ ID NO: 8075 - DNA, 60 bp, Artificial Sequence
  Description of Artificial Sequence: Synthetic probe
ccgcttgccgacgtcgttcaacttcggtgcagtcaaagcggacacagtcactgagttact

SEQ ID NO: 8076 - DNA, 60 bp, Artificial Sequence
  Description of Artificial Sequence: Synthetic probe
caggtgcacaaggacagcatcgtgggagcgcttcttcgcgcggccacgtactacttctct

SEQ ID NO: 8077 - DNA, 60 bp, Artificial Sequence
  Description of Artificial Sequence: Synthetic probe
atgcaggtgcacaaggacagcatcgtgggagcgcttcttcgcgcggccacgtactacttc

SEQ ID NO: 8078 - DNA, 60 bp, Artificial Sequence
  Description of Artificial Sequence: Synthetic probe
gatcaccagggcaaggaccgctacaaagtggccctaaccaaacctgccaaacaactgtgc

SEQ ID NO: 8079 - DNA, 60 bp, Artificial Sequence
  Description of Artificial Sequence: Synthetic probe
tcaactacggcaggatttacacggaggcggaagtcaacgtgtacgtgagaatgaagcggg

SEQ ID NO: 8080 - DNA, 60 bp, Artificial Sequence
  Description of Artificial Sequence: Synthetic probe
acatcccaacaaccttcaactacggcaggatttacacggaggcggaagtcaacgtgtacg

SEQ ID NO: 8081 - DNA, 60 bp, Artificial Sequence
  Description of Artificial Sequence: Synthetic probe
tgactgcaagtacaaaccaaacagcgaggcgccgcggaccaacatccgtggggaccttgc

SEQ ID NO: 8082 - DNA, 60 bp, Artificial Sequence
  Description of Artificial Sequence: Synthetic probe
gtgactgcaagtacaaaccaaacagcgaggcgccgcggaccaacatccgtggggaccttg

SEQ ID NO: 8083 - DNA, 51 bp, Artificial Sequence
  Description of Artificial Sequence: Synthetic probe
caatggaacaacccgttttgctttgccttacaccgccccacacaggtgtct

SEQ ID NO: 8084 - DNA, 60 bp, Artificial Sequence
  Description of Artificial Sequence: Synthetic probe
taatctgacctgggtgcccaatggtgcccctgaatcggccctgtcctactccagcaaccc

SEQ ID NO: 8085 - DNA, 60 bp, Artificial Sequence
  Description of Artificial Sequence: Synthetic probe
gtaacctgacttgggtgcccaatggtgcccctgaatcggccctgtctaacaccagcaacc

SEQ ID NO: 8086 - DNA, 60 bp, Artificial Sequence
  Description of Artificial Sequence: Synthetic probe
cacgacggtaatctgacctgggtgcccaatggtgcccctgaatcggccctgtcctactcc

SEQ ID NO: 8087 - DNA, 53 bp, Artificial Sequence
  Description of Artificial Sequence: Synthetic probe
ccactcaggaccgccgtaaacaggagatcattgcacctgagaagcagatgatg

SEQ ID NO: 8088 - DNA, 51 bp, Artificial Sequence
  Description of Artificial Sequence: Synthetic probe
ggggaatctgcagaccctgtcaccaccactgttgagaactacggcggtgac

SEQ ID NO: 8089 - DNA, 59 bp, Artificial Sequence
  Description of Artificial Sequence: Synthetic probe
ggggagtctgcagaccctgtcaccaccactgttgagaactacggtggggagacacaggt

SEQ ID NO: 8090 - DNA, 60 bp, Artificial Sequence
  Description of Artificial Sequence: Synthetic probe
accaccgcgacgggggagtctgcagaccctgtcaccaccactgttgagaactacggtggg

SEQ ID NO: 8091 - DNA, 60 bp, Artificial Sequence
  Description of Artificial Sequence: Synthetic probe
ctcgtgcgcatgaaacgtgctgagctttactgccccaggccactgctggcagtagaggtg

SEQ ID NO: 8092 - DNA, 60 bp, Artificial Sequence
  Description of Artificial Sequence: Synthetic probe
ttgtcaaccgtctacaatggtgaatgtgaatacaacacgcgcgtcaccgccatccgtggt

SEQ ID NO: 8093 - DNA, 60 bp, Artificial Sequence
  Description of Artificial Sequence: Synthetic probe
gtttgttgtcaaccgtctacaatggtgaatgtgaatacaacacgcgcgtcgcctccgtcc

SEQ ID NO: 8094 - DNA, 60 bp, Artificial Sequence
  Description of Artificial Sequence: Synthetic probe
caccgtttgttgtcaaccgtctacaatggtgaatgtgaatacaacacgcgcgtcaccgcc

SEQ ID NO: 8095 - DNA, 60 bp, Artificial Sequence
  Description of Artificial Sequence: Synthetic probe
caccgtttgttgtcaaccgtctacaatggtgaatgtgaatacaacacgcgtgtcaccgcc

SEQ ID NO: 8096 - DNA, 60 bp, Artificial Sequence
  Description of Artificial Sequence: Synthetic probe
acaccgcaccacaccgtttgttgtcaaccgtctacaatggtgaatgtgaatacaacacgc

SEQ ID NO: 8097 - DNA, 60 bp, Artificial Sequence
  Description of Artificial Sequence: Synthetic probe
caagactcttgacgaggcggaaaagaaccctctggagaccagcggtgccagcactgttgg

SEQ ID NO: 8098 - DNA, 60 bp, Artificial Sequence
  Description of Artificial Sequence: Synthetic probe
caagactcttgacgaggcggaaaagaaccctctggaaactagtggtgccagcaccgttgg

SEQ ID NO: 8099 - DNA, 60 bp, Artificial Sequence
  Description of Artificial Sequence: Synthetic probe
tcgagccacgaccatccacgagcttctcgtgcggatgaagcgtgccgagctctactgccc

SEQ ID NO: 8100 - DNA, 50 bp, Artificial Sequence
  Description of Artificial Sequence: Synthetic probe
tggcctcaaagacccttgaggctatcctctcctttgcacgccgtgggacc

SEQ ID NO: 8101 - DNA, 60 bp, Artificial Sequence
  Description of Artificial Sequence: Synthetic probe
cctgtgatgacctcgaagaccctcgaggctatcctctcctttgcacgccgtgggaccata

SEQ ID NO: 8102 - DNA, 60 bp, Artificial Sequence
  Description of Artificial Sequence: Synthetic probe
gcaggcaaccccaccgcctacaacaaagcaccattcacgagactagcactcccctacact

SEQ ID NO: 8103 - DNA, 60 bp, Artificial Sequence
  Description of Artificial Sequence: Synthetic probe
caacaactactacatgcagcagtaccagaactcaatggacacccagcttggtgacaacgc

SEQ ID NO: 8104 - DNA, 60 bp, Artificial Sequence
  Description of Artificial Sequence: Synthetic probe
gctatcccgttcacggccccacacaggctgctgtccactgtctacaacggcgagtgcacc

SEQ ID NO: 8105 - DNA, 60 bp, Artificial Sequence
  Description of Artificial Sequence: Synthetic probe
tcgcgacgtactacttctcagacctggaggttgcgcttgttcacacaggcccagccacct

SEQ ID NO: 8106 - DNA, 60 bp, Artificial Sequence
  Description of Artificial Sequence: Synthetic probe
accagactggtcgcacctgggaagcagttgtgcaacttcgacctgttaaagttggccgga

SEQ ID NO: 8107 - DNA, 60 bp, Artificial Sequence
  Description of Artificial Sequence: Synthetic probe
accggtacaaaaccagactggtcgcacctgggaagcagttgtgcaacttcgacctgttaa

SEQ ID NO: 8108 - DNA, 55 bp, Artificial Sequence
  Description of Artificial Sequence: Synthetic probe
tttactaccggatgaagagagctgaactgtactgcccacggcctctcatggtcag

SEQ ID NO: 8109 - DNA, 52 bp, Artificial Sequence
  Description of Artificial Sequence: Synthetic probe
agaatgaaaccacaagatgcacacccacaaccttcaacttcgggagattgtt

SEQ ID NO: 8110 - DNA, 60 bp, Artificial Sequence
  Description of Artificial Sequence: Synthetic probe
acgcgtcacaccacgccgtggtgacttggccgcactggcacaacgcgttgagaatgaaac

SEQ ID NO: 8111 - DNA, 60 bp, Artificial Sequence
  Description of Artificial Sequence: Synthetic probe
accgtgtacaacggcaactgtaagtattctagaacccaacgcgtcacaccacgccgtggt

SEQ ID NO: 8112 - DNA, 60 bp, Artificial Sequence
  Description of Artificial Sequence: Synthetic probe
agggtccttgctaccgtgtacaacggcaactgtaagtattctagaacccaacgcgtcaca

SEQ ID NO: 8113 - DNA, 60 bp, Artificial Sequence
  Description of Artificial Sequence: Synthetic probe
tgtcgcccgtttcgccctgccgtacacagcaccacacagggtccttgctaccgtgtacaa

SEQ ID NO: 8114 - DNA, 60 bp, Artificial Sequence
  Description of Artificial Sequence: Synthetic probe
acgcgaagaacggtgtcgcccgtttcgccctgccgtacacagcaccacacagggtccttg

SEQ ID NO: 8115 - DNA, 60 bp, Artificial Sequence
  Description of Artificial Sequence: Synthetic probe
ttgctttcgttcttgacaggtttgtgaaactcactgcacccaagaacactcagattcttg

SEQ ID NO: 8116 - DNA, 60 bp, Artificial Sequence
  Description of Artificial Sequence: Synthetic probe
gaaccgcttagcggggaatggaaaacaaaagttcaaaagaagctcaagggagccggacga

SEQ ID NO: 8117 - DNA, 60 bp, Artificial Sequence
  Description of Artificial Sequence: Synthetic probe
gtcccgtacgatcaagaaccgcttagcggggaatggaaaacaaaagttcaaaagaagctc

SEQ ID NO: 8118 - DNA, 60 bp, Artificial Sequence
  Description of Artificial Sequence: Synthetic probe
ccctggactcccgacccctctgatgtcctggtgtttgtcccgtacgatcaagaaccgctt

SEQ ID NO: 8119 - DNA, 60 bp, Artificial Sequence
  Description of Artificial Sequence: Synthetic probe
acgaggaattttacccctggactcccgacccctctgatgtcctggtgtttgtcccgtacg

SEQ ID NO: 8120 - DNA, 60 bp, Artificial Sequence
  Description of Artificial Sequence: Synthetic probe
ttgcctgacctccaatgggtggtacgccatcgacgacgaggaattttacccctggactcc

SEQ ID NO: 8121 - DNA, 60 bp, Artificial Sequence
  Description of Artificial Sequence: Synthetic probe
acacgctgtgtttgcttgcctgacctccaatgggtggtacgccatcgacgacgaggaatt

SEQ ID NO: 8122 - DNA, 60 bp, Artificial Sequence
  Description of Artificial Sequence: Synthetic probe
gacttccacgcgggaatctttctgaaaggcgttgaacacgctgtgtttgcttgcctgacc

SEQ ID NO: 8123 - DNA, 60 bp, Artificial Sequence
  Description of Artificial Sequence: Synthetic probe
gacatgtgtcttgctgacttccacgcgggaatctttctgaaaggcgttgaacacgctgtg

SEQ ID NO: 8124 - DNA, 60 bp, Artificial Sequence
  Description of Artificial Sequence: Synthetic probe
cgcggcctagcgaggtgtgcatggtggatggtactgacatgtgtcttgctgacttccacg

SEQ ID NO: 8125 - DNA, 60 bp, Artificial Sequence
  Description of Artificial Sequence: Synthetic probe
gcgttggctccgcctcgcggcctagcgaggtgtgcatggtggatggtactgacatgtgtc

SEQ ID NO: 8126 - DNA, 60 bp, Artificial Sequence
  Description of Artificial Sequence: Synthetic probe
tcgtgatttggaacatcaagcacttgctccacactggcgttggctccgcctcgcggccta

SEQ ID NO: 8127 - DNA, 60 bp, Artificial Sequence
  Description of Artificial Sequence: Synthetic probe
tgggcccccggccctcgtgatttggaacatcaagcacttgctccacactggcgttggctc

SEQ ID NO: 8128 - DNA, 60 bp, Artificial Sequence
  Description of Artificial Sequence: Synthetic probe
cgactgggtttacgactcgcccgagaacctcacgctccaagcaattgaacagttggagga

SEQ ID NO: 8129 - DNA, 59 bp, Artificial Sequence
  Description of Artificial Sequence: Synthetic probe
cagacttttgttaaaaggctcaaagaagatggaattcacactccacaacggtgagaaga

SEQ ID NO: 8130 - DNA, 60 bp, Artificial Sequence
  Description of Artificial Sequence: Synthetic probe
gactgttttatcgctttggtacaggctatcagagagatcagacttttgttaaaaggctca

SEQ ID NO: 8131 - DNA, 60 bp, Artificial Sequence
  Description of Artificial Sequence: Synthetic probe
atgaacacaactgactgttttatcgctttggtacaggctatcagagagatcagacttttg

SEQ ID NO: 8132 - DNA, 60 bp, Artificial Sequence
  Description of Artificial Sequence: Synthetic probe
cggaggagagactcaagtccaacgtcgccaccacaccgacgttgccttcattcttgaccg

SEQ ID NO: 8133 - DNA, 60 bp, Artificial Sequence
  Description of Artificial Sequence: Synthetic probe
tacggaggagagactcaagtccaacgtcgccaccacaccgacgttgccttcgtccttgac

SEQ ID NO: 8134 - DNA, 60 bp, Artificial Sequence
  Description of Artificial Sequence: Synthetic probe
gtatggacggtgacaccatgcctggactcttcgcgtaccgcgcagggaccaaagttggat

SEQ ID NO: 8135 - DNA, 60 bp, Artificial Sequence
  Description of Artificial Sequence: Synthetic probe
aagacctggtcgtttgtatggacggtgacaccatgcctggactcttcgcgtaccgcgcag

SEQ ID NO: 8136 - DNA, 54 bp, Artificial Sequence
  Description of Artificial Sequence: Synthetic probe
caaagacctggtcgtttgtatggacggtgacaccatgcctggactcttcgcgta

SEQ ID NO: 8137 - DNA, 58 bp, Artificial Sequence
  Description of Artificial Sequence: Synthetic probe
taaagtaaaaggacaggacatgctctcagacgccgctctcatggtgctgcaccgtggg

SEQ ID NO: 8138 - DNA, 60 bp, Artificial Sequence
  Description of Artificial Sequence: Synthetic probe
tttgagatcaaagtaaaaggacaggacatgctctcagacgccgctctcatggtgctgcac

SEQ ID NO: 8139 - DNA, 60 bp, Artificial Sequence
  Description of Artificial Sequence: Synthetic probe
gcctctttcaactacggtgcaatcagggccgacaccatccacgagcttctcgtgcgcatg

SEQ ID NO: 8140 - DNA, 60 bp, Artificial Sequence
  Description of Artificial Sequence: Synthetic probe
cctgcctcttttaactacggtgcaatcagggccgacaccatccacgagcttctcgtgcgt

SEQ ID NO: 8141 - DNA, 60 bp, Artificial Sequence
  Description of Artificial Sequence: Synthetic probe
cctgcctcttttaactacggtgcaatcagggccgacaccatccacgagcttctcgtgcgc

SEQ ID NO: 8142 - DNA, 60 bp, Artificial Sequence
  Description of Artificial Sequence: Synthetic probe
gcgaaacaacttcctgcctctttcaactacggtgcaatcagggccgacaccatccacgag

SEQ ID NO: 8143 - DNA, 58 bp, Artificial Sequence
  Description of Artificial Sequence: Synthetic probe
catgaaacgggccgagctctactgccccagaccactgttggcaatagaggtgtcttcg

SEQ ID NO: 8144 - DNA, 60 bp, Artificial Sequence
  Description of Artificial Sequence: Synthetic probe
cgcggagatctcgcgaccctcgcgaccaaaattgccaacgagacacacatcccaaccact

SEQ ID NO: 8145 - DNA, 60 bp, Artificial Sequence
  Description of Artificial Sequence: Synthetic probe
acatccgcggagatctcgcgaccctcgcgaccaaaattgccaacgagacacacatcccaa

SEQ ID NO: 8146 - DNA, 60 bp, Artificial Sequence
  Description of Artificial Sequence: Synthetic probe
ttgtaagtacaagcccgttggcacagccccgcgtgaaaacatccgcggagatctcgcgac

SEQ ID NO: 8147 - DNA, 60 bp, Artificial Sequence
  Description of Artificial Sequence: Synthetic probe
ctacaacggtgattgtaagtacaagcccgttggcacagccccgcgtgaaaacatccgcgg

SEQ ID NO: 8148 - DNA, 60 bp, Artificial Sequence
  Description of Artificial Sequence: Synthetic probe
agcgaggtgggcgacaatccagtcgtcttctccgctaacggcgccacccgttttgcactg

SEQ ID NO: 8149 - DNA, 60 bp, Artificial Sequence
  Description of Artificial Sequence: Synthetic probe
ggctcctgagctcagcgaggtgggcgacaatccagtcgtcttctccgctaacggcgccac

SEQ ID NO: 8150 - DNA, 60 bp, Artificial Sequence
  Description of Artificial Sequence: Synthetic probe
ccagaacatacacgagcttctcgtgcgcatgaagcgggccgaactctactgccctagacc

SEQ ID NO: 8151 - DNA, 60 bp, Artificial Sequence
  Description of Artificial Sequence: Synthetic probe
ccatgcctggactcttcgcgtaccgcgctgggactaaggtaggatactgcggggcagccg

SEQ ID NO: 8152 - DNA, 60 bp, Artificial Sequence
  Description of Artificial Sequence: Synthetic probe
gcgtggtgaccttgctgttcttgcacagcgggtaagcaacaggctgcccacctccttcaa

SEQ ID NO: 8153 - DNA, 60 bp, Artificial Sequence
  Description of Artificial Sequence: Synthetic probe
caagtgttggcccagaaggcagctagagcgctgcctacctccttcaactacggtgccatt

SEQ ID NO: 8154 - DNA, 60 bp, Artificial Sequence
  Description of Artificial Sequence: Synthetic probe
gcaagtgttggcccagaaggcggcaagagcgctgcctacctccttcaactacggtgccat

SEQ ID NO: 8155 - DNA, 60 bp, Artificial Sequence
  Description of Artificial Sequence: Synthetic probe
acaagtgttggcccagaaggcagctagagcgctgcctacctccttcaactacggtgccat

SEQ ID NO: 8156 - DNA, 60 bp, Artificial Sequence
  Description of Artificial Sequence: Synthetic probe
ctacggcggtgagacacaagtccagcggcgtcaccacactgacgtcagcttcataatgga

SEQ ID NO: 8157 - DNA, 60 bp, Artificial Sequence
  Description of Artificial Sequence: Synthetic probe
cgtgcggccacgtactacttctccgacctggagattgtggtacaccacgaaggcaacctg

SEQ ID NO: 8158 - DNA, 60 bp, Artificial Sequence
  Description of Artificial Sequence: Synthetic probe
tctccacaccggaaaccgcgtgcgcgatctcacgggacacttccgtgacaccatgaaact

SEQ ID NO: 8159 - DNA, 60 bp, Artificial Sequence
  Description of Artificial Sequence: Synthetic probe
ttctccactccggaaaccgcgtgcgcgatctcacgggacacttccgtgacaccatgaaac

SEQ ID NO: 8160 - DNA, 54 bp, Artificial Sequence
  Description of Artificial Sequence: Synthetic probe
ctcaaaggagccgggcaatccagcccggcgactgggtcacagaaccagtcaggc

SEQ ID NO: 8161 - DNA, 59 bp, Artificial Sequence
  Description of Artificial Sequence: Synthetic probe
aaggcggcaagagcgctgcctacctccttcaactacggtgccatcaaggctactggggt

SEQ ID NO: 8162 - DNA, 60 bp, Artificial Sequence
  Description of Artificial Sequence: Synthetic probe
ccacccgttttgcactgccctacaccgctccacacaggtgcttggcgacagcctacaacg

SEQ ID NO: 8163 - DNA, 60 bp, Artificial Sequence
  Description of Artificial Sequence: Synthetic probe
ctacaccgcaccacacaggtgcttggcaacaacctacaacggtgactgtaagtacaagcc

SEQ ID NO: 8164 - DNA, 60 bp, Artificial Sequence
  Description of Artificial Sequence: Synthetic probe
ctcaccatgtatgaccatgcaggccaggacaggcgcaagattagacttgtggcgcctgca

SEQ ID NO: 8165 - DNA, 60 bp, Artificial Sequence
  Description of Artificial Sequence: Synthetic probe
gcccccgtttcgttctcaccatgtatgaccatgcaggccaggacaggcgcaagattagac

SEQ ID NO: 8166 - DNA, 60 bp, Artificial Sequence
  Description of Artificial Sequence: Synthetic probe
agaaggtgaagttgacgtctacgtgcgcatgaaacgagcggagctttactgcccccgttt

SEQ ID NO: 8167 - DNA, 55 bp, Artificial Sequence
  Description of Artificial Sequence: Synthetic probe
agaaggtgaagttgacgtctacgtgcgcatgaaacgagcggagctttactgcccc

SEQ ID NO: 8168 - DNA, 60 bp, Artificial Sequence
  Description of Artificial Sequence: Synthetic probe
ggcaggatatacactgaagccgaggtcgatgtctacgtgaggatgaaacgcgcggagctc

SEQ ID NO: 8169 - DNA, 60 bp, Artificial Sequence
  Description of Artificial Sequence: Synthetic probe
gcacacatcccgacgactttcaactacgggattatcctgacagaaggtgaagttgacgtc

SEQ ID NO: 8170 - DNA, 60 bp, Artificial Sequence
  Description of Artificial Sequence: Synthetic probe
gctgaacaggcacacatcccgacgactttcaactacgggattatcctgacagaaggtgaa

SEQ ID NO: 8171 - DNA, 60 bp, Artificial Sequence
  Description of Artificial Sequence: Synthetic probe
tcaggggcgatcttgcgacgctagccgctcgcattgctgaacaggcacacatcccgacga

SEQ ID NO: 8172 - DNA, 60 bp, Artificial Sequence
  Description of Artificial Sequence: Synthetic probe
cacctcgccccaccatcaggggcgatcttgcgacgctagccgctcgcattgctgaacagg

SEQ ID NO: 8173 - DNA, 60 bp, Artificial Sequence
  Description of Artificial Sequence: Synthetic probe
ggagtgacccgcttcgcgcttccctacactgcgccacaccgtgttctggcgaccgtgtac

SEQ ID NO: 8174 - DNA, 58 bp, Artificial Sequence
  Description of Artificial Sequence: Synthetic probe
ggagtgacccgcttcgcgcttccctacactgcgccacaccgtgttctggcgaccgtgt

SEQ ID NO: 8175 - DNA, 60 bp, Artificial Sequence
  Description of Artificial Sequence: Synthetic probe
ccaacaagtgggtcggttggctgccaaatggcgcgccagttccgagcgaagttggcgaca

SEQ ID NO: 8176 - DNA, 60 bp, Artificial Sequence
  Description of Artificial Sequence: Synthetic probe
ctactttgctgatttggaggtggcatgtgttgggaccaacaagtgggtcggttggctgcc

SEQ ID NO: 8177 - DNA, 60 bp, Artificial Sequence
  Description of Artificial Sequence: Synthetic probe
gcgttctgccacgtactactttgctgatttggaggtggcatgtgttgggaccaacaagtg

SEQ ID NO: 8178 - DNA, 53 bp, Artificial Sequence
  Description of Artificial Sequence: Synthetic probe
aaaagaaggcactggtgggcgcaatcctgcgttctgccacgtactactttgct

SEQ ID NO: 8179 - DNA, 60 bp, Artificial Sequence
  Description of Artificial Sequence: Synthetic probe
accacttttaattatggcaggatatacactgaagccgaggtcgatgtctacgtgaggatg

SEQ ID NO: 8180 - DNA, 60 bp, Artificial Sequence
  Description of Artificial Sequence: Synthetic probe
gtgcttgacatgctccagaccaaaaagaaggcactggtgggcgcaatcctgcgttctgcc

SEQ ID NO: 8181 - DNA, 60 bp, Artificial Sequence
  Description of Artificial Sequence: Synthetic probe
cccagagagctacgcgtcgtgttcacactgacgtcgcgttcctgctagacaggttcactc

SEQ ID NO: 8182 - DNA, 60 bp, Artificial Sequence
  Description of Artificial Sequence: Synthetic probe
ccacggtggcacccagagagctacgcgtcgtgttcacactgacgtcgcgttcctgctaga

SEQ ID NO: 8183 - DNA, 60 bp, Artificial Sequence
  Description of Artificial Sequence: Synthetic probe
tgagggtgccgacgttgtcactgttgacgctaccgcccacggtggcacccagagagctac

SEQ ID NO: 8184 - DNA, 60 bp, Artificial Sequence
  Description of Artificial Sequence: Synthetic probe
acaaccagtgcgggtgagggtgccgacgttgtcactgttgacgctaccgcccacggtggc

SEQ ID NO: 8185 - DNA, 60 bp, Artificial Sequence
  Description of Artificial Sequence: Synthetic probe
taagtacaagcccactggcacggccccgcgcgaaaacattcgtggggaccttgcaactct

SEQ ID NO: 8186 - DNA, 60 bp, Artificial Sequence
  Description of Artificial Sequence: Synthetic probe
caatccagtcgtcttttcgcacaacggcaccacccgctttgcgctaccttacactgcgcc

SEQ ID NO: 8187 - DNA, 60 bp, Artificial Sequence
  Description of Artificial Sequence: Synthetic probe
ggacgaagtaggcgacaatccagtcgtcttttcgcacaacggcaccacccgctttgcgct

SEQ ID NO: 8188 - DNA, 60 bp, Artificial Sequence
  Description of Artificial Sequence: Synthetic probe
ccagagacggcaccacacggatgtcggcttcataatggacagatttgtgaaagtgaccag

SEQ ID NO: 8189 - DNA, 53 bp, Artificial Sequence
  Description of Artificial Sequence: Synthetic probe
aggtacgaacacggtgagaaagaccgctaccgagtagccctcaccaaacctgc

SEQ ID NO: 8190 - DNA, 60 bp, Artificial Sequence
  Description of Artificial Sequence: Synthetic probe
aaccactttcaactatggtaggatctacactgaggcggaagccgacgtgtacgtgaggat

SEQ ID NO: 8191 - DNA, 60 bp, Artificial Sequence
  Description of Artificial Sequence: Synthetic probe
ggagatctcgcgacgctcgcagagcgcatcgcagcagaagcacacattccaaccactttc

SEQ ID NO: 8192 - DNA, 54 bp, Artificial Sequence
  Description of Artificial Sequence: Synthetic probe
accactactggcggtggaggtgtccgcagacaggcacaagcagaaaattatcgc

SEQ ID NO: 8193 - DNA, 60 bp, Artificial Sequence
  Description of Artificial Sequence: Synthetic probe
gaccactactggcggtggaggtgtccgcagacaggcacaagcagaaaattatcgcacctg

SEQ ID NO: 8194 - DNA, 60 bp, Artificial Sequence
  Description of Artificial Sequence: Synthetic probe
gcatccttcaatttcggtgcgatacgcgccacaaccatccacgagctcctcgtgcgcatg

SEQ ID NO: 8195 - DNA, 60 bp, Artificial Sequence
  Description of Artificial Sequence: Synthetic probe
ccgcgcagcttcctgcatccttcaatttcggtgcgatacgcgccacaaccatccacgagc

SEQ ID NO: 8196 - DNA, 60 bp, Artificial Sequence
  Description of Artificial Sequence: Synthetic probe
gccgcgcaacttcctgcatccttcaatttcggtgcgatacgcgccacaaccatccacgag

SEQ ID NO: 8197 - DNA, 60 bp, Artificial Sequence
  Description of Artificial Sequence: Synthetic probe
acagcctaccacaaagcaccattcacaagacttgcacttccctacaccgcgccacaccgc

SEQ ID NO: 8198 - DNA, 60 bp, Artificial Sequence
  Description of Artificial Sequence: Synthetic probe
acagcctaccacaaagcaccattcacgagacttgcacttccctacaccgcgccacaccgc

SEQ ID NO: 8199 - DNA, 60 bp, Artificial Sequence
  Description of Artificial Sequence: Synthetic probe
gacctggagattgtggtgaggcacacaggcgagctgacgtgggtgcccaacggcgcccct

SEQ ID NO: 8200 - DNA, 60 bp, Artificial Sequence
  Description of Artificial Sequence: Synthetic probe
cgcgcagctacgtactatttctctgacctggagattgtggtgaggcacacaggcgagctg

SEQ ID NO: 8201 - DNA, 55 bp, Artificial Sequence
  Description of Artificial Sequence: Synthetic probe
ttgctgcgcgcagctacgtactatttctctgacctggagattgtggtgaggcaca

SEQ ID NO: 8202 - DNA, 60 bp, Artificial Sequence
  Description of Artificial Sequence: Synthetic probe
aacacggattggtgggtgcgttgctgcgcgcagctacgtactatttctctgacctggaga

SEQ ID NO: 8203 - DNA, 60 bp, Artificial Sequence
  Description of Artificial Sequence: Synthetic probe
ttatagacctcatgcagacacaccaacacggattggtgggtgcgttgctgcgcgcagcta

SEQ ID NO: 8204 - DNA, 60 bp, Artificial Sequence
  Description of Artificial Sequence: Synthetic probe
gccctacacatgttatagacctcatgcagacacaccaacacggattggtgggtgcgttgc

SEQ ID NO: 8205 - DNA, 60 bp, Artificial Sequence
  Description of Artificial Sequence: Synthetic probe
aataaacagccttagccctacacatgttatagacctcatgcagacacaccaacacggatt

SEQ ID NO: 8206 - DNA, 53 bp, Artificial Sequence
  Description of Artificial Sequence: Synthetic probe
aaaataaacagccctagccctacacatgttatagacctcatgcagacacacca

SEQ ID NO: 8207 - DNA, 60 bp, Artificial Sequence
  Description of Artificial Sequence: Synthetic probe
cttcatcatggacagatttgtaaaaataaacagccctagccctacacatgttatagacct

SEQ ID NO: 8208 - DNA, 60 bp, Artificial Sequence
  Description of Artificial Sequence: Synthetic probe
aaagctactcgggtgactgaactgctttaccgcatgaaaagggctgagacatactgcccc

SEQ ID NO: 8209 - DNA, 60 bp, Artificial Sequence
  Description of Artificial Sequence: Synthetic probe
cacgcgtcttagcgaccgtcggaagttgcaagtacagtgacgcccgtagcaatgtgaggc

SEQ ID NO: 8210 - DNA, 60 bp, Artificial Sequence
  Description of Artificial Sequence: Synthetic probe
tggacacagctaaagcactcacgcgactggccctgcctacggccccacgcgtcttagcga

SEQ ID NO: 8211 - DNA, 60 bp, Artificial Sequence
  Description of Artificial Sequence: Synthetic probe
ccgagacagccttggacacagctaaagcactcacgcgactggccctgcctacggccccac

SEQ ID NO: 8212 - DNA, 50 bp, Artificial Sequence
  Description of Artificial Sequence: Synthetic probe
actgagcttttgatccgcatgaaacgcgcggagacatactgccccaggcc

SEQ ID NO: 8213 - DNA, 51 bp, Artificial Sequence
  Description of Artificial Sequence: Synthetic probe
cactgagcttttgatccgcatgaaacgcgcggagacatactgccccaggcc

SEQ ID NO: 8214 - DNA, 60 bp, Artificial Sequence
  Description of Artificial Sequence: Synthetic probe
gaggtgtcgtcacaagacagacacaaacagaagatcattgcacctgccaaacaactcctg

SEQ ID NO: 8215 - DNA, 60 bp, Artificial Sequence
  Description of Artificial Sequence: Synthetic probe
cagaccaaggagaaagcactggtgggcgcaatcctgcgcgtcgccacgtactatttctcg

SEQ ID NO: 8216 - DNA, 60 bp, Artificial Sequence
  Description of Artificial Sequence: Synthetic probe
tggacctgctccagaccaaggagaaagcactggtgggcgcaatcctgcgcgctgccacgt

SEQ ID NO: 8217 - DNA, 60 bp, Artificial Sequence
  Description of Artificial Sequence: Synthetic probe
acactggacctgctccagaccaaggagaaagcactggtgggcgcaatcctgcgcgctgcc

SEQ ID NO: 8218 - DNA, 60 bp, Artificial Sequence
  Description of Artificial Sequence: Synthetic probe
cgacgtactacttctcagacctagaggttgcgcttgttcacacaggcccggtcacctggg

SEQ ID NO: 8219 - DNA, 60 bp, Artificial Sequence
  Description of Artificial Sequence: Synthetic probe
atcacagcccatttccgcgacaccgttcgtgttgcgaaaggaaaccccgttgtcggcgtg

SEQ ID NO: 8220 - DNA, 60 bp, Artificial Sequence
  Description of Artificial Sequence: Synthetic probe
ggttaaagtaaagggacaggacatgctctcagacgccgccctcatggtcctcaacagagg

SEQ ID NO: 8221 - DNA, 60 bp, Artificial Sequence
  Description of Artificial Sequence: Synthetic probe
tgtttgagtttgaggttaaagtaaagggacaggacatgctctcagacgccgccctcatgg

SEQ ID NO: 8222 - DNA, 60 bp, Artificial Sequence
  Description of Artificial Sequence: Synthetic probe
gtttctcgtgcgcatgaagcgtgccgaactctactgccccagaccattgttggcggtgga

SEQ ID NO: 8223 - DNA, 60 bp, Artificial Sequence
  Description of Artificial Sequence: Synthetic probe
tacaacaaagcgccgttcacgaggcttgcgcttccctacactgcgccacaccgcgtgttg

SEQ ID NO: 8224 - DNA, 60 bp, Artificial Sequence
  Description of Artificial Sequence: Synthetic probe
cacattccaaccaccttcaactacggcaggatctacacacaagccgaggttgacgtgtac

SEQ ID NO: 8225 - DNA, 60 bp, Artificial Sequence
  Description of Artificial Sequence: Synthetic probe
cctcgcggcccagcgaggtgtgcatggtagacggtactgacatgtgtcttgctgatttcc

SEQ ID NO: 8226 - DNA, 60 bp, Artificial Sequence
  Description of Artificial Sequence: Synthetic probe
gcacagcctcgcgacccagcgaggtgtgcatggtagacggtactgacatgtgtcttgctg

SEQ ID NO: 8227 - DNA, 60 bp, Artificial Sequence
  Description of Artificial Sequence: Synthetic probe
gcacagcctcgcggcccagcgaggtgtgcatggtagacggtactgacatgtgtcttgctg

SEQ ID NO: 8228 - DNA, 60 bp, Artificial Sequence
  Description of Artificial Sequence: Synthetic probe
ggtacgtcgatgaaccattcttcgactgggtttacaactcgcctgagaacctcacactcc

SEQ ID NO: 8229 - DNA, 60 bp, Artificial Sequence
  Description of Artificial Sequence: Synthetic probe
ggtacgtcgatgaaccattcttcgactgggtttacaactcgcccgagaacctcacgctcc

SEQ ID NO: 8230 - DNA, 60 bp, Artificial Sequence
  Description of Artificial Sequence: Synthetic probe
gatacgtcgatgaaccattcttcgactgggtttacaactcgcctgagaacctcactcttc

SEQ ID NO: 8231 - DNA, 60 bp, Artificial Sequence
  Description of Artificial Sequence: Synthetic probe
ctacagttgtttaggtacgtcgatgaaccattcttcgactgggtttacaactcgcctgag

SEQ ID NO: 8232 - DNA, 60 bp, Artificial Sequence
  Description of Artificial Sequence: Synthetic probe
ctacagttgttcagatacgtcgatgaaccattcttcgactgggtttacaactcgcctgag

SEQ ID NO: 8233 - DNA, 60 bp, Artificial Sequence
  Description of Artificial Sequence: Synthetic probe
gcgttggcaccagcactcgccccagcgagatctgtgtgatcaacggagtcgtgatgacac

SEQ ID NO: 8234 - DNA, 55 bp, Artificial Sequence
  Description of Artificial Sequence: Synthetic probe
actcaagggggccggacaatccagcccagcaaccggctcgcagaaccaatctggc

SEQ ID NO: 8235 - DNA, 60 bp, Artificial Sequence
  Description of Artificial Sequence: Synthetic probe
aaacacttgctccacaccggtaacggggccgcctcgcgacccagcgaggtgtgtatggta

SEQ ID NO: 8236 - DNA, 60 bp, Artificial Sequence
  Description of Artificial Sequence: Synthetic probe
catcaaacacttgctccacaccggtaacggggccgcctcgcgacccagcgaggtgtgtat

SEQ ID NO: 8237 - DNA, 60 bp, Artificial Sequence
  Description of Artificial Sequence: Synthetic probe
actgggcttgagttgcacgagggcggaccacctgcccttgtgatctggaacatcaaacac

SEQ ID NO: 8238 - DNA, 54 bp, Artificial Sequence
  Description of Artificial Sequence: Synthetic probe
tcacactgcataacggtgaaaagaaaactttctactccaggcccaataaccacg

SEQ ID NO: 8239 - DNA, 60 bp, Artificial Sequence
  Description of Artificial Sequence: Synthetic probe
ttcgcggtgaccgcgccgtgctggcgtccaagtacgctggtgcgcgacacacgcttccgt

SEQ ID NO: 8240 - DNA, 60 bp, Artificial Sequence
  Description of Artificial Sequence: Synthetic probe
cgtgcgcatgaagcgtgccgaactctactgccctagaccactgttggcagaggaggtgtc

SEQ ID NO: 8241 - DNA, 60 bp, Artificial Sequence
  Description of Artificial Sequence: Synthetic probe
gcgccctctcctcacgcactatgaccacggcaccaaggatcgctacaagatcgcgataac

SEQ ID NO: 8242 - DNA, 60 bp, Artificial Sequence
  Description of Artificial Sequence: Synthetic probe
ctttactgtccgcgccctctcctcacgcactatgaccacggcaccaaggatcgctacaag

SEQ ID NO: 8243 - DNA, 60 bp, Artificial Sequence
  Description of Artificial Sequence: Synthetic probe
agccgaagtcgacgtgtacgttaggatgaagcgcgcggaactttactgtccgcgccctct

SEQ ID NO: 8244 - DNA, 60 bp, Artificial Sequence
  Description of Artificial Sequence: Synthetic probe
tctacacacaagccgaagtcgacgtgtacgttaggatgaagcgcgcggaactttactgtc

SEQ ID NO: 8245 - DNA, 60 bp, Artificial Sequence
  Description of Artificial Sequence: Synthetic probe
gagaacatccgtggggacctcgccactctcgcggcgaggattgcaagcgagacacacatt

SEQ ID NO: 8246 - DNA, 60 bp, Artificial Sequence
  Description of Artificial Sequence: Synthetic probe
ggcacagtcccgcgcgagaacatccgtggggacctcgccactctcgcggcgaggattgca

SEQ ID NO: 8247 - DNA, 60 bp, Artificial Sequence
  Description of Artificial Sequence: Synthetic probe
gagtgaggtgggcgacaatccagtcgtcttctccacgaaccacaccgcccgttttgcact

SEQ ID NO: 8248 - DNA, 60 bp, Artificial Sequence
  Description of Artificial Sequence: Synthetic probe
gctccagagttgagtgaggtgggcgacaatccagtcgtcttctccacgaaccacaccgcc

SEQ ID NO: 8249 - DNA, 60 bp, Artificial Sequence
  Description of Artificial Sequence: Synthetic probe
tgaagacaactgactgttttaacgttttactcgagatctttcacaggttcagacaaacgt

SEQ ID NO: 8250 - DNA, 60 bp, Artificial Sequence
  Description of Artificial Sequence: Synthetic probe
atgaagacaactgactgttttaacgttttactcgaaatcttccacaggtttagacaaacg

SEQ ID NO: 8251 - DNA, 60 bp, Artificial Sequence
  Description of Artificial Sequence: Synthetic probe
atgaagacaactgactgttttaacgttttactcgagatctttcacaggttcagacaaacg

SEQ ID NO: 8252 - DNA, 52 bp, Artificial Sequence
  Description of Artificial Sequence: Synthetic probe
aaggatcgctacaagaccgcgataaccaaacctgtcaaacagttgtgcaatt

SEQ ID NO: 8253 - DNA, 51 bp, Artificial Sequence
  Description of Artificial Sequence: Synthetic probe
attgtggttcgacacgacggcaacctgacatgggtacccaatggagcaccc

SEQ ID NO: 8254 - DNA, 60 bp, Artificial Sequence
  Description of Artificial Sequence: Synthetic probe
ggtacactcacaccacagacagatacaaggtcacacttgtgtcgccagccaaacaactgt

SEQ ID NO: 8255 - DNA, 60 bp, Artificial Sequence
  Description of Artificial Sequence: Synthetic probe
caggtgaagtgtactaccgaatgaagcggactgaactctactgtccacgtccgttgatgg

SEQ ID NO: 8256 - DNA, 57 bp, Artificial Sequence
  Description of Artificial Sequence: Synthetic probe
gacacaacgtgtcaatccacgccgtggtgatatggccacactggcacagcgcgttga

SEQ ID NO: 8257 - DNA, 57 bp, Artificial Sequence
  Description of Artificial Sequence: Synthetic probe
tgggtgcctaacggctgcccgcacactaaccgcgtggaggacaacccagtcgttcat

SEQ ID NO: 8258 - DNA, 60 bp, Artificial Sequence
  Description of Artificial Sequence: Synthetic probe
ggtacgcgattgatgacgaggacttttacccttggacaccggacccgtccgatgttctgg

SEQ ID NO: 8259 - DNA, 60 bp, Artificial Sequence
  Description of Artificial Sequence: Synthetic probe
gcagtcctggctgctcgaattgctagtgagacccacatcccgacaacattcaactacggg

SEQ ID NO: 8260 - DNA, 60 bp, Artificial Sequence
  Description of Artificial Sequence: Synthetic probe
gtgacttggcagtcctggctgctcgaattgctagtgagacccacatcccgacaacattca

SEQ ID NO: 8261 - DNA, 60 bp, Artificial Sequence
  Description of Artificial Sequence: Synthetic probe
cgctgccacgtactacttctcggacttggaggtggcatgtgttggcacgaacaagtgggt

SEQ ID NO: 8262 - DNA, 60 bp, Artificial Sequence
  Description of Artificial Sequence: Synthetic probe
gcgctgccacgtactacttctcggacttggaggtggcatgtgttggcacgaacaagtggg

SEQ ID NO: 8263 - DNA, 60 bp, Artificial Sequence
  Description of Artificial Sequence: Synthetic probe
gcgcgctgccacgtactacttctcggacttggaggtggcatgtgttggcacgaacaagtg

SEQ ID NO: 8264 - DNA, 60 bp, Artificial Sequence
  Description of Artificial Sequence: Synthetic probe
ggcagctgcccacctctttcaactacggcgctgtaaaggctaacaccatcactgagcttc

SEQ ID NO: 8265 - DNA, 60 bp, Artificial Sequence
  Description of Artificial Sequence: Synthetic probe
gggcagctgcccacctctttcaactacggcgctgtaaaggctaacaccatcactgagctt

SEQ ID NO: 8266 - DNA, 60 bp, Artificial Sequence
  Description of Artificial Sequence: Synthetic probe
gctggcatcttcctgaaaggacaggagcacgctgtgtttgcctgtatcacctccaacggg

SEQ ID NO: 8267 - DNA, 60 bp, Artificial Sequence
  Description of Artificial Sequence: Synthetic probe
cgctggcatcttcctgaaaggacaggagcacgctgtgtttgcctgtatcacctccaacgg

SEQ ID NO: 8268 - DNA, 60 bp, Artificial Sequence
  Description of Artificial Sequence: Synthetic probe
acttccacgctggcatcttcctgaaaggacaggagcacgctgtgtttgcctgtatcacct

SEQ ID NO: 8269 - DNA, 60 bp, Artificial Sequence
  Description of Artificial Sequence: Synthetic probe
gtctatggatcgcctgagaacctcactctcgaggcaatcaggcagttggaagaggttact

SEQ ID NO: 8270 - DNA, 60 bp, Artificial Sequence
  Description of Artificial Sequence: Synthetic probe
gtctatcaatcgcctgagaacctcactctcgaggcaatcaggcagttggaagaggttact

SEQ ID NO: 8271 - DNA, 60 bp, Artificial Sequence
  Description of Artificial Sequence: Synthetic probe
gtctatgaatcgcctgagaacctcactctcgaggcaatcaggcagttggaagaggttact

SEQ ID NO: 8272 - DNA, 60 bp, Artificial Sequence
  Description of Artificial Sequence: Synthetic probe
aacaagtgctggagaaggtgccgacgtcgtcacgaccgacgcatccgcacacggaggtaa

SEQ ID NO: 8273 - DNA, 60 bp, Artificial Sequence
  Description of Artificial Sequence: Synthetic probe
acaacaagtgctggagaaggtgccgacgtcgtcacgaccgacgcatccgcacacggaggt

SEQ ID NO: 8274 - DNA, 60 bp, Artificial Sequence
  Description of Artificial Sequence: Synthetic probe
ccacgctgggaagctcacatgggtgcccaacggtgcaccagtttctgcacttaacaacac

SEQ ID NO: 8275 - DNA, 60 bp, Artificial Sequence
  Description of Artificial Sequence: Synthetic probe
acccacgctgggaagctcacatgggtgcccaacggtgcaccagtttctgcacttaacaac

SEQ ID NO: 8276 - DNA, 60 bp, Artificial Sequence
  Description of Artificial Sequence: Synthetic probe
ccaacaaccttcaactatggaatcattctgactgaagcagaagtggacgtccatgtgcgc

SEQ ID NO: 8277 - DNA, 60 bp, Artificial Sequence
  Description of Artificial Sequence: Synthetic probe
ccaacaaccttcaactatggaatcattctgactgaagcagaagtggacgtctatgtgcgc

SEQ ID NO: 8278 - DNA, 60 bp, Artificial Sequence
  Description of Artificial Sequence: Synthetic probe
acattccaacaactttcaactatggaatcattctgactgaagcagaagtggacgtctacg

SEQ ID NO: 8279 - DNA, 60 bp, Artificial Sequence
  Description of Artificial Sequence: Synthetic probe
tcgcacatcccaacaaccttcaactatggaatcattctgactgaagcagaagtggacgtc

SEQ ID NO: 8280 - DNA, 60 bp, Artificial Sequence
  Description of Artificial Sequence: Synthetic probe
gcgcgcagaactctactgcccgcgccctgttctgacacactacgatcacaaaggactgga

SEQ ID NO: 8281 - DNA, 60 bp, Artificial Sequence
  Description of Artificial Sequence: Synthetic probe
ccgtggagacttcgcgaccctcgcggacagaattgccagtgagacacatattccaaccac

SEQ ID NO: 8282 - DNA, 60 bp, Artificial Sequence
  Description of Artificial Sequence: Synthetic probe
tccgtggagacttcgcgaccctcgcggacagaattgccagtgagacacatattccaacca

SEQ ID NO: 8283 - DNA, 60 bp, Artificial Sequence
  Description of Artificial Sequence: Synthetic probe
attgcaagtacaagcctgctggcactgctccgcgcgacaacatccgtggagacttcgcga

SEQ ID NO: 8284 - DNA, 60 bp, Artificial Sequence
  Description of Artificial Sequence: Synthetic probe
caacggtgattgcaagtacaagcctgctggcactgctccgcgcgacaacatccgtggaga

SEQ ID NO: 8285 - DNA, 60 bp, Artificial Sequence
  Description of Artificial Sequence: Synthetic probe
cgctgccctacaccgcaccacacaggtgcctcgcaacatcctacaacggtgattgcaagt

SEQ ID NO: 8286 - DNA, 60 bp, Artificial Sequence
  Description of Artificial Sequence: Synthetic probe
cgctttgcgctgccctacaccgcaccacacaggtgcctcgcaacatcctacaacggtgat

SEQ ID NO: 8287 - DNA, 60 bp, Artificial Sequence
  Description of Artificial Sequence: Synthetic probe
attgacctcatgcagacgcaccagcacgggctggtgggcgcgttgctgcgtgcagctacg

SEQ ID NO: 8288 - DNA, 60 bp, Artificial Sequence
  Description of Artificial Sequence: Synthetic probe
ttgtgaagataaacaaccctagccccacacatgtcattgacctcatgcagacgcaccagc

SEQ ID NO: 8289 - DNA, 60 bp, Artificial Sequence
  Description of Artificial Sequence: Synthetic probe
ttgtgaaaatagaaagcctcagccccacacatgtcattgacctcatgcagacgcaccagc

SEQ ID NO: 8290 - DNA, 54 bp, Artificial Sequence
  Description of Artificial Sequence: Synthetic probe
accactgcaacgggggaatctgcagaccctgtcaccaccacggttgagaactac

SEQ ID NO: 8291 - DNA, 60 bp, Artificial Sequence
  Description of Artificial Sequence: Synthetic probe
tacgaccacggagtccgggacagattcgacgcaccaattggcgttgaaaagcaactgtgc

SEQ ID NO: 8292 - DNA, 60 bp, Artificial Sequence
  Description of Artificial Sequence: Synthetic probe
ggcttacgaccacggagtccgggacagattcgacgcaccaattggcgttgaaaagcaact

SEQ ID NO: 8293 - DNA, 60 bp, Artificial Sequence
  Description of Artificial Sequence: Synthetic probe
ttggccacatcaccgccgacaaaccagttgatgtgtattacaggatgaagcgtgctgaac

SEQ ID NO: 8294 - DNA, 60 bp, Artificial Sequence
  Description of Artificial Sequence: Synthetic probe
cctctaccttcaactttggccacatcaccgccgacaaaccagttgatgtgtattacagga

SEQ ID NO: 8295 - DNA, 60 bp, Artificial Sequence
  Description of Artificial Sequence: Synthetic probe
caacagtgtacaacggtgagtgcaagtacaccgaccgcgctaccgccattcgtggagacc

SEQ ID NO: 8296 - DNA, 60 bp, Artificial Sequence
  Description of Artificial Sequence: Synthetic probe
ctcaccgtctgctggcaacagtgtacaacggtgagtgcaagtacaccgaccgcgctaccg

SEQ ID NO: 8297 - DNA, 60 bp, Artificial Sequence
  Description of Artificial Sequence: Synthetic probe
ctctcacaacggtgtctccagatttgctctgccctacactgcacctcaccgtctgctggc

SEQ ID NO: 8298 - DNA, 60 bp, Artificial Sequence
  Description of Artificial Sequence: Synthetic probe
ggttttctctcacaacggtgtctccagatttgctctgccctacactgcacctcaccgtct

SEQ ID NO: 8299 - DNA, 60 bp, Artificial Sequence
  Description of Artificial Sequence: Synthetic probe
caacccaacggagcaccacgcaccacccagctgggagacaaccccatggttttctctcac

SEQ ID NO: 8300 - DNA, 60 bp, Artificial Sequence
  Description of Artificial Sequence: Synthetic probe
tggcaacccaacggagcaccacgcaccacccagctgggagacaaccccatggttttctct

SEQ ID NO: 8301 - DNA, 60 bp, Artificial Sequence
  Description of Artificial Sequence: Synthetic probe
tgactgcaagtacaaacccgctggcacacccccgcgcgagaacattcgcggggacctcgc

SEQ ID NO: 8302 - DNA, 60 bp, Artificial Sequence
  Description of Artificial Sequence: Synthetic probe
aaacagctgcccacctctttcaactacggcgctgtaaaggctgaagccatcactgagctc

SEQ ID NO: 8303 - DNA, 51 bp, Artificial Sequence
  Description of Artificial Sequence: Synthetic probe
tactgagcttttgatccgcatgaaacgcgcggagacatactgccctaggcc

SEQ ID NO: 8304 - DNA, 51 bp, Artificial Sequence
  Description of Artificial Sequence: Synthetic probe
cactgagcttttgatccgcatgaaacgcgcggagacatactgccctaggcc

SEQ ID NO: 8305 - DNA, 51 bp, Artificial Sequence
  Description of Artificial Sequence: Synthetic probe
cacggagcttttgatccgcatgaaacgcgcggagacatactgccctaggcc

SEQ ID NO: 8306 - DNA, 60 bp, Artificial Sequence
  Description of Artificial Sequence: Synthetic probe
tgtcttaggcacagggaaatggaccggatgggttcccaacggctgcccgctcactgaacg

SEQ ID NO: 8307 - DNA, 60 bp, Artificial Sequence
  Description of Artificial Sequence: Synthetic probe
gctgtcttaggcacagggaaatggaccggatgggttcccaacggctgcccgctcactgaa

SEQ ID NO: 8308 - DNA, 60 bp, Artificial Sequence
  Description of Artificial Sequence: Synthetic probe
atggtgacaccatgccaggcctctttgcctacagagccgccaccaaagctggctactgtg

SEQ ID NO: 8309 - DNA, 60 bp, Artificial Sequence
  Description of Artificial Sequence: Synthetic probe
tgtgtatggatggtgacaccatgccaggcctctttgcctacagagccgccaccaaagctg

SEQ ID NO: 8310 - DNA, 60 bp, Artificial Sequence
  Description of Artificial Sequence: Synthetic probe
gtgcagttaaagcagaaacaatcactgagttgctcgtgcgcatgaagcgtgctgaactct

SEQ ID NO: 8311 - DNA, 60 bp, Artificial Sequence
  Description of Artificial Sequence: Synthetic probe
agaaggctgagagaacgctgcctacctccttcaactacggtgccatcaaagcgaccgggg

SEQ ID NO: 8312 - DNA, 54 bp, Artificial Sequence
  Description of Artificial Sequence: Synthetic probe
cactacgaccaccgagggaaggaccgttacaaaacggacctcaccaagcctgcc

SEQ ID NO: 8313 - DNA, 60 bp, Artificial Sequence
  Description of Artificial Sequence: Synthetic probe
cgggatgatatacacacaagcagaagtgaacgtgtacctgaggatgaagagagcggaact

SEQ ID NO: 8314 - DNA, 60 bp, Artificial Sequence
  Description of Artificial Sequence: Synthetic probe
gacaaccttcaactacgggatgatatacacacaagcagaagtgaacgtgtacctgaggat

SEQ ID NO: 8315 - DNA, 57 bp, Artificial Sequence
  Description of Artificial Sequence: Synthetic probe
tcttctcacacaacaacaccacccgtttcgcgataccctacactgcaccacacaggg

SEQ ID NO: 8316 - DNA, 60 bp, Artificial Sequence
  Description of Artificial Sequence: Synthetic probe
gacaccgaacggtagtccagtgttgggcgaggtgggcgacaacccagtcgtcttctcaca

SEQ ID NO: 8317 - DNA, 60 bp, Artificial Sequence
  Description of Artificial Sequence: Synthetic probe
gcgtcttagcgaccgtcggaagttgtaagtacagtgacgcccgcagcaacgtgaggcttc

SEQ ID NO: 8318 - DNA, 60 bp, Artificial Sequence
  Description of Artificial Sequence: Synthetic probe
tttggacacagctaaagcactcacgcggctggccttgcctacggccccacgcgtcttagc

SEQ ID NO: 8319 - DNA, 60 bp, Artificial Sequence
  Description of Artificial Sequence: Synthetic probe
ctgagacagctttggacacagctaaagcactcacgcggctggccttgcctacggccccac

SEQ ID NO: 8320 - DNA, 60 bp, Artificial Sequence
  Description of Artificial Sequence: Synthetic probe
gtgactgaactgctttatcgcatgaagagggctgagacatactgcccccggcctcttttg

SEQ ID NO: 8321 - DNA, 60 bp, Artificial Sequence
  Description of Artificial Sequence: Synthetic probe
gggacctcgcgacccttgcgcagaggattgcaagcgagacacacatcccaaccaccttta

SEQ ID NO: 8322 - DNA, 60 bp, Artificial Sequence
  Description of Artificial Sequence: Synthetic probe
cgcggggacctcgcaactcttgcagagaggattgcaagcgagacacacatcccaaccact

SEQ ID NO: 8323 - DNA, 57 bp, Artificial Sequence
  Description of Artificial Sequence: Synthetic probe
tctactgcccccgtccaattctgacttactacgatcatggtggaaaggaccgctaca

SEQ ID NO: 8324 - DNA, 60 bp, Artificial Sequence
  Description of Artificial Sequence: Synthetic probe
cgcgagtgacacgcacatcccaactaccttcaactatggcaggatctacacggaggcgga

SEQ ID NO: 8325 - DNA, 60 bp, Artificial Sequence
  Description of Artificial Sequence: Synthetic probe
cgcatcgcgagtgacacgcacatcccaactaccttcaactatggcaggatctacacggag

SEQ ID NO: 8326 - DNA, 60 bp, Artificial Sequence
  Description of Artificial Sequence: Synthetic probe
accaacattcgcggtgatcttgcgaccctcgcggaacgcatcgcgagtgacacgcacatc

SEQ ID NO: 8327 - DNA, 60 bp, Artificial Sequence
  Description of Artificial Sequence: Synthetic probe
atgaggccccgcggaccaacattcgcggtgatcttgcgaccctcgcggaacgcatcgcga

SEQ ID NO: 8328 - DNA, 60 bp, Artificial Sequence
  Description of Artificial Sequence: Synthetic probe
acaacgggacaacccgtttcgctctgccttacaccgccccacacaggtgtctcgctacca

SEQ ID NO: 8329 - DNA, 60 bp, Artificial Sequence
  Description of Artificial Sequence: Synthetic probe
cgtcttctcgcacaacgggacaacccgtttcgctctgccttacaccgccccacacaggtg

SEQ ID NO: 8330 - DNA, 60 bp, Artificial Sequence
  Description of Artificial Sequence: Synthetic probe
gcgccagaactgagcgaggtcggcgacaacccagtcgtcttctcgcacaacgggacaacc

SEQ ID NO: 8331 - DNA, 60 bp, Artificial Sequence
  Description of Artificial Sequence: Synthetic probe
tggacgccgaatggcgcgccagaactgagcgaggtcggcgacaacccagtcgtcttctcg

SEQ ID NO: 8332 - DNA, 60 bp, Artificial Sequence
  Description of Artificial Sequence: Synthetic probe
acggccccacgcgtcttagcgaccgtcggaagttgcaagtacagtgacgcccgtagcaat

SEQ ID NO: 8333 - DNA, 60 bp, Artificial Sequence
  Description of Artificial Sequence: Synthetic probe
acggccccacgcgtcttagcgaccgtcggaagttgtaagtacagtgacgcccgcagcaac

SEQ ID NO: 8334 - DNA, 51 bp, Artificial Sequence
  Description of Artificial Sequence: Synthetic probe
ggccacctactctttgttggctgtcaaaggtgatgttccgaacggggcccc

SEQ ID NO: 8335 - DNA, 60 bp, Artificial Sequence
  Description of Artificial Sequence: Synthetic probe
ggccacctactctttgttggctgtcaaaggtgatgttccgaacggggcccccgagacagc

SEQ ID NO: 8336 - DNA, 60 bp, Artificial Sequence
  Description of Artificial Sequence: Synthetic probe
ggccacctactctttgttggctgtcaaaggtgatgttccgaacggggcccctgagacagc

SEQ ID NO: 8337 - DNA, 53 bp, Artificial Sequence
  Description of Artificial Sequence: Synthetic probe
catcaacgtgccgctgcagatccctgcccacactttggtagcccccctgcgga

SEQ ID NO: 8338 - DNA, 53 bp, Artificial Sequence
  Description of Artificial Sequence: Synthetic probe
catcaatgtgctgctgcagatccctgcccacactttggtagcccccctgcgga

SEQ ID NO: 8339 - DNA, 60 bp, Artificial Sequence
  Description of Artificial Sequence: Synthetic probe
cgccaggatatctcgtttatattagacaaagtcccaaaagacatcaacgtgccgctgcag

SEQ ID NO: 8340 - DNA, 60 bp, Artificial Sequence
  Description of Artificial Sequence: Synthetic probe
cgccaggatatctcgtttatattagacaaagtcccaaaagacatcaatgtgctgctgcag

SEQ ID NO: 8341 - DNA, 60 bp, Artificial Sequence
  Description of Artificial Sequence: Synthetic probe
gaggtcagacgccaggatatctcgtttatattagacaaagtcccaaaagacatcaatgtg

SEQ ID NO: 8342 - DNA, 60 bp, Artificial Sequence
  Description of Artificial Sequence: Synthetic probe
gagatcagacgccaggatatctcgtttatattagacaaagtcccaaaagacatcaacgtg

SEQ ID NO: 8343 - DNA, 60 bp, Artificial Sequence
  Description of Artificial Sequence: Synthetic probe
gctcttgacaccactcaggaccgccgtaaacagaagatcattgcacctgagaagcaggtg

SEQ ID NO: 8344 - DNA, 58 bp, Artificial Sequence
  Description of Artificial Sequence: Synthetic probe
acgaggctcgcactcccctacactgcaccacaccgtgtgctggcaacagtgtacaacg

SEQ ID NO: 8345 - DNA, 60 bp, Artificial Sequence
  Description of Artificial Sequence: Synthetic probe
cctccagttgtttaggtacgtcgatgaacccttcttcgactgggtctacgactcgcctga

SEQ ID NO: 8346 - DNA, 60 bp, Artificial Sequence
  Description of Artificial Sequence: Synthetic probe
aacaccatcctccagttgtttaggtacgtcgatgaacccttcttcgactgggtctacgac

SEQ ID NO: 8347 - DNA, 56 bp, Artificial Sequence
  Description of Artificial Sequence: Synthetic probe
ttatcgctctgttgcacgctatcagagagatcaagacactgtttctttcaagagtc

SEQ ID NO: 8348 - DNA, 60 bp, Artificial Sequence
  Description of Artificial Sequence: Synthetic probe
ccctgtctacgaggacggaaacagggacagattcgacgcgccaatcggtgtggagaaaca

SEQ ID NO: 8349 - DNA, 60 bp, Artificial Sequence
  Description of Artificial Sequence: Synthetic probe
ctccctgtctacgaggacggaaacagggacagattcgacgcgccaatcggtgtggagaaa

SEQ ID NO: 8350 - DNA, 60 bp, Artificial Sequence
  Description of Artificial Sequence: Synthetic probe
cttctccctgtctacgaccacggaaacagggacagattcgacgcgccaatcggtgtggag

SEQ ID NO: 8351 - DNA, 60 bp, Artificial Sequence
  Description of Artificial Sequence: Synthetic probe
ccccttctccctgtctacgaccacggaaacagggacagattcgacgcgccaatcggtgtg

SEQ ID NO: 8352 - DNA, 60 bp, Artificial Sequence
  Description of Artificial Sequence: Synthetic probe
cgaatgaagagggccgagctctactgtcctagaccccttctccctgtctacgaggacgga

SEQ ID NO: 8353 - DNA, 60 bp, Artificial Sequence
  Description of Artificial Sequence: Synthetic probe
taccgaatggagagggccgagctctactgtcctagaccccttctccctgtctacgaccac

SEQ ID NO: 8354 - DNA, 60 bp, Artificial Sequence
  Description of Artificial Sequence: Synthetic probe
acgtttactaccgaatgaagagggccgagctctactgtcctagaccccttctccctgtct

SEQ ID NO: 8355 - DNA, 60 bp, Artificial Sequence
  Description of Artificial Sequence: Synthetic probe
gccgccaagtatgcaaacacaaagcacgagctcccgtccaccttcaacttcggattcgtg

SEQ ID NO: 8356 - DNA, 60 bp, Artificial Sequence
  Description of Artificial Sequence: Synthetic probe
tgttggccgccaagtatgcaaacacaaagcacgagctcccgtccaccttcaacttcggat

SEQ ID NO: 8357 - DNA, 54 bp, Artificial Sequence
  Description of Artificial Sequence: Synthetic probe
tcctgtcaaccaggtacaacggtgagtgcaagtacacggaacgggcgaccgcta

SEQ ID NO: 8358 - DNA, 60 bp, Artificial Sequence
  Description of Artificial Sequence: Synthetic probe
tcctgtcaaccaggtacaacggtgagtgcaagtacacggaacgggcgaccgctatccgcg

SEQ ID NO: 8359 - DNA, 60 bp, Artificial Sequence
  Description of Artificial Sequence: Synthetic probe
ccgcggacaacccagctccgcgataacccgatggtgttttcacacaactcagtcacacgc

SEQ ID NO: 8360 - DNA, 60 bp, Artificial Sequence
  Description of Artificial Sequence: Synthetic probe
caccgcggacaacccagctccgcgataacccgatggtgttttcacacaactcagtcacac

SEQ ID NO: 8361 - DNA, 55 bp, Artificial Sequence
  Description of Artificial Sequence: Synthetic probe
gcctacgggtgacaggcacaagcaaccgatcatcgcacctgcaaaacagctatta

SEQ ID NO: 8362 - DNA, 56 bp, Artificial Sequence
  Description of Artificial Sequence: Synthetic probe
agcttacgggtgacaggcacaagcaaccgatcatcgcacctgcaaaacagctacta

SEQ ID NO: 8363 - DNA, 56 bp, Artificial Sequence
  Description of Artificial Sequence: Synthetic probe
agcctacgggtgacaggcacaagcaaccgatcatcgcacctgcaaaacagctgtta

SEQ ID NO: 8364 - DNA, 60 bp, Artificial Sequence
  Description of Artificial Sequence: Synthetic probe
cggcgctgtgaaggctgaaaacattactgagcttttgctccgcatgaagcgcgcggagac

SEQ ID NO: 8365 - DNA, 60 bp, Artificial Sequence
  Description of Artificial Sequence: Synthetic probe
cggcgctgtgaaggctgaaaacatcactgagcttttgctccgcatgaagcgcgcggagac

SEQ ID NO: 8366 - DNA, 60 bp, Artificial Sequence
  Description of Artificial Sequence: Synthetic probe
acggcgctgtgaaggctgaaaacatcactgagcttttgctccgcatgaagcgcgcggaga

SEQ ID NO: 8367 - DNA, 60 bp, Artificial Sequence
  Description of Artificial Sequence: Synthetic probe
acggcgctgtgaaggctgaaaacattactgagcttttgctccgcatgaagcgcgcggaga

SEQ ID NO: 8368 - DNA, 60 bp, Artificial Sequence
  Description of Artificial Sequence: Synthetic probe
gaccccaagacttctgacccgatttatggacacgtctacaaccccgcgagaacagccttg

SEQ ID NO: 8369 - DNA, 60 bp, Artificial Sequence
  Description of Artificial Sequence: Synthetic probe
tgtaaggatgaaacgcgcggaactctactgcccgcgccccgtcctgacacactacgacca

SEQ ID NO: 8370 - DNA, 60 bp, Artificial Sequence
  Description of Artificial Sequence: Synthetic probe
ttgtactgccccagaccacttctcccggcgtacgaacatggagaccgggacaggttcgat

SEQ ID NO: 8371 - DNA, 60 bp, Artificial Sequence
  Description of Artificial Sequence: Synthetic probe
cgacaaagcagttgatgtgtactacaggatgaagcgtgctgaattgtactgccccagacc

SEQ ID NO: 8372 - DNA, 60 bp, Artificial Sequence
  Description of Artificial Sequence: Synthetic probe
acgttactgccgacaaagcagttgatgtgtactacaggatgaagcgtgctgaattgtact

SEQ ID NO: 8373 - DNA, 60 bp, Artificial Sequence
  Description of Artificial Sequence: Synthetic probe
aaagtactctgaaagacagcacacgctaccgtccacattcaactttggtcacgttactgc

SEQ ID NO: 8374 - DNA, 60 bp, Artificial Sequence
  Description of Artificial Sequence: Synthetic probe
tcgctgccattcgcggcgaccgcgctgtcctggcggcaaagtactctgaaagacagcaca

SEQ ID NO: 8375 - DNA, 60 bp, Artificial Sequence
  Description of Artificial Sequence: Synthetic probe
tacagcacgcctgtcgctgccattcgcggcgaccgcgctgtcctggcggcaaagtactct

SEQ ID NO: 8376 - DNA, 55 bp, Artificial Sequence
  Description of Artificial Sequence: Synthetic probe
ttgtcaactgtttacaacggtgaatgcacatacagcacgcctgtcgctgccattc

SEQ ID NO: 8377 - DNA, 60 bp, Artificial Sequence
  Description of Artificial Sequence: Synthetic probe
acaccgcgcctcaccgcttgttgtcaactgtttacaacggtgaatgcacatacagcacgc

SEQ ID NO: 8378 - DNA, 60 bp, Artificial Sequence
  Description of Artificial Sequence: Synthetic probe
cccaacggtgcgcctaggaccacccaactcggggacaacccgatggttttctccaacaac

SEQ ID NO: 8379 - DNA, 60 bp, Artificial Sequence
  Description of Artificial Sequence: Synthetic probe
cggtggaggtctcgtctcaagacagacacaaacagaagatcattgcaccagcaaaacaac

SEQ ID NO: 8380 - DNA, 60 bp, Artificial Sequence
  Description of Artificial Sequence: Synthetic probe
cggtggaggtctcgtctcaagacagacacaaacagaagatcattgcaccagcaaaacagc

SEQ ID NO: 8381 - DNA, 60 bp, Artificial Sequence
  Description of Artificial Sequence: Synthetic probe
gtctgcgacgtactacttctcagacctggaggttgcgcttgtccacacaggcccggtcac

SEQ ID NO: 8382 - DNA, 60 bp, Artificial Sequence
  Description of Artificial Sequence: Synthetic probe
ccactaccgttgagaactacggaggagagacgcaagtccaacgtcgtcaccacactgacg

SEQ ID NO: 8383 - DNA, 51 bp, Artificial Sequence
  Description of Artificial Sequence: Synthetic probe
ccactaccgttgagaactacggaggagagacgcaagtccaacgtcgtcacc

SEQ ID NO: 8384 - DNA, 60 bp, Artificial Sequence
  Description of Artificial Sequence: Synthetic probe
accactaccgttgagaactacggaggagagacgcaagtccaacgtcgtcaccacactgac

SEQ ID NO: 8385 - DNA, 53 bp, Artificial Sequence
  Description of Artificial Sequence: Synthetic probe
accactaccgttgagaactacggaggagagacgcaagtccaacgtcgtcacca

SEQ ID NO: 8386 - DNA, 60 bp, Artificial Sequence
  Description of Artificial Sequence: Synthetic probe
cactgacgttgccttcgttcttgacaggtttgtgaaactcactgcacccaagaacactca

SEQ ID NO: 8387 - DNA, 60 bp, Artificial Sequence
  Description of Artificial Sequence: Synthetic probe
cccgggcacaaaactgacatgaaagggaactctgagcccggtcgtacccggggacaaaca

SEQ ID NO: 8388 - DNA, 60 bp, Artificial Sequence
  Description of Artificial Sequence: Synthetic probe
tccccgggcacaaaactgacatgaaagggaactctgagcccggtcgtacccggggacaaa

SEQ ID NO: 8389 - DNA, 60 bp, Artificial Sequence
  Description of Artificial Sequence: Synthetic probe
gggagtcgacaaacccactgttgggcttccgtgagagaaagctccccgggcacaaaactg

SEQ ID NO: 8390 - DNA, 60 bp, Artificial Sequence
  Description of Artificial Sequence: Synthetic probe
ccctaagagggagtcgacaaacccactgttgggcttccgtgagagaaagctccccgggca

SEQ ID NO: 8391 - DNA, 60 bp, Artificial Sequence
  Description of Artificial Sequence: Synthetic probe
gcgccagaagatggtcgacgacgccctcgatgaatacattgagaaggcgaacatcaccac

SEQ ID NO: 8392 - DNA, 60 bp, Artificial Sequence
  Description of Artificial Sequence: Synthetic probe
actcgcaagcgccagaagatggtcgacgacgccctcgatgaatacattgagaaggcgaac

SEQ ID NO: 8393 - DNA, 60 bp, Artificial Sequence
  Description of Artificial Sequence: Synthetic probe
tgctgttggcaaacattatcatcatgatccgcgagactcgcaagcgccagaagatggtcg

SEQ ID NO: 8394 - DNA, 60 bp, Artificial Sequence
  Description of Artificial Sequence: Synthetic probe
ttgctctcgttgttgtgctgttggcaaacattatcatcatgatccgcgagactcgcaagc

SEQ ID NO: 8395 - DNA, 60 bp, Artificial Sequence
  Description of Artificial Sequence: Synthetic probe
gcttcgccaagcgtgctttcaagcgccttaaggagaacttcgagatcgttgctctcgttg

SEQ ID NO: 8396 - DNA, 60 bp, Artificial Sequence
  Description of Artificial Sequence: Synthetic probe
cagcttcgccaagcgtgctttcaagcgccttaaggagaacttcgagatcgttgctctcgt

SEQ ID NO: 8397 - DNA, 60 bp, Artificial Sequence
  Description of Artificial Sequence: Synthetic probe
atacgggctacgaacatccacgagcttctcgtgcgcatgaagcgtgccgagctctactgc

SEQ ID NO: 8398 - DNA, 60 bp, Artificial Sequence
  Description of Artificial Sequence: Synthetic probe
tacgaccaggaacccctggacgtagactggcaggaccgagctggcctgttcctccgtgga

SEQ ID NO: 8399 - DNA, 60 bp, Artificial Sequence
  Description of Artificial Sequence: Synthetic probe
cctacgaccaggaacccctggacgtagactggcaggaccgagctggcctgttcctccgtg

SEQ ID NO: 8400 - DNA, 60 bp, Artificial Sequence
  Description of Artificial Sequence: Synthetic probe
tctacccatggacacccgaccctgagaatgtgctcgcgtacgttccctacgaccaggaac

SEQ ID NO: 8401 - DNA, 60 bp, Artificial Sequence
  Description of Artificial Sequence: Synthetic probe
ggtgttctacccatggacacccgaccctgagaatgtgctcgcgtacgttccctacgacca

SEQ ID NO: 8402 - DNA, 60 bp, Artificial Sequence
  Description of Artificial Sequence: Synthetic probe
cgccctcaacacatctgagggctggtatgccatagatgatgaggtgttctacccatggac

SEQ ID NO: 8403 - DNA, 60 bp, Artificial Sequence
  Description of Artificial Sequence: Synthetic probe
gccgtgttcgccctcaacacatctgagggctggtatgccatagatgatgaggtgttctac

SEQ ID NO: 8404 - DNA, 60 bp, Artificial Sequence
  Description of Artificial Sequence: Synthetic probe
tgaccctggctgacttccacgccggtatcttcatcaaaggcaccgaacacgccgtgttcg

SEQ ID NO: 8405 - DNA, 58 bp, Artificial Sequence
  Description of Artificial Sequence: Synthetic probe
tgaccctggctgacttccacgccggtatcttcatcaaaggcaccgaacacgccgtgtt

SEQ ID NO: 8406 - DNA, 60 bp, Artificial Sequence
  Description of Artificial Sequence: Synthetic probe
tcgccctagcgagatctgtgtgatcaacggggttgtcatgaccctggctgacttccacgc

SEQ ID NO: 8407 - DNA, 60 bp, Artificial Sequence
  Description of Artificial Sequence: Synthetic probe
ttgtgctctggctcatcaaggactgcttgcaaaccggtgtcggcaccagcactcgcccta

SEQ ID NO: 8408 - DNA, 60 bp, Artificial Sequence
  Description of Artificial Sequence: Synthetic probe
ccaccggcacttgtgctctggctcatcaaggactgcttgcaaaccggtgtcggcaccagc

SEQ ID NO: 8409 - DNA, 60 bp, Artificial Sequence
  Description of Artificial Sequence: Synthetic probe
ctgattacaccaaacttgatctttcagacggtggaccaccggcacttgtgctctggctca

SEQ ID NO: 8410 - DNA, 60 bp, Artificial Sequence
  Description of Artificial Sequence: Synthetic probe
ggctgttttgacgttttgatcgaaatcgctcatagactcagacaactcaacaagacagac

SEQ ID NO: 8411 - DNA, 60 bp, Artificial Sequence
  Description of Artificial Sequence: Synthetic probe
atgaagacaactggctgttttgacgttttgatcgaaatcgctcatagactcagacaactc

SEQ ID NO: 8412 - DNA, 60 bp, Artificial Sequence
  Description of Artificial Sequence: Synthetic probe
cgtcttctccagaaacggaaccacccgcttcgcagtgccctacaccgctccacacaggtg

SEQ ID NO: 8413 - DNA, 60 bp, Artificial Sequence
  Description of Artificial Sequence: Synthetic probe
aaaagtatgacaagatcatgattgacggcagagccatgacagaccgtgatttcagagtgt

SEQ ID NO: 8414 - DNA, 60 bp, Artificial Sequence
  Description of Artificial Sequence: Synthetic probe
agaagtatgacaagatcatgattgacggcagagccatgacggaccgtgacttcagagtgt

SEQ ID NO: 8415 - DNA, 60 bp, Artificial Sequence
  Description of Artificial Sequence: Synthetic probe
gtgttcgcccacaacggcgttaccaggtttgccataccctacactgcaccacaccggttg

SEQ ID NO: 8416 - DNA, 60 bp, Artificial Sequence
  Description of Artificial Sequence: Synthetic probe
tactggcagcctaacggcgcgccacgcacaacagttttgggagacaaccccatggtgttc

SEQ ID NO: 8417 - DNA, 60 bp, Artificial Sequence
  Description of Artificial Sequence: Synthetic probe
gtggacctgatggacactaaacagcaagccttagtgggtgccctcctcagggcgtcaacc

SEQ ID NO: 8418 - DNA, 60 bp, Artificial Sequence
  Description of Artificial Sequence: Synthetic probe
tcgtgcttgacagattcacccatgttcacaccaacaagaccactttcaatgtggacctga

SEQ ID NO: 8419 - DNA, 60 bp, Artificial Sequence
  Description of Artificial Sequence: Synthetic probe
accactagcgccggagagggagcggacgtcgtcacgactgacccctcgacgcacggcgga

SEQ ID NO: 8420 - DNA, 60 bp, Artificial Sequence
  Description of Artificial Sequence: Synthetic probe
gacacgagctcccgtctaccttcaacttcggttatgtgaccgccgacaagccagtcgacg

SEQ ID NO: 8421 - DNA, 60 bp, Artificial Sequence
  Description of Artificial Sequence: Synthetic probe
caccagacacgagctcccgtctaccttcaacttcggttacgtgaccgccgacaagccagt

SEQ ID NO: 8422 - DNA, 60 bp, Artificial Sequence
  Description of Artificial Sequence: Synthetic probe
caccagacacgagctcccgtctaccttcaacttcggttatgtgaccgccgacaagccagt

SEQ ID NO: 8423 - DNA, 60 bp, Artificial Sequence
  Description of Artificial Sequence: Synthetic probe
aacaacttttcaactttgacctgctcaaggtggcaggagacgtcgagtccaaccctgggc

SEQ ID NO: 8424 - DNA, 60 bp, Artificial Sequence
  Description of Artificial Sequence: Synthetic probe
cgagcattcaagagcttctcgtgcgcatgaagcgtgccgagctttactgccccagaccac

SEQ ID NO: 8425 - DNA, 60 bp, Artificial Sequence
  Description of Artificial Sequence: Synthetic probe
tgaacaagtactccgcagcgagcggcggtagacggggtgacctagggtctcttgcggcac

SEQ ID NO: 8426 - DNA, 60 bp, Artificial Sequence
  Description of Artificial Sequence: Synthetic probe
caacatgagcaaccccactgcctaccccaagcaaccgttcacgagacttgcgctccccta

SEQ ID NO: 8427 - DNA, 60 bp, Artificial Sequence
  Description of Artificial Sequence: Synthetic probe
ggcttcataatggacagatttgtaaaaattaaccccgtgacccccacacatgtcattgac

SEQ ID NO: 8428 - DNA, 60 bp, Artificial Sequence
  Description of Artificial Sequence: Synthetic probe
atttaccaaattacacacgggaaagctgagcaagacactctagtcgtatcggttagcgcc

SEQ ID NO: 8429 - DNA, 60 bp, Artificial Sequence
  Description of Artificial Sequence: Synthetic probe
acagaggctgagtgggcaactgcccacctctttcaactacggcgctgtgaaggctgacac

SEQ ID NO: 8430 - DNA, 52 bp, Artificial Sequence
  Description of Artificial Sequence: Synthetic probe
gcccctgaagcagctttgtcaaacaccagcaaccccactgcctacaacaagg

SEQ ID NO: 8431 - DNA, 59 bp, Artificial Sequence
  Description of Artificial Sequence: Synthetic probe
caacggtgcccctgaagcagctttgtcaaacaccagcaaccccactgcctacaacaagg

SEQ ID NO: 8432 - DNA, 60 bp, Artificial Sequence
  Description of Artificial Sequence: Synthetic probe
acgtactacttctcagacctggaggttgcgcttgtacacacaggcccagccacctgggtg

SEQ ID NO: 8433 - DNA, 60 bp, Artificial Sequence
  Description of Artificial Sequence: Synthetic probe
ggatctacaccgaggcggaagccgacgtgtatgtgaggatgaagcgggcggagctttact

SEQ ID NO: 8434 - DNA, 60 bp, Artificial Sequence
  Description of Artificial Sequence: Synthetic probe
cgcgacgctcgcagagcacatcgcagcagaagcacgcattccaaccactttcaactatgg

SEQ ID NO: 8435 - DNA, 60 bp, Artificial Sequence
  Description of Artificial Sequence: Synthetic probe
tctcgcgacgctcgcagagcacatcgcagcagaagcacgcattccaaccactttcaacta

SEQ ID NO: 8436 - DNA, 60 bp, Artificial Sequence
  Description of Artificial Sequence: Synthetic probe
aacaagtgggtcggctggactccgaacggagcgccagagttgaatgaggtgggcgacaac

SEQ ID NO: 8437 - DNA, 60 bp, Artificial Sequence
  Description of Artificial Sequence: Synthetic probe
gttggcacgaacaagtgggtcggctggactccgaacggagcgccagagttgaatgaggtg

SEQ ID NO: 8438 - DNA, 51 bp, Artificial Sequence
  Description of Artificial Sequence: Synthetic probe
caggaacccctggacgtggattggcaggaccgcgctggtctgttcctccgc

SEQ ID NO: 8439 - DNA, 60 bp, Artificial Sequence
  Description of Artificial Sequence: Synthetic probe
accctgagaacgtgctcgcgtacgtcccttacgaccaggaacccctggacgtggattggc

SEQ ID NO: 8440 - DNA, 60 bp, Artificial Sequence
  Description of Artificial Sequence: Synthetic probe
tcggcaccagcactcgccctagtgagatctgtgtgatcaacggggtcgtcatgaccctgg

SEQ ID NO: 8441 - DNA, 60 bp, Artificial Sequence
  Description of Artificial Sequence: Synthetic probe
tctgattacactaaattggacttgtcggacggtgggccacctgccctcgtcctctggctg

SEQ ID NO: 8442 - DNA, 60 bp, Artificial Sequence
  Description of Artificial Sequence: Synthetic probe
atgatcaaacaactttctgattacactaaattggacttgtcggacggtgggccacctgcc

SEQ ID NO: 8443 - DNA, 60 bp, Artificial Sequence
  Description of Artificial Sequence: Synthetic probe
cggagaaaagaagaccttctacagtagacccaacaaacacgggaactgctggctcaattc

SEQ ID NO: 8444 - DNA, 60 bp, Artificial Sequence
  Description of Artificial Sequence: Synthetic probe
catgttggacggccgcgccctgacagacagtgacttcagagtgtttgagtttgaggtgaa

SEQ ID NO: 8445 - DNA, 60 bp, Artificial Sequence
  Description of Artificial Sequence: Synthetic probe
gatcatgttggacggccgcgccctgacagacagtgacttcagagtgtttgagtttgaggt

SEQ ID NO: 8446 - DNA, 60 bp, Artificial Sequence
  Description of Artificial Sequence: Synthetic probe
cctctttcaactacggcgctgtaaaggctgacaccatcactgagcttttgattcgcatga

SEQ ID NO: 8447 - DNA, 60 bp, Artificial Sequence
  Description of Artificial Sequence: Synthetic probe
tcgtgtgagagatatcacgaagcactttcgtgacacagcaaggatgaagaagggtacccc

SEQ ID NO: 8448 - DNA, 60 bp, Artificial Sequence
  Description of Artificial Sequence: Synthetic probe
ccgtgggaatcgtgtgagagatatcacgaagcactttcgtgacacagcaaggatgaagaa

SEQ ID NO: 8449 - DNA, 60 bp, Artificial Sequence
  Description of Artificial Sequence: Synthetic probe
ctgttgtgctaccggagtgtttggcactgcttacctcgtaccgcgtcatcttttcgcgga

SEQ ID NO: 8450 - DNA, 60 bp, Artificial Sequence
  Description of Artificial Sequence: Synthetic probe
cccttggacgccggacccgtccgacgtcctggtgttcgtcccgtacgatcaagaaccact

SEQ ID NO: 8451 - DNA, 60 bp, Artificial Sequence
  Description of Artificial Sequence: Synthetic probe
gacggcagggccatgacagaccgtgacttcagagtgtttgagtttgagattaaagtaaaa

SEQ ID NO: 8452 - DNA, 60 bp, Artificial Sequence
  Description of Artificial Sequence: Synthetic probe
gacggcagagccatgacagaccgtgacttcagagtgtttgagtttgagattaaagtaaaa

SEQ ID NO: 8453 - DNA, 60 bp, Artificial Sequence
  Description of Artificial Sequence: Synthetic probe
tcatgattgacggcagggccataacagaccgtgacttcagagtgtttgagtttgagatca

SEQ ID NO: 8454 - DNA, 60 bp, Artificial Sequence
  Description of Artificial Sequence: Synthetic probe
gatcatgattgatggcagagctatgacagaccgtgacttcagagtgtttgagtttgagat

SEQ ID NO: 8455 - DNA, 60 bp, Artificial Sequence
  Description of Artificial Sequence: Synthetic probe
gatcatgattgacggcagagccatgacggaccgtgacttcagagtgtttgagtttgagat

SEQ ID NO: 8456 - DNA, 60 bp, Artificial Sequence
  Description of Artificial Sequence: Synthetic probe
atcttttcgctgagaagtatgacaagatcatgattgacggcagggccatgacagaccgtg

SEQ ID NO: 8457 - DNA, 60 bp, Artificial Sequence
  Description of Artificial Sequence: Synthetic probe
atctcgtgcctcgtcatcttttcgctgagaagtatgacaagatcatgattgacggcaggg

SEQ ID NO: 8458 - DNA, 60 bp, Artificial Sequence
  Description of Artificial Sequence: Synthetic probe
atgaaacgcgcggagctttattgccctaggcccattcttccattccagcctacgggtgac

SEQ ID NO: 8459 - DNA, 60 bp, Artificial Sequence
  Description of Artificial Sequence: Synthetic probe
cgcatgaaacgcgcggagctttattgccctaggcccatccttccactccagcctacgggt

SEQ ID NO: 8460 - DNA, 60 bp, Artificial Sequence
  Description of Artificial Sequence: Synthetic probe
gcgcatgaaacgcgcggagctttattgccctaggcccatccttccactccagcttacggg

SEQ ID NO: 8461 - DNA, 60 bp, Artificial Sequence
  Description of Artificial Sequence: Synthetic probe
gcgcatgaaacgcgcggagctttattgccctaggcccatccttccattccagcctacggg

SEQ ID NO: 8462 - DNA, 60 bp, Artificial Sequence
  Description of Artificial Sequence: Synthetic probe
gcgcatgaaacgcgcggagctttattgccctaggcccattcttccattccagcctacggg

SEQ ID NO: 8463 - DNA, 60 bp, Artificial Sequence
  Description of Artificial Sequence: Synthetic probe
gcgcatgaaacgcgcggagctttattgccctaggcccatctttcctatccagcttacggg

SEQ ID NO: 8464 - DNA, 60 bp, Artificial Sequence
  Description of Artificial Sequence: Synthetic probe
aagtactcaacgggtgtctcgcccaggcgaggtgacctcggggcccttgcggcaagagtc

SEQ ID NO: 8465 - DNA, 60 bp, Artificial Sequence
  Description of Artificial Sequence: Synthetic probe
acgggacgagcaagtactcaacgggtgtctcgcccaggcgaggtgacctcggggcccttg

SEQ ID NO: 8466 - DNA, 52 bp, Artificial Sequence
  Description of Artificial Sequence: Synthetic probe
ccaacacgggctggtcggcgcgttgttgcgctcagctacctactacttctct

SEQ ID NO: 8467 - DNA, 60 bp, Artificial Sequence
  Description of Artificial Sequence: Synthetic probe
cctactcccacacatgtcatagatctcatgcaaactcaccaacacgggctggtcggcgcg

SEQ ID NO: 8468 - DNA, 60 bp, Artificial Sequence
  Description of Artificial Sequence: Synthetic probe
aaagtggaacgccctactcccacacatgtcatagatctcatgcaaactcaccaacacggg

SEQ ID NO: 8469 - DNA, 60 bp, Artificial Sequence
  Description of Artificial Sequence: Synthetic probe
gcggcaccacacggatgtcggtttcataatggatagatttgtgaaagtggaacgccctac

SEQ ID NO: 8470 - DNA, 60 bp, Artificial Sequence
  Description of Artificial Sequence: Synthetic probe
tccaaaggcggcaccacacggatgtcggtttcataatggatagatttgtgaaagtggaac

SEQ ID NO: 8471 - DNA, 60 bp, Artificial Sequence
  Description of Artificial Sequence: Synthetic probe
gacaggttcacacatgtccacacgaacaagaccaccttcaacgtggacctcatggacacc

SEQ ID NO: 8472 - DNA, 60 bp, Artificial Sequence
  Description of Artificial Sequence: Synthetic probe
tcgtgctcgacaggttcacacatgtccacacgaacaagaccaccttcaacgtggacctca

SEQ ID NO: 8473 - DNA, 60 bp, Artificial Sequence
  Description of Artificial Sequence: Synthetic probe
gctgttggcagtagaggtgtcttcgcaagacaggcacaagcaaaagatcattgcaccagc

SEQ ID NO: 8474 - DNA, 60 bp, Artificial Sequence
  Description of Artificial Sequence: Synthetic probe
cctgcttcattcaactacggtgcaatcaaggccgagaccatccacgagcttctcgtgcgc

SEQ ID NO: 8475 - DNA, 60 bp, Artificial Sequence
  Description of Artificial Sequence: Synthetic probe
aaacaacttcctgcttcattcaactacggtgcaatcaaggccgagaccatccacgagctt

SEQ ID NO: 8476 - DNA, 56 bp, Artificial Sequence
  Description of Artificial Sequence: Synthetic probe
cgtgtgttggcaacagtgtacaacggggtgagtaagtatgctgtgggcggttcagg

SEQ ID NO: 8477 - DNA, 60 bp, Artificial Sequence
  Description of Artificial Sequence: Synthetic probe
acaacaaggcaccgttcacgagactcgctctcccctacactgcgccacaccgtgtgttgg

SEQ ID NO: 8478 - DNA, 60 bp, Artificial Sequence
  Description of Artificial Sequence: Synthetic probe
gttgtacggcacgatggcaatctgacctgggtacccaacggtgcccctgaatcagccttg

SEQ ID NO: 8479 - DNA, 60 bp, Artificial Sequence
  Description of Artificial Sequence: Synthetic probe
tctgacctggaaattgttgtacggcacgatggcaatctgacctgggtacccaacggtgcc

SEQ ID NO: 8480 - DNA, 60 bp, Artificial Sequence
  Description of Artificial Sequence: Synthetic probe
ccagaacggtctggtgggtgccttgctgcgtgcagccacgtactacttttctgacctgga

SEQ ID NO: 8481 - DNA, 60 bp, Artificial Sequence
  Description of Artificial Sequence: Synthetic probe
caaaagtttgagcccgacacacgtcattgacctcatgcagactcaccagaacggtctggt

SEQ ID NO: 8482 - DNA, 60 bp, Artificial Sequence
  Description of Artificial Sequence: Synthetic probe
gaaaatcaaaagtttgagcccgacacacgtcattgacctcatgcagactcaccagaacgg

SEQ ID NO: 8483 - DNA, 55 bp, Artificial Sequence
  Description of Artificial Sequence: Synthetic probe
agaactacggcggtgagacacaaatccagagacgtcaccacacggacgttggttt

SEQ ID NO: 8484 - DNA, 60 bp, Artificial Sequence
  Description of Artificial Sequence: Synthetic probe
ccggcgttctgtgctttgtcccgtacgatatggaaccgttcaacggagacgcggtggtga

SEQ ID NO: 8485 - DNA, 56 bp, Artificial Sequence
  Description of Artificial Sequence: Synthetic probe
atggtacgccattgacgatgaggacttctacccgtggacgccggatccgtccggcg

SEQ ID NO: 8486 - DNA, 60 bp, Artificial Sequence
  Description of Artificial Sequence: Synthetic probe
atggtacgccattgacgatgaggacttctacccgtggacgccggatccgtccggcgttct

SEQ ID NO: 8487 - DNA, 59 bp, Artificial Sequence
  Description of Artificial Sequence: Synthetic probe
aacacgccgtgttcgcctgtctgacttctgacggatggtacgccattgacgatgaggac

SEQ ID NO: 8488 - DNA, 60 bp, Artificial Sequence
  Description of Artificial Sequence: Synthetic probe
ttccccaaaggtactgaacacgccgtgttcgcctgtctgacttctgacggatggtacgcc

SEQ ID NO: 8489 - DNA, 60 bp, Artificial Sequence
  Description of Artificial Sequence: Synthetic probe
cggggatgtgtcttgctgacttccacgcaggaatcttccccaaaggtactgaacacgccg

SEQ ID NO: 8490 - DNA, 60 bp, Artificial Sequence
  Description of Artificial Sequence: Synthetic probe
tgctccacaccggaatcggcaccgcttcacggcctagtgaagtgtgcatggttgacggta

SEQ ID NO: 8491 - DNA, 60 bp, Artificial Sequence
  Description of Artificial Sequence: Synthetic probe
acacctgctccacaccggaatcggcaccgcttcacggcctagtgaagtgtgcatggttga

SEQ ID NO: 8492 - DNA, 60 bp, Artificial Sequence
  Description of Artificial Sequence: Synthetic probe
agggcggcccgcctgccctcgtgatttggaacatcaaacacctgctccacaccggaatcg

SEQ ID NO: 8493 - DNA, 57 bp, Artificial Sequence
  Description of Artificial Sequence: Synthetic probe
ttcttcgactgggtttacaactcgcccaagaagctcacgcttcaggcaattgaacag

SEQ ID NO: 8494 - DNA, 60 bp, Artificial Sequence
  Description of Artificial Sequence: Synthetic probe
gctggctcaacaccatcttgcagttgttccggtatgtcgatgagcctttcttcgactggg

SEQ ID NO: 8495 - DNA, 60 bp, Artificial Sequence
  Description of Artificial Sequence: Synthetic probe
actgctggctcaacaccatcttgcagttgttccggtatgtcgatgagcctttcttcgact

SEQ ID NO: 8496 - DNA, 60 bp, Artificial Sequence
  Description of Artificial Sequence: Synthetic probe
actgactgttttaccgctttggcacaggctatcagagagatcagacaactgttcaaatca

SEQ ID NO: 8497 - DNA, 60 bp, Artificial Sequence
  Description of Artificial Sequence: Synthetic probe
atgaatacaactgactgttttaccgctttggcacaggctatcagagagatcagacaactg

SEQ ID NO: 8498 - DNA, 60 bp, Artificial Sequence
  Description of Artificial Sequence: Synthetic probe
tcaacttcggttacgtgaccgccgacaaaccagtcgacgtttactaccggatgaagagag

SEQ ID NO: 8499 - DNA, 60 bp, Artificial Sequence
  Description of Artificial Sequence: Synthetic probe
tcaacttcggctacgtgaccgccgacaaaccagtcgacgtttactaccggatgaagagag

SEQ ID NO: 8500 - DNA, 60 bp, Artificial Sequence
  Description of Artificial Sequence: Synthetic probe
cttcaacttcggctacgtgaccgccgacaaaccagtcgacgtttactaccggatgaagag

SEQ ID NO: 8501 - DNA, 60 bp, Artificial Sequence
  Description of Artificial Sequence: Synthetic probe
cggttcaccctggttgggaaaactgtggacaacaaattgacactggacctgctccagacc

SEQ ID NO: 8502 - DNA, 60 bp, Artificial Sequence
  Description of Artificial Sequence: Synthetic probe
tcatactcgaccggttcaccctggttgggaaaactgtggacaacaaattgacactggacc

SEQ ID NO: 8503 - DNA, 60 bp, Artificial Sequence
  Description of Artificial Sequence: Synthetic probe
ccgcaccgctcgcaggcaccacactgacgtctcgttcatactcgaccggttcaccctggt

SEQ ID NO: 8504 - DNA, 60 bp, Artificial Sequence
  Description of Artificial Sequence: Synthetic probe
gcacggtggtggacgccgcaccgctcgcaggcaccacactgacgtctcgttcatactcga

SEQ ID NO: 8505 - DNA, 60 bp, Artificial Sequence
  Description of Artificial Sequence: Synthetic probe
gagggcgcggagcccgtaaccaccgacgcatcacagcacggtggtggacgccgcaccgct

SEQ ID NO: 8506 - DNA, 60 bp, Artificial Sequence
  Description of Artificial Sequence: Synthetic probe
accacatcggcgggtgagggcgcggagcccgtaaccaccgacgcatcacagcacggtggt

SEQ ID NO: 8507 - DNA, 59 bp, Artificial Sequence
  Description of Artificial Sequence: Synthetic probe
ttcccaggtccatgcttttgaagatgaaggcacacattgaccctgaaccacaccacgag

SEQ ID NO: 8508 - DNA, 60 bp, Artificial Sequence
  Description of Artificial Sequence: Synthetic probe
aacgtactacttctcagacctggaggttgcgcttgtccacacgggcccagccacctgggt

SEQ ID NO: 8509 - DNA, 60 bp, Artificial Sequence
  Description of Artificial Sequence: Synthetic probe
gcaggccgaggtcgatgtgtatgtcaggatgaaacgcgcagaactctattgcccgcgacc

SEQ ID NO: 8510 - DNA, 60 bp, Artificial Sequence
  Description of Artificial Sequence: Synthetic probe
ggatctacacgcaggccgaggtcgatgtgtatgtcaggatgaaacgcgcagaactctatt

SEQ ID NO: 8511 - DNA, 60 bp, Artificial Sequence
  Description of Artificial Sequence: Synthetic probe
gcgagacccacattccaacaaccttcaactatggcaggatctacacgcaggccgaggtcg

SEQ ID NO: 8512 - DNA, 60 bp, Artificial Sequence
  Description of Artificial Sequence: Synthetic probe
ggggaggattgcaagcgagacccacattccaacaaccttcaactatggcaggatctacac

SEQ ID NO: 8513 - DNA, 60 bp, Artificial Sequence
  Description of Artificial Sequence: Synthetic probe
cgcgagaacatccgcggggacctcgcagctcttgcggggaggattgcaagcgagacccac

SEQ ID NO: 8514 - DNA, 60 bp, Artificial Sequence
  Description of Artificial Sequence: Synthetic probe
gctggcacagccccgcgcgagaacatccgcggggacctcgcagctcttgcggggaggatt

SEQ ID NO: 8515 - DNA, 60 bp, Artificial Sequence
  Description of Artificial Sequence: Synthetic probe
caaaaccacccgctttgcactgccctacactgccccacacaggtgtttggcaacgtcata

SEQ ID NO: 8516 - DNA, 60 bp, Artificial Sequence
  Description of Artificial Sequence: Synthetic probe
cgtcttctcgaaaaacaaaaccacccgctttgcactgccctacactgccccacacaggtg

SEQ ID NO: 8517 - DNA, 60 bp, Artificial Sequence
  Description of Artificial Sequence: Synthetic probe
ggactcccaacggagctccagagcttgacgaggtgggtgacaatccagtcgtcttctcga

SEQ ID NO: 8518 - DNA, 60 bp, Artificial Sequence
  Description of Artificial Sequence: Synthetic probe
tggactcccaacggagctccagagcttgacgaggtgggtgacaatccagtcgtcttctcg

SEQ ID NO: 8519 - DNA, 60 bp, Artificial Sequence
  Description of Artificial Sequence: Synthetic probe
tgttgtgcagcacgatggcaacctgacttgggtacccaacggtgcccctgaatcggcctt

SEQ ID NO: 8520 - DNA, 60 bp, Artificial Sequence
  Description of Artificial Sequence: Synthetic probe
aattgttgtgcagcacgatggcaacctgacttgggtacccaacggtgcccctgaatcggc

SEQ ID NO: 8521 - DNA, 60 bp, Artificial Sequence
  Description of Artificial Sequence: Synthetic probe
cgctttgcactgccctacaccgcgccacacagatgcctggcgacatcttacaacggtgat

SEQ ID NO: 8522 - DNA, 60 bp, Artificial Sequence
  Description of Artificial Sequence: Synthetic probe
tgtcatttggaacatcaagcacctgctccacaccggaatcggcactgcctcgcgacccag

SEQ ID NO: 8523 - DNA, 60 bp, Artificial Sequence
  Description of Artificial Sequence: Synthetic probe
aaggctgacaccattactgagcttttgatccgcatgaaacgcgcggagacatactgccct

SEQ ID NO: 8524 - DNA, 60 bp, Artificial Sequence
  Description of Artificial Sequence: Synthetic probe
gactaaactggtatcacctgaaaagcaactgtgcaatttcgacctgttaaagttggccgg

SEQ ID NO: 8525 - DNA, 60 bp, Artificial Sequence
  Description of Artificial Sequence: Synthetic probe
attagagccacgaccatccacgagcttctcgtgcgcatgaagcgggccgagctctactgt

SEQ ID NO: 8526 - DNA, 60 bp, Artificial Sequence
  Description of Artificial Sequence: Synthetic probe
ccacaccgtgtgttggccacagtgtacaacgggacgaacaagtacgctgcaaccggtgct

SEQ ID NO: 8527 - DNA, 60 bp, Artificial Sequence
  Description of Artificial Sequence: Synthetic probe
gccacaccgtgtgttggccacagtgtacaacgggacgaacaagtacgctgtaaccggtgc

SEQ ID NO: 8528 - DNA, 60 bp, Artificial Sequence
  Description of Artificial Sequence: Synthetic probe
tacaagcaaccccactgcctaccacagggaaccatttacgaggctcgcgctcccctacac

SEQ ID NO: 8529 - DNA, 56 bp, Artificial Sequence
  Description of Artificial Sequence: Synthetic probe
tggagattgtggtacgccatgaaggcaacctgacgtgggtgcctaacggagcaccc

SEQ ID NO: 8530 - DNA, 60 bp, Artificial Sequence
  Description of Artificial Sequence: Synthetic probe
tgacctggagattgtggtacgccatgaaggcaacctgacgtgggtgcctaacggagcacc

SEQ ID NO: 8531 - DNA, 60 bp, Artificial Sequence
  Description of Artificial Sequence: Synthetic probe
ctgacctggagattgtggtacgccatgaaggcaacctgacgtgggtgcctaacggagcac

SEQ ID NO: 8532 - DNA, 60 bp, Artificial Sequence
  Description of Artificial Sequence: Synthetic probe
cgcgttggtaggcgctctgttgcgtgcggctacgtactacttctctgacctggagattgt

SEQ ID NO: 8533 - DNA, 60 bp, Artificial Sequence
  Description of Artificial Sequence: Synthetic probe
caacacgcgttggtaggcgctctgttgcgtgcggctacgtactacttctctgacctggag

SEQ ID NO: 8534 - DNA, 60 bp, Artificial Sequence
  Description of Artificial Sequence: Synthetic probe
caacgagcgttggtaggcgctctgttgcgtgcggctacgtactacttctctgacctggag

SEQ ID NO: 8535 - DNA, 60 bp, Artificial Sequence
  Description of Artificial Sequence: Synthetic probe
ccaacacgcgttggtaggcgctctgttgcgtgcggctacgtactacttctctgacctgga

SEQ ID NO: 8536 - DNA, 54 bp, Artificial Sequence
  Description of Artificial Sequence: Synthetic probe
aagggtctggatcgctacaaaaccgcgataaccaaacctgtcaaacaactgtgc

SEQ ID NO: 8537 - DNA, 60 bp, Artificial Sequence
  Description of Artificial Sequence: Synthetic probe
ccccgcgtgttggcaaccgtgggtgagtgcaggtacagcagaaatgctcccaacgtgaga

SEQ ID NO: 8538 - DNA, 60 bp, Artificial Sequence
  Description of Artificial Sequence: Synthetic probe
gagtccaaccctgggcccttcttcttctccgacgtcaggacaaacttctccaagctggta

SEQ ID NO: 8539 - DNA, 58 bp, Artificial Sequence
  Description of Artificial Sequence: Synthetic probe
ccccactcacgtcattgacctcatgcaaacccaccagcactcgctggttggcgccctg

SEQ ID NO: 8540 - DNA, 60 bp, Artificial Sequence
  Description of Artificial Sequence: Synthetic probe
ttagccctacaacccctactcacgtcattgacctcatgcaaacccaccagcactcgctgg

SEQ ID NO: 8541 - DNA, 57 bp, Artificial Sequence
  Description of Artificial Sequence: Synthetic probe
ccccggccgcaaactaccaccaccggggaatctgcagaccctgtcaccaccaccgtc

SEQ ID NO: 8542 - DNA, 60 bp, Artificial Sequence
  Description of Artificial Sequence: Synthetic probe
tgacccccggccgcaaactaccaccgccggggaatctgcagaccctgtcaccaccaccgt

SEQ ID NO: 8543 - DNA, 60 bp, Artificial Sequence
  Description of Artificial Sequence: Synthetic probe
ttgcgcctcccgattgacccccggccgcaaactaccaccgccggggaatctgcagaccct

SEQ ID NO: 8544 - DNA, 60 bp, Artificial Sequence
  Description of Artificial Sequence: Synthetic probe
ctattggcaatagaggtgtcttcacaagacaggcacaagcaaaagatcattgcacctgca

SEQ ID NO: 8545 - DNA, 58 bp, Artificial Sequence
  Description of Artificial Sequence: Synthetic probe
actattggcaatagaggtgtcttcacaagacaggcacaagcaaaagatcattgcaccc

SEQ ID NO: 8546 - DNA, 60 bp, Artificial Sequence
  Description of Artificial Sequence: Synthetic probe
ggccactattggcaatagaggtgtcttcacaagacaggcacaagcaaaagatcattgcac

SEQ ID NO: 8547 - DNA, 60 bp, Artificial Sequence
  Description of Artificial Sequence: Synthetic probe
gcgtacgaccaccagtcacgcgacaggtttgacgcacctattggggtagagaaacaacta

SEQ ID NO: 8548 - DNA, 60 bp, Artificial Sequence
  Description of Artificial Sequence: Synthetic probe
atgaagagggcggagctctactgccccaggccgctcttgcctgcgtacgaccaccagtca

SEQ ID NO: 8549 - DNA, 60 bp, Artificial Sequence
  Description of Artificial Sequence: Synthetic probe
tgcaaacccgcgacggaagcacactgacgtgggctttctcttggacaggtccacccatgt

SEQ ID NO: 8550 - DNA, 60 bp, Artificial Sequence
  Description of Artificial Sequence: Synthetic probe
acacggtggggccgttgcaaacccgcgacggaagcacactgacgtgggctttctcttgga

SEQ ID NO: 8551 - DNA, 60 bp, Artificial Sequence
  Description of Artificial Sequence: Synthetic probe
ggctgacaacatcactgagcttttgatccgcatgaaacgcgcggagacatactgccctag

SEQ ID NO: 8552 - DNA, 60 bp, Artificial Sequence
  Description of Artificial Sequence: Synthetic probe
gcgtacgggacggagaccccaaggcgcggtgatcttgcggccattgcacaaagggtgaac

SEQ ID NO: 8553 - DNA, 60 bp, Artificial Sequence
  Description of Artificial Sequence: Synthetic probe
gagtctgcagaccctgtcaccaccaccgttgagaactacggcggcgagacacaggcacag

SEQ ID NO: 8554 - DNA, 60 bp, Artificial Sequence
  Description of Artificial Sequence: Synthetic probe
tagcgagtgatgacgtgaactccgagcccgctaagaccatggaggagcaaccacaagctg

SEQ ID NO: 8555 - DNA, 60 bp, Artificial Sequence
  Description of Artificial Sequence: Synthetic probe
gaggaactccggcccctcatccaacagacctcatttgtgaaacgcgccttcaagcgcctg

SEQ ID NO: 8556 - DNA, 60 bp, Artificial Sequence
  Description of Artificial Sequence: Synthetic probe
gaggaactccggcctctcattcaacagacctcatttgtgaaacgcgccttcaagcgcttg

SEQ ID NO: 8557 - DNA, 60 bp, Artificial Sequence
  Description of Artificial Sequence: Synthetic probe
caaggaggaactccggcctctcattcaacagacctcatttgtgaaacgcgccttcaagcg

SEQ ID NO: 8558 - DNA, 60 bp, Artificial Sequence
  Description of Artificial Sequence: Synthetic probe
tcaaggaggaactccggcccctcatccaacagacctcatttgtgaaacgcgccttcaagc

SEQ ID NO: 8559 - DNA, 60 bp, Artificial Sequence
  Description of Artificial Sequence: Synthetic probe
ttgacgtgtactacaggatgaagcgtgctgaactttactgccccaggccacttctcccgg

SEQ ID NO: 8560 - DNA, 55 bp, Artificial Sequence
  Description of Artificial Sequence: Synthetic probe
accgacgggcgacagacacaagcaacagctcattgcaccggcgaaacagctgctg

SEQ ID NO: 8561 - DNA, 60 bp, Artificial Sequence
  Description of Artificial Sequence: Synthetic probe
gagctctactgccccaggccggtcctcccgttccaaccgacgggcgacagacacaagcaa

SEQ ID NO: 8562 - DNA, 60 bp, Artificial Sequence
  Description of Artificial Sequence: Synthetic probe
cgcatgaagcgtgctgagctctactgccccaggccggtcctcccgttccaaccgacgggc

SEQ ID NO: 8563 - DNA, 60 bp, Artificial Sequence
  Description of Artificial Sequence: Synthetic probe
ggtgcagttaaagcagaaacaatcacagaattgcttgtgcgcatgaagcgtgctgagctc

SEQ ID NO: 8564 - DNA, 60 bp, Artificial Sequence
  Description of Artificial Sequence: Synthetic probe
cgcaccacaccgcgtgttggccacaacgtacactggtacaacggcctacactactggtgc

SEQ ID NO: 8565 - DNA, 60 bp, Artificial Sequence
  Description of Artificial Sequence: Synthetic probe
ataccacaaggggccgctaacccggctggctcttccgtacaccgcaccacaccgcgtgtt

SEQ ID NO: 8566 - DNA, 60 bp, Artificial Sequence
  Description of Artificial Sequence: Synthetic probe
cccactgcataccacaaggggccgctaacccggctggctcttccgtacaccgcaccacac

SEQ ID NO: 8567 - DNA, 60 bp, Artificial Sequence
  Description of Artificial Sequence: Synthetic probe
ccttcgttcttgaccggtttgtgcaggtccaagtgtcaggtgaacaacacacactggacg

SEQ ID NO: 8568 - DNA, 60 bp, Artificial Sequence
  Description of Artificial Sequence: Synthetic probe
ccggaccctgagaacgtactcgcgtacgtgccctacgaccaagaaccattggacgttgac

SEQ ID NO: 8569 - DNA, 60 bp, Artificial Sequence
  Description of Artificial Sequence: Synthetic probe
tggacacccgatcctgagaacgtactcgcgtacgtgccctacgaccatgaacctctggac

SEQ ID NO: 8570 - DNA, 60 bp, Artificial Sequence
  Description of Artificial Sequence: Synthetic probe
acccatggacaccggaccctgagaacgtactcgcgtacgtgccctacgaccaagaaccat

SEQ ID NO: 8571 - DNA, 60 bp, Artificial Sequence
  Description of Artificial Sequence: Synthetic probe
gaggtgttctacccatggacacccgatcctgagaacgtactcgcgtacgtgccctacgac

SEQ ID NO: 8572 - DNA, 60 bp, Artificial Sequence
  Description of Artificial Sequence: Synthetic probe
tgcgcatgaagcgtgctgagctctactgccctagaccactactggcagtggaagtgacaa

SEQ ID NO: 8573 - DNA, 60 bp, Artificial Sequence
  Description of Artificial Sequence: Synthetic probe
cggcggtgagacacaagtccaacggcgtcaccacactgatgtcggcttcataatggacag

SEQ ID NO: 8574 - DNA, 60 bp, Artificial Sequence
  Description of Artificial Sequence: Synthetic probe
ctacggcggtgagacacaagtccaacggcgtcaccacactgatgtcggcttcataatgga

SEQ ID NO: 8575 - DNA, 60 bp, Artificial Sequence
  Description of Artificial Sequence: Synthetic probe
cttgcctcttgcgatcgatccactcccgcgattgtccgctggtttgccgctcatctcctt

SEQ ID NO: 8576 - DNA, 60 bp, Artificial Sequence
  Description of Artificial Sequence: Synthetic probe
tggccgcgcttattggctaacgtcctccggcgtcgagcccggcgtcattggtaggggatt

SEQ ID NO: 8577 - DNA, 60 bp, Artificial Sequence
  Description of Artificial Sequence: Synthetic probe
agcgcattggacacctcctttgactgggatgtcgtgctccctggtgtcggggtggctgct

SEQ ID NO: 8578 - DNA, 53 bp, Artificial Sequence
  Description of Artificial Sequence: Synthetic probe
cagttcgagtcttgcagacattaagaccaacaccaccgcagcggcaagctttg

SEQ ID NO: 8579 - DNA, 60 bp, Artificial Sequence
  Description of Artificial Sequence: Synthetic probe
cctatcgtcgtgcaatacttctccgtcaaggagagttggatccgccatttgaaactggcg

SEQ ID NO: 8580 - DNA, 60 bp, Artificial Sequence
  Description of Artificial Sequence: Synthetic probe
tcatctttcccgttttgactcacattgtctcctatggtgccctcactactagccatttcc

SEQ ID NO: 8581 - DNA, 60 bp, Artificial Sequence
  Description of Artificial Sequence: Synthetic probe
gctaaccaacctgccactcccagagaggcctaagcctgaagacttttgcccttctgagtg

SEQ ID NO: 8582 - DNA, 60 bp, Artificial Sequence
  Description of Artificial Sequence: Synthetic probe
taccatggtcgctcatcgcgctttgtccgctcgtgaaacccggcaggccaagaagcacga

SEQ ID NO: 8583 - DNA, 60 bp, Artificial Sequence
  Description of Artificial Sequence: Synthetic probe
acgctatgtgagctgaatggcacagactggctagctaacaaatttgattgggcagtggag

SEQ ID NO: 8584 - DNA, 60 bp, Artificial Sequence
  Description of Artificial Sequence: Synthetic probe
aactcgaggcttttgccgataccgtggcaccccaactctcgcccggtgacattgtcgttg

SEQ ID NO: 8585 - DNA, 60 bp, Artificial Sequence
  Description of Artificial Sequence: Synthetic probe
actcgaggcttttgccgataccgtggcaccccaactctcgcctggcgacattgttgttgc

SEQ ID NO: 8586 - DNA, 60 bp, Artificial Sequence
  Description of Artificial Sequence: Synthetic probe
gacacctgagaccatgaggtgggcaaccgttttagcctgtcttttgccatccctactggc

SEQ ID NO: 8587 - DNA, 60 bp, Artificial Sequence
  Description of Artificial Sequence: Synthetic probe
ccacgcatcctcgagaaaacagaaaatgtcggcgagatggccaaccagggacccttggcc

SEQ ID NO: 8588 - DNA, 60 bp, Artificial Sequence
  Description of Artificial Sequence: Synthetic probe
gctgcaaagctttccatggagcaggccctaggtatgatgaacgttgacggcgagctgacc

SEQ ID NO: 8589 - DNA, 60 bp, Artificial Sequence
  Description of Artificial Sequence: Synthetic probe
ccaggaccatactcggtaccaataacttcattgcgctggcccaccgggcagcactgagtg

SEQ ID NO: 8590 - DNA, 60 bp, Artificial Sequence
  Description of Artificial Sequence: Synthetic probe
agctccgcccgcagatacaggtggtgtcggctcattcactgatttgccatcttcagatgg

SEQ ID NO: 8591 - DNA, 60 bp, Artificial Sequence
  Description of Artificial Sequence: Synthetic probe
gcacagcccaaaacttgctgcacgggaacaccctcctgtgacagccctcttcaggggaat

SEQ ID NO: 8592 - DNA, 60 bp, Artificial Sequence
  Description of Artificial Sequence: Synthetic probe
ttgtttcctatggggcacttaccaccagccatttccttgacacagtcggtcttgccactg

SEQ ID NO: 8593 - DNA, 60 bp, Artificial Sequence
  Description of Artificial Sequence: Synthetic probe
gggctggcattcttgtggcacctcagtgtcggaattggaagaatgtgtggtgaatggcac

SEQ ID NO: 8594 - DNA, 60 bp, Artificial Sequence
  Description of Artificial Sequence: Synthetic probe
ctttctttgtggtgtatcgtgccgttctggtttgctgtgctcgtcaacgccaacagcacc

SEQ ID NO: 8595 - DNA, 60 bp, Artificial Sequence
  Description of Artificial Sequence: Synthetic probe
aaaagtggccggaccggctggttgctagccttcgccctgtccataagtatagccgcgcgt

SEQ ID NO: 8596 - DNA, 60 bp, Artificial Sequence
  Description of Artificial Sequence: Synthetic probe
gacggtgattatgccagtaccgccctgctccccacttgtaaagagatcatcatggtcgct

SEQ ID NO: 8597 - DNA, 60 bp, Artificial Sequence
  Description of Artificial Sequence: Synthetic probe
cacctgcaattgtccgctggtttgcctccaatcttctttatgaacttgcctgtgctgagg

SEQ ID NO: 8598 - DNA, 60 bp, Artificial Sequence
  Description of Artificial Sequence: Synthetic probe
gatagtacagacgcgtgggagtgcctcagagttagcaatcctgccgactttgaccctgag

SEQ ID NO: 8599 - DNA, 60 bp, Artificial Sequence
  Description of Artificial Sequence: Synthetic probe
tggaggtggcccacacttcattgctgctctgcacgttgcctgctcgatggcgttgcacat

SEQ ID NO: 8600 - DNA, 60 bp, Artificial Sequence
  Description of Artificial Sequence: Synthetic probe
tacgaccaacctgccaaagactcccggatgtcgtcgctggggtttgacgagagcgcaacg

SEQ ID NO: 8601 - DNA, 60 bp, Artificial Sequence
  Description of Artificial Sequence: Synthetic probe
taccggacttgacccgcgacccgtactgccgagcgggcttgacaagcttaaagaccagat

SEQ ID NO: 8602 - DNA, 60 bp, Artificial Sequence
  Description of Artificial Sequence: Synthetic probe
gaaggcaactgctggtggcgcttgttcgactcgctcccgccggaagtccagaacaaagaa

SEQ ID NO: 8603 - DNA, 56 bp, Artificial Sequence
  Description of Artificial Sequence: Synthetic probe
caccctgatcaggtgtgcttggggaaaatcatcagcctttgtcaggttattgagga

SEQ ID NO: 8604 - DNA, 60 bp, Artificial Sequence
  Description of Artificial Sequence: Synthetic probe
tcaagtttatgtcgacatcaagcaccaattcatctgcgccgttcacgacggggataacgc

SEQ ID NO: 8605 - DNA, 60 bp, Artificial Sequence
  Description of Artificial Sequence: Synthetic probe
ccgacaaccatggacctatcgtcatacagtacttctctgttaaggagagttggatccgcc

SEQ ID NO: 8606 - DNA, 56 bp, Artificial Sequence
  Description of Artificial Sequence: Synthetic probe
gaggatgtcatcatgtcacctccggatacctcccgcgcgtccttcctaaggaatca

SEQ ID NO: 8607 - DNA, 60 bp, Artificial Sequence
  Description of Artificial Sequence: Synthetic probe
gtagtgagtgcaaatcccctgtagggaagggcacaagccctttagacgaggtgctggaac

SEQ ID NO: 8608 - DNA, 60 bp, Artificial Sequence
  Description of Artificial Sequence: Synthetic probe
gccctggcggtggttattctccgggtgattggggttttgcagctcttactctattgtgcc

SEQ ID NO: 8609 - DNA, 58 bp, Artificial Sequence
  Description of Artificial Sequence: Synthetic probe
gagaagaatatgggctcatgccaaccgagcctggtccacggcccacactgccacgcgg

SEQ ID NO: 8610 - DNA, 60 bp, Artificial Sequence
  Description of Artificial Sequence: Synthetic probe
aaccgccgtgctctccaatttggaaaaggttgtccgagaagaatatgggctcatgccaac

SEQ ID NO: 8611 - DNA, 55 bp, Artificial Sequence
  Description of Artificial Sequence: Synthetic probe
cccagaacaaaactaaccgggtcaccccggaggaggtcgcagcaaagattgacct

SEQ ID NO: 8612 - DNA, 60 bp, Artificial Sequence
  Description of Artificial Sequence: Synthetic probe
cagcctttgtcaggtgattgaggactgctgctgttcccagaacaaaactaaccgggtcac

SEQ ID NO: 8613 - DNA, 60 bp, Artificial Sequence
  Description of Artificial Sequence: Synthetic probe
ccaataacttcattgcactggcccaccgggcagcactgagcggtgtcacccagggcttta

SEQ ID NO: 8614 - DNA, 57 bp, Artificial Sequence
  Description of Artificial Sequence: Synthetic probe
atgtaaaaggggacttcgccatggctgattgcccgaattggcaaggggttgctccca

SEQ ID NO: 8615 - DNA, 60 bp, Artificial Sequence
  Description of Artificial Sequence: Synthetic probe
attttccgacaccatccgagccgatgacacccatgagtgagcccgtacttgtgcccgcgt

SEQ ID NO: 8616 - DNA, 60 bp, Artificial Sequence
  Description of Artificial Sequence: Synthetic probe
gctctccgctccccaaggtcgcacacaacctgggatttcatttctcacctgatttaacac

SEQ ID NO: 8617 - DNA, 60 bp, Artificial Sequence
  Description of Artificial Sequence: Synthetic probe
ttaccatcgctggctggctggtggtcttctgcatccgattggtttgctccgcggtactcc

SEQ ID NO: 8618 - DNA, 60 bp, Artificial Sequence
  Description of Artificial Sequence: Synthetic probe
agagcttgtagttgggatagcgcagtgtgcccgcaaggacggctacagttttcccggccc

SEQ ID NO: 8619 - DNA, 60 bp, Artificial Sequence
  Description of Artificial Sequence: Synthetic probe
aaaatcaggcaaatttccaagccctcgggaggaggcccgcacctcattgctgccctgcat

SEQ ID NO: 8620 - DNA, 60 bp, Artificial Sequence
  Description of Artificial Sequence: Synthetic probe
gcttgtttgactcgctcccactggacgttcagaacaaagaaattcgccgtgccaaccaat

SEQ ID NO: 8621 - DNA, 60 bp, Artificial Sequence
  Description of Artificial Sequence: Synthetic probe
ttcatcacctccagatgccgtttgtgcttgctaggccgcaagtacattctggcccctgcc

SEQ ID NO: 8622 - DNA, 60 bp, Artificial Sequence
  Description of Artificial Sequence: Synthetic probe
gaagttcatcacctccagatgccgtttgtgcttgctaggccgcaagtacattctggcccc

SEQ ID NO: 8623 - DNA, 60 bp, Artificial Sequence
  Description of Artificial Sequence: Synthetic probe
ccccatctggtaagaagttcttggtccccgtcaacccagagaatggaagagtccaatggg

SEQ ID NO: 8624 - DNA, 60 bp, Artificial Sequence
  Description of Artificial Sequence: Synthetic probe
ccgttttcgccaactccctgcatgtaagtgatagacctttcccaggggctactcacgtgc

SEQ ID NO: 8625 - DNA, 51 bp, Artificial Sequence
  Description of Artificial Sequence: Synthetic probe
ggacaaacttatgtccatggttaacacgacccgtgtgacctacgtggaaaa

SEQ ID NO: 8626 - DNA, 57 bp, Artificial Sequence
  Description of Artificial Sequence: Synthetic probe
tcaagtaccgcagcctgcatgccgtcttggtcggtgatggtgcgttttccgcggctt

SEQ ID NO: 8627 - DNA, 60 bp, Artificial Sequence
  Description of Artificial Sequence: Synthetic probe
tgttcaagtaccgcagcctgcatgccgtcttggtcggtgatggtgcgttttccgcggctt

SEQ ID NO: 8628 - DNA, 57 bp, Artificial Sequence
  Description of Artificial Sequence: Synthetic probe
tcaagtaccgcagcctgcatgccgtcttggtcggtgatggtgtgttttccacggctt

SEQ ID NO: 8629 - DNA, 56 bp, Artificial Sequence
  Description of Artificial Sequence: Synthetic probe
caacccctggttcccggccaaagcttaatgattttcagcaatggttaatagctgta

SEQ ID NO: 8630 - DNA, 60 bp, Artificial Sequence
  Description of Artificial Sequence: Synthetic probe
gcacttagagtagaactggcccagttggtacaggttgataaagttcgaggtactttggcc

SEQ ID NO: 8631 - DNA, 60 bp, Artificial Sequence
  Description of Artificial Sequence: Synthetic probe
gtgaaatttgaagctgtccccggggagttgaggttgattgcgaaccggctccgcacctcc

SEQ ID NO: 8632 - DNA, 60 bp, Artificial Sequence
  Description of Artificial Sequence: Synthetic probe
gctggtaccccattgttggacctgcccctggagtggccgtttacgccaattccctacatg

SEQ ID NO: 8633 - DNA, 60 bp, Artificial Sequence
  Description of Artificial Sequence: Synthetic probe
gggtttccggggtcggctttaatcaaatgcttgactttgatgtaaaaggggacttcgcca

SEQ ID NO: 8634 - DNA, 60 bp, Artificial Sequence
  Description of Artificial Sequence: Synthetic probe
cctgctacgcaggagtggctctctcgcatgtgggatagggttaacatgctgacttggcgc

SEQ ID NO: 8635 - DNA, 60 bp, Artificial Sequence
  Description of Artificial Sequence: Synthetic probe
ccgcggattagtctccgttaggcgtggcattaggggaaatgaagtcgacctaccagacgg

SEQ ID NO: 8636 - DNA, 60 bp, Artificial Sequence
  Description of Artificial Sequence: Synthetic probe
ggcggagggccaagtctactgcacacgatgtctcagtgcacggtctctccttcctctgaa

SEQ ID NO: 8637 - DNA, 60 bp, Artificial Sequence
  Description of Artificial Sequence: Synthetic probe
gtttgtggcggagggccaagtctactgcacacgatgtctcagtgcacggtctctccttcc

SEQ ID NO: 8638 - DNA, 60 bp, Artificial Sequence
  Description of Artificial Sequence: Synthetic probe
catccggcatcaccttacccagactgaacgttctctctgcttgcaatcgatccagacggc

SEQ ID NO: 8639 - DNA, 60 bp, Artificial Sequence
  Description of Artificial Sequence: Synthetic probe
tacagtacaacaccacgctgaaccgcgttgagctcattttccccacgccaggcacgaggc

SEQ ID NO: 8640 - DNA, 60 bp, Artificial Sequence
  Description of Artificial Sequence: Synthetic probe
cactctcaccgatgtgtatctccccgaactccggccctatctgcaacctgagacggcatc

SEQ ID NO: 8641 - DNA, 60 bp, Artificial Sequence
  Description of Artificial Sequence: Synthetic probe
gcgaccgcatcctggctgctctcgcataccacatgaaggcgcagaacgcctcagagtatt

SEQ ID NO: 8642 - DNA, 60 bp, Artificial Sequence
  Description of Artificial Sequence: Synthetic probe
cctagcctccgtccctgtattggaaggcggcctctcgaccgtccaacttctgtgtgtctt

SEQ ID NO: 8643 - DNA, 60 bp, Artificial Sequence
  Description of Artificial Sequence: Synthetic probe
cttttgtggctgcggttcgatgcggttactcgacagcacaactggtcttgggccagggca

SEQ ID NO: 8644 - DNA, 60 bp, Artificial Sequence
  Description of Artificial Sequence: Synthetic probe
aacgacccttgagagagagcaaacacccgataacccaggttctgatgccggtgccctccc

SEQ ID NO: 8645 - DNA, 60 bp, Artificial Sequence
  Description of Artificial Sequence: Synthetic probe
ggtagaggtgagatctggaatggctcctcgctccctttctcgtgaatgtgtggtcggcgt

SEQ ID NO: 8646 - DNA, 60 bp, Artificial Sequence
  Description of Artificial Sequence: Synthetic probe
gggccagtcggtcgaagtgcgctgccatgaagaacatctagccaacgccttcggttacca

SEQ ID NO: 8647 - DNA, 60 bp, Artificial Sequence
  Description of Artificial Sequence: Synthetic probe
gctctcagctgtattccctttggcgcgcatgacctctggcaatcacaacttccttcaacg

SEQ ID NO: 8648 - DNA, 56 bp, Artificial Sequence
  Description of Artificial Sequence: Synthetic probe
ccctccaagggagaaccggtctgtggccaacctgccaaagatccccggatgtcgcc

SEQ ID NO: 8649 - DNA, 56 bp, Artificial Sequence
  Description of Artificial Sequence: Synthetic probe
ccctccatgggagaaccggtctgtggccaacctgccaaagatccccggatgtcgcc

SEQ ID NO: 8650 - DNA, 52 bp, Artificial Sequence
  Description of Artificial Sequence: Synthetic probe
tgggcagtcgagacctttgtgctttacccagttgccactcatatcctctcac

SEQ ID NO: 8651 - DNA, 60 bp, Artificial Sequence
  Description of Artificial Sequence: Synthetic probe
cgccattctcttggcgatatgagatgctctcacaaattggggcgtttcttgactccacac

SEQ ID NO: 8652 - DNA, 56 bp, Artificial Sequence
  Description of Artificial Sequence: Synthetic probe
tgctgatgctttctgcgtgccttttccacgcctcagaaatgagcgagaaaggcttc

SEQ ID NO: 8653 - DNA, 60 bp, Artificial Sequence
  Description of Artificial Sequence: Synthetic probe
ggcacatgcgagtttcccacctaattgatgagatggtctctcgtcgcatttaccagacca

SEQ ID NO: 8654 - DNA, 60 bp, Artificial Sequence
  Description of Artificial Sequence: Synthetic probe
gggaagggttcgccttctgttttactaactgtggcgattcggggtcacccgtcatctcag

SEQ ID NO: 8655 - DNA, 60 bp, Artificial Sequence
  Description of Artificial Sequence: Synthetic probe
aaaccggttgggccagtgcttgaccagaccgtccctccgcccacggatatccagcaagaa

SEQ ID NO: 8656 - DNA, 60 bp, Artificial Sequence
  Description of Artificial Sequence: Synthetic probe
gtggttgacgcccctgtcgacttgacgacttcgaacgaggccctctctgtagtcgatcct

SEQ ID NO: 8657 - DNA, 60 bp, Artificial Sequence
  Description of Artificial Sequence: Synthetic probe
tgcctcatacattcgagttcctgttaattctactgtgtatttggacccctgcatgggccc

SEQ ID NO: 8658 - DNA, 51 bp, Artificial Sequence
  Description of Artificial Sequence: Synthetic probe
atagccgcgcgtgcattggtgccggctacatggtgggcccctcggtgtttt

SEQ ID NO: 8659 - DNA, 60 bp, Artificial Sequence
  Description of Artificial Sequence: Synthetic probe
ccatctggaggttcgggcagaatatctgtgatgccattcaaccagagtacagggacaaac

SEQ ID NO: 8660 - DNA, 60 bp, Artificial Sequence
  Description of Artificial Sequence: Synthetic probe
atggcacgctttgggattttgaggccgaggctactaaagaggaagttgaactcagtgcgc

SEQ ID NO: 8661 - DNA, 60 bp, Artificial Sequence
  Description of Artificial Sequence: Synthetic probe
accgcgtagaactgtgacaacgacgctgacgcaccaggacgagcctctggatctgtctgc

SEQ ID NO: 8662 - DNA, 60 bp, Artificial Sequence
  Description of Artificial Sequence: Synthetic probe
cagcggaggctgcaagttaatggtcttcgagcagtggtcgacacacatgggccaatcgtc

SEQ ID NO: 8663 - DNA, 60 bp, Artificial Sequence
  Description of Artificial Sequence: Synthetic probe
ggtcctaggcaggtgccttgaagctgatcttgcgtcctgcgatcgatccacacccgcaat

SEQ ID NO: 8664 - DNA, 60 bp, Artificial Sequence
  Description of Artificial Sequence: Synthetic probe
gaggaggtccatattagcacagacgagtgggagtgccttagaactggcgaccctgtcgac

SEQ ID NO: 8665 - DNA, 60 bp, Artificial Sequence
  Description of Artificial Sequence: Synthetic probe
gaatggtgcgggttgcagctgagatttacagagccggccagctcacccctgcagtcttga

SEQ ID NO: 8666 - DNA, 59 bp, Artificial Sequence
  Description of Artificial Sequence: Synthetic probe
gcatgatagctccgcccgcagatacaggtggtgtcggctcattcactgattcgccgtct

SEQ ID NO: 8667 - DNA, 60 bp, Artificial Sequence
  Description of Artificial Sequence: Synthetic probe
ggtgcccgggttgaaaagcctcgtgttgggtggcagaaaagctgttaagcagggagtggt

SEQ ID NO: 8668 - DNA, 60 bp, Artificial Sequence
  Description of Artificial Sequence: Synthetic probe
ggtgcccgggttgaaaagcctcgtgttgggtggcagaaaagctgttaagcgaggagtggt

SEQ ID NO: 8669 - DNA, 60 bp, Artificial Sequence
  Description of Artificial Sequence: Synthetic probe
gcctgttggtggcattttcgacctaaaggttggtagcaccaagcacactctccaagccat

SEQ ID NO: 8670 - DNA, 56 bp, Artificial Sequence
  Description of Artificial Sequence: Synthetic probe
cgacgcaacatactgtgcgtctgatccgcgccccagcatcaccctcagcatgatgg

SEQ ID NO: 8671 - DNA, 60 bp, Artificial Sequence
  Description of Artificial Sequence: Synthetic probe
cttagtgatatatgcacagcacatggtgctcagttacttcaaaagtggtcactctcatgg

SEQ ID NO: 8672 - DNA, 60 bp, Artificial Sequence
  Description of Artificial Sequence: Synthetic probe
gcgtattagacacctcctttgattgggatgttgtgctccctggtgtcggggcggctgctc

SEQ ID NO: 8673 - DNA, 60 bp, Artificial Sequence
  Description of Artificial Sequence: Synthetic probe
gcagggccacgctgttgtggcaaacttatgctccggtgtcatcttgatgagacctcaccc

SEQ ID NO: 8674 - DNA, 60 bp, Artificial Sequence
  Description of Artificial Sequence: Synthetic probe
ttactcgacagcacaactggtcctgggccgaggcaactttgccaagttaaatcagacccc

SEQ ID NO: 8675 - DNA, 60 bp, Artificial Sequence
  Description of Artificial Sequence: Synthetic probe
ctggtgtccattgttgatatcatcatattcttggccattttgtttggcttcacaatcgcc

SEQ ID NO: 8676 - DNA, 60 bp, Artificial Sequence
  Description of Artificial Sequence: Synthetic probe
gccagatgctgggtaagatcatcgctcaacaaaaccagtccagaggcaaggggccgggga

SEQ ID NO: 8677 - DNA, 60 bp, Artificial Sequence
  Description of Artificial Sequence: Synthetic probe
tcatctgcgccgatcacgacggggacaacgccaccctgcgtcgccatgacaatatttcag

SEQ ID NO: 8678 - DNA, 60 bp, Artificial Sequence
  Description of Artificial Sequence: Synthetic probe
cctccacccagagaccccgtccaagtgctggaaagtgatgctggactttaaggaggttcg

SEQ ID NO: 8679 - DNA, 60 bp, Artificial Sequence
  Description of Artificial Sequence: Synthetic probe
atgacccacacagacaattgcagagcatgttcgatcttcctgcggctggcacacccgtca

SEQ ID NO: 8680 - DNA, 60 bp, Artificial Sequence
  Description of Artificial Sequence: Synthetic probe
aattatgcacgtggaacagggcctcacccctcttgacccgggcagataccaaactcgccg

SEQ ID NO: 8681 - DNA, 60 bp, Artificial Sequence
  Description of Artificial Sequence: Synthetic probe
accctaggacctgtgaacttgaaagtggccagtgaggttgaactgagggatgcggtcgag

SEQ ID NO: 8682 - DNA, 60 bp, Artificial Sequence
  Description of Artificial Sequence: Synthetic probe
cacttatgccttccttcctcggatgatggttatcgcttcaccagtcccagtgatcgcgtg

SEQ ID NO: 8683 - DNA, 60 bp, Artificial Sequence
  Description of Artificial Sequence: Synthetic probe
gccttggccactgcaccagatggaacctacttggcagccgtccgccgcgctgcgttgact

SEQ ID NO: 8684 - DNA, 60 bp, Artificial Sequence
  Description of Artificial Sequence: Synthetic probe
gcggtagggagtgtttgactgtcgatggtacccttgattttccagtgctatccgagccga

SEQ ID NO: 8685 - DNA, 60 bp, Artificial Sequence
  Description of Artificial Sequence: Synthetic probe
acgctctggtacgactaccgctgtcactcatcgcgccttgtccgctcatgaaaccctgca

SEQ ID NO: 8686 - DNA, 60 bp, Artificial Sequence
  Description of Artificial Sequence: Synthetic probe
acatcaagaccaacaccactgaaggagcgaacgccgttgtcctccaagacatcagctgcc

SEQ ID NO: 8687 - DNA, 60 bp, Artificial Sequence
  Description of Artificial Sequence: Synthetic probe
gccgtacgccactgcctgtggtctcgacgtttgtgtttaccacacccacttccaccagca

SEQ ID NO: 8688 - DNA, 60 bp, Artificial Sequence
  Description of Artificial Sequence: Synthetic probe
cagatgggacctacttggccgccgttcgccgtgctgcgctgaccggtcgtaccatgctgt

SEQ ID NO: 8689 - DNA, 60 bp, Artificial Sequence
  Description of Artificial Sequence: Synthetic probe
aaacccggcacacgaccaacccgctgatgactccccgacatcgtcgcgagggtttgacga

SEQ ID NO: 8690 - DNA, 60 bp, Artificial Sequence
  Description of Artificial Sequence: Synthetic probe
aaagcacgcattggtgcggctgccacggtcgctcaccgcgctttgcccgctcgcgaaacc

SEQ ID NO: 8691 - DNA, 60 bp, Artificial Sequence
  Description of Artificial Sequence: Synthetic probe
ctcagttggtacaggttgataaggtccgaggtaccatggccaaactcgaggcttttgccg

SEQ ID NO: 8692 - DNA, 60 bp, Artificial Sequence
  Description of Artificial Sequence: Synthetic probe
ccagggcaagacatgctgtctttgtgtatgacccacacaggcaactgcagagcatgtttg

SEQ ID NO: 8693 - DNA, 60 bp, Artificial Sequence
  Description of Artificial Sequence: Synthetic probe
ggttctgcggcaacccctttaaccagagtttcagcggaacaatggggtcgtccttagacg

SEQ ID NO: 8694 - DNA, 60 bp, Artificial Sequence
  Description of Artificial Sequence: Synthetic probe
ccaaccccgagaatagaagagctcagtgcgaatccgcacagctttccgtgcaacaagccc

SEQ ID NO: 8695 - DNA, 57 bp, Artificial Sequence
  Description of Artificial Sequence: Synthetic probe
tcgccatgagactcactgacgaggatttggatttccttacgaaatggactgatttta

SEQ ID NO: 8696 - DNA, 60 bp, Artificial Sequence
  Description of Artificial Sequence: Synthetic probe
ggatgtgcctgccggagtctgacgagagcataatagctccgcccgcaaatacaggtggtg

SEQ ID NO: 8697 - DNA, 60 bp, Artificial Sequence
  Description of Artificial Sequence: Synthetic probe
gcaccctccaagggagaaccggtcggtgaccaacctgccaaagatccccggatgtgcctg

SEQ ID NO: 8698 - DNA, 60 bp, Artificial Sequence
  Description of Artificial Sequence: Synthetic probe
ccaaagatgattctcgagaaaccgccgccccacccgtgcggatttgtgatgttacctcac

SEQ ID NO: 8699 - DNA, 60 bp, Artificial Sequence
  Description of Artificial Sequence: Synthetic probe
agaggttgtcctggaagaatatgggctcacgtccactggactttgcccgcgacccgtgct

SEQ ID NO: 8700 - DNA, 60 bp, Artificial Sequence
  Description of Artificial Sequence: Synthetic probe
gtcatgcatgtggccggaggaaaggtctcctgggcccctcgtggtgggaatgaagtgaaa

SEQ ID NO: 8701 - DNA, 60 bp, Artificial Sequence
  Description of Artificial Sequence: Synthetic probe
gcgaccttaccatcggctcagtcgctactgaagatgttccacgcatcctcgagaaagtag

SEQ ID NO: 8702 - DNA, 60 bp, Artificial Sequence
  Description of Artificial Sequence: Synthetic probe
agattctctccgcgctatttgcgcagacttggaagggtcgagctccccgctccccaaggt

SEQ ID NO: 8703 - DNA, 60 bp, Artificial Sequence
  Description of Artificial Sequence: Synthetic probe
tgtagattctctccgcgctatttgcgcagacttggaagggtcgagctccccgctccccaa

SEQ ID NO: 8704 - DNA, 60 bp, Artificial Sequence
  Description of Artificial Sequence: Synthetic probe
agcagctcttaacaggaacagattgtcactcgccttttacagccttggtgcgctaaccgg

SEQ ID NO: 8705 - DNA, 60 bp, Artificial Sequence
  Description of Artificial Sequence: Synthetic probe
ccctaggacccgtgaacttaaaagtgaccagcgaggtcgagctaaaagacgcggtcgagc

SEQ ID NO: 8706 - DNA, 55 bp, Artificial Sequence
  Description of Artificial Sequence: Synthetic probe
atgctgttgttcccaaaacaagaccaaccgggccaccccggatgaggttgcaaaa

SEQ ID NO: 8707 - DNA, 60 bp, Artificial Sequence
  Description of Artificial Sequence: Synthetic probe
cctgcgatcgatccacacccgcaattgtccgctggtttgctgccaatcttctttatgaac

SEQ ID NO: 8708 - DNA, 60 bp, Artificial Sequence
  Description of Artificial Sequence: Synthetic probe
cggaacacggttgtgaggatgctgcattaagagacctctccaagtatgatttgtccaccc

SEQ ID NO: 8709 - DNA, 50 bp, Artificial Sequence
  Description of Artificial Sequence: Synthetic probe
aagcgcgcccgccacgcgtaatcgacaccttctttgattgggatgttgtg

SEQ ID NO: 8710 - DNA, 50 bp, Artificial Sequence
  Description of Artificial Sequence: Synthetic probe
aagcgcgcccgccgcgtgtaatcgacaccttctttgattgggatgttgtg

SEQ ID NO: 8711 - DNA, 60 bp, Artificial Sequence
  Description of Artificial Sequence: Synthetic probe
atatggctgcctccccgctgacactgtcccggaaggaaactgctggtggcgcttgtttga

SEQ ID NO: 8712 - DNA, 60 bp, Artificial Sequence
  Description of Artificial Sequence: Synthetic probe
acaatgatgcgtttcgtgcacgccaggaagggaaaatttacaaggccactgccaccagct

SEQ ID NO: 8713 - DNA, 60 bp, Artificial Sequence
  Description of Artificial Sequence: Synthetic probe
tcggcacccttcaagggaggaccggtctgtgaccaacctgccaaaatttcccggatgtcg

SEQ ID NO: 8714 - DNA, 60 bp, Artificial Sequence
  Description of Artificial Sequence: Synthetic probe
acagggaccgagaggacggcgccattaccatcgactccagtcaaggcgccacatttgatg

SEQ ID NO: 8715 - DNA, 60 bp, Artificial Sequence
  Description of Artificial Sequence: Synthetic probe
ggtcagatccgattgcggcagcccagttttgatgggcgacaatgttcctaacggttcgga

SEQ ID NO: 8716 - DNA, 52 bp, Artificial Sequence
  Description of Artificial Sequence: Synthetic probe
aatgatatacgcccttaaggtgtcacgcggccgactcctggggctgttgcac

SEQ ID NO: 8717 - DNA, 60 bp, Artificial Sequence
  Description of Artificial Sequence: Synthetic probe
aagccctgtttctcgacgcatctatcagatattaagaccaacacgaccgcggctgccggt

SEQ ID NO: 8718 - DNA, 60 bp, Artificial Sequence
  Description of Artificial Sequence: Synthetic probe
cgatttcgagtatcagacccgaggtgcaagtctctcttagccgcttgttcggccagtctg

SEQ ID NO: 8719 - DNA, 60 bp, Artificial Sequence
  Description of Artificial Sequence: Synthetic probe
cccgagcacttgtagccatcactcgggcaagacacgggttgttcatttatgaccctcaca

SEQ ID NO: 8720 - DNA, 60 bp, Artificial Sequence
  Description of Artificial Sequence: Synthetic probe
atgaccctgagtggtatgaggacctcatctgcggtattgcccaatgcgcccgccaggatg

SEQ ID NO: 8721 - DNA, 60 bp, Artificial Sequence
  Description of Artificial Sequence: Synthetic probe
attgatcatgaccctgagtggtatgaggacctcatctgcggtatcgcccgatgcgcccgc

SEQ ID NO: 8722 - DNA, 60 bp, Artificial Sequence
  Description of Artificial Sequence: Synthetic probe
tgcattgaccatgaccctgagtggtatgaggacctcatctgcggtattgcccggtgcgcc

SEQ ID NO: 8723 - DNA, 60 bp, Artificial Sequence
  Description of Artificial Sequence: Synthetic probe
tgcgtctgctgccgcaatcctgatggattcatgtgcttgcattgatcatgaccctgagtg

SEQ ID NO: 8724 - DNA, 60 bp, Artificial Sequence
  Description of Artificial Sequence: Synthetic probe
cagaacgcctcagagtattatgcgtctgctgccgcaatcctgatggattcatgtgcttgc

SEQ ID NO: 8725 - DNA, 60 bp, Artificial Sequence
  Description of Artificial Sequence: Synthetic probe
gcgcagaacgcctcagagtattatgcgtctgctgccgcaatcctgatggattcatgtgct

SEQ ID NO: 8726 - DNA, 60 bp, Artificial Sequence
  Description of Artificial Sequence: Synthetic probe
gcaggatgtgaagagtacttgcctagctatgtgcttaactgctgccatgaccttgtggca

SEQ ID NO: 8727 - DNA, 60 bp, Artificial Sequence
  Description of Artificial Sequence: Synthetic probe
ttttcaggacaggtcagccgactacagagacagggactatgaaggtgtgcaaaccgcccc

SEQ ID NO: 8728 - DNA, 60 bp, Artificial Sequence
  Description of Artificial Sequence: Synthetic probe
ctgggcaattggccgctttacccaggttgccggaattattacaccttatgacatccacca

SEQ ID NO: 8729 - DNA, 53 bp, Artificial Sequence
  Description of Artificial Sequence: Synthetic probe
cccctcactatgctttgggtgcactcattcttggtgttttgtatgccagcagc

SEQ ID NO: 8730 - DNA, 60 bp, Artificial Sequence
  Description of Artificial Sequence: Synthetic probe
caccctcttactatgctttgggtgcactcattcttggtgttttgtctgccagcagccggc

SEQ ID NO: 8731 - DNA, 60 bp, Artificial Sequence
  Description of Artificial Sequence: Synthetic probe
ttcaccctctcaccatgctttgggtgcactcattcttggtgttttgtctgccagcggccg

SEQ ID NO: 8732 - DNA, 60 bp, Artificial Sequence
  Description of Artificial Sequence: Synthetic probe
aaaggagttgatcccgtgcacttggcaacgggttggcgcgggtgctggcgtggtgaaagt

SEQ ID NO: 8733 - DNA, 60 bp, Artificial Sequence
  Description of Artificial Sequence: Synthetic probe
ttttattctcgactccatccaacccagtcggttcttcttgtgaccacgattcgccggagt

SEQ ID NO: 8734 - DNA, 60 bp, Artificial Sequence
  Description of Artificial Sequence: Synthetic probe
ctttatgctcacacttttctcgccgcggggctctatggctccaggtgattggttgtttgc

SEQ ID NO: 8735 - DNA, 57 bp, Artificial Sequence
  Description of Artificial Sequence: Synthetic probe
catgtgcaccccggctgcccgggtattttggaacgccggccaagtcttttgcacacg

SEQ ID NO: 8736 - DNA, 52 bp, Artificial Sequence
  Description of Artificial Sequence: Synthetic probe
ggtgccctcactactagccatttccttgacacagtcgctttagtcactgtgt

SEQ ID NO: 8737 - DNA, 60 bp, Artificial Sequence
  Description of Artificial Sequence: Synthetic probe
gtctcctatggtgccctcactactagccatttccttgacacagtcgctttagtcactgtg

SEQ ID NO: 8738 - DNA, 60 bp, Artificial Sequence
  Description of Artificial Sequence: Synthetic probe
gtgcgcctgatccgtgtcacagcatcaccttcagcatgatgagctggcattcttgtggca

SEQ ID NO: 8739 - DNA, 60 bp, Artificial Sequence
  Description of Artificial Sequence: Synthetic probe
catgacggacagaacaccaccttgcctcgccacgacaacatctcagctgtgttccagacc

SEQ ID NO: 8740 - DNA, 60 bp, Artificial Sequence
  Description of Artificial Sequence: Synthetic probe
gccgggaatatcttgacgatcgggagcgggaagttgctgcatccctcccacacgccttta

SEQ ID NO: 8741 - DNA, 60 bp, Artificial Sequence
  Description of Artificial Sequence: Synthetic probe
ccacgcctgcaattgttcgctggtttgctgccaaccttctttatgaacttgcctgtgctg

SEQ ID NO: 8742 - DNA, 60 bp, Artificial Sequence
  Description of Artificial Sequence: Synthetic probe
gcaaagctttccgtggagcaggccctaggcatgatgaatgtcgacggcgaactgactgcc

SEQ ID NO: 8743 - DNA, 60 bp, Artificial Sequence
  Description of Artificial Sequence: Synthetic probe
attggctactgcaccagatggaacctacttagccgctgttcgccgcgctgcgttgactgg

SEQ ID NO: 8744 - DNA, 60 bp, Artificial Sequence
  Description of Artificial Sequence: Synthetic probe
cccagcatttggcatcgttcccctcttgggtgtattttctgggtcttctcggcgcgtgcg

SEQ ID NO: 8745 - DNA, 60 bp, Artificial Sequence
  Description of Artificial Sequence: Synthetic probe
aacaccttcgagtgagccagtggttgtgtcagcaccgcagtgcatcttcagaccggcgac

SEQ ID NO: 8746 - DNA, 60 bp, Artificial Sequence
  Description of Artificial Sequence: Synthetic probe
tcgctgaccgcgctttgtccgttcgtgaaatctggcaggccaaggagcatgaggttaccg

SEQ ID NO: 8747 - DNA, 60 bp, Artificial Sequence
  Description of Artificial Sequence: Synthetic probe
gcgaaccaactctgcacctccttcccaccccaccacgtagtcaacatgtctaagttcgcc

SEQ ID NO: 8748 - DNA, 60 bp, Artificial Sequence
  Description of Artificial Sequence: Synthetic probe
taatagtactttggatcaggtgtttgccgttttcccaacccctggttcccggccaaagct

SEQ ID NO: 8749 - DNA, 60 bp, Artificial Sequence
  Description of Artificial Sequence: Synthetic probe
ctgttaaggagagttggatccgccacctgaaattggtggaagaacccagcctccccgggt

SEQ ID NO: 8750 - DNA, 60 bp, Artificial Sequence
  Description of Artificial Sequence: Synthetic probe
tgaattacacggtgtgcccgccttgccttacccgtcaggcagccgctgagatctacgaac

SEQ ID NO: 8751 - DNA, 60 bp, Artificial Sequence
  Description of Artificial Sequence: Synthetic probe
tgatcttcccgcgaagggcacacccgttaacctcgcagtgcaccgtgacgagcagctaat

SEQ ID NO: 8752 - DNA, 60 bp, Artificial Sequence
  Description of Artificial Sequence: Synthetic probe
cggactcgccgtcattcttaggctgcaggataacaaatgggcgccagctagtccctaacc

SEQ ID NO: 8753 - DNA, 60 bp, Artificial Sequence
  Description of Artificial Sequence: Synthetic probe
gcagctggccaatttatcgaggctgcttacgcaaaagcactaagaattgaacttgctcag

SEQ ID NO: 8754 - DNA, 60 bp, Artificial Sequence
  Description of Artificial Sequence: Synthetic probe
caccgcaccagatggaacttacttggctgccgtccgtcgtgctgcgttgactggtcgtac

SEQ ID NO: 8755 - DNA, 60 bp, Artificial Sequence
  Description of Artificial Sequence: Synthetic probe
agctcctttcttccccgctggagtgaaaattgaccctgagtgcagaatcgtggttgaccc

SEQ ID NO: 8756 - DNA, 60 bp, Artificial Sequence
  Description of Artificial Sequence: Synthetic probe
tcggcaccctttaagggaggaccggcctgcgaccaacctgccaaagattcccggatgtcg

SEQ ID NO: 8757 - DNA, 60 bp, Artificial Sequence
  Description of Artificial Sequence: Synthetic probe
tgattttcagacaccatccgaaccgacaatacctatgagtgagcccgtactcacgcccgc

SEQ ID NO: 8758 - DNA, 60 bp, Artificial Sequence
  Description of Artificial Sequence: Synthetic probe
tgccagcgctaacgaggctgagcatttcaagcgatactctccgcctgccgaagggaactg

SEQ ID NO: 8759 - DNA, 60 bp, Artificial Sequence
  Description of Artificial Sequence: Synthetic probe
gccggccaactcacccctgcagttctgaagaccttacaagtttatgaacggggttgtcgc

SEQ ID NO: 8760 - DNA, 60 bp, Artificial Sequence
  Description of Artificial Sequence: Synthetic probe
gcgtggactgtttcgcaattctatgcccgtcatagaggaggaaatcatcgtgaccaggtg

SEQ ID NO: 8761 - DNA, 60 bp, Artificial Sequence
  Description of Artificial Sequence: Synthetic probe
cccagttcctgcaccgcgtagaactgtgtcccgaccaatgacgcccttgagtgagccaat

SEQ ID NO: 8762 - DNA, 60 bp, Artificial Sequence
  Description of Artificial Sequence: Synthetic probe
agtgacatctttgagtgtgctggccccagttcctgcaccgcgtagaactgtgtcccgacc

SEQ ID NO: 8763 - DNA, 60 bp, Artificial Sequence
  Description of Artificial Sequence: Synthetic probe
agcttgctagaggacaagcctgtccctgctccgcgcaggaaggttagatccgattgctgc

SEQ ID NO: 8764 - DNA, 60 bp, Artificial Sequence
  Description of Artificial Sequence: Synthetic probe
tagggaatgtgagtcgagtttatgttgacatcaagcaccaagtcatctgcgccgttcacg

SEQ ID NO: 8765 - DNA, 57 bp, Artificial Sequence
  Description of Artificial Sequence: Synthetic probe
ccaacccctggttcccggccaaagcgtcatgattttcagcaatggctaatagctgta

SEQ ID NO: 8766 - DNA, 60 bp, Artificial Sequence
  Description of Artificial Sequence: Synthetic probe
gagaagactaggacaatacttggcaccaataactttattgcgttggcccatcgggcagcg

SEQ ID NO: 8767 - DNA, 60 bp, Artificial Sequence
  Description of Artificial Sequence: Synthetic probe
gggtttacaatgtctacacctccccatccggtaggaggttcctggttcctgccaaccctg

SEQ ID NO: 8768 - DNA, 60 bp, Artificial Sequence
  Description of Artificial Sequence: Synthetic probe
cccagctgtcctggtccgaagtgttttctccttcgggatgtttgttctatcttggctcac

SEQ ID NO: 8769 - DNA, 60 bp, Artificial Sequence
  Description of Artificial Sequence: Synthetic probe
actggtcgcactatgctgttcaccccgtctcagcccgggtccctccttgagggcgctttc

SEQ ID NO: 8770 - DNA, 60 bp, Artificial Sequence
  Description of Artificial Sequence: Synthetic probe
cttctcatacctcttcaaatctgacagtggttattcttcgggtgattggagttttgcagc

SEQ ID NO: 8771 - DNA, 60 bp, Artificial Sequence
  Description of Artificial Sequence: Synthetic probe
ctagatttgtctgcgttctcacagactgaatatgaggcttctcccttagcaccattgcag

SEQ ID NO: 8772 - DNA, 60 bp, Artificial Sequence
  Description of Artificial Sequence: Synthetic probe
ataggtgttggctctatgccacgacattggtattgtcgggagctgtgaccattggcacag

SEQ ID NO: 8773 - DNA, 60 bp, Artificial Sequence
  Description of Artificial Sequence: Synthetic probe
ggcggcgatgtccctaacagttgggaagatttggctgttagtagcgttaaccaatgcatc

SEQ ID NO: 8774 - DNA, 53 bp, Artificial Sequence
  Description of Artificial Sequence: Synthetic probe
tgccatgacctcaccagtcccaatggttgcgtgtggtgttgtgcacttgcttg

SEQ ID NO: 8775 - DNA, 60 bp, Artificial Sequence
  Description of Artificial Sequence: Synthetic probe
tgatcctaaccaggccgtaaagtgcttgcgggtattgcaggcgggtggggcgatggtagt

SEQ ID NO: 8776 - DNA, 60 bp, Artificial Sequence
  Description of Artificial Sequence: Synthetic probe
ctgacttggcgacacacgtctgcttaccaggcatttcgcatcttagacggcaggtttggg

SEQ ID NO: 8777 - DNA, 60 bp, Artificial Sequence
  Description of Artificial Sequence: Synthetic probe
ctgacttggcgaaacacgtctgcttaccaggcatttcgcatcttagacggcaggtttggg

SEQ ID NO: 8778 - DNA, 60 bp, Artificial Sequence
  Description of Artificial Sequence: Synthetic probe
ccggccgaattgaggtagattgccgggaatatcttgatgatcgggagagagaagttgctg

SEQ ID NO: 8779 - DNA, 60 bp, Artificial Sequence
  Description of Artificial Sequence: Synthetic probe
tgaattacacggtgtgcccgccttgcctaacccggcaggcagccgctgagatctacgaac

SEQ ID NO: 8780 - DNA, 60 bp, Artificial Sequence
  Description of Artificial Sequence: Synthetic probe
ccggccgaattggggtagattgtcgagagtatcttgacgatcgggagcgggaagttgctg

SEQ ID NO: 8781 - DNA, 51 bp, Artificial Sequence
  Description of Artificial Sequence: Synthetic probe
ttttcctcctgtggagaatgatggggcatgcctggacgcccttggttgctg

SEQ ID NO: 8782 - DNA, 60 bp, Artificial Sequence
  Description of Artificial Sequence: Synthetic probe
gagggcgctttcaggactcaaaagccctcactgaacaccgttaatgtggtcgggtcctcc

SEQ ID NO: 8783 - DNA, 60 bp, Artificial Sequence
  Description of Artificial Sequence: Synthetic probe
gcccagctggatgagaagaggattacggctaaaactgtggtcgctcagccttatgatccc

SEQ ID NO: 8784 - DNA, 60 bp, Artificial Sequence
  Description of Artificial Sequence: Synthetic probe
aaaataggagacaccggtgagctgcttgaccagggtccctcggcacccttcaagggagga

SEQ ID NO: 8785 - DNA, 60 bp, Artificial Sequence
  Description of Artificial Sequence: Synthetic probe
caccaaccctgcacctgtgtcaccaagcggctccctgtcaagtgttaagatcacacgccc

SEQ ID NO: 8786 - DNA, 60 bp, Artificial Sequence
  Description of Artificial Sequence: Synthetic probe
gggcgacaatgtccctaatggttcggaagagactgtcggtggtcccctcaattttccgac

SEQ ID NO: 8787 - DNA, 60 bp, Artificial Sequence
  Description of Artificial Sequence: Synthetic probe
gttcctcccgtgactcaagagcctttgggtaaagactcggtccctctgaccgccttctcg

SEQ ID NO: 8788 - DNA, 53 bp, Artificial Sequence
  Description of Artificial Sequence: Synthetic probe
tctttccgattgcacgaatgactagtgggaacctgaactttcaacaaagaatt

SEQ ID NO: 8789 - DNA, 58 bp, Artificial Sequence
  Description of Artificial Sequence: Synthetic probe
ctccggtgctgatgcatctcccaagttactcgcccatcacgggccgggaaacactggg

SEQ ID NO: 8790 - DNA, 58 bp, Artificial Sequence
  Description of Artificial Sequence: Synthetic probe
catgctgtgcattttgcttgcaattgccagctatgtttgggtacctctcacctggttg

SEQ ID NO: 8791 - DNA, 60 bp, Artificial Sequence
  Description of Artificial Sequence: Synthetic probe
gctgacatgctgtgtgtcttgcttgcaattgccagctatgtttgggtacctcttacctgg

SEQ ID NO: 8792 - DNA, 60 bp, Artificial Sequence
  Description of Artificial Sequence: Synthetic probe
actgacctaaacggacctatcgtcgtacagtacttcttcgttaaggagagttggatccgc

SEQ ID NO: 8793 - DNA, 52 bp, Artificial Sequence
  Description of Artificial Sequence: Synthetic probe
gggcgtgccggttcaacgttccagcaggtacaacgctgcaattccctgcccc

SEQ ID NO: 8794 - DNA, 59 bp, Artificial Sequence
  Description of Artificial Sequence: Synthetic probe
acatgttgtgcattttactcgcaatcgctagttatgtttgggtacctcttacctggttg

SEQ ID NO: 8795 - DNA, 56 bp, Artificial Sequence
  Description of Artificial Sequence: Synthetic probe
ccttccaaaggagaaccggtctgtgaccaacctgccaaggatccccggatgtcgcc

SEQ ID NO: 8796 - DNA, 50 bp, Artificial Sequence
  Description of Artificial Sequence: Synthetic probe
ttgatttcccaaccctacctgagttggtggcaagctcgagcgagcctgtg

SEQ ID NO: 8797 - DNA, 60 bp, Artificial Sequence
  Description of Artificial Sequence: Synthetic probe
ccctgacagccgggaagacttggccggtggtccctttgatttcccaaccctacctgagtt

SEQ ID NO: 8798 - DNA, 60 bp, Artificial Sequence
  Description of Artificial Sequence: Synthetic probe
gctctggctgcgttgatttgctttgtcattagccttgcgaagaactgcatgtcctggcgc

SEQ ID NO: 8799 - DNA, 60 bp, Artificial Sequence
  Description of Artificial Sequence: Synthetic probe
cagacgagtgggagtgccttagaactggtgaccctgtcgactttgatcctgaggcaggga

SEQ ID NO: 8800 - DNA, 60 bp, Artificial Sequence
  Description of Artificial Sequence: Synthetic probe
cgaattggcaaggggttgctcccaaagcccaattctgcgaggatgggtggactggtcgcg

SEQ ID NO: 8801 - DNA, 60 bp, Artificial Sequence
  Description of Artificial Sequence: Synthetic probe
ggaggatctgctagaactagccaacacccaggcgacttcagatatgatggcctgggcggc

SEQ ID NO: 8802 - DNA, 60 bp, Artificial Sequence
  Description of Artificial Sequence: Synthetic probe
taccttcatggcccctgggagtggtgtctccatgcggattgagtaccaacacggctgcct

SEQ ID NO: 8803 - DNA, 60 bp, Artificial Sequence
  Description of Artificial Sequence: Synthetic probe
ttccaacaaaggatggtacgggtcgcagctgagctttacagagccggccagctcacccct

SEQ ID NO: 8804 - DNA, 60 bp, Artificial Sequence
  Description of Artificial Sequence: Synthetic probe
cagtttgctaaactcccagtagaacttgcacctcactggcccgtggtgtcaacccagaac

SEQ ID NO: 8805 - DNA, 60 bp, Artificial Sequence
  Description of Artificial Sequence: Synthetic probe
cagtttgctaaactcccagtagaacttgcacctcactggcccgtggtgacgacccagaac

SEQ ID NO: 8806 - DNA, 60 bp, Artificial Sequence
  Description of Artificial Sequence: Synthetic probe
ccgtggcaaaggccctagagacaggtccaactcaattccgagtgtcagatccgaggtgta

SEQ ID NO: 8807 - DNA, 60 bp, Artificial Sequence
  Description of Artificial Sequence: Synthetic probe
ccagttttctcgggtgcaggatcgaggcagggcgacagttagttcccaatcgtgaccgca

SEQ ID NO: 8808 - DNA, 60 bp, Artificial Sequence
  Description of Artificial Sequence: Synthetic probe
ttgacgttcttctgaaacccggactcgacacagcacccggcattcaaccagggcatgggg

SEQ ID NO: 8809 - DNA, 60 bp, Artificial Sequence
  Description of Artificial Sequence: Synthetic probe
ccctgacgtaacatccattcctagtgacttggcatcgctcctggcctccgtccctgtagt

SEQ ID NO: 8810 - DNA, 60 bp, Artificial Sequence
  Description of Artificial Sequence: Synthetic probe
ggctggcattctttggtacctcagtgttagaatcgggagaatgtgtggtgaatggcactg

SEQ ID NO: 8811 - DNA, 60 bp, Artificial Sequence
  Description of Artificial Sequence: Synthetic probe
gcccgcagatacaggtggcgccggctcattcactgatttgccgtcttcggatagtgtgga

SEQ ID NO: 8812 - DNA, 53 bp, Artificial Sequence
  Description of Artificial Sequence: Synthetic probe
acacctttggatgggtcggccccggttcctgcaccgcgtagaactgtgtcccg

SEQ ID NO: 8813 - DNA, 56 bp, Artificial Sequence
  Description of Artificial Sequence: Synthetic probe
tgagtgagcccgtacttacgcccgcgctgcaacgtgtccccaagttgatgacacct

SEQ ID NO: 8814 - DNA, 60 bp, Artificial Sequence
  Description of Artificial Sequence: Synthetic probe
ggtgcgggtcgcaggtgaaatctacagagccggccaactcacccctacagttctgaagac

SEQ ID NO: 8815 - DNA, 60 bp, Artificial Sequence
  Description of Artificial Sequence: Synthetic probe
gccctctccgcagtcgatcctttcaagttttccgaacccaggcgcccgcgtttctctgca

SEQ ID NO: 8816 - DNA, 60 bp, Artificial Sequence
  Description of Artificial Sequence: Synthetic probe
gagttcagctccaatggggaacggccagtcagtcaatcaactgtgccagctgctgggtgc

SEQ ID NO: 8817 - DNA, 60 bp, Artificial Sequence
  Description of Artificial Sequence: Synthetic probe
tgtctctccgcattgtgccgaacacagagcctaccaccctccaggtctttcgattcgggg

SEQ ID NO: 8818 - DNA, 60 bp, Artificial Sequence
  Description of Artificial Sequence: Synthetic probe
acaccacgttagaccgcgttgaccttatcttccccacgccaggcacgaggcccaagttga

SEQ ID NO: 8819 - DNA, 60 bp, Artificial Sequence
  Description of Artificial Sequence: Synthetic probe
cggcgctgcccgactatgccaggttcattcagctgcccaaggatgccgtcgtatacattg

SEQ ID NO: 8820 - DNA, 60 bp, Artificial Sequence
  Description of Artificial Sequence: Synthetic probe
ggtacagccccgccccgcttcttggcccctgttctagcccaacaggcacccttctccctc

SEQ ID NO: 8821 - DNA, 60 bp, Artificial Sequence
  Description of Artificial Sequence: Synthetic probe
tcgcgacgtgtccccaagctgatggcacctttgagtgggtcggcaccagttcctgcaccg

SEQ ID NO: 8822 - DNA, 60 bp, Artificial Sequence
  Description of Artificial Sequence: Synthetic probe
tcgcgacgtgtccccaagctgatgaaacctttgagtgggtcggcaccagttcctgcaccg

SEQ ID NO: 8823 - DNA, 60 bp, Artificial Sequence
  Description of Artificial Sequence: Synthetic probe
ggtcagatctgattatggcagcccgattttgatgggcgacaatgttcctaacggttggga

SEQ ID NO: 8824 - DNA, 60 bp, Artificial Sequence
  Description of Artificial Sequence: Synthetic probe
cggcgtattgcaatcacctcgacgtcttgaggcttctcagtaaaacaactctcacttgcc

SEQ ID NO: 8825 - DNA, 60 bp, Artificial Sequence
  Description of Artificial Sequence: Synthetic probe
ggttggtagcaccaagcatactctccaagctattgagactagagtccttgccgggtccaa

SEQ ID NO: 8826 - DNA, 60 bp, Artificial Sequence
  Description of Artificial Sequence: Synthetic probe
aattaatgacacatgcgaggtgccttcagatctttgtgccctgcttgctgccaaacccga

SEQ ID NO: 8827 - DNA, 60 bp, Artificial Sequence
  Description of Artificial Sequence: Synthetic probe
gacctaaggtcccgctcggtgatgtgaaaattggcagtcacataattaatgacacatgcg

SEQ ID NO: 8828 - DNA, 60 bp, Artificial Sequence
  Description of Artificial Sequence: Synthetic probe
ctccaagtttctgagcttggggtgctgggtctattttataggcccgaagagccactccgg

SEQ ID NO: 8829 - DNA, 60 bp, Artificial Sequence
  Description of Artificial Sequence: Synthetic probe
tttataggcccgaagagccactccggtggacgttgcctcgtgcattccccactgtcgagt

SEQ ID NO: 8830 - DNA, 60 bp, Artificial Sequence
  Description of Artificial Sequence: Synthetic probe
tggttgatcccgatacttttactacagccctccggtctggctattctaccacgaacctcg

SEQ ID NO: 8831 - DNA, 60 bp, Artificial Sequence
  Description of Artificial Sequence: Synthetic probe
tggttgatcccgatacttttactacagccctccggtctggctattccactgcgaacctcg

SEQ ID NO: 8832 - DNA, 50 bp, Artificial Sequence
  Description of Artificial Sequence: Synthetic probe
accttgatagatgaaatggtgtcgcgtcgaatgtaccgcatcatggaaaa

SEQ ID NO: 8833 - DNA, 60 bp, Artificial Sequence
  Description of Artificial Sequence: Synthetic probe
gaatgatacgggtcgcagctgagctttacagagccggccagctcacccctgcagtcttga

SEQ ID NO: 8834 - DNA, 60 bp, Artificial Sequence
  Description of Artificial Sequence: Synthetic probe
gaatggtacgggtcgcagctgagatttacagagccggccagctcacccctgcagtcttga

SEQ ID NO: 8835 - DNA, 60 bp, Artificial Sequence
  Description of Artificial Sequence: Synthetic probe
ctgagacagcggtgaaaatagtcaaatttcacaatcggactttcactctggggcctgtga

SEQ ID NO: 8836 - DNA, 60 bp, Artificial Sequence
  Description of Artificial Sequence: Synthetic probe
ccgggttgaaaagcctcgtgttgggtggcagaagggctgtcaaacggggagtggtaaacc

SEQ ID NO: 8837 - DNA, 60 bp, Artificial Sequence
  Description of Artificial Sequence: Synthetic probe
ccgggttgaaaagcctcgtgttgggtggcagaagagctgtcaaacggggagtggtaaacc

SEQ ID NO: 8838 - DNA, 60 bp, Artificial Sequence
  Description of Artificial Sequence: Synthetic probe
tggtccagtggccaccgaggatgttccacgcatcctcgggaaaataggagacaccggtga

SEQ ID NO: 8839 - DNA, 60 bp, Artificial Sequence
  Description of Artificial Sequence: Synthetic probe
tgccaagcacaccctacaagccatcgagaccagagtccttgctgggtccaggatgaccgt

SEQ ID NO: 8840 - DNA, 60 bp, Artificial Sequence
  Description of Artificial Sequence: Synthetic probe
cgcccgttggcagcatctttgacttaaagattggtaatgccaagcacaccctacaagcca

SEQ ID NO: 8841 - DNA, 60 bp, Artificial Sequence
  Description of Artificial Sequence: Synthetic probe
cgcccgttggcagcatctttgacttaaagattggtaatgctaagcacaccctacaagcca

SEQ ID NO: 8842 - DNA, 60 bp, Artificial Sequence
  Description of Artificial Sequence: Synthetic probe
ccaaatttgaaaccacccttcccgaaagagtgagacctccagatgactgggctaccgacg

SEQ ID NO: 8843 - DNA, 60 bp, Artificial Sequence
  Description of Artificial Sequence: Synthetic probe
cttcacctccccatctggtaggagaatcttggtccccgccaaccccgagaatggaagagc

SEQ ID NO: 8844 - DNA, 60 bp, Artificial Sequence
  Description of Artificial Sequence: Synthetic probe
ccttgacacggtcggcctgatcactgtgtccatcgccggatactgccataggcggtatgt

SEQ ID NO: 8845 - DNA, 60 bp, Artificial Sequence
  Description of Artificial Sequence: Synthetic probe
ggcctgactgccctaaactgctgacagagcacggctgcaaagatgccgcactgaaagacc

SEQ ID NO: 8846 - DNA, 60 bp, Artificial Sequence
  Description of Artificial Sequence: Synthetic probe
ccggtgacattgttgtcgctctccgccacacgcctgtgggcagtatcttcgacctaaagg

SEQ ID NO: 8847 - DNA, 60 bp, Artificial Sequence
  Description of Artificial Sequence: Synthetic probe
ctcagttggtacaggttgataaggtccggggcaccatggccaaactcgaggcttttgccg

SEQ ID NO: 8848 - DNA, 60 bp, Artificial Sequence
  Description of Artificial Sequence: Synthetic probe
cgaaatggactgattttaagtgctttgcttctgcgtccaacatgaggaatgcagctggcc

SEQ ID NO: 8849 - DNA, 60 bp, Artificial Sequence
  Description of Artificial Sequence: Synthetic probe
cggtccctctgaccgccttctcactgtccagttgctattaccctgcacaaggtgacgagg

SEQ ID NO: 8850 - DNA, 60 bp, Artificial Sequence
  Description of Artificial Sequence: Synthetic probe
acgttccctctgcttgcaatcgatccagacggctttcaatcaaggcgcaggaactgcgtc

SEQ ID NO: 8851 - DNA, 60 bp, Artificial Sequence
  Description of Artificial Sequence: Synthetic probe
acgctccctctgcttgcaatcgatccagacggctttcaatcaaggcgcaggaactgcgtc

SEQ ID NO: 8852 - DNA, 60 bp, Artificial Sequence
  Description of Artificial Sequence: Synthetic probe
cactctagtaccaggacttcggagcctcgtgctgggcggcaaacgagctgttaaacgagg

SEQ ID NO: 8853 - DNA, 60 bp, Artificial Sequence
  Description of Artificial Sequence: Synthetic probe
acatcagtgaacggcactctagtaccaggacttcggagcctcgtgctgggcggcaaacga

SEQ ID NO: 8854 - DNA, 60 bp, Artificial Sequence
  Description of Artificial Sequence: Synthetic probe
aacatcagtgaacggcactctagtaccaggacttcggagcctcgtgctgggcggcaaacg

SEQ ID NO: 8855 - DNA, 60 bp, Artificial Sequence
  Description of Artificial Sequence: Synthetic probe
caggtctccattcaatcccagcgtctggtaaccgagcatacgctgtgagaaagcccggac

SEQ ID NO: 8856 - DNA, 60 bp, Artificial Sequence
  Description of Artificial Sequence: Synthetic probe
ggggcccagcacattttgacaacagcctggttcgaggacctcgggccgcagtggaaaatt

SEQ ID NO: 8857 - DNA, 60 bp, Artificial Sequence
  Description of Artificial Sequence: Synthetic probe
cggtgcccagaacattttgacaacagcctggttcgaggacctcgggccgcagtggaagat

SEQ ID NO: 8858 - DNA, 60 bp, Artificial Sequence
  Description of Artificial Sequence: Synthetic probe
gattacggtgcccagaacattttgacaacagcctggttcgaggacctcgggccgcagtgg

SEQ ID NO: 8859 - DNA, 60 bp, Artificial Sequence
  Description of Artificial Sequence: Synthetic probe
actggcgggccgacctggcagtgacaccgtatgattacggggcccagcacattttgacaa

SEQ ID NO: 8860 - DNA, 60 bp, Artificial Sequence
  Description of Artificial Sequence: Synthetic probe
gcaacctgagacggcatcaaaatgctggaaactcaaattagacttcagggacgtccgact

SEQ ID NO: 8861 - DNA, 60 bp, Artificial Sequence
  Description of Artificial Sequence: Synthetic probe
ttgcctagctatgtgcttaattgctgccatgaccttgtggcaacacaggatggtgccttc

SEQ ID NO: 8862 - DNA, 52 bp, Artificial Sequence
  Description of Artificial Sequence: Synthetic probe
ggaggcgtgggtatagccccgccccaccccttggcccctgttctagcccaac

SEQ ID NO: 8863 - DNA, 58 bp, Artificial Sequence
  Description of Artificial Sequence: Synthetic probe
tactttggaggcgtgggtacagccccgccccaccccttggcccctgttctagcccaac

SEQ ID NO: 8864 - DNA, 60 bp, Artificial Sequence
  Description of Artificial Sequence: Synthetic probe
cgtttccgtcggaggcatggctcataggttgagctgtaaggctgacatgctgtgcgtctt

SEQ ID NO: 8865 - DNA, 58 bp, Artificial Sequence
  Description of Artificial Sequence: Synthetic probe
accaagtgcgcttagggaaaattatcagtctttgtcaggtgattgaggactgctgctg

SEQ ID NO: 8866 - DNA, 60 bp, Artificial Sequence
  Description of Artificial Sequence: Synthetic probe
tgttggggaaatgcttgaccgcgggctggtgctcgcaattgctttctttggggtgtatcg

SEQ ID NO: 8867 - DNA, 60 bp, Artificial Sequence
  Description of Artificial Sequence: Synthetic probe
ctgcaaaccatgtttcagttcgagtcttgcggatattaagaccaacaccaccgcagcggc

SEQ ID NO: 8868 - DNA, 60 bp, Artificial Sequence
  Description of Artificial Sequence: Synthetic probe
ccggtaggtctctttggtgtaggatagggtatgaccgatgtgaggaggatgatcatgacg

SEQ ID NO: 8869 - DNA, 53 bp, Artificial Sequence
  Description of Artificial Sequence: Synthetic probe
ttttgacaaaattggccaactctttgtggatgctttcacggagttcttggtgt

SEQ ID NO: 8870 - DNA, 50 bp, Artificial Sequence
  Description of Artificial Sequence: Synthetic probe
ctccggtgctgatgcatctcccaggttacttgcccatcacgggccgggaa

SEQ ID NO: 8871 - DNA, 60 bp, Artificial Sequence
  Description of Artificial Sequence: Synthetic probe
ccatcattctgtacttgtttaagtaccgtggcctgcaccatatccttgttggcgatggag

SEQ ID NO: 8872 - DNA, 60 bp, Artificial Sequence
  Description of Artificial Sequence: Synthetic probe
gccttcactgaacaccgtcaatgtgatcgggtcctccatgggctctggcggggtgtttac

SEQ ID NO: 8873 - DNA, 60 bp, Artificial Sequence
  Description of Artificial Sequence: Synthetic probe
cggagagcgaccttaccattggctcagttactactgaagatgttccacgcatcctcgaga

SEQ ID NO: 8874 - DNA, 60 bp, Artificial Sequence
  Description of Artificial Sequence: Synthetic probe
gattccgatcgttcggcttctccggtcaccaccgtgtggactgtgtcgcagttctttgcc

SEQ ID NO: 8875 - DNA, 60 bp, Artificial Sequence
  Description of Artificial Sequence: Synthetic probe
tgcacctgcctagcagtgctatcccagctgctctggccgaaatgtctggcgattccgatc

SEQ ID NO: 8876 - DNA, 58 bp, Artificial Sequence
  Description of Artificial Sequence: Synthetic probe
ctccggcgctgacgcatctcccaagttactcgcccatcacgggccgggaaacactggg

SEQ ID NO: 8877 - DNA, 60 bp, Artificial Sequence
  Description of Artificial Sequence: Synthetic probe
ccataaggtgtcaaccctgactgatgaaatggtgtcgcgtcgaatgtaccgcatcatgga

SEQ ID NO: 8878 - DNA, 60 bp, Artificial Sequence
  Description of Artificial Sequence: Synthetic probe
atggtgtcgcgtcgaatgtaccgcatcatggaaaaggcaggacaggctgcctggaaacag

SEQ ID NO: 8879 - DNA, 60 bp, Artificial Sequence
  Description of Artificial Sequence: Synthetic probe
tcagacaaatttccaagccttcaggaggaggtccatatctcatggcggccttgcatgtcg

SEQ ID NO: 8880 - DNA, 60 bp, Artificial Sequence
  Description of Artificial Sequence: Synthetic probe
atactgtgcgtctgatccgcgccacggcatcaccctcagcatgatgggccggcattcttt

SEQ ID NO: 8881 - DNA, 60 bp, Artificial Sequence
  Description of Artificial Sequence: Synthetic probe
cgatccagactgccttcaatcagggcgctgggacttgtgccctgtcagattcagggagga

SEQ ID NO: 8882 - DNA, 60 bp, Artificial Sequence
  Description of Artificial Sequence: Synthetic probe
atcatccgagccgatgacacctatgagtgaacccgtacttgtgcccgcgtcgcgacgtgt

SEQ ID NO: 8883 - DNA, 60 bp, Artificial Sequence
  Description of Artificial Sequence: Synthetic probe
cgccaaccggatggtgaattctaactttgagaccacccttcctgaaagagtaaggccttc

SEQ ID NO: 8884 - DNA, 60 bp, Artificial Sequence
  Description of Artificial Sequence: Synthetic probe
aagctccagggcctgactaaggagcagtgtttaaactgctagccgccagcgacttgaccc

SEQ ID NO: 8885 - DNA, 60 bp, Artificial Sequence
  Description of Artificial Sequence: Synthetic probe
accagaacgagcccctggatttgtctgcttccttacagactgaatatgaggcctctcccc

SEQ ID NO: 8886 - DNA, 60 bp, Artificial Sequence
  Description of Artificial Sequence: Synthetic probe
ctgtgacccctgggatgttcccttctttgctccctcttgaatgtgttcagagctgttgtg

SEQ ID NO: 8887 - DNA, 60 bp, Artificial Sequence
  Description of Artificial Sequence: Synthetic probe
gctggcactgtatctccgccatcgccaatcggatggtaaactctaagtttgagactgccc

SEQ ID NO: 8888 - DNA, 60 bp, Artificial Sequence
  Description of Artificial Sequence: Synthetic probe
gttccactacggtcaacggcacattggtgcccgggttgaaaagcctcgtgttgggtggca

SEQ ID NO: 8889 - DNA, 60 bp, Artificial Sequence
  Description of Artificial Sequence: Synthetic probe
ctccactacggttaacggcacattggtgcccgggttgaaaagcctcgtgttgggtggcag

SEQ ID NO: 8890 - DNA, 60 bp, Artificial Sequence
  Description of Artificial Sequence: Synthetic probe
ccgatggcagcggcaacagctcgacataccaatacatatataacttgacgatatgcgagc

SEQ ID NO: 8891 - DNA, 60 bp, Artificial Sequence
  Description of Artificial Sequence: Synthetic probe
ccaacaggcacccttctccctccgggcgagtgcgccgcctgctgctcccttgcagcggga

SEQ ID NO: 8892 - DNA, 60 bp, Artificial Sequence
  Description of Artificial Sequence: Synthetic probe
gccatagaaacctggaaattcatcacctccagatgccgtttgtgcttgctaggccgcaag

SEQ ID NO: 8893 - DNA, 53 bp, Artificial Sequence
  Description of Artificial Sequence: Synthetic probe
ttttctcgccactgggtggcgtgggtgttggaccggccggagtcccattgagc

SEQ ID NO: 8894 - DNA, 60 bp, Artificial Sequence
  Description of Artificial Sequence: Synthetic probe
gtcgcagatcttgcggtaactcgagggcatccgttacaggtggtaatgaactcaagcacc

SEQ ID NO: 8895 - DNA, 60 bp, Artificial Sequence
  Description of Artificial Sequence: Synthetic probe
cgcctcatacattcgagttcctgttaattccactgtgtacttggacccctgcatgggccc

SEQ ID NO: 8896 - DNA, 51 bp, Artificial Sequence
  Description of Artificial Sequence: Synthetic probe
atagccgcgcgtgcattggtgccggttatatggtgggcccctcggtgtttt

SEQ ID NO: 8897 - DNA, 55 bp, Artificial Sequence
  Description of Artificial Sequence: Synthetic probe
tactcatggacagctgtgcttgtctagagtatgatcctgaatggtttgaagagct

SEQ ID NO: 8898 - DNA, 60 bp, Artificial Sequence
  Description of Artificial Sequence: Synthetic probe
ggcaccaataacttccttgcgttggcccatccggcagcgttgagtagtgttacccagggc

SEQ ID NO: 8899 - DNA, 60 bp, Artificial Sequence
  Description of Artificial Sequence: Synthetic probe
ggcgatggtggccgaggcagtcccaaaagtagtcaaagtttccgctattccattccgagc

SEQ ID NO: 8900 - DNA, 60 bp, Artificial Sequence
  Description of Artificial Sequence: Synthetic probe
gtgttagaacaagtcccgtacaagcctccgcggactgtaattatgcacgtggaacagggc

SEQ ID NO: 8901 - DNA, 60 bp, Artificial Sequence
  Description of Artificial Sequence: Synthetic probe
gccctcttcaggggaattaggggtctgtccctaacaccttgcttccggagttgcactgct

SEQ ID NO: 8902 - DNA, 60 bp, Artificial Sequence
  Description of Artificial Sequence: Synthetic probe
gttggccatttgaatgttcagatatgttggggaaatgcttgaccgcgggctattgctcgc

SEQ ID NO: 8903 - DNA, 60 bp, Artificial Sequence
  Description of Artificial Sequence: Synthetic probe
gcggagagcgaccttaccattggctcagttgctactgaagatgttccacgcatcctcgag

SEQ ID NO: 8904 - DNA, 60 bp, Artificial Sequence
  Description of Artificial Sequence: Synthetic probe
ggaagaatgtttggtgaatggcactgattgacactgtgcctttaagtcacctattcaatt

SEQ ID NO: 8905 - DNA, 54 bp, Artificial Sequence
  Description of Artificial Sequence: Synthetic probe
caatggctcttagctgtgcactcctccttattttcttctgttgcagcttcctgc

SEQ ID NO: 8906 - DNA, 60 bp, Artificial Sequence
  Description of Artificial Sequence: Synthetic probe
ctgacttggggaaacacgtctgcttaccaggcatttcgcattttagacggcaggtttggg

SEQ ID NO: 8907 - DNA, 54 bp, Artificial Sequence
  Description of Artificial Sequence: Synthetic probe
aatgctactccggtgactgatgggcgttccgtcttggctacaaccatgccctct

SEQ ID NO: 8908 - DNA, 56 bp, Artificial Sequence
  Description of Artificial Sequence: Synthetic probe
ccaacatccggttgccagaccagttgatggtgttgtgctcctgcgctctgcagttc

SEQ ID NO: 8909 - DNA, 60 bp, Artificial Sequence
  Description of Artificial Sequence: Synthetic probe
ctaaaactagccaacacccaggcgacttcaggaatgatggcctgggcggctgagcaggtc

SEQ ID NO: 8910 - DNA, 54 bp, Artificial Sequence
  Description of Artificial Sequence: Synthetic probe
taaactgtgcttttaccttcgggtatatgacatttgtgcactttcagagcacaa

SEQ ID NO: 8911 - DNA, 55 bp, Artificial Sequence
  Description of Artificial Sequence: Synthetic probe
ctaaactgtgcatttaccttcgggtatatgacatttgtgcactttcagagcacaa

SEQ ID NO: 8912 - DNA, 59 bp, Artificial Sequence
  Description of Artificial Sequence: Synthetic probe
ttttctaaactgttctttcaccttcgggtatatgacatttgtgcactttcagagcacaa

SEQ ID NO: 8913 - DNA, 52 bp, Artificial Sequence
  Description of Artificial Sequence: Synthetic probe
catcaagcatcaatttatttgcgctgttcatgacgggcaaaacaccaccttg

SEQ ID NO: 8914 - DNA, 60 bp, Artificial Sequence
  Description of Artificial Sequence: Synthetic probe
gcatctccccagttgctcgcccatcacggtccaggaaacactgggattgatggcacgctc

SEQ ID NO: 8915 - DNA, 60 bp, Artificial Sequence
  Description of Artificial Sequence: Synthetic probe
tccggccagagccccgttgagcaacccactgagaaacccattgcattcgcccagttggat

SEQ ID NO: 8916 - DNA, 60 bp, Artificial Sequence
  Description of Artificial Sequence: Synthetic probe
gctcgctcccattggaaatccagtacaaagaaattcgccacgccacccaatttggctatc

SEQ ID NO: 8917 - DNA, 54 bp, Artificial Sequence
  Description of Artificial Sequence: Synthetic probe
taaagtgcttgcgggtattgcagtcgggtggggcgatggtggctaaggcggtcc

SEQ ID NO: 8918 - DNA, 60 bp, Artificial Sequence
  Description of Artificial Sequence: Synthetic probe
ctctcacttgcctaggagacttcaaacaactccatcctgtgggtttcgactctcattgct

SEQ ID NO: 8919 - DNA, 59 bp, Artificial Sequence
  Description of Artificial Sequence: Synthetic probe
tgcagaccggatgtcccacaatttgcagtcaagcacccattgggtatgttttggcacat

SEQ ID NO: 8920 - DNA, 60 bp, Artificial Sequence
  Description of Artificial Sequence: Synthetic probe
cgtcggtttggcagctgaaatcgggacttttgctggcagattgtctgaattgtctcaagc

SEQ ID NO: 8921 - DNA, 60 bp, Artificial Sequence
  Description of Artificial Sequence: Synthetic probe
ttactcgacagcacaactggttctgggccggggcaactttgccaagttaaatcagacccc

SEQ ID NO: 8922 - DNA, 60 bp, Artificial Sequence
  Description of Artificial Sequence: Synthetic probe
gggtgtttatggcggagggccaagtctactgcacacgatgtctcagtgcacggtctctcc

SEQ ID NO: 8923 - DNA, 60 bp, Artificial Sequence
  Description of Artificial Sequence: Synthetic probe
ataagcgcgttgtagattctctccgcgctgtttgcgcagacctggaagggtcgagctccc

SEQ ID NO: 8924 - DNA, 60 bp, Artificial Sequence
  Description of Artificial Sequence: Synthetic probe
ccaggtcgtcactcatcgacctgtgcgataggttttgcgcaccaaaaggcatggacccca

SEQ ID NO: 8925 - DNA, 60 bp, Artificial Sequence
  Description of Artificial Sequence: Synthetic probe
ggcaccagttcctgcaccgcgtagaactgtaacaacaacgctgacgcaccaggatgagcc

SEQ ID NO: 8926 - DNA, 60 bp, Artificial Sequence
  Description of Artificial Sequence: Synthetic probe
ataggtgttggctctatgccatggcaatttgtttgtcaggagctgtgaccattggcacag

SEQ ID NO: 8927 - DNA, 52 bp, Artificial Sequence
  Description of Artificial Sequence: Synthetic probe
ttttgacatcatccagacggacccaaagaagaccatctggaggtttggacag

SEQ ID NO: 8928 - DNA, 60 bp, Artificial Sequence
  Description of Artificial Sequence: Synthetic probe
gtttgcaggtccaagatgcacgaggctgctagcgtcaacaaggctgagctccttgagcgc

SEQ ID NO: 8929 - DNA, 60 bp, Artificial Sequence
  Description of Artificial Sequence: Synthetic probe
caccaaccctgcacctgtgtcatcgagcagctccctgtcaagtgttaagatcacacgccc

SEQ ID NO: 8930 - DNA, 60 bp, Artificial Sequence
  Description of Artificial Sequence: Synthetic probe
caccaaccctgcacctgtgtcatcaggcagctccctgtcaagtgttaagatcacacgccc

SEQ ID NO: 8931 - DNA, 60 bp, Artificial Sequence
  Description of Artificial Sequence: Synthetic probe
tgcgcctgatccgcgtcacagcgccatcatcagcgtaatgggctggcattccttaagcac

SEQ ID NO: 8932 - DNA, 59 bp, Artificial Sequence
  Description of Artificial Sequence: Synthetic probe
ccgccggatattatcacgggcggtatgttttgagtagcatttacgcagtctgtgctttg

SEQ ID NO: 8933 - DNA, 60 bp, Artificial Sequence
  Description of Artificial Sequence: Synthetic probe
cgaattggcaaggggttgctcccaagacccagctctgcgaggatgggtggactggtcgcg

SEQ ID NO: 8934 - DNA, 60 bp, Artificial Sequence
  Description of Artificial Sequence: Synthetic probe
cgaattggcaaggggttgctcccaagacccagttctgcgaggatgggtggactggtcgcg

SEQ ID NO: 8935 - DNA, 50 bp, Artificial Sequence
  Description of Artificial Sequence: Synthetic probe
agcaaaaccactctcacctgtttaggggacttcaaacaactccacccagt

SEQ ID NO: 8936 - DNA, 60 bp, Artificial Sequence
  Description of Artificial Sequence: Synthetic probe
tttgccatagccgattgtccgggttggcagggagtcgctcccaagtcccagttctgcaag

SEQ ID NO: 8937 - DNA, 60 bp, Artificial Sequence
  Description of Artificial Sequence: Synthetic probe
gcgacctcaccgttggctcagttgctactgaggatgtcccgcgcattctcgggaatgtac

SEQ ID NO: 8938 - DNA, 60 bp, Artificial Sequence
  Description of Artificial Sequence: Synthetic probe
ggtcacgctccgcctactcgtgaaacccagcaagccaagaaacacgaagctgctagtgcc

SEQ ID NO: 8939 - DNA, 60 bp, Artificial Sequence
  Description of Artificial Sequence: Synthetic probe
gccggtcacgctccgcctactcgtgaaacccagcaagccaagaaacacgaagctgctagt

SEQ ID NO: 8940 - DNA, 60 bp, Artificial Sequence
  Description of Artificial Sequence: Synthetic probe
gccggctgcctcacccctacagtcctaaagagtctacaagtctatgaacggggttgccgc

SEQ ID NO: 8941 - DNA, 60 bp, Artificial Sequence
  Description of Artificial Sequence: Synthetic probe
tccctaacggttcggaagaaactgtcggtgatcccctcaattttccgacaccatccgagc

SEQ ID NO: 8942 - DNA, 60 bp, Artificial Sequence
  Description of Artificial Sequence: Synthetic probe
gttaaggagagttggatccgccacctgaggttggtggaagaacccagcctccccgggttt

SEQ ID NO: 8943 - DNA, 60 bp, Artificial Sequence
  Description of Artificial Sequence: Synthetic probe
gggtcgtctttagacgacttctgcaatgatagcacagctccacaaaaggtgcttttggcg

SEQ ID NO: 8944 - DNA, 60 bp, Artificial Sequence
  Description of Artificial Sequence: Synthetic probe
tcccggttccactacggttaacggcacattggtgcccgggttgaaaagcctcgtgttggg

SEQ ID NO: 8945 - DNA, 60 bp, Artificial Sequence
  Description of Artificial Sequence: Synthetic probe
ggcggtatgtcttgagtagcatttacgctgtctgcgccctggctgcgttgatttgcttcg

SEQ ID NO: 8946 - DNA, 60 bp, Artificial Sequence
  Description of Artificial Sequence: Synthetic probe
gcatgtcctggcgttactcatgcactagatacaccaactttctcctggacaccaagggca

SEQ ID NO: 8947 - DNA, 60 bp, Artificial Sequence
  Description of Artificial Sequence: Synthetic probe
cctggatcccggccaaagctccatgattttcaccaatggctaatagctgtgcactcctcc

SEQ ID NO: 8948 - DNA, 60 bp, Artificial Sequence
  Description of Artificial Sequence: Synthetic probe
agacaggctggttgccagtctccgccccatccacaaacatagccgcgcatgcattggagc

SEQ ID NO: 8949 - DNA, 60 bp, Artificial Sequence
  Description of Artificial Sequence: Synthetic probe
gatcttagtccaagtcccgtacaagcctccacggaccgttctcatgcatgttgagcaggg

SEQ ID NO: 8950 - DNA, 60 bp, Artificial Sequence
  Description of Artificial Sequence: Synthetic probe
actgggagcccagtgcacgcggccgcctgccttacgcccaatgccaccccggtgactgat

SEQ ID NO: 8951 - DNA, 60 bp, Artificial Sequence
  Description of Artificial Sequence: Synthetic probe
ccccagctctcgcccggtgatattgttgttgctcttggccacacgcctgttggcagtgtt

SEQ ID NO: 8952 - DNA, 60 bp, Artificial Sequence
  Description of Artificial Sequence: Synthetic probe
ggcgtgcatacaggatcaaacaaacaaggaggaggcatcgtcacgcgcccttcaggtcag

SEQ ID NO: 8953 - DNA, 60 bp, Artificial Sequence
  Description of Artificial Sequence: Synthetic probe
tgttcgcagccttgttgtgggccccgtcggcctcagtcttgccgttcttggcaggttact

SEQ ID NO: 8954 - DNA, 60 bp, Artificial Sequence
  Description of Artificial Sequence: Synthetic probe
aaacggtctcggctccccaaatgcggtcggagtcttcgggtttgaccctgcttgccttga

SEQ ID NO: 8955 - DNA, 60 bp, Artificial Sequence
  Description of Artificial Sequence: Synthetic probe
cacggctgtctccccgctgatactgtccctgacggaaactgttggtggcgcttgtttgac

SEQ ID NO: 8956 - DNA, 60 bp, Artificial Sequence
  Description of Artificial Sequence: Synthetic probe
gtccctcccgtgactcaagaacctttgggcaaggactcggtccctctgaccgccttctca

SEQ ID NO: 8957 - DNA, 60 bp, Artificial Sequence
  Description of Artificial Sequence: Synthetic probe
gtccctcccgtgactcaagagccttcgggcaaggactcggtccctctgaccgccttctca

SEQ ID NO: 8958 - DNA, 60 bp, Artificial Sequence
  Description of Artificial Sequence: Synthetic probe
gtccctcccgtgactcgagagcctttgggcaaggactcggtccctctgaccgccttctca

SEQ ID NO: 8959 - DNA, 50 bp, Artificial Sequence
  Description of Artificial Sequence: Synthetic probe
aaaactggccagatcggctggttgccagcctgcgccctattcacaaacat

SEQ ID NO: 8960 - DNA, 58 bp, Artificial Sequence
  Description of Artificial Sequence: Synthetic probe
aaaactggccagatcggctggttgccagcctgcgccctattcacaaacatagccgtgc

SEQ ID NO: 8961 - DNA, 51 bp, Artificial Sequence
  Description of Artificial Sequence: Synthetic probe
ggggatgaggaccgtttgaataagaaggagaggcgcaggatggaagccctc

SEQ ID NO: 8962 - DNA, 60 bp, Artificial Sequence
  Description of Artificial Sequence: Synthetic probe
tgtcctggaagaatatgggctcatgtctactggacttggcccgcgacccgtgcttccgag

SEQ ID NO: 8963 - DNA, 60 bp, Artificial Sequence
  Description of Artificial Sequence: Synthetic probe
agaggttgtcctggaagaatatgggcccatgtctactggacttggcccgcgacccgtgct

SEQ ID NO: 8964 - DNA, 60 bp, Artificial Sequence
  Description of Artificial Sequence: Synthetic probe
tgaccactgaacaggctttaaactgttagccgccagcggcttgacccgctgtggccgcgg

SEQ ID NO: 8965 - DNA, 60 bp, Artificial Sequence
  Description of Artificial Sequence: Synthetic probe
accccggctgcccgggtattttggaacgccggccaagtcttttgcacacggtgtctcagt

SEQ ID NO: 8966 - DNA, 60 bp, Artificial Sequence
  Description of Artificial Sequence: Synthetic probe
ggcgccacatttgatgtggttacactgcatttgcccactaaagattcactcaacaggcaa

SEQ ID NO: 8967 - DNA, 55 bp, Artificial Sequence
  Description of Artificial Sequence: Synthetic probe
ttttggcccctcagtgttagaattgggagaatgtgtggtgaatggccctgattga

SEQ ID NO: 8968 - DNA, 60 bp, Artificial Sequence
  Description of Artificial Sequence: Synthetic probe
ggccggcattctttggcacctcagtgttagaattgggagaatgtgtggtgaatggcactg

SEQ ID NO: 8969 - DNA, 60 bp, Artificial Sequence
  Description of Artificial Sequence: Synthetic probe
ggtacggtgccggaaagagagcaaggaaaccacgctctggtgcgactactatggtcgctc

SEQ ID NO: 8970 - DNA, 60 bp, Artificial Sequence
  Description of Artificial Sequence: Synthetic probe
gtcagaattggaagaatgtgtggtggatggcactgattgacattgtgcctctaagtcacc

SEQ ID NO: 8971 - DNA, 60 bp, Artificial Sequence
  Description of Artificial Sequence: Synthetic probe
gcccactaaagattcactcaacaggcaaagagcccttgttgctatcaccagggcaagaca

SEQ ID NO: 8972 - DNA, 60 bp, Artificial Sequence
  Description of Artificial Sequence: Synthetic probe
ccgggttgaaaagcctcgtgttgggtggcaggagagctgtcaaacggggagtggtaaacc

SEQ ID NO: 8973 - DNA, 60 bp, Artificial Sequence
  Description of Artificial Sequence: Synthetic probe
cctggcgctactcatgcactagatataccaactttctcctggacaccaaaggcagactct

SEQ ID NO: 8974 - DNA, 60 bp, Artificial Sequence
  Description of Artificial Sequence: Synthetic probe
aacaaagaatgcacggttgctcaggctctgggcaatggggacaaattcagggccacagac

SEQ ID NO: 8975 - DNA, 60 bp, Artificial Sequence
  Description of Artificial Sequence: Synthetic probe
ccatggccggaataaacgggaataggtttccaaccaaggacattcagagcatccctgaga

SEQ ID NO: 8976 - DNA, 60 bp, Artificial Sequence
  Description of Artificial Sequence: Synthetic probe
gcttacagtgtctatgcctccccatctggcaagaagttcctggtccccgcctacccagag

SEQ ID NO: 8977 - DNA, 60 bp, Artificial Sequence
  Description of Artificial Sequence: Synthetic probe
tgcctcgcgcaagtgccgtggcctcaccagtcccaattgttgcgtgcggtgttgtgcact

SEQ ID NO: 8978 - DNA, 60 bp, Artificial Sequence
  Description of Artificial Sequence: Synthetic probe
cgatggtagctgaggcggtcccaaaagtggttaaggtctccgccgtcccattccgagctc

SEQ ID NO: 8979 - DNA, 60 bp, Artificial Sequence
  Description of Artificial Sequence: Synthetic probe
gttacccggcttttggtgttgctcccctattgggtatattttctgggtcttctcggcgcg

SEQ ID NO: 8980 - DNA, 60 bp, Artificial Sequence
  Description of Artificial Sequence: Synthetic probe
ttgagtaagcctgtgcctgtccctgcgccgcgtagggttgtgctccgaccagtgtcgtct

SEQ ID NO: 8981 - DNA, 60 bp, Artificial Sequence
  Description of Artificial Sequence: Synthetic probe
catgtcgaaattcaccttcacggcccctgagtgtggtgcttccatgcgggtcgaacgcca

SEQ ID NO: 8982 - DNA, 60 bp, Artificial Sequence
  Description of Artificial Sequence: Synthetic probe
tgataaccacgcatttgtcgtccggcgtcccggctccactacggtcaacggcacattggt

SEQ ID NO: 8983 - DNA, 60 bp, Artificial Sequence
  Description of Artificial Sequence: Synthetic probe
gcaaatgataaccacgcatttgtcgtccggcgtcccggctccactacggtcaacggcaca

SEQ ID NO: 8984 - DNA, 60 bp, Artificial Sequence
  Description of Artificial Sequence: Synthetic probe
ggcaaatgataaccacgcatttgtcgtccggcgtcccggctctactacggtcaacggcac

SEQ ID NO: 8985 - DNA, 60 bp, Artificial Sequence
  Description of Artificial Sequence: Synthetic probe
ggcaaatgataaccacgcatttgtcgtccggcgtcccggttccactacggtcaacggcac

SEQ ID NO: 8986 - DNA, 60 bp, Artificial Sequence
  Description of Artificial Sequence: Synthetic probe
ggctttcatccgattgcggcaaatgataaccacgcatttgtcgtccggcgtcccggctcc

SEQ ID NO: 8987 - DNA, 60 bp, Artificial Sequence
  Description of Artificial Sequence: Synthetic probe
gggctttcatccgattgcggcaaatgataaccacgcatttgtcgtccggcgtcccggctc

SEQ ID NO: 8988 - DNA, 60 bp, Artificial Sequence
  Description of Artificial Sequence: Synthetic probe
ggctttcatccgattgcggcaagtgataaccacgcatttgtcgtccggcgtcccggttcc

SEQ ID NO: 8989 - DNA, 60 bp, Artificial Sequence
  Description of Artificial Sequence: Synthetic probe
aggctttcatccgattgcggcaagtgataaccacgcatttgtcgtccggcgtcccggctc

SEQ ID NO: 8990 - DNA, 60 bp, Artificial Sequence
  Description of Artificial Sequence: Synthetic probe
cgatccagactgcctttaaccagggcgccgggacatgttccctgtcagattcagggagga

SEQ ID NO: 8991 - DNA, 60 bp, Artificial Sequence
  Description of Artificial Sequence: Synthetic probe
acaccttgccgccattgaggccgagacctacaaatacttggcttcccggctgcccatgct

SEQ ID NO: 8992 - DNA, 60 bp, Artificial Sequence
  Description of Artificial Sequence: Synthetic probe
cagtttgctaaactcccagcagaactcgcaccccactggcccgtggtaacaacccagaac

SEQ ID NO: 8993 - DNA, 60 bp, Artificial Sequence
  Description of Artificial Sequence: Synthetic probe
cgccactgcctgtggcctcgacgtctgtacttaccacacccatttccaccagcattgtcc

SEQ ID NO: 8994 - DNA, 60 bp, Artificial Sequence
  Description of Artificial Sequence: Synthetic probe
ttgccgagggaaagctgagagaaggggtgtcgcaatcctgtgggatgagtcatgagtcgc

SEQ ID NO: 8995 - DNA, 60 bp, Artificial Sequence
  Description of Artificial Sequence: Synthetic probe
tgtggtcgggtcctccatgggctctggcggtgtgttcaccatcgacgggagaattaagtg

SEQ ID NO: 8996 - DNA, 56 bp, Artificial Sequence
  Description of Artificial Sequence: Synthetic probe
accggccaaagtcccatcgagcaaccctcagaaaagcccatcgcgttcgcccagtt

SEQ ID NO: 8997 - DNA, 60 bp, Artificial Sequence
  Description of Artificial Sequence: Synthetic probe
cctcgaagaatgaagcctgttaagagcctgccagagaacaagcctgtccccgctccacgc

SEQ ID NO: 8998 - DNA, 60 bp, Artificial Sequence
  Description of Artificial Sequence: Synthetic probe
tcgtccgctcgtgaaacccggcaggccaagaagcacgaaggtgttgacgctaacaatgcg

SEQ ID NO: 8999 - DNA, 60 bp, Artificial Sequence
  Description of Artificial Sequence: Synthetic probe
cgccgctgagatctacagggccggccaactcacccctgcagttctgaaggttctacaagt

SEQ ID NO: 9000 - DNA, 60 bp, Artificial Sequence
  Description of Artificial Sequence: Synthetic probe
ccgcgaaaggcactcccgtcaaccttgcagtgcaccgtgacgaacagctgatcgtgttag

SEQ ID NO: 9001 - DNA, 60 bp, Artificial Sequence
  Description of Artificial Sequence: Synthetic probe
cgaattggcaaggggttgctcccaaggcccagttttgcgaggatgggtggactggtcgcg

SEQ ID NO: 9002 - DNA, 50 bp, Artificial Sequence
  Description of Artificial Sequence: Synthetic probe
aagcgcgcccgccacgcgtaatcgacacctcctttgattgggatgttgtg

SEQ ID NO: 9003 - DNA, 60 bp, Artificial Sequence
  Description of Artificial Sequence: Synthetic probe
cccgttaccagtgtgtccaacaccgtatattcactggtgatctatgcccagcacatggta

SEQ ID NO: 9004 - DNA, 56 bp, Artificial Sequence
  Description of Artificial Sequence: Synthetic probe
atgaaaacttggcgctgcacctcgcagttccaagctggtcgcattcttgcgtccct

SEQ ID NO: 9005 - DNA, 56 bp, Artificial Sequence
  Description of Artificial Sequence: Synthetic probe
caacccctggttcccggccaaagcttcacgattttcagcaatggctaatagctgta

SEQ ID NO: 9006 - DNA, 60 bp, Artificial Sequence
  Description of Artificial Sequence: Synthetic probe
ggccgccatttcacctggtatcaacttgcaagctacgcctcatacatccgagttcctgta

SEQ ID NO: 9007 - DNA, 60 bp, Artificial Sequence
  Description of Artificial Sequence: Synthetic probe
cttgaaggccgtcattttacctggtatcaacttgcaagctacgcctcatacatccgagtt

SEQ ID NO: 9008 - DNA, 60 bp, Artificial Sequence
  Description of Artificial Sequence: Synthetic probe
agtacatccttaagctggaaggtgctcactggactgtttcagtgattcccggaatgcccc

SEQ ID NO: 9009 - DNA, 60 bp, Artificial Sequence
  Description of Artificial Sequence: Synthetic probe
ccagaaattttgggacaagaattccggtgatgggttttatgaggaggtccatattagcac

SEQ ID NO: 9010 - DNA, 60 bp, Artificial Sequence
  Description of Artificial Sequence: Synthetic probe
ggcgatggtggccgaggcagtcccaagagtggtcaaagtttccgctattccattccgagc

SEQ ID NO: 9011 - DNA, 51 bp, Artificial Sequence
  Description of Artificial Sequence: Synthetic probe
ccattcttggcaggttactgcgcggggcacgctacatctggcactttatgc

SEQ ID NO: 9012 - DNA, 60 bp, Artificial Sequence
  Description of Artificial Sequence: Synthetic probe
gcgaaccgactccacacctccttcccgccgcatcacgtagtagacatgtccaggtttacc

SEQ ID NO: 9013 - DNA, 60 bp, Artificial Sequence
  Description of Artificial Sequence: Synthetic probe
actgcatggccccggctccgtacgccactgcctgtggtctcgacgtctgtgtttaccaca

SEQ ID NO: 9014 - DNA, 60 bp, Artificial Sequence
  Description of Artificial Sequence: Synthetic probe
cctggctacggacctggctctctttgcacgtccagattgtgcatctcccaacacggtctc

SEQ ID NO: 9015 - DNA, 60 bp, Artificial Sequence
  Description of Artificial Sequence: Synthetic probe
caatcgtccggtttccccggccgctgctacgtggactgtttcgcaatcctatgctcgtca

SEQ ID NO: 9016 - DNA, 60 bp, Artificial Sequence
  Description of Artificial Sequence: Synthetic probe
tattctacaagcccgaagagccactccggtggacgttgccacgcgcattccccactgtcg

SEQ ID NO: 9017 - DNA, 60 bp, Artificial Sequence
  Description of Artificial Sequence: Synthetic probe
gtggtgtcaacccagaacaatgaaaagtggccggatcggctggttgccagccttcgccct

SEQ ID NO: 9018 - DNA, 50 bp, Artificial Sequence
  Description of Artificial Sequence: Synthetic probe
ttgttgcagactttgcaactaatcaggggtggtcgttgcacgcgatcatg

SEQ ID NO: 9019 - DNA, 60 bp, Artificial Sequence
  Description of Artificial Sequence: Synthetic probe
gctgccttcggtctctcacccctttaccatgtctgggattcttgatcggtgcacgtgcac

SEQ ID NO: 9020 - DNA, 60 bp, Artificial Sequence
  Description of Artificial Sequence: Synthetic probe
tacgcctgcaccttccgtaggtgcggagagtgacctcaccataggctcggttgccactga

SEQ ID NO: 9021 - DNA, 60 bp, Artificial Sequence
  Description of Artificial Sequence: Synthetic probe
aactcagcaggccaagaagcacgaggctgctagcgtcaacaaggctgagctccttgagcg

SEQ ID NO: 9022 - DNA, 60 bp, Artificial Sequence
  Description of Artificial Sequence: Synthetic probe
ggtgagcggcaattgtgtctgtcgtcgatccagactgcctttaaccagggcgctggaact

SEQ ID NO: 9023 - DNA, 60 bp, Artificial Sequence
  Description of Artificial Sequence: Synthetic probe
gcatcagattggtttgctccgcggtattccgtgcgcgccctgccattcaccctgagcaat

SEQ ID NO: 9024 - DNA, 60 bp, Artificial Sequence
  Description of Artificial Sequence: Synthetic probe
taggcaacggagataaattcagggccaccgacaagcgcgttgtagattctctccgcgcca

SEQ ID NO: 9025 - DNA, 60 bp, Artificial Sequence
  Description of Artificial Sequence: Synthetic probe
ggcgtggcatcagaggaaacgaagttgacctaccagacggtgattatgctagcaccgccc

SEQ ID NO: 9026 - DNA, 60 bp, Artificial Sequence
  Description of Artificial Sequence: Synthetic probe
aagttactcgctcgtcacgggccggggaacactgggatcgatggcacgctttgggacttt

SEQ ID NO: 9027 - DNA, 60 bp, Artificial Sequence
  Description of Artificial Sequence: Synthetic probe
gtctacgcctccccatctggcaagaagttcctggtccccgtcaactcagagagcggaaga

SEQ ID NO: 9028 - DNA, 60 bp, Artificial Sequence
  Description of Artificial Sequence: Synthetic probe
ccgcggcctgcacaatgttcttgttggtgatggagcgttttctgcagctttcttcttgcg

SEQ ID NO: 9029 - DNA, 60 bp, Artificial Sequence
  Description of Artificial Sequence: Synthetic probe
ggcgttcacacaggatcaaataaacaaggaggtggcatcgtcacgcgcccttcaggccag

SEQ ID NO: 9030 - DNA, 60 bp, Artificial Sequence
  Description of Artificial Sequence: Synthetic probe
ttgcctcacacccctgcaccttccgtgagtgcagagagcgaccttaccatcggttcagtc

SEQ ID NO: 9031 - DNA, 60 bp, Artificial Sequence
  Description of Artificial Sequence: Synthetic probe
tcgctcactgcgctttgcccgctcgcgaagcccagcaggccaagaagctcgaggttgcca

SEQ ID NO: 9032 - DNA, 60 bp, Artificial Sequence
  Description of Artificial Sequence: Synthetic probe
cgccagtcccagtgatcgcgtgtggtgttgtgcacctccttgccataattttgtacttgt

SEQ ID NO: 9033 - DNA, 60 bp, Artificial Sequence
  Description of Artificial Sequence: Synthetic probe
ctcgccagtcccagtgatcgcgtgtggtgttgtgcacctccttgccataattttgtactt

SEQ ID NO: 9034 - DNA, 60 bp, Artificial Sequence
  Description of Artificial Sequence: Synthetic probe
gatgtggggaggacgatcatgacgagctagggtttatgataccgcctggcctctccagcg

SEQ ID NO: 9035 - DNA, 60 bp, Artificial Sequence
  Description of Artificial Sequence: Synthetic probe
ccacacctccttcccgccccatcacgcagtggacatgtccaagtttaccttcatgacccc

SEQ ID NO: 9036 - DNA, 60 bp, Artificial Sequence
  Description of Artificial Sequence: Synthetic probe
ccagtcaaggcgccacattcgatgtggtcacattgcatttgcccactaaagattcactca

SEQ ID NO: 9037 - DNA, 60 bp, Artificial Sequence
  Description of Artificial Sequence: Synthetic probe
ataaccacgcatttgtcgtccggcgtcccggctccactacggttaacggcacattggtgc

SEQ ID NO: 9038 - DNA, 60 bp, Artificial Sequence
  Description of Artificial Sequence: Synthetic probe
cgttgggtccactaattggggagctgacctcgcggtcaccccttatgattatggggcaag

SEQ ID NO: 9039 - DNA, 60 bp, Artificial Sequence
  Description of Artificial Sequence: Synthetic probe
atgaggtgccctcagatctttgcgccttgcttgccaagcccgagttggaaggaggcctct

SEQ ID NO: 9040 - DNA, 60 bp, Artificial Sequence
  Description of Artificial Sequence: Synthetic probe
agccttgtggtggggcccgtcggtctctgttttgccattattggcaagttactgggcggg

SEQ ID NO: 9041 - DNA, 60 bp, Artificial Sequence
  Description of Artificial Sequence: Synthetic probe
tattgtgcctctttctatgttacagttacccagcctttggtgttgctcccctattgggtg

SEQ ID NO: 9042 - DNA, 51 bp, Artificial Sequence
  Description of Artificial Sequence: Synthetic probe
gaccctgccacgcaagaatggctttcctgcatgtgggatagggtagacatg

SEQ ID NO: 9043 - DNA, 60 bp, Artificial Sequence
  Description of Artificial Sequence: Synthetic probe
gccggtcacgctccgcccactcgtgaaacccagcaagctgagaaacacgaagctgctagt

SEQ ID NO: 9044 - DNA, 60 bp, Artificial Sequence
  Description of Artificial Sequence: Synthetic probe
ctacaagtctatgaacggggtggccgctggtactccatcgttggaccggtccctggagtt

SEQ ID NO: 9045 - DNA, 60 bp, Artificial Sequence
  Description of Artificial Sequence: Synthetic probe
cacgccaggtacgaggcccaagttgaccgatttcagacaatggctcatcagtgtgcacgc

SEQ ID NO: 9046 - DNA, 60 bp, Artificial Sequence
  Description of Artificial Sequence: Synthetic probe
tggggttttacttttccccggacagtccaacatttgcacctctgccaaaagagttggcgc

SEQ ID NO: 9047 - DNA, 60 bp, Artificial Sequence
  Description of Artificial Sequence: Synthetic probe
cagcctatgttggtatactctgatgatcttgtcttgtacgctgaaagacccacatttccc

SEQ ID NO: 9048 - DNA, 60 bp, Artificial Sequence
  Description of Artificial Sequence: Synthetic probe
acctcacccaccgtcccttgtcgacgttcttctgaaacccggacttgacacaatacccgg

SEQ ID NO: 9049 - DNA, 60 bp, Artificial Sequence
  Description of Artificial Sequence: Synthetic probe
ggtggactccataccctcggtgtgattctgtggttattcaaataccggtgcctccacaac

SEQ ID NO: 9050 - DNA, 60 bp, Artificial Sequence
  Description of Artificial Sequence: Synthetic probe
gtggaccagcctacacctgaggtcgttcgtgtgtccgagatccccttctcagccccattt

SEQ ID NO: 9051 - DNA, 60 bp, Artificial Sequence
  Description of Artificial Sequence: Synthetic probe
accggttgggccagtgcttgaccagatcgtccctccgcctacggatatccagcaagaaga

SEQ ID NO: 9052 - DNA, 57 bp, Artificial Sequence
  Description of Artificial Sequence: Synthetic probe
cccctacatacacgacacttctagtgtttgtgtaccttggaggcgtgggtacagccc

SEQ ID NO: 9053 - DNA, 58 bp, Artificial Sequence
  Description of Artificial Sequence: Synthetic probe
attacagagacaagcttatgtccatggtcaacacaactcgtgtaacttatgtggaaaa

SEQ ID NO: 9054 - DNA, 60 bp, Artificial Sequence
  Description of Artificial Sequence: Synthetic probe
gggaagatttggctgttagcagcccctttgatctcccgaccccacctgagccggcaatac

SEQ ID NO: 9055 - DNA, 60 bp, Artificial Sequence
  Description of Artificial Sequence: Synthetic probe
cagtcaggtgaatggccgcgattggcgtgtggcctctgagtcacctattcaattagggcg

SEQ ID NO: 9056 - DNA, 60 bp, Artificial Sequence
  Description of Artificial Sequence: Synthetic probe
ccaagcatacgctgtgagaaagcccggactaacatcagtgaacggcactctggtaccagg

SEQ ID NO: 9057 - DNA, 51 bp, Artificial Sequence
  Description of Artificial Sequence: Synthetic probe
attacctacacgccagtcatgatatatgccctaaaggtgagtcgcggccga

SEQ ID NO: 9058 - DNA, 60 bp, Artificial Sequence
  Description of Artificial Sequence: Synthetic probe
gatagcacggctccagtaaaggtgcttttggcgttttctattacctacacgccagtcatg

SEQ ID NO: 9059 - DNA, 60 bp, Artificial Sequence
  Description of Artificial Sequence: Synthetic probe
ggcctttctttcccagtgccaagtggacgttcccacctggggaactaaacatcctttggg

SEQ ID NO: 9060 - DNA, 60 bp, Artificial Sequence
  Description of Artificial Sequence: Synthetic probe
gtggtgacgacccagaacaatgaaaagtggccagatcggctggttgccagccttcgccct

SEQ ID NO: 9061 - DNA, 60 bp, Artificial Sequence
  Description of Artificial Sequence: Synthetic probe
tcctaggctgcagaataataaatgggcgccagctggtccccaaccgtgacaggatcctcg

SEQ ID NO: 9062 - DNA, 60 bp, Artificial Sequence
  Description of Artificial Sequence: Synthetic probe
gaccaacctgccgctcccgcagagatccaagcctgaagacttttgcccctttgtgtgtgc

SEQ ID NO: 9063 - DNA, 54 bp, Artificial Sequence
  Description of Artificial Sequence: Synthetic probe
ggtctctcacccctttaccatgtctgggatacttgatcggtgcacgtgtacccc

SEQ ID NO: 9064 - DNA, 60 bp, Artificial Sequence
  Description of Artificial Sequence: Synthetic probe
gggcagtggagagttttgtcatctttcccgtgttgactcacattgtttcttactgcgccc

SEQ ID NO: 9065 - DNA, 60 bp, Artificial Sequence
  Description of Artificial Sequence: Synthetic probe
gtcaggtatgggcaagtcctcaccccttaccacagagaccgagaggacgacgccattacc

SEQ ID NO: 9066 - DNA, 60 bp, Artificial Sequence
  Description of Artificial Sequence: Synthetic probe
ccggcgcagtgactaaaagaggtggcctgtcatctggcgacccgatcacctctgtgtcta

SEQ ID NO: 9067 - DNA, 60 bp, Artificial Sequence
  Description of Artificial Sequence: Synthetic probe
ctgggattgatggctcgctctgggatttcgagtctgaagccaccaaagaggaagtcgcac

SEQ ID NO: 9068 - DNA, 60 bp, Artificial Sequence
  Description of Artificial Sequence: Synthetic probe
tacctcaccagtcccggcaattgcgtgcggcgtcgtgcacctgcttgccatcattctgta

SEQ ID NO: 9069 - DNA, 60 bp, Artificial Sequence
  Description of Artificial Sequence: Synthetic probe
ccgcacatgtcctcacgggcaactctgctagggtttccggggttggctttaatcgaatgc

SEQ ID NO: 9070 - DNA, 60 bp, Artificial Sequence
  Description of Artificial Sequence: Synthetic probe
cattgcgtttgcccagttggatgaaaagaagatcacggctaagactgtggtcgcccagcc

SEQ ID NO: 9071 - DNA, 60 bp, Artificial Sequence
  Description of Artificial Sequence: Synthetic probe
gatactcgaaacaccgccgccctatccgtgtgggtttgtgatgatgcctcgtacgcctgc

SEQ ID NO: 9072 - DNA, 60 bp, Artificial Sequence
  Description of Artificial Sequence: Synthetic probe
tgcacctgcctagcagtgttatcccagccgccctggccgagatgtccgaccactttgatc

SEQ ID NO: 9073 - DNA, 60 bp, Artificial Sequence
  Description of Artificial Sequence: Synthetic probe
gcctccccgctgatactgtccctaatggcaactgctggtgggtcctgttttactcgctcc

SEQ ID NO: 9074 - DNA, 60 bp, Artificial Sequence
  Description of Artificial Sequence: Synthetic probe
cttcacctctccatctggtaggagattcttggttcccgccaaccccgagaatagaagagc

SEQ ID NO: 9075 - DNA, 54 bp, Artificial Sequence
  Description of Artificial Sequence: Synthetic probe
tcctctgaatctccaagtttctgagcttggggtgctgggcctattttataggcc

SEQ ID NO: 9076 - DNA, 60 bp, Artificial Sequence
  Description of Artificial Sequence: Synthetic probe
atggcaactcgccccattcggcggctcgcaaaagctctcagtgccgcacggcgataggaa

SEQ ID NO: 9077 - DNA, 60 bp, Artificial Sequence
  Description of Artificial Sequence: Synthetic probe
ggccctgccttttgcaacagaagagttgtcggatccactcattggagggccgacctcgca

SEQ ID NO: 9078 - DNA, 60 bp, Artificial Sequence
  Description of Artificial Sequence: Synthetic probe
tgcccctgtctgtggccttgacgtctgtgttgaccacacccacttccaccagcattgtcc

SEQ ID NO: 9079 - DNA, 60 bp, Artificial Sequence
  Description of Artificial Sequence: Synthetic probe
caaggcttataacgtctacatctccccatctggcaagaagttcctggtccttgtcaaccc

SEQ ID NO: 9080 - DNA, 60 bp, Artificial Sequence
  Description of Artificial Sequence: Synthetic probe
cacgcgcccctcaggcctgttttgtaatgtgacacccgtcaaactgagcgacttgagtga

SEQ ID NO: 9081 - DNA, 60 bp, Artificial Sequence
  Description of Artificial Sequence: Synthetic probe
ccctgcccttaacagcaattgtggcgggattcggtcttcaggaagtcgccctggtcgctt

SEQ ID NO: 9082 - DNA, 60 bp, Artificial Sequence
  Description of Artificial Sequence: Synthetic probe
ttcttaaaccttgggaccctgttcgcagccttgttgtgggccccgtcggtctcggtcttg

SEQ ID NO: 9083 - DNA, 60 bp, Artificial Sequence
  Description of Artificial Sequence: Synthetic probe
tccgtcaccatccgagctaatgacacctccgagtgagcccatacttgtgcccgcattgcg

SEQ ID NO: 9084 - DNA, 60 bp, Artificial Sequence
  Description of Artificial Sequence: Synthetic probe
agcggtctcagctccccaaattcggtcggagtcttcggatttgaccctgcctgccttgac

SEQ ID NO: 9085 - DNA, 60 bp, Artificial Sequence
  Description of Artificial Sequence: Synthetic probe
acaaagaatggtgcgggtcgcggctgaactttacagagccggccagctcactcctgcagt

SEQ ID NO: 9086 - DNA, 50 bp, Artificial Sequence
  Description of Artificial Sequence: Synthetic probe
tataacttaacgctatgtgaactgaatggcacagattggctggcacaaaa

SEQ ID NO: 9087 - DNA, 60 bp, Artificial Sequence
  Description of Artificial Sequence: Synthetic probe
gcaccaattcatctgcgctgttcacgacgaggataacgccaccttgcctcgccatgacaa

SEQ ID NO: 9088 - DNA, 54 bp, Artificial Sequence
  Description of Artificial Sequence: Synthetic probe
aatgctactccggtgactgatgggcgctccgccttggctacaaccatgccctct

SEQ ID NO: 9089 - DNA, 60 bp, Artificial Sequence
  Description of Artificial Sequence: Synthetic probe
cgaaatggactgattttaagtgctttgtctctgcgtccaacatgaggaatgcagcgggcc

SEQ ID NO: 9090 - DNA, 50 bp, Artificial Sequence
  Description of Artificial Sequence: Synthetic probe
taactcagctagggtttccggggttggcttcaatcaaatgcttgacttta

SEQ ID NO: 9091 - DNA, 60 bp, Artificial Sequence
  Description of Artificial Sequence: Synthetic probe
ccctcgggagtcttggccgtggtgctattggcttctctctggcttttaggtcgttatact

SEQ ID NO: 9092 - DNA, 56 bp, Artificial Sequence
  Description of Artificial Sequence: Synthetic probe
gaggcccacacctcattgctgccttacatgttgcctgctcgatggcgttacacatg

SEQ ID NO: 9093 - DNA, 60 bp, Artificial Sequence
  Description of Artificial Sequence: Synthetic probe
gcgcttgcggtagcgccaagtacgtgcttaagctggagggtgagcattggactgtctctg

SEQ ID NO: 9094 - DNA, 60 bp, Artificial Sequence
  Description of Artificial Sequence: Synthetic probe
attttacaggcccgaagagccactccggtggacgttgccacgtgcattccccactgtcga

SEQ ID NO: 9095 - DNA, 60 bp, Artificial Sequence
  Description of Artificial Sequence: Synthetic probe
ctttgtctctgcgtccaacatgaggaatgcagcgggtcaatttatcgaggctgcctatgc

SEQ ID NO: 9096 - DNA, 60 bp, Artificial Sequence
  Description of Artificial Sequence: Synthetic probe
ccccatctggtaagaagttcttggtccccgtcaacccagagaatggaagagttcaacggg

SEQ ID NO: 9097 - DNA, 60 bp, Artificial Sequence
  Description of Artificial Sequence: Synthetic probe
ccccatctggtaagaagttcttggtccccgtcaacccagagaatggaagagttcagtggg

SEQ ID NO: 9098 - DNA, 55 bp, Artificial Sequence
  Description of Artificial Sequence: Synthetic probe
atgtgtggtgaatggccctgattgaccctgtgcctttaagtcacctattcaatta

SEQ ID NO: 9099 - DNA, 60 bp, Artificial Sequence
  Description of Artificial Sequence: Synthetic probe
gcaacatactgtgcgtttgatccgcgccccagcatcaccctcagcatgatgggctggcat

SEQ ID NO: 9100 - DNA, 53 bp, Artificial Sequence
  Description of Artificial Sequence: Synthetic probe
ggggatgtcatcacgttacctccaaatacctcccgcgcttccttcccaaggaa

SEQ ID NO: 9101 - DNA, 60 bp, Artificial Sequence
  Description of Artificial Sequence: Synthetic probe
ctccactacggttaacggcacattggtccccgggttgaaaagcctcgtgttgggtggcag

SEQ ID NO: 9102 - DNA, 60 bp, Artificial Sequence
  Description of Artificial Sequence: Synthetic probe
gggtttacaatgtctacacctccccatctggtaggaggttcctggttcccgccaaccctg

SEQ ID NO: 9103 - DNA, 60 bp, Artificial Sequence
  Description of Artificial Sequence: Synthetic probe
attgtcacttgtcttttacagccttggtgcagtgaccggtcttgtcgcagatcttgcggc

SEQ ID NO: 9104 - DNA, 60 bp, Artificial Sequence
  Description of Artificial Sequence: Synthetic probe
gccttcgggaatcttggccgtggtgttattagtttctctttggcttttaggtcgttatac

SEQ ID NO: 9105 - DNA, 60 bp, Artificial Sequence
  Description of Artificial Sequence: Synthetic probe
gctccgtccgcagatacaggcggcgccggcttattcactgatttgctgccttcagatggt

SEQ ID NO: 9106 - DNA, 53 bp, Artificial Sequence
  Description of Artificial Sequence: Synthetic probe
aggacctgactaaggagcagtgtttaaactgctagccgccagcggcttgaccc

SEQ ID NO: 9107 - DNA, 60 bp, Artificial Sequence
  Description of Artificial Sequence: Synthetic probe
cccggctccactacggttaacggcatattggtgcccgggttgaaaagcctcgtgttgggt

SEQ ID NO: 9108 - DNA, 60 bp, Artificial Sequence
  Description of Artificial Sequence: Synthetic probe
tactgtgcgcctgattcgcgtcacagcaccaccctcagcgtgatgggctggcattcttga

SEQ ID NO: 9109 - DNA, 60 bp, Artificial Sequence
  Description of Artificial Sequence: Synthetic probe
ccgtcctttccggcgattcgtaaaagctctcaatgccgcacggcgataggaacacccgtg

SEQ ID NO: 9110 - DNA, 60 bp, Artificial Sequence
  Description of Artificial Sequence: Synthetic probe
gctccgcggtactccgtgcgcgccctacctttcaccctgagcaattacagaagatcctat

SEQ ID NO: 9111 - DNA, 60 bp, Artificial Sequence
  Description of Artificial Sequence: Synthetic probe
gcagagcatgtttgatcttcctgagaaaggcacacccgtcaaccttgctgtgcaccgtga

SEQ ID NO: 9112 - DNA, 60 bp, Artificial Sequence
  Description of Artificial Sequence: Synthetic probe
gcgagcaatgtttctgaatactacgcttcggcggctgcgatactcatggacagctgtgcc

SEQ ID NO: 9113 - DNA, 60 bp, Artificial Sequence
  Description of Artificial Sequence: Synthetic probe
gcaccccaactctcgcccggtgacattgtcgttgctcttggccatacgcctgttggtagt

SEQ ID NO: 9114 - DNA, 60 bp, Artificial Sequence
  Description of Artificial Sequence: Synthetic probe
aattaagtgcgtgacagccgcacatgtccttacgggcaactcagctagggtttccggggt

SEQ ID NO: 9115 - DNA, 60 bp, Artificial Sequence
  Description of Artificial Sequence: Synthetic probe
ttggttgctggctggcttttgctgttggcctgttcaagcctgtgtccgacccagtcggca

SEQ ID NO: 9116 - DNA, 60 bp, Artificial Sequence
  Description of Artificial Sequence: Synthetic probe
ccatccgagccgatgacacctctgggtgagcctgcactcttgcccgcgttgcaacatatt

SEQ ID NO: 9117 - DNA, 60 bp, Artificial Sequence
  Description of Artificial Sequence: Synthetic probe
cccgccaatactgtccctgaaggcaactgctggtggcgcttgtttgacttgctcccactg

SEQ ID NO: 9118 - DNA, 60 bp, Artificial Sequence
  Description of Artificial Sequence: Synthetic probe
tttacaggcccgaagagccactccggtggacgttgccacgtgcatttcccactgtcgagt

SEQ ID NO: 9119 - DNA, 57 bp, Artificial Sequence
  Description of Artificial Sequence: Synthetic probe
ggcctattctataggcccgaagagccactccggtggacgttgccacgtgcattcccc

SEQ ID NO: 9120 - DNA, 60 bp, Artificial Sequence
  Description of Artificial Sequence: Synthetic probe
cggttaacggcacattggtgcccgggttgaagagcctcgtgttgggtggcagaaaagctg

SEQ ID NO: 9121 - DNA, 60 bp, Artificial Sequence
  Description of Artificial Sequence: Synthetic probe
gcgctgttcatgatgggcagaacaccaccttgccccgccatgacaacttttcagccgtgt

SEQ ID NO: 9122 - DNA, 60 bp, Artificial Sequence
  Description of Artificial Sequence: Synthetic probe
gcagagcttgtttgatcttcctgcaaaaggcacacccgttaacctcgcagtgcaccgcga

SEQ ID NO: 9123 - DNA, 60 bp, Artificial Sequence
  Description of Artificial Sequence: Synthetic probe
cacctgcaattgtccgctggtttgccgccaatcttctttataagcttgcctgtgctgaag

SEQ ID NO: 9124 - DNA, 60 bp, Artificial Sequence
  Description of Artificial Sequence: Synthetic probe
atctcccaaattacttgcccatcacggaccgggcaacaccgggatcgatggcacgctctg

SEQ ID NO: 9125 - DNA, 60 bp, Artificial Sequence
  Description of Artificial Sequence: Synthetic probe
ccgctgcctgcacaacatccttgttggcgatggagtgttctctgcggctttcttcctgcg

SEQ ID NO: 9126 - DNA, 60 bp, Artificial Sequence
  Description of Artificial Sequence: Synthetic probe
accccgacactttcactgcagccctccgatctgggtactccaccacaaacctcgtccttg

SEQ ID NO: 9127 - DNA, 60 bp, Artificial Sequence
  Description of Artificial Sequence: Synthetic probe
accaacctgccagagatcctcggacatcatcgcagaggtttgacgggagcacaccagctc

SEQ ID NO: 9128 - DNA, 60 bp, Artificial Sequence
  Description of Artificial Sequence: Synthetic probe
aagactgtgtcccgaccggcaacacctctgagtgagccgatccctgtgcccgcaccgcga

SEQ ID NO: 9129 - DNA, 60 bp, Artificial Sequence
  Description of Artificial Sequence: Synthetic probe
acagtcgctggccgcgctttgcccgttcgtgaaacccggcaggtcgaggagcacgaggtt

SEQ ID NO: 9130 - DNA, 60 bp, Artificial Sequence
  Description of Artificial Sequence: Synthetic probe
gtgcccgggttgaaaagcctcgtgttgggtggcagaaaagctgttaaacgaggagtggtg

SEQ ID NO: 9131 - DNA, 60 bp, Artificial Sequence
  Description of Artificial Sequence: Synthetic probe
ggtgcccgggttgaaaagcctcgtgttgggtggcagaaaagctgttaaacagggagtggt

SEQ ID NO: 9132 - DNA, 51 bp, Artificial Sequence
  Description of Artificial Sequence: Synthetic probe
tgcaggcgggtggggcgatggtggctgaagcgattccaaaagtggttaagg

SEQ ID NO: 9133 - DNA, 60 bp, Artificial Sequence
  Description of Artificial Sequence: Synthetic probe
tgacgccgttatgttcgtggccgaagggagggtctcctgggctccgcgtggtggggaaaa

SEQ ID NO: 9134 - DNA, 60 bp, Artificial Sequence
  Description of Artificial Sequence: Synthetic probe
agtttgccaacgcatcacactgtgcgtctaatccgcgccacaacatcaccttcagcatga

SEQ ID NO: 9135 - DNA, 60 bp, Artificial Sequence
  Description of Artificial Sequence: Synthetic probe
tcatctgcgccgaacatgacgggctgaacgccaccctgcctcgccatgacaacatttcag

SEQ ID NO: 9136 - DNA, 60 bp, Artificial Sequence
  Description of Artificial Sequence: Synthetic probe
cagcgtacttgtacgagttcactggaaacggcgaggactgggaggattacaacgacgcgt

SEQ ID NO: 9137 - DNA, 60 bp, Artificial Sequence
  Description of Artificial Sequence: Synthetic probe
cacccacttccacccgcattgtccagtcataatatggtgtggccatccagcgggttctgg

SEQ ID NO: 9138 - DNA, 60 bp, Artificial Sequence
  Description of Artificial Sequence: Synthetic probe
ttggtctccggtgctgacgcatctcccaagttgctcgcccatcatggaccgggaaacact

SEQ ID NO: 9139 - DNA, 60 bp, Artificial Sequence
  Description of Artificial Sequence: Synthetic probe
gcactaactggatttgctgcagatcttgcaactagtcaggggcactcgctgcacgcggcc

SEQ ID NO: 9140 - DNA, 60 bp, Artificial Sequence
  Description of Artificial Sequence: Synthetic probe
ggcgcggatgctggtccggtcagagccctattgaacaacccactgagaaacccattgcgt

SEQ ID NO: 9141 - DNA, 60 bp, Artificial Sequence
  Description of Artificial Sequence: Synthetic probe
attgtgtcccgattggtgtcgtcaccgatagtatcgactcctgtgcccgcgccacgacgt

SEQ ID NO: 9142 - DNA, 60 bp, Artificial Sequence
  Description of Artificial Sequence: Synthetic probe
acgtgcaggtgctgccactacagttgctggtcacgcctcgcctgttcgcgaaactcagca

SEQ ID NO: 9143 - DNA, 60 bp, Artificial Sequence
  Description of Artificial Sequence: Synthetic probe
gggcagtggagactttcgttatctttcctgtgttgactcatattgtttcctatggcgccc

SEQ ID NO: 9144 - DNA, 60 bp, Artificial Sequence
  Description of Artificial Sequence: Synthetic probe
cctccatattctcttctgttgcggcttcctgcacccttttcgccgtgctgtggttgcggc

SEQ ID NO: 9145 - DNA, 60 bp, Artificial Sequence
  Description of Artificial Sequence: Synthetic probe
cgtttcgtgcgcgacagaaaggaaaggtttataaggccactgccaccagcctgaagttcc

SEQ ID NO: 9146 - DNA, 60 bp, Artificial Sequence
  Description of Artificial Sequence: Synthetic probe
gctctccactccccaaggttgcacataatctggggttttatttctcacctgatttgatac

SEQ ID NO: 9147 - DNA, 60 bp, Artificial Sequence
  Description of Artificial Sequence: Synthetic probe
tgggcgtcagctagtcccaaatcgtgacaggatcctcgcagctcttgcctaccacatgaa

SEQ ID NO: 9148 - DNA, 60 bp, Artificial Sequence
  Description of Artificial Sequence: Synthetic probe
cccaaggttttgttttacccggagtccttcgcctcgtgcgaaagtacttgtttgcccacg

SEQ ID NO: 9149 - DNA, 60 bp, Artificial Sequence
  Description of Artificial Sequence: Synthetic probe
aaacttgaggctttcgctgatactgtagcgccccaactctcgcccggtgacattgtcgtc

SEQ ID NO: 9150 - DNA, 60 bp, Artificial Sequence
  Description of Artificial Sequence: Synthetic probe
acgtccaagttgtgcatctcccagcatggtcttactctgcctttaacagcgcttgtggcg

SEQ ID NO: 9151 - DNA, 60 bp, Artificial Sequence
  Description of Artificial Sequence: Synthetic probe
attctcgggaaggtacaaggtgttggcgaagcgaccgaccagggacccttggcacccttc

SEQ ID NO: 9152 - DNA, 60 bp, Artificial Sequence
  Description of Artificial Sequence: Synthetic probe
aagcatggcgttgctggcaagtacatacagcggaggctgcaaattaatggtcttcgagca

SEQ ID NO: 9153 - DNA, 60 bp, Artificial Sequence
  Description of Artificial Sequence: Synthetic probe
tcccgtgttgactcacattgtctcatatagtgcactcaccactagccatttccttgacac

SEQ ID NO: 9154 - DNA, 55 bp, Artificial Sequence
  Description of Artificial Sequence: Synthetic probe
ggtgatgccatttacacgccaactcaccagaccatgctcgatatgattagggctt

SEQ ID NO: 9155 - DNA, 60 bp, Artificial Sequence
  Description of Artificial Sequence: Synthetic probe
cggcaacaatgctgacgcaccaggacgaacctctagatttgtctgcatcctcacagactg

SEQ ID NO: 9156 - DNA, 60 bp, Artificial Sequence
  Description of Artificial Sequence: Synthetic probe
taggccagtgacacctttgagtgtgctggccccagtacctgcaccgcgtagaactgtgtc

SEQ ID NO: 9157 - DNA, 60 bp, Artificial Sequence
  Description of Artificial Sequence: Synthetic probe
gccgatgacacctctgagtgagcctgcacctatgcccgcgttgcaatatatttctaggcc

SEQ ID NO: 9158 - DNA, 60 bp, Artificial Sequence
  Description of Artificial Sequence: Synthetic probe
cctcgtggcggggatgaggcgaaatttgaacctgtccctagggagttgaagttgatcgcg

SEQ ID NO: 9159 - DNA, 60 bp, Artificial Sequence
  Description of Artificial Sequence: Synthetic probe
tcccggctccactacggttaacggcacattggtgcccgggttgaaaagcctcgtgttggg

SEQ ID NO: 9160 - DNA, 60 bp, Artificial Sequence
  Description of Artificial Sequence: Synthetic probe
cattgtctcctatggtgccctcaccaccagccattttcttgacacagtcgctttagtcac

SEQ ID NO: 9161 - DNA, 60 bp, Artificial Sequence
  Description of Artificial Sequence: Synthetic probe
gcgccgaacatgacgggcagaacgccaccttgtctcgtcatgacaatatttcagccgtgt

SEQ ID NO: 9162 - DNA, 58 bp, Artificial Sequence
  Description of Artificial Sequence: Synthetic probe
ccccggatacaaaattctggcgtgcgcggagttctcgttggatgacccagttaggtac

SEQ ID NO: 9163 - DNA, 60 bp, Artificial Sequence
  Description of Artificial Sequence: Synthetic probe
tggcctcctgttcttacaagaccagctgaagtttgaggacatgctcaaggtccaacccct

SEQ ID NO: 9164 - DNA, 60 bp, Artificial Sequence
  Description of Artificial Sequence: Synthetic probe
gggaaggggtgtcgcaatcctgcggaatgaaccatgagtctctgactggtgccctcgcta

SEQ ID NO: 9165 - DNA, 56 bp, Artificial Sequence
  Description of Artificial Sequence: Synthetic probe
ttggtttctctttggcttcttggtcgctatactaatgttgctggccttgtcacccc

SEQ ID NO: 9166 - DNA, 60 bp, Artificial Sequence
  Description of Artificial Sequence: Synthetic probe
gacatgctgacttggcgcaacacgtctgtttgccaggcgattcgcaccttagatggcagg

SEQ ID NO: 9167 - DNA, 60 bp, Artificial Sequence
  Description of Artificial Sequence: Synthetic probe
aagcctgtccccgctccgcgcaggaaggttgggcccgattgtggcagcccggtttcatta

SEQ ID NO: 9168 - DNA, 60 bp, Artificial Sequence
  Description of Artificial Sequence: Synthetic probe
gttcagggctgttgtgagcacaagggcggtcttggttccccagatgcaatcgaggtctct

SEQ ID NO: 9169 - DNA, 60 bp, Artificial Sequence
  Description of Artificial Sequence: Synthetic probe
ccgggcaggtgttggctctatgcctcggcatttgtattgtcaggagctgtgaccattggc

SEQ ID NO: 9170 - DNA, 60 bp, Artificial Sequence
  Description of Artificial Sequence: Synthetic probe
cagggaggataagttacactgtggagtttagtttgcctacgcatcatactgtgcgcctga

SEQ ID NO: 9171 - DNA, 60 bp, Artificial Sequence
  Description of Artificial Sequence: Synthetic probe
taggccgcaagtacattctggcccctgcccaccacgttgagagtgccgcaggctttcatc

SEQ ID NO: 9172 - DNA, 60 bp, Artificial Sequence
  Description of Artificial Sequence: Synthetic probe
gcctccttcaggggagtttaggggtttgtccctagcaccttgtttctggagttgcactgc

SEQ ID NO: 9173 - DNA, 54 bp, Artificial Sequence
  Description of Artificial Sequence: Synthetic probe
ggcccgaagagccactccggtggacgttgccacgtgcattccccactgttgagt

SEQ ID NO: 9174 - DNA, 56 bp, Artificial Sequence
  Description of Artificial Sequence: Synthetic probe
caggcccgaagagccactccggtggacgttgccacgtgcattccccactgttgagt

SEQ ID NO: 9175 - DNA, 60 bp, Artificial Sequence
  Description of Artificial Sequence: Synthetic probe
tttataggcccgaagagccactccggtggacgttgccacgtgcattccccactgtcgagt

SEQ ID NO: 9176 - DNA, 60 bp, Artificial Sequence
  Description of Artificial Sequence: Synthetic probe
attctacaggcccgaagagccactccggtggacgttgccacgtgcattccccactgttga

SEQ ID NO: 9177 - DNA, 60 bp, Artificial Sequence
  Description of Artificial Sequence: Synthetic probe
ggtgccacattcgatgtggttacactgcatttgcccactaaagattcactcaacaggcaa

SEQ ID NO: 9178 - DNA, 60 bp, Artificial Sequence
  Description of Artificial Sequence: Synthetic probe
ggcgccacattcgatgtggttacactgcatttgcccactaaagattcactcaacaggcaa

SEQ ID NO: 9179 - DNA, 60 bp, Artificial Sequence
  Description of Artificial Sequence: Synthetic probe
ttgactcagtttgctaaactcccggcagaacttgcaccccactggcccgtggtgacgacc

SEQ ID NO: 9180 - DNA, 60 bp, Artificial Sequence
  Description of Artificial Sequence: Synthetic probe
tccgaatcttatgctgggtttccagacggatccaaagaagacaaccatcacagactcacc

SEQ ID NO: 9181 - DNA, 60 bp, Artificial Sequence
  Description of Artificial Sequence: Synthetic probe
cttcacctccccatctggtaggagattcctggtccccgccaatcccgagaatagaagagc

SEQ ID NO: 9182 - DNA, 55 bp, Artificial Sequence
  Description of Artificial Sequence: Synthetic probe
caccatggccaaactcgaggctttcgccgataccgtggcaccccaactctcgccc

SEQ ID NO: 9183 - DNA, 60 bp, Artificial Sequence
  Description of Artificial Sequence: Synthetic probe
ggtggtaatgaacttaagcacttatgccttcctgccccggatgatggttgtgtcctcgcc

SEQ ID NO: 9184 - DNA, 60 bp, Artificial Sequence
  Description of Artificial Sequence: Synthetic probe
gcgcctactggctgacatcctctggcgttgaacccggtgttattgggaatgggttcgcct

SEQ ID NO: 9185 - DNA, 60 bp, Artificial Sequence
  Description of Artificial Sequence: Synthetic probe
ccgagctcctttctttcccgcaggagtgaaggttgatcctgagtgcagaatcgtggttga

SEQ ID NO: 9186 - DNA, 60 bp, Artificial Sequence
  Description of Artificial Sequence: Synthetic probe
cggtccctctgaccgccttctcactgtccaactgctattaccctgcacaaggtgacgagg

SEQ ID NO: 9187 - DNA, 60 bp, Artificial Sequence
  Description of Artificial Sequence: Synthetic probe
ttcatgacccctgggagtggtgtttccttgcgggctgagtaccaatacggttgcctcccc

SEQ ID NO: 9188 - DNA, 60 bp, Artificial Sequence
  Description of Artificial Sequence: Synthetic probe
gccggccaactcacccctacagttctaaggactctacaagtttatgaacggggttgtcgc

SEQ ID NO: 9189 - DNA, 60 bp, Artificial Sequence
  Description of Artificial Sequence: Synthetic probe
tgaagcttttgctgataccgtggcaccccaactttcgcccggtgacattgttgtcgctct

SEQ ID NO: 9190 - DNA, 60 bp, Artificial Sequence
  Description of Artificial Sequence: Synthetic probe
tgccgtctgtgcttgttaggccgcaagtacattctggcccctgcccaccacgtcgaaagt

SEQ ID NO: 9191 - DNA, 60 bp, Artificial Sequence
  Description of Artificial Sequence: Synthetic probe
ctggaggaggtcgttcgtgaggaatatgggcttatgtcaattggatcaggccctcgaccc

SEQ ID NO: 9192 - DNA, 57 bp, Artificial Sequence
  Description of Artificial Sequence: Synthetic probe
gtgacgaggttcgtcaccgcgagaggctgaacttcgtgctctctaagctggaggagg

SEQ ID NO: 9193 - DNA, 53 bp, Artificial Sequence
  Description of Artificial Sequence: Synthetic probe
gtggtaaacctcgttaaatatgccaaataacaacggcaggcagcagaagaaaa

SEQ ID NO: 9194 - DNA, 60 bp, Artificial Sequence
  Description of Artificial Sequence: Synthetic probe
cacccagtgggttttgattcccattgctatgtctttgacattatgcctcagactcaactg

SEQ ID NO: 9195 - DNA, 60 bp, Artificial Sequence
  Description of Artificial Sequence: Synthetic probe
agaacttgtggttggaatagcgcaatgcgcccgcaaggacggctacagcttccccggccc

SEQ ID NO: 9196 - DNA, 60 bp, Artificial Sequence
  Description of Artificial Sequence: Synthetic probe
caagtgcccacctgtccatcggccctccacttacccggccaagaattccatggctggaat

SEQ ID NO: 9197 - DNA, 60 bp, Artificial Sequence
  Description of Artificial Sequence: Synthetic probe
gcgagctgaccgccaaagaactggataaattgaagaggataattgacaaactccaaggcc

SEQ ID NO: 9198 - DNA, 60 bp, Artificial Sequence
  Description of Artificial Sequence: Synthetic probe
tgatccgactcccgcgccgccacccgcacccgtgcccgttcctctcccaccgaaagtatt

SEQ ID NO: 9199 - DNA, 60 bp, Artificial Sequence
  Description of Artificial Sequence: Synthetic probe
ggccttgcacatgctcgttgggatttatgtcaccgcggtgggttcttgtggttctggcac

SEQ ID NO: 9200 - DNA, 60 bp, Artificial Sequence
  Description of Artificial Sequence: Synthetic probe
gtgatgcgtgaggcatgtgatgcgaccaaacttgatgaccctgccacgcaagaatggctt

SEQ ID NO: 9201 - DNA, 60 bp, Artificial Sequence
  Description of Artificial Sequence: Synthetic probe
ttcacctttacggcccctgagtgtggtgtttccatgcgagtcgaacgccagtgtggctgc

SEQ ID NO: 9202 - DNA, 60 bp, Artificial Sequence
  Description of Artificial Sequence: Synthetic probe
ggaaaatttgacactgttcccgaagagctgaggttgattgcagagcaactttatacctcc

SEQ ID NO: 9203 - DNA, 50 bp, Artificial Sequence
  Description of Artificial Sequence: Synthetic probe
tataacttaacgctatgtgagccgaatggcacagattggctggcacaaaa

SEQ ID NO: 9204 - DNA, 57 bp, Artificial Sequence
  Description of Artificial Sequence: Synthetic probe
actggcaatttgaatgttaaagtatgttggggaagtgcttgaccgtgtgctgttgct

SEQ ID NO: 9205 - DNA, 52 bp, Artificial Sequence
  Description of Artificial Sequence: Synthetic probe
ggggcaagacgctgaggaagtcctgagtgaaatctcggacatactaaatgac

SEQ ID NO: 9206 - DNA, 60 bp, Artificial Sequence
  Description of Artificial Sequence: Synthetic probe
tttcccctggctgcagaagatgacatccggcaccacctcacccaaactgaacgctccctc

SEQ ID NO: 9207 - DNA, 60 bp, Artificial Sequence
  Description of Artificial Sequence: Synthetic probe
aggcctcagcaacgcaaggtcaagttccctccagaaagtcgtcccaatgccgtgaagccg

SEQ ID NO: 9208 - DNA, 60 bp, Artificial Sequence
  Description of Artificial Sequence: Synthetic probe
acatcaggggtgagccccaggccttgccagagacactcgtttcaacaggacgcatagcca

SEQ ID NO: 9209 - DNA, 60 bp, Artificial Sequence
  Description of Artificial Sequence: Synthetic probe
tgcattgcactgtcgccggcaggtgtcttgaagccgacttggcctcctgtgaccgcagca

SEQ ID NO: 9210 - DNA, 60 bp, Artificial Sequence
  Description of Artificial Sequence: Synthetic probe
tctattccgagtgacttggcatcgctcctagcttccgtccctgtaatggaaggcggcctc

SEQ ID NO: 9211 - DNA, 60 bp, Artificial Sequence
  Description of Artificial Sequence: Synthetic probe
gcgcggccttgtggttggcccctcaggtctcttatgtgtcatccttggcaagttactcgg

SEQ ID NO: 9212 - DNA, 60 bp, Artificial Sequence
  Description of Artificial Sequence: Synthetic probe
gcgtccctcaaatttcttcctgacatgattcaagacacgccgcctcctgtccccaagaag

SEQ ID NO: 9213 - DNA, 60 bp, Artificial Sequence
  Description of Artificial Sequence: Synthetic probe
tccccatcgccgttcgaggatttgtcccgacagggcccatactccgtcatgttgagcact

SEQ ID NO: 9214 - DNA, 60 bp, Artificial Sequence
  Description of Artificial Sequence: Synthetic probe
attcggccctcgctcccaagattgccccaccggtccccacctgtggaatcaccacctact

SEQ ID NO: 9215 - DNA, 60 bp, Artificial Sequence
  Description of Artificial Sequence: Synthetic probe
ggttgctgatgttttgtatcgcgatggttgcttggcgcctcgacacctccgtgaactcca

SEQ ID NO: 9216 - DNA, 60 bp, Artificial Sequence
  Description of Artificial Sequence: Synthetic probe
atcacctccagatgccgtttgtgcttgctaggccgcaagtacattctggcccctgcccac

SEQ ID NO: 9217 - DNA, 60 bp, Artificial Sequence
  Description of Artificial Sequence: Synthetic probe
ggccactgtgtccaccgccggatattgtcacgggcggtatgtcttgagcagcatttacgc

SEQ ID NO: 9218 - DNA, 60 bp, Artificial Sequence
  Description of Artificial Sequence: Synthetic probe
cagactcaccatcattcctaggttgcaggttaataaatgggcgccagctagtccctaacc

SEQ ID NO: 9219 - DNA, 60 bp, Artificial Sequence
  Description of Artificial Sequence: Synthetic probe
ttgaggcggcgaatcagacaaccgaacagcctcacgtcaactcatgctgcaccctggtcc

SEQ ID NO: 9220 - DNA, 60 bp, Artificial Sequence
  Description of Artificial Sequence: Synthetic probe
gcgccgaacatgatgggcagaacgccaccttgcctcgtcatgacaatatttcagccgtgt

SEQ ID NO: 9221 - DNA, 60 bp, Artificial Sequence
  Description of Artificial Sequence: Synthetic probe
agattctctccgcgccatttgtgcagatctagaggggtcgagctctccgctccccaaggt

SEQ ID NO: 9222 - DNA, 60 bp, Artificial Sequence
  Description of Artificial Sequence: Synthetic probe
ccgcggattagtctctgtcaggcgtggaatcaggggaaatgaagtcgaactaccagacgg

SEQ ID NO: 9223 - DNA, 60 bp, Artificial Sequence
  Description of Artificial Sequence: Synthetic probe
ggaccatactcggcaccaataacttcatcgcgctagcccaccgagcagcgttgagtggtg

SEQ ID NO: 9224 - DNA, 60 bp, Artificial Sequence
  Description of Artificial Sequence: Synthetic probe
cgcccggtgacattgttgtcgctctcggtcatacgcctgttggcagtattttcgacctaa

SEQ ID NO: 9225 - DNA, 60 bp, Artificial Sequence
  Description of Artificial Sequence: Synthetic probe
gcgttcacacgggatcgaataagcaaggaggaggcatcgttacacgcccctcaggccagt

SEQ ID NO: 9226 - DNA, 60 bp, Artificial Sequence
  Description of Artificial Sequence: Synthetic probe
cacggccttaccctgcccttgactgcacttgtggcgggattcggcattcaagaaattgcc

SEQ ID NO: 9227 - DNA, 60 bp, Artificial Sequence
  Description of Artificial Sequence: Synthetic probe
gacgagaacacatcagctccgtccgcaggcacaggtggcaccggctcatttaccgatttg

SEQ ID NO: 9228 - DNA, 60 bp, Artificial Sequence
  Description of Artificial Sequence: Synthetic probe
cctgagccggcaacaccttccagtgagctggtgattgtgtccgcaccgcaatgcatcttc

SEQ ID NO: 9229 - DNA, 60 bp, Artificial Sequence
  Description of Artificial Sequence: Synthetic probe
gcgctttgtccgttcgtgagacccggcaggccaaggagtacgaggttgccggcgccaaca

SEQ ID NO: 9230 - DNA, 56 bp, Artificial Sequence
  Description of Artificial Sequence: Synthetic probe
ccagaaagggaaaatttacaaagctaatgccaccagcatgaggtttcattttcccc

SEQ ID NO: 9231 - DNA, 60 bp, Artificial Sequence
  Description of Artificial Sequence: Synthetic probe
ctgcaagaccagctaaagtttgaggacatactcaaggttcaacccctgatcgtctattcg

SEQ ID NO: 9232 - DNA, 56 bp, Artificial Sequence
  Description of Artificial Sequence: Synthetic probe
cgcaatcgctagttatgtttgggtacctcttacctggttgctttgtgtgtttccgt

SEQ ID NO: 9233 - DNA, 56 bp, Artificial Sequence
  Description of Artificial Sequence: Synthetic probe
acagcacttgtggcgggattcggcctccaagagattgccttggtcgttttgatttt

SEQ ID NO: 9234 - DNA, 60 bp, Artificial Sequence
  Description of Artificial Sequence: Synthetic probe
cgcgggagtctaacgagagcataatagctccgcccgcagatacaggtggtgtcggctcat

SEQ ID NO: 9235 - DNA, 60 bp, Artificial Sequence
  Description of Artificial Sequence: Synthetic probe
aaccggtctgtgaccaacctgccaaagatccccggatgtcgccgcgggagtctaacgaga

SEQ ID NO: 9236 - DNA, 60 bp, Artificial Sequence
  Description of Artificial Sequence: Synthetic probe
ccaatttggctaccaaaccaagcatggtgtccctggcaagtacctacagcggaggctgca

SEQ ID NO: 9237 - DNA, 60 bp, Artificial Sequence
  Description of Artificial Sequence: Synthetic probe
cgtgttgtggttgcggcttccaataatacgtactgcttttggtttccactggttaggggc

SEQ ID NO: 9238 - DNA, 60 bp, Artificial Sequence
  Description of Artificial Sequence: Synthetic probe
ttcctccttatctaccgttgaccaactttgggcttagactgaaatgaaatgggagctgtg

SEQ ID NO: 9239 - DNA, 60 bp, Artificial Sequence
  Description of Artificial Sequence: Synthetic probe
gcgctgaggagcacctaccgtcgtatgtgttgaattgctgccatgatctactggtcacgc

SEQ ID NO: 9240 - DNA, 60 bp, Artificial Sequence
  Description of Artificial Sequence: Synthetic probe
ggtgaattggcagatgtccaacctgctagagaaccccgggcacaaacccctcctgcaagc

SEQ ID NO: 9241 - DNA, 56 bp, Artificial Sequence
  Description of Artificial Sequence: Synthetic probe
gaggcccacacctcattgctgctttgcatgtcgcctgctcgatggcgttacacatg

SEQ ID NO: 9242 - DNA, 60 bp, Artificial Sequence
  Description of Artificial Sequence: Synthetic probe
gtcgacctaccagacggtgattacgctagcaccgccttgctccctacttgtaaagagatc

SEQ ID NO: 9243 - DNA, 56 bp, Artificial Sequence
  Description of Artificial Sequence: Synthetic probe
taggtcgttatactaacgttgctggtcttgtcactccctatgacattcatcattac

SEQ ID NO: 9244 - DNA, 50 bp, Artificial Sequence
  Description of Artificial Sequence: Synthetic probe
ttcttgatttctgtaaatataccctcaggagtcttggccgtggtgttgtt

SEQ ID NO: 9245 - DNA, 60 bp, Artificial Sequence
  Description of Artificial Sequence: Synthetic probe
ggctgacgtctatgacattggtcgtggcgctgtcatgtatgtggccggaggaaaggtctc

SEQ ID NO: 9246 - DNA, 60 bp, Artificial Sequence
  Description of Artificial Sequence: Synthetic probe
tgataaccacgcatttgtcgtccggcgtcccggctccactacggttaacggcacactggt

SEQ ID NO: 9247 - DNA, 60 bp, Artificial Sequence
  Description of Artificial Sequence: Synthetic probe
ggcaaatgataaccacgcatttgtcgtccggcgtcccggctccactacggttaacggcac

SEQ ID NO: 9248 - DNA, 60 bp, Artificial Sequence
  Description of Artificial Sequence: Synthetic probe
ccagtccagaggtaagggaccggggaagaaaagtaagacgaaaagcctggagaagcccca

SEQ ID NO: 9249 - DNA, 60 bp, Artificial Sequence
  Description of Artificial Sequence: Synthetic probe
ggctgaacgatcattttagttgggcagtggagacgttcgtcatctttcctgtgttgactc

SEQ ID NO: 9250 - DNA, 60 bp, Artificial Sequence
  Description of Artificial Sequence: Synthetic probe
gaagccgagacttgtaaatacttgacctcccggctgccaatgctgcacaatctgcgcatg

SEQ ID NO: 9251 - DNA, 60 bp, Artificial Sequence
  Description of Artificial Sequence: Synthetic probe
gatgtgtacctcccagaccttgaagcttatctccatcctaagaccctgtccaagtgctgg

SEQ ID NO: 9252 - DNA, 60 bp, Artificial Sequence
  Description of Artificial Sequence: Synthetic probe
gagtcactaactggtgccctcgccatgacactcagcgacgaagacttagatttcctcaca

SEQ ID NO: 9253 - DNA, 60 bp, Artificial Sequence
  Description of Artificial Sequence: Synthetic probe
ggtggtccatacctcttggcggccttacatgtcgcttgctcggtggccttgcacatgcta

SEQ ID NO: 9254 - DNA, 60 bp, Artificial Sequence
  Description of Artificial Sequence: Synthetic probe
ggcggggcacgctacgtctggctgtttctgcttaggcttggcatcgtttcagactgcatc

SEQ ID NO: 9255 - DNA, 60 bp, Artificial Sequence
  Description of Artificial Sequence: Synthetic probe
catgtgatgcgaccaagcttgatgaccccgccacgcaagaatggctttcccgcatgtggg

SEQ ID NO: 9256 - DNA, 60 bp, Artificial Sequence
  Description of Artificial Sequence: Synthetic probe
cgccggtcacgctccgcctacccgtgaaacccagcaagctaagaaacacgaagctgctat

SEQ ID NO: 9257 - DNA, 60 bp, Artificial Sequence
  Description of Artificial Sequence: Synthetic probe
ggctgccgtctatgacattggtcatgatgccattatgttcgtggccgaggggagagtctc

SEQ ID NO: 9258 - DNA, 60 bp, Artificial Sequence
  Description of Artificial Sequence: Synthetic probe
cggttaacggcacattggtgcccgggttgaaaagcctcgtgttgggtggcagaaaagctg

SEQ ID NO: 9259 - DNA, 60 bp, Artificial Sequence
  Description of Artificial Sequence: Synthetic probe
cggttaacggcacactggtgcccgggttgaaaagcctcgtgttgggtggcagaaaagctg

SEQ ID NO: 9260 - DNA, 60 bp, Artificial Sequence
  Description of Artificial Sequence: Synthetic probe
cggtcaacggcacattggtgcccgggttgaaaagcctcgtgttgggtggcagaaaagctg

SEQ ID NO: 9261 - DNA, 60 bp, Artificial Sequence
  Description of Artificial Sequence: Synthetic probe
tttcccttggctgctgaagatgacatccggcatcacctcacccagactgaacgttccctc

SEQ ID NO: 9262 - DNA, 60 bp, Artificial Sequence
  Description of Artificial Sequence: Synthetic probe
cgcaatgtcgccaagccgtcggcaccccacagtacatcacgataacggctaatgtgaccg

SEQ ID NO: 9263 - DNA, 60 bp, Artificial Sequence
  Description of Artificial Sequence: Synthetic probe
aaccccgactgccgcctgagctagcaccgtgaacctgaagtgatgcaatggggtcgttgt

SEQ ID NO: 9264 - DNA, 58 bp, Artificial Sequence
  Description of Artificial Sequence: Synthetic probe
tgcggcattgccaggtgcgctcgccaagatggctacagttttcccggcccggcatttt

SEQ ID NO: 9265 - DNA, 60 bp, Artificial Sequence
  Description of Artificial Sequence: Synthetic probe
attgacgttcttctgaaacccggacttgacacgacacccggcattcaaccggggcatggg

SEQ ID NO: 9266 - DNA, 60 bp, Artificial Sequence
  Description of Artificial Sequence: Synthetic probe
cctcacggcggccctcacccgtaacaagctttctctggtattctatgctctcggaggtgt

SEQ ID NO: 9267 - DNA, 60 bp, Artificial Sequence
  Description of Artificial Sequence: Synthetic probe
ccccacttatggtcccggtgtcgtgtgctcctcccaactttgtgtatccgccgacggtgt

SEQ ID NO: 9268 - DNA, 60 bp, Artificial Sequence
  Description of Artificial Sequence: Synthetic probe
atgaacggtgcctccaagcctgtgagcccggcagtcgtgcaaccccagccaccaagaagt

SEQ ID NO: 9269 - DNA, 60 bp, Artificial Sequence
  Description of Artificial Sequence: Synthetic probe
ctcgcgaatgtgtggttggcgtttgttccgaaggctgtgtcgcgtcgtcttacccagaga

SEQ ID NO: 9270 - DNA, 60 bp, Artificial Sequence
  Description of Artificial Sequence: Synthetic probe
tgtctcagtgcacggcctcttctccctccagagctccaggaccccggtcttggcgcaatt

SEQ ID NO: 9271 - DNA, 60 bp, Artificial Sequence
  Description of Artificial Sequence: Synthetic probe
agacgcggttgagcacaaccaacacccggttgcgagaccgatcgatggtggggttgtgct

SEQ ID NO: 9272 - DNA, 60 bp, Artificial Sequence
  Description of Artificial Sequence: Synthetic probe
atggccgcgattggcgtgtggcctctaagtcacctattcaattagggcgatcacatgggg

SEQ ID NO: 9273 - DNA, 60 bp, Artificial Sequence
  Description of Artificial Sequence: Synthetic probe
atggccgcgattggcgtgtggcttctgagtcacctattcaattagggcgatcacatgggg

SEQ ID NO: 9274 - DNA, 56 bp, Artificial Sequence
  Description of Artificial Sequence: Synthetic probe
cggcaaacgagctgttaaacgaggagtggttaacctcgtcaagtatggccggtaaa

SEQ ID NO: 9275 - DNA, 60 bp, Artificial Sequence
  Description of Artificial Sequence: Synthetic probe
gtgctgggcggcaaacgagctgttaaacgaggagtggttaacctcgtcaagtatggccgg

SEQ ID NO: 9276 - DNA, 60 bp, Artificial Sequence
  Description of Artificial Sequence: Synthetic probe
gtgctgggcggcaaacgagctgttaaacgaggagtggttaacctcgtcaaatatggccgg

SEQ ID NO: 9277 - DNA, 60 bp, Artificial Sequence
  Description of Artificial Sequence: Synthetic probe
ccaggacttcggggcctcgtgttgggcggcaaacgagctgttaaacgaggagtggttaac

SEQ ID NO: 9278 - DNA, 60 bp, Artificial Sequence
  Description of Artificial Sequence: Synthetic probe
cgtctggtaaccgagcatacgctgtgagaaagcccggactaacatcagtgaacggcactc

SEQ ID NO: 9279 - DNA, 60 bp, Artificial Sequence
  Description of Artificial Sequence: Synthetic probe
gcttgcattgaccatgaccctgagtggtatgaggacctcatctgcggtattgcccggtgc

SEQ ID NO: 9280 - DNA, 60 bp, Artificial Sequence
  Description of Artificial Sequence: Synthetic probe
tgccatgaccttgtggcaacacaggatggtgccttcacaaaacgcggtggcctgtcgtcc

SEQ ID NO: 9281 - DNA, 58 bp, Artificial Sequence
  Description of Artificial Sequence: Synthetic probe
agttgccttaggcatcgcggctcggcccctgaggcgattcgcaaaatccctcagtgcc

SEQ ID NO: 9282 - DNA, 60 bp, Artificial Sequence
  Description of Artificial Sequence: Synthetic probe
ccggtgggtctctttggtgcagaatagggtatgaccgatgtgaggaggatgatcgtgacg

SEQ ID NO: 9283 - DNA, 60 bp, Artificial Sequence
  Description of Artificial Sequence: Synthetic probe
ccttgcttgctgccaaacctgaaccggaaggaggcctctccaccgtccaacttctttgtg

SEQ ID NO: 9284 - DNA, 60 bp, Artificial Sequence
  Description of Artificial Sequence: Synthetic probe
atcggctttgtgcgccaaaaggaatggaccctatttctctcgccactgggtggcgcgggt

SEQ ID NO: 9285 - DNA, 60 bp, Artificial Sequence
  Description of Artificial Sequence: Synthetic probe
accagaacgagcccctggacttgtctgcttcctcacagactgaatatgaggcctctcccc

SEQ ID NO: 9286 - DNA, 60 bp, Artificial Sequence
  Description of Artificial Sequence: Synthetic probe
aaccgagcctggtccacagcccacactgccacgcgggctcgatgaactcaaagaccagat

SEQ ID NO: 9287 - DNA, 60 bp, Artificial Sequence
  Description of Artificial Sequence: Synthetic probe
cccagatgatcaaactgcctcaggtcaaccagtgccgtgctctggtccctgttgtgactc

SEQ ID NO: 9288 - DNA, 60 bp, Artificial Sequence
  Description of Artificial Sequence: Synthetic probe
cggcaggccaaggagcacgaggttgccggcaccaacaaggctgagcacctcaaacactac

SEQ ID NO: 9289 - DNA, 58 bp, Artificial Sequence
  Description of Artificial Sequence: Synthetic probe
tgcggaccagctccgcacttccttcccgccccaccacacagtggacgtgtctaagttc

SEQ ID NO: 9290 - DNA, 60 bp, Artificial Sequence
  Description of Artificial Sequence: Synthetic probe
cccgggcaggtgttggctctatgcctcggctttgtattgtcaggagctgtgaccattggc

SEQ ID NO: 9291 - DNA, 60 bp, Artificial Sequence
  Description of Artificial Sequence: Synthetic probe
gatgtgagaaggatgatcatgacgagctagggtttatggtaccgcctggcctctccagcg

SEQ ID NO: 9292 - DNA, 60 bp, Artificial Sequence
  Description of Artificial Sequence: Synthetic probe
ggacccaatgaaaaccgtcataactgataaacccagcttcctcggctgcagaattgaggc

SEQ ID NO: 9293 - DNA, 60 bp, Artificial Sequence
  Description of Artificial Sequence: Synthetic probe
gcattcaaccagggcatggggccgggaatatgggcgtagacggctctacttgggattttg

SEQ ID NO: 9294 - DNA, 60 bp, Artificial Sequence
  Description of Artificial Sequence: Synthetic probe
gccagcagccggcatactctcactagggataactggccttctctgggcaattggccgctt

SEQ ID NO: 9295 - DNA, 60 bp, Artificial Sequence
  Description of Artificial Sequence: Synthetic probe
tttattacctccagatgccggttgtgcttgctaggccgcaagtacattctggcccctgcc

SEQ ID NO: 9296 - DNA, 60 bp, Artificial Sequence
  Description of Artificial Sequence: Synthetic probe
gagattcatcacctccaggtgccggttgtgcttgctaggccgcaagtacattctggcccc

SEQ ID NO: 9297 - DNA, 60 bp, Artificial Sequence
  Description of Artificial Sequence: Synthetic probe
gctcgtcatagaggaggagatcatcatgaccaggtgtgcttggggaaaatcatcagcctt

SEQ ID NO: 9298 - DNA, 60 bp, Artificial Sequence
  Description of Artificial Sequence: Synthetic probe
cgtgttgtggttgcggcttccaataatacgcactgcttttggtttccactggttaggggc

SEQ ID NO: 9299 - DNA, 52 bp, Artificial Sequence
  Description of Artificial Sequence: Synthetic probe
gcagggtcgtggttgacccagacacctcacaactgctctccggtcggctctc

SEQ ID NO: 9300 - DNA, 50 bp, Artificial Sequence
  Description of Artificial Sequence: Synthetic probe
gtctgtcaagagcctaccggagagcaggcccctccctgccccgcgcaaaa

SEQ ID NO: 9301 - DNA, 60 bp, Artificial Sequence
  Description of Artificial Sequence: Synthetic probe
ctcaggatcatgtgcgctcactgtgtctactagcatggcacaacggagagcatgagtatg

SEQ ID NO: 9302 - DNA, 60 bp, Artificial Sequence
  Description of Artificial Sequence: Synthetic probe
gaaacgaactacatagactacctctgtaattcccaccacctgtacagggacagacactac

SEQ ID NO: 9303 - DNA, 60 bp, Artificial Sequence
  Description of Artificial Sequence: Synthetic probe
accattcaaggtcagagtcgacagtggagaacttcctgtgcagatctgcatgcgttttct

SEQ ID NO: 9304 - DNA, 60 bp, Artificial Sequence
  Description of Artificial Sequence: Synthetic probe
cgcactacaggtatgtagtaatggatgaatacaccgctggtggatacataacatgctggt

SEQ ID NO: 9305 - DNA, 60 bp, Artificial Sequence
  Description of Artificial Sequence: Synthetic probe
ccactcaaccagatgtggccacgtgcaggttttacacgctcgaatctgtgatgtggcaac

SEQ ID NO: 9306 - DNA, 60 bp, Artificial Sequence
  Description of Artificial Sequence: Synthetic probe
tcaacccactcaaccagatgtggccacgtgcaggttttacacgctcgaatctgtgatgtg

SEQ ID NO: 9307 - DNA, 60 bp, Artificial Sequence
  Description of Artificial Sequence: Synthetic probe
cccctgaatgcggctaatcctaactgcggagcaggcaatcacaatccagtgggtggcctg

SEQ ID NO: 9308 - DNA, 60 bp, Artificial Sequence
  Description of Artificial Sequence: Synthetic probe
ccgacatggtgcgaagagtctattgagctagatggtagtcctccggcccctgaatgcggc

SEQ ID NO: 9309 - DNA, 60 bp, Artificial Sequence
  Description of Artificial Sequence: Synthetic probe
ggtgtcgtaatgcgtaagtctgggatggaaccgactactttgggtgtccgtgtttcttgt

SEQ ID NO: 9310 - DNA, 60 bp, Artificial Sequence
  Description of Artificial Sequence: Synthetic probe
gactcatcgaggcttccagtctcaacgactcagtggcaatgaggcagacattcgggaacc

SEQ ID NO: 9311 - DNA, 60 bp, Artificial Sequence
  Description of Artificial Sequence: Synthetic probe
ggccatcaaggcttttcagcagcactcctcagacactacttcaatgacgaacaaggagaa

SEQ ID NO: 9312 - DNA, 60 bp, Artificial Sequence
  Description of Artificial Sequence: Synthetic probe
atttgcgcaccaacaacagtgcaacaattgtggtaccatatgtgaactcgctcgtgattg

SEQ ID NO: 9313 - DNA, 60 bp, Artificial Sequence
  Description of Artificial Sequence: Synthetic probe
taactgcggagcagatacccacacaccagcgggcagtctgtcgtaacgggcaactctgca

SEQ ID NO: 9314 - DNA, 60 bp, Artificial Sequence
  Description of Artificial Sequence: Synthetic probe
gaacattgaggttgtttccatgtatagccagaacggtaagatcaacatgcctatggcagt

SEQ ID NO: 9315 - DNA, 60 bp, Artificial Sequence
  Description of Artificial Sequence: Synthetic probe
ccacggtctccgacagtagagcactcgtaagaaggttccactttgacatgaacattgagg

SEQ ID NO: 9316 - DNA, 60 bp, Artificial Sequence
  Description of Artificial Sequence: Synthetic probe
acccggacggtaaagatgtgtccttgttttgtcagatggtctccagcgttgacttcgtgc

SEQ ID NO: 9317 - DNA, 60 bp, Artificial Sequence
  Description of Artificial Sequence: Synthetic probe
cgacgccatggagcaaggagttagggattatgtggaacaactcggcaactgcttcggctc

SEQ ID NO: 9318 - DNA, 60 bp, Artificial Sequence
  Description of Artificial Sequence: Synthetic probe
ggggaaggtgttgttggttttgccgatgtaagagacttgttgtggctggaggacgacgcc

SEQ ID NO: 9319 - DNA, 60 bp, Artificial Sequence
  Description of Artificial Sequence: Synthetic probe
ttaccgtggggggggaaggtgttgttggttttgccgatgtaagagacttgttgtggctgg

SEQ ID NO: 9320 - DNA, 60 bp, Artificial Sequence
  Description of Artificial Sequence: Synthetic probe
acaagaaccatgactccgatggcgacaacttcgcctactgggtgatcaacacacggcaag

SEQ ID NO: 9321 - DNA, 60 bp, Artificial Sequence
  Description of Artificial Sequence: Synthetic probe
tcagacacaatgcaaactagacacgtgaagaattaccattcaagatcagagtcgacagtg

SEQ ID NO: 9322 - DNA, 60 bp, Artificial Sequence
  Description of Artificial Sequence: Synthetic probe
gggtaagatccatcaccttagggaattcgaccataacaactcaagaatgtgcaaacgtgg

SEQ ID NO: 9323 - DNA, 51 bp, Artificial Sequence
  Description of Artificial Sequence: Synthetic probe
ctactcggggtatgacgctagcctcagcccagtgtggttcagggcgctgga

SEQ ID NO: 9324 - DNA, 60 bp, Artificial Sequence
  Description of Artificial Sequence: Synthetic probe
gagtcctccggcccctgaatgcggctaatctcaaccacggagcaggtagtcacaaaccag

SEQ ID NO: 9325 - DNA, 60 bp, Artificial Sequence
  Description of Artificial Sequence: Synthetic probe
gctctcataggttgcaccacatcaccgtggcgctggctcaaacagaaagtgtctcaatat

SEQ ID NO: 9326 - DNA, 60 bp, Artificial Sequence
  Description of Artificial Sequence: Synthetic probe
ttaaaacagcctgtgggttgtacccacccacagggcccactgggcgctagcacactggta

SEQ ID NO: 9327 - DNA, 60 bp, Artificial Sequence
  Description of Artificial Sequence: Synthetic probe
caagtccaaatgccgtattgaacctgtatgtctactcctccacggtaatccaggggctgg

SEQ ID NO: 9328 - DNA, 60 bp, Artificial Sequence
  Description of Artificial Sequence: Synthetic probe
agtgtttcgctccgcacagccccagtgtagatcaggtcgatgagccaccgcattccccac

SEQ ID NO: 9329 - DNA, 60 bp, Artificial Sequence
  Description of Artificial Sequence: Synthetic probe
gtgtttcactcagcacattcccagtgtagatcaggtcgatgagtcaccgcattccccacg

SEQ ID NO: 9330 - DNA, 60 bp, Artificial Sequence
  Description of Artificial Sequence: Synthetic probe
ctccggcccctgaatgcggctaatcctaacctcggggcaggtggtcacaaaccagtgatt

SEQ ID NO: 9331 - DNA, 60 bp, Artificial Sequence
  Description of Artificial Sequence: Synthetic probe
agtgtttcgctccgcacaaccccagtgtagaccaggtcgatgagtcaccgcattccccac

SEQ ID NO: 9332 - DNA, 60 bp, Artificial Sequence
  Description of Artificial Sequence: Synthetic probe
ggttgttcccacccacagggcccactgggcgctagtacactggtatgccttacctcggta

SEQ ID NO: 9333 - DNA, 60 bp, Artificial Sequence
  Description of Artificial Sequence: Synthetic probe
ctctgcagcggaaccgactactttgggagtccgtgtttccttttattcttacactggctg

SEQ ID NO: 9334 - DNA, 56 bp, Artificial Sequence
  Description of Artificial Sequence: Synthetic probe
gttaccacgccacgccaaacctggtcccaccatcttgatgaatgatcaggaagttg

SEQ ID NO: 9335 - DNA, 60 bp, Artificial Sequence
  Description of Artificial Sequence: Synthetic probe
ttcaccacgcttggtatttatgacagatgggcggtgttaccacgccacgccaaacctggt

SEQ ID NO: 9336 - DNA, 60 bp, Artificial Sequence
  Description of Artificial Sequence: Synthetic probe
cgctctaataccgacatggtgtgaagagtccattgagctagctggtagtcctccggcccc

SEQ ID NO: 9337 - DNA, 60 bp, Artificial Sequence
  Description of Artificial Sequence: Synthetic probe
cgctctaatacagacatggtgcgaagagtccattgagctagttggtagtcctccggcccc

SEQ ID NO: 9338 - DNA, 60 bp, Artificial Sequence
  Description of Artificial Sequence: Synthetic probe
tgtggcggtggctgcgttggcggccctgcccatggggcaacccatgggacgcttcaatac

SEQ ID NO: 9339 - DNA, 60 bp, Artificial Sequence
  Description of Artificial Sequence: Synthetic probe
cgactactttgggtgtccgtgtttccttctattctcacattggctgcttatggtgacaat

SEQ ID NO: 9340 - DNA, 60 bp, Artificial Sequence
  Description of Artificial Sequence: Synthetic probe
aagcccaaggtgcccaccctgaggcaagcaaaggtacaaggccctgcatttgagttcgcc

SEQ ID NO: 9341 - DNA, 60 bp, Artificial Sequence
  Description of Artificial Sequence: Synthetic probe
acgttcgttacccggccagttacttcgggaagcctagtaccaccatgaaagttgcgcagt

SEQ ID NO: 9342 - DNA, 60 bp, Artificial Sequence
  Description of Artificial Sequence: Synthetic probe
tagtctccggcccctgaatgcggctaatcctaaccacggagcgtccaccagcaatccagc

SEQ ID NO: 9343 - DNA, 60 bp, Artificial Sequence
  Description of Artificial Sequence: Synthetic probe
gcggcagacatttggaaacctatataagacttttcacctcaatccaggcattgtcacggg

SEQ ID NO: 9344 - DNA, 60 bp, Artificial Sequence
  Description of Artificial Sequence: Synthetic probe
tgtttcgctccacacaaccccggtgtagatcaggtcgatgagtcaccgcaatccccacgg

SEQ ID NO: 9345 - DNA, 60 bp, Artificial Sequence
  Description of Artificial Sequence: Synthetic probe
gtgagaggtgggatgccatcgggatgttcaggcaccagcatatttaactccatgattaat

SEQ ID NO: 9346 - DNA, 60 bp, Artificial Sequence
  Description of Artificial Sequence: Synthetic probe
atgtgcgctcgttgtgtttactggcctggcataacggggagcacgaatatgaggagttta

SEQ ID NO: 9347 - DNA, 60 bp, Artificial Sequence
  Description of Artificial Sequence: Synthetic probe
ggcaatgaggcagacatttggacacctatacaaggctttccacctcaacccgggcatcgt

SEQ ID NO: 9348 - DNA, 60 bp, Artificial Sequence
  Description of Artificial Sequence: Synthetic probe
ctgggaatacacgtaggagggaatggacaccaggggttctcagcggcactcctcagacac

SEQ ID NO: 9349 - DNA, 60 bp, Artificial Sequence
  Description of Artificial Sequence: Synthetic probe
cggatggcaaagacgtatccctgttttgtcagatggtctccagcgttgactttgtgcccc

SEQ ID NO: 9350 - DNA, 60 bp, Artificial Sequence
  Description of Artificial Sequence: Synthetic probe
gccgacgtaagagacttgttgtggctggaggatgacgccatggagcaaggagttagggga

SEQ ID NO: 9351 - DNA, 60 bp, Artificial Sequence
  Description of Artificial Sequence: Synthetic probe
atgtacgtgccgccaggtggcccagtgcccacaaaggtgaacagttacagttggcaaacg

SEQ ID NO: 9352 - DNA, 60 bp, Artificial Sequence
  Description of Artificial Sequence: Synthetic probe
tgacggaaggaatcattgcccgcgtcgctgataccgtagggagtggaccagtcaactcgg

SEQ ID NO: 9353 - DNA, 60 bp, Artificial Sequence
  Description of Artificial Sequence: Synthetic probe
ccactggaaagttcttgctagcatactcaccaccaggagctggggcaccgaccacacgca

SEQ ID NO: 9354 - DNA, 60 bp, Artificial Sequence
  Description of Artificial Sequence: Synthetic probe
ggcatgggcgtaggcgtcggtaatttaaccatcttccctcatcagtggatcaacttgcgc

SEQ ID NO: 9355 - DNA, 60 bp, Artificial Sequence
  Description of Artificial Sequence: Synthetic probe
cttgtttgtcagtcttgcaccgttgtaccataaagccttaactgcccctcaacaccgtca

SEQ ID NO: 9356 - DNA, 60 bp, Artificial Sequence
  Description of Artificial Sequence: Synthetic probe
caaggcgcttacacagggatgcctaatcagaaacccaaggtgcccaccctaaggcaggcc

SEQ ID NO: 9357 - DNA, 60 bp, Artificial Sequence
  Description of Artificial Sequence: Synthetic probe
gaggagcagggtgagatagagttcattgagaattcgagagacgcaggttttcccgtgatc

SEQ ID NO: 9358 - DNA, 60 bp, Artificial Sequence
  Description of Artificial Sequence: Synthetic probe
acccggacggtaaagatgtgtccttgttctgtcagatggtctccagcgttgacttcgtgc

SEQ ID NO: 9359 - DNA, 60 bp, Artificial Sequence
  Description of Artificial Sequence: Synthetic probe
atggctgcgacaccattgccaggtgcgattgcacagcaggagtgtacttctgcgcctcca

SEQ ID NO: 9360 - DNA, 60 bp, Artificial Sequence
  Description of Artificial Sequence: Synthetic probe
cggaccagttaactcggaatccattccagctctaaccgccgcagagacagggcacacgtc

SEQ ID NO: 9361 - DNA, 60 bp, Artificial Sequence
  Description of Artificial Sequence: Synthetic probe
gagctcaaaggacgcaggatttcccgtgatcaacactcccagcaagacaaaattggaacc

SEQ ID NO: 9362 - DNA, 60 bp, Artificial Sequence
  Description of Artificial Sequence: Synthetic probe
ccaaacctggccccaccatcttgatgaatgaccaggtagtcggagtattggatgccaagg

SEQ ID NO: 9363 - DNA, 60 bp, Artificial Sequence
  Description of Artificial Sequence: Synthetic probe
tccaaggcgcatacacagggatgcctaaccagaagcccaaggtgcccaccctgagacaag

SEQ ID NO: 9364 - DNA, 60 bp, Artificial Sequence
  Description of Artificial Sequence: Synthetic probe
acagctacagctggcaaacgtccaccaacccaagtgtgttctggacggaagggagcgcac

SEQ ID NO: 9365 - DNA, 60 bp, Artificial Sequence
  Description of Artificial Sequence: Synthetic probe
cgtatcactgaactacaaagccttaaacacccattaatttcatcataacgctcaatacgt

SEQ ID NO: 9366 - DNA, 60 bp, Artificial Sequence
  Description of Artificial Sequence: Synthetic probe
gtttgttagtctcgtatcactgaactacaaagccttaaacacccattaatttcatcataa

SEQ ID NO: 9367 - DNA, 60 bp, Artificial Sequence
  Description of Artificial Sequence: Synthetic probe
ggtgagaagaacctattgcgctaccatatagtcctccggcccctgaatgcggctaatccc

SEQ ID NO: 9368 - DNA, 60 bp, Artificial Sequence
  Description of Artificial Sequence: Synthetic probe
cagctaagtctcgatcaagcacttctgttaccccggaccgagtatcaataggctgtaccc

SEQ ID NO: 9369 - DNA, 60 bp, Artificial Sequence
  Description of Artificial Sequence: Synthetic probe
caggctatgacgccagtctcagcccagtgtggtttacgtgcttgaaactccttctggaaa

SEQ ID NO: 9370 - DNA, 60 bp, Artificial Sequence
  Description of Artificial Sequence: Synthetic probe
gcggttcttagaaatggggacccacgactcaaggccaactttgaggaggcaatcttctcc

SEQ ID NO: 9371 - DNA, 60 bp, Artificial Sequence
  Description of Artificial Sequence: Synthetic probe
cattttattcacctcgccgttcgttctcgcatccaccaatgcagggtcagttaacgcccc

SEQ ID NO: 9372 - DNA, 60 bp, Artificial Sequence
  Description of Artificial Sequence: Synthetic probe
ggcgctcgctcgctgagaaacttaacagctcggtgtactcactaccgccagatccagacc

SEQ ID NO: 9373 - DNA, 60 bp, Artificial Sequence
  Description of Artificial Sequence: Synthetic probe
gccaaagcacgtcaaaacgtggatccctagaccacccagactatgtcaataccaaaaggc

SEQ ID NO: 9374 - DNA, 60 bp, Artificial Sequence
  Description of Artificial Sequence: Synthetic probe
caccggtgctcacccaccaaataatgtatgtgcctccaggtggcccagtgcccacaaagg

SEQ ID NO: 9375 - DNA, 60 bp, Artificial Sequence
  Description of Artificial Sequence: Synthetic probe
cgcactacaggtatgtggtaatggatgaatacaccgctggtggttacataacttgctggt

SEQ ID NO: 9376 - DNA, 60 bp, Artificial Sequence
  Description of Artificial Sequence: Synthetic probe
cgtccgatgatttccagtcaccatcagccgtgccacaattcgatgtcactcctgagatgg

SEQ ID NO: 9377 - DNA, 60 bp, Artificial Sequence
  Description of Artificial Sequence: Synthetic probe
agacacaacaattttacgctcatggtcatcccgttcgccccactgagctacagcacaggg

SEQ ID NO: 9378 - DNA, 60 bp, Artificial Sequence
  Description of Artificial Sequence: Synthetic probe
gaatagttgcttacctgtttgttagcctcgtatcactgaactacaaagccttgaacaccc

SEQ ID NO: 9379 - DNA, 56 bp, Artificial Sequence
  Description of Artificial Sequence: Synthetic probe
tgtgggttgttcccacccacagggcccactgggcgccagcacactggtatcacggt

SEQ ID NO: 9380 - DNA, 60 bp, Artificial Sequence
  Description of Artificial Sequence: Synthetic probe
cggaaccgactactttgggtgtccgtgtttccttttattcttatactggctgcttatggt

SEQ ID NO: 9381 - DNA, 60 bp, Artificial Sequence
  Description of Artificial Sequence: Synthetic probe
ggtgcgaagagcctattgagctacaagagagtcctccggcccctgaatgcggctaatccc

SEQ ID NO: 9382 - DNA, 60 bp, Artificial Sequence
  Description of Artificial Sequence: Synthetic probe
ggtgtgaagagcctattgagctgcaagagagtcctccggcccctgaatgcggctaatccc

SEQ ID NO: 9383 - DNA, 60 bp, Artificial Sequence
  Description of Artificial Sequence: Synthetic probe
cgattgagctagttggtagtcctccggcccctgaatgcggctaatcctaactgcggagca

SEQ ID NO: 9384 - DNA, 60 bp, Artificial Sequence
  Description of Artificial Sequence: Synthetic probe
tttaaaacagcctgtgggttgttcccacccacagggcccactgggcgctagcactctggt

SEQ ID NO: 9385 - DNA, 60 bp, Artificial Sequence
  Description of Artificial Sequence: Synthetic probe
ggcggaaccgactactttgggtgtccgtgtttccttttattttatgctggctgcttatgg

SEQ ID NO: 9386 - DNA, 53 bp, Artificial Sequence
  Description of Artificial Sequence: Synthetic probe
tggtgacaattgaaagattgttaccatatagctattggattggccatccggtg

SEQ ID NO: 9387 - DNA, 60 bp, Artificial Sequence
  Description of Artificial Sequence: Synthetic probe
ctgcggcggaaccgactactttgggtgtccgtgtttccttttattcttatactggctgct

SEQ ID NO: 9388 - DNA, 60 bp, Artificial Sequence
  Description of Artificial Sequence: Synthetic probe
tactgagctaggtagtagtcctccggcccctgaatgcggctaatcccaaccacggagcag

SEQ ID NO: 9389 - DNA, 60 bp, Artificial Sequence
  Description of Artificial Sequence: Synthetic probe
gggtggcttgtcgtaacgcgcaagtctgtggcggaaccgactactttgggtgtccgtgtt

SEQ ID NO: 9390 - DNA, 60 bp, Artificial Sequence
  Description of Artificial Sequence: Synthetic probe
cggaaccgactactttgggtgtccgtgtttccttttattcttatactggctacttatggt

SEQ ID NO: 9391 - DNA, 60 bp, Artificial Sequence
  Description of Artificial Sequence: Synthetic probe
ctgcagcggaaccgactactttgggtgtccgtgtttccttttattcttatgttggctgct

SEQ ID NO: 9392 - DNA, 60 bp, Artificial Sequence
  Description of Artificial Sequence: Synthetic probe
attgagctagctggtagtcctccggcccctgaatgcggctaatcctaactgcggagcacg

SEQ ID NO: 9393 - DNA, 60 bp, Artificial Sequence
  Description of Artificial Sequence: Synthetic probe
cggaaccgactactttgggtgtccgtgtttccttttatttcaacttggctgcttatggtg

SEQ ID NO: 9394 - DNA, 60 bp, Artificial Sequence
  Description of Artificial Sequence: Synthetic probe
tagtagtcctccggcccctgaatgcggctaatcctaaccacggagcgtccaccggcaaac

SEQ ID NO: 9395 - DNA, 60 bp, Artificial Sequence
  Description of Artificial Sequence: Synthetic probe
tagtagtcctccggcccctgaatgcggctaatcctaaccacggagcgtccaccagcaatc

SEQ ID NO: 9396 - DNA, 60 bp, Artificial Sequence
  Description of Artificial Sequence: Synthetic probe
gggtagtagtcctccggcccctgaatgcggctaatcctaaccacggagcgtccaccagca

SEQ ID NO: 9397 - DNA, 60 bp, Artificial Sequence
  Description of Artificial Sequence: Synthetic probe
ccagagggcagtgtgtcgtaatgggcaactctgcagcggaaccgactactttgggtgtcc

SEQ ID NO: 9398 - DNA, 60 bp, Artificial Sequence
  Description of Artificial Sequence: Synthetic probe
cctattgagctaattggtagtcctccggcccctgaatgcggctaatcctaactgcggagc

SEQ ID NO: 9399 - DNA, 60 bp, Artificial Sequence
  Description of Artificial Sequence: Synthetic probe
tctgtggcggaaccgactactttgggtgtccgtgtttcctgttttatttaccttggctgc

SEQ ID NO: 9400 - DNA, 55 bp, Artificial Sequence
  Description of Artificial Sequence: Synthetic probe
tacgcaagtctggagcggaaccgactactttgggtgtccgtgtttcctgttttac

SEQ ID NO: 9401 - DNA, 60 bp, Artificial Sequence
  Description of Artificial Sequence: Synthetic probe
cgtaatgggcaactctgcagcggaaccgactactttgggtgtccgtgtttccttttattc

SEQ ID NO: 9402 - DNA, 60 bp, Artificial Sequence
  Description of Artificial Sequence: Synthetic probe
gccagtcgtaatgggcaactctgggatggaaccgactactttgggtgtccgtgtttcctg

SEQ ID NO: 9403 - DNA, 52 bp, Artificial Sequence
  Description of Artificial Sequence: Synthetic probe
caattctgtggcggaaccgactactttgggtgtccgtgtttccttttatttt

SEQ ID NO: 9404 - DNA, 60 bp, Artificial Sequence
  Description of Artificial Sequence: Synthetic probe
ggtagtgtgtcgtaatgggcaactctgcagcggaaccgactactttgggtgtccgtgttt

SEQ ID NO: 9405 - DNA, 60 bp, Artificial Sequence
  Description of Artificial Sequence: Synthetic probe
ctattgagctaattggtagtcctccggcccctgaatgcggctaatcctaaccgcggagca

SEQ ID NO: 9406 - DNA, 60 bp, Artificial Sequence
  Description of Artificial Sequence: Synthetic probe
accagtgggcagtctgtcgtaacgggcaactctgcagcggaaccgactactttgggtgtc

SEQ ID NO: 9407 - DNA, 53 bp, Artificial Sequence
  Description of Artificial Sequence: Synthetic probe
tgtcgtaacgggcaactctgcagcggaaccgactactttgggtgtccgtgttt

SEQ ID NO: 9408 - DNA, 60 bp, Artificial Sequence
  Description of Artificial Sequence: Synthetic probe
cctattgagctagttggtagtcctccggcccctgaatgcggctaatcctaactgcggagc

SEQ ID NO: 9409 - DNA, 60 bp, Artificial Sequence
  Description of Artificial Sequence: Synthetic probe
gctaattggtagtcctccggcccctgaatgcggctaatcccaactgcggagcaaataccc

SEQ ID NO: 9410 - DNA, 60 bp, Artificial Sequence
  Description of Artificial Sequence: Synthetic probe
gcggaaccgactactttgggtgtccgtgtttccttttattcttatattggctgcttatgg

SEQ ID NO: 9411 - DNA, 60 bp, Artificial Sequence
  Description of Artificial Sequence: Synthetic probe
gcggaaccgactactttgggtgtccgtgtttccttttattctcatgtcggctgcttatgg

SEQ ID NO: 9412 - DNA, 60 bp, Artificial Sequence
  Description of Artificial Sequence: Synthetic probe
tgactggcttgtcgtaacgcgcaagtctgtggcggaaccgactactttgggtgtccgtgt

SEQ ID NO: 9413 - DNA, 60 bp, Artificial Sequence
  Description of Artificial Sequence: Synthetic probe
tggctgcttatggtgacaattgagagattgttaccatatagctattggattggccatccg

SEQ ID NO: 9414 - DNA, 60 bp, Artificial Sequence
  Description of Artificial Sequence: Synthetic probe
tgtcgtaacgggcaactctgcagcggaaccgactactttgggtgtccgtgtttcctttta

SEQ ID NO: 9415 - DNA, 60 bp, Artificial Sequence
  Description of Artificial Sequence: Synthetic probe
gctagttagtagtcctccggcccctgaatgcggctaatcctaactgcggagcacataccc

SEQ ID NO: 9416 - DNA, 60 bp, Artificial Sequence
  Description of Artificial Sequence: Synthetic probe
cctattgagctaggtagtagtcctccggcccctgaatgcggctaatcctaaccacggagc

SEQ ID NO: 9417 - DNA, 60 bp, Artificial Sequence
  Description of Artificial Sequence: Synthetic probe
tgaagagcccattgcgctagggagtagtcctccggcccctgaatgcggctaatcctaacc

SEQ ID NO: 9418 - DNA, 60 bp, Artificial Sequence
  Description of Artificial Sequence: Synthetic probe
tgaagagtctattgagctagttagtagtcctccggcccctgaatgcggctaatcctaact

SEQ ID NO: 9419 - DNA, 60 bp, Artificial Sequence
  Description of Artificial Sequence: Synthetic probe
ggtgcgaagagcctattgagctagttggtagtcctccggcccctgaatgcggctaatcct

SEQ ID NO: 9420 - DNA, 60 bp, Artificial Sequence
  Description of Artificial Sequence: Synthetic probe
cagtgggtggtctgtcgtaacgggtaactctgcagcggaaccgactactttgggtgtccg

SEQ ID NO: 9421 - DNA, 56 bp, Artificial Sequence
  Description of Artificial Sequence: Synthetic probe
tgtgggttgttcccacccacagggcccactgggcgctagtactctggtattacggt

SEQ ID NO: 9422 - DNA, 56 bp, Artificial Sequence
  Description of Artificial Sequence: Synthetic probe
tgtgggttgttcccacccacagggcccactgggcgcaagcacactggtattacggt

SEQ ID NO: 9423 - DNA, 60 bp, Artificial Sequence
  Description of Artificial Sequence: Synthetic probe
agagcctattgagctagtgagtagtcctccggcccctgaatgcggctaatcctaaccacg

SEQ ID NO: 9424 - DNA, 60 bp, Artificial Sequence
  Description of Artificial Sequence: Synthetic probe
taattggtagtcctccggcccctgaatgcggctaatcctaactgcggagcagatacccac

SEQ ID NO: 9425 - DNA, 56 bp, Artificial Sequence
  Description of Artificial Sequence: Synthetic probe
tggtgacaattgagagattgttaccatatagctattggattggccatccggtgact

SEQ ID NO: 9426 - DNA, 60 bp, Artificial Sequence
  Description of Artificial Sequence: Synthetic probe
ggtgcgaagagtctactgagctagttagtagtcctccggcccctgaatgcggctaatccc

SEQ ID NO: 9427 - DNA, 56 bp, Artificial Sequence
  Description of Artificial Sequence: Synthetic probe
tgtgggttgttcccacccacagggcccactgggcgccagcactctggtattacggt

SEQ ID NO: 9428 - DNA, 60 bp, Artificial Sequence
  Description of Artificial Sequence: Synthetic probe
ttaaaacagcctgtgggttgttcccacccacagggcccactgggcgctagcacactgatt

SEQ ID NO: 9429 - DNA, 60 bp, Artificial Sequence
  Description of Artificial Sequence: Synthetic probe
ctattgagctaggcagtagtcctccggcccctgaatgcggctaatcctaaccacggagcc

SEQ ID NO: 9430 - DNA, 60 bp, Artificial Sequence
  Description of Artificial Sequence: Synthetic probe
agccagcgggtagtgtgtcgtaacgggcaactctgcagcggaaccgactactttgggtgt

SEQ ID NO: 9431 - DNA, 60 bp, Artificial Sequence
  Description of Artificial Sequence: Synthetic probe
ctgcagcggaaccgactactttgggtgtccgtgtttccttttattcttatactggctgct

SEQ ID NO: 9432 - DNA, 60 bp, Artificial Sequence
  Description of Artificial Sequence: Synthetic probe
agtgggtggtgtgtcgtaacgggcaactctgcagcggaaccgactactttgggtgtccgt

SEQ ID NO: 9433 - DNA, 56 bp, Artificial Sequence
  Description of Artificial Sequence: Synthetic probe
tgtgggttgttcccacccacagggcccactgggcgctagcacactggtatcccggt

SEQ ID NO: 9434 - DNA, 60 bp, Artificial Sequence
  Description of Artificial Sequence: Synthetic probe
cagcggaaccgactactttgggtgtccgtgtttccttttatttcaacttggctgcttatg

SEQ ID NO: 9435 - DNA, 60 bp, Artificial Sequence
  Description of Artificial Sequence: Synthetic probe
agccagagggcagtgtgtcgtaacgggcaactctgcagcggaaccgactactttgggtgt

SEQ ID NO: 9436 - DNA, 60 bp, Artificial Sequence
  Description of Artificial Sequence: Synthetic probe
gtgtgtcgtaatgggcaactctgcagcggaaccgactactttgggtgtccgtgtttcctt

SEQ ID NO: 9437 - DNA, 60 bp, Artificial Sequence
  Description of Artificial Sequence: Synthetic probe
cagtgggcagtctgtcgtaatgggcaactctgcagcggaaccgactactttgggtgtccg

SEQ ID NO: 9438 - DNA, 56 bp, Artificial Sequence
  Description of Artificial Sequence: Synthetic probe
tgtgggttgttcccacccacagggcccactgggcgctagcacactggtatcacggt

SEQ ID NO: 9439 - DNA, 60 bp, Artificial Sequence
  Description of Artificial Sequence: Synthetic probe
gctgcttatggtgacaattgagagattgttaccatatagctattggattggccatccggt

SEQ ID NO: 9440 - DNA, 60 bp, Artificial Sequence
  Description of Artificial Sequence: Synthetic probe
aaacagcctgtgggttgcacccactcacagggcccactgggcgctagtacactggtatct

SEQ ID NO: 9441 - DNA, 60 bp, Artificial Sequence
  Description of Artificial Sequence: Synthetic probe
ttgagctaactggtagtcctccggcccctgaatgcggctaatcctaactgcggagcagac

SEQ ID NO: 9442 - DNA, 60 bp, Artificial Sequence
  Description of Artificial Sequence: Synthetic probe
tgagctagttagtagtcctccggcccctgaatgcggctaatcccaactgcggagcacacg

SEQ ID NO: 9443 - DNA, 54 bp, Artificial Sequence
  Description of Artificial Sequence: Synthetic probe
cgcaagtctgtggcggaaccgactactttgggtgtccgtgtttccttttatttt

SEQ ID NO: 9444 - DNA, 56 bp, Artificial Sequence
  Description of Artificial Sequence: Synthetic probe
tgtgggttgttcccacccacagggcccactgggcgctagtacactggtaccaaggt

SEQ ID NO: 9445 - DNA, 60 bp, Artificial Sequence
  Description of Artificial Sequence: Synthetic probe
cagtgtgtcgtaacgggcaactctgcagcggaaccgactactttgggtgtccgtgtttcc

SEQ ID NO: 9446 - DNA, 60 bp, Artificial Sequence
  Description of Artificial Sequence: Synthetic probe
gagggtagtgtgtcgtaatgggcaactctgcagcggaaccgactactttgggtgtccgtg

SEQ ID NO: 9447 - DNA, 51 bp, Artificial Sequence
  Description of Artificial Sequence: Synthetic probe
tggtgacaattgagagattgttaccatatagctattggattggccatccgg

SEQ ID NO: 9448 - DNA, 60 bp, Artificial Sequence
  Description of Artificial Sequence: Synthetic probe
cagtgggcagtctgtcgtaacgggtaactctgcagcggaaccgactactttgggtgtccg

SEQ ID NO: 9449 - DNA, 60 bp, Artificial Sequence
  Description of Artificial Sequence: Synthetic probe
tgccagtgggcagtctgtcgtaacgggtaactctgcagcggaaccgactactttgggtgt

SEQ ID NO: 9450 - DNA, 60 bp, Artificial Sequence
  Description of Artificial Sequence: Synthetic probe
ggtgcgaagagtctattgagctagctggtagtcctccggcccctgaatgcggctaatccc

SEQ ID NO: 9451 - DNA, 60 bp, Artificial Sequence
  Description of Artificial Sequence: Synthetic probe
ggtgtgaagagcctattgagctacataagagtcctccggcccctgaatgcggctaatcct

SEQ ID NO: 9452 - DNA, 60 bp, Artificial Sequence
  Description of Artificial Sequence: Synthetic probe
cgaagagcctattgagctagttagtagtcctccggcccctgaatgcggctaatcctaact

SEQ ID NO: 9453 - DNA, 60 bp, Artificial Sequence
  Description of Artificial Sequence: Synthetic probe
ttgagctagctggtagtcctccggcccctgaatgcggctaatcccaactgcggagcacat

SEQ ID NO: 9454 - DNA, 60 bp, Artificial Sequence
  Description of Artificial Sequence: Synthetic probe
gtctgtcgtaacgggcaactctgcagcggaaccgactactttgggtgtccgtgtttcctt

SEQ ID NO: 9455 - DNA, 60 bp, Artificial Sequence
  Description of Artificial Sequence: Synthetic probe
tattgagctagctggtagtcctccggcccctgaatgcggctaatcccaactgcggagcac

SEQ ID NO: 9456 - DNA, 60 bp, Artificial Sequence
  Description of Artificial Sequence: Synthetic probe
gcggaaccgactactttgggtgtccgtgtttccttttattcttacattggctgcttatgg

SEQ ID NO: 9457 - DNA, 60 bp, Artificial Sequence
  Description of Artificial Sequence: Synthetic probe
gggcagcgtgtcgtaatgggcaactctgcagcggaaccgactactttgggtgtccgtgtt

SEQ ID NO: 9458 - DNA, 60 bp, Artificial Sequence
  Description of Artificial Sequence: Synthetic probe
ggtgtgaagagtctattgagctagttagtagtcctccggcccctgaatgcggctaatcct

SEQ ID NO: 9459 - DNA, 53 bp, Artificial Sequence
  Description of Artificial Sequence: Synthetic probe
aagagtctattgagctgctatagagtcctccggcccctgaatgcggctaatcc

SEQ ID NO: 9460 - DNA, 60 bp, Artificial Sequence
  Description of Artificial Sequence: Synthetic probe
gcagcctgtcgtaacgggcaactctgcagcggaaccgactactttgggtgtccgtgtttc

SEQ ID NO: 9461 - DNA, 60 bp, Artificial Sequence
  Description of Artificial Sequence: Synthetic probe
gcttatggtgacaattgagagattgttaccatatagctattggattggccatccggtgtc

SEQ ID NO: 9462 - DNA, 60 bp, Artificial Sequence
  Description of Artificial Sequence: Synthetic probe
cacaagccagcgggtagtgtgtcgtaacgggcaactctgcagcggaaccgactactttgg

SEQ ID NO: 9463 - DNA, 60 bp, Artificial Sequence
  Description of Artificial Sequence: Synthetic probe
gcgaagagtctattgagctagttggtagtcctccggcccctgaatgcggctaatcctaac

SEQ ID NO: 9464 - DNA, 60 bp, Artificial Sequence
  Description of Artificial Sequence: Synthetic probe
tgagctagttagtagtcctccggcccctgaatgcggctaatcctaactgcggagcacgtg

SEQ ID NO: 9465 - DNA, 60 bp, Artificial Sequence
  Description of Artificial Sequence: Synthetic probe
gggcagtctgtcgtaacgggcaactctgcagcggaaccgactactttgggtgtccgtgtt

SEQ ID NO: 9466 - DNA, 60 bp, Artificial Sequence
  Description of Artificial Sequence: Synthetic probe
cagcgggtagtgtgtcgtaacgggtaactctgcagcggaaccgactactttgggtgtccg

SEQ ID NO: 9467 - DNA, 60 bp, Artificial Sequence
  Description of Artificial Sequence: Synthetic probe
tctattgagctagttggtagtcctccggcccctgaatgcggctaatcctaactgcggagc

SEQ ID NO: 9468 - DNA, 60 bp, Artificial Sequence
  Description of Artificial Sequence: Synthetic probe
gtgggatgggaccgactactttgggtgtccgtgtttcatgttttactttatgacttgctt

SEQ ID NO: 9469 - DNA, 60 bp, Artificial Sequence
  Description of Artificial Sequence: Synthetic probe
agcgggtagtgtgtcgtaacgggcaactctgcagcggaaccgactactttgggtgtccgt

SEQ ID NO: 9470 - DNA, 60 bp, Artificial Sequence
  Description of Artificial Sequence: Synthetic probe
cagtgggcagtgtgtcgtaacgggtaactctgcagcggaaccgactactttgggtgtccg

SEQ ID NO: 9471 - DNA, 60 bp, Artificial Sequence
  Description of Artificial Sequence: Synthetic probe
aacgcgtaagtctgggacggaaccgactactttgggtgtccgtgtttcctgttttactta

SEQ ID NO: 9472 - DNA, 60 bp, Artificial Sequence
  Description of Artificial Sequence: Synthetic probe
ctgcagcggaaccgactactttgggtgtccgtgtttccttttattcttatattggctgct

SEQ ID NO: 9473 - DNA, 60 bp, Artificial Sequence
  Description of Artificial Sequence: Synthetic probe
cgtaacgggtaactctgcagcggaaccgactactttgggtgtccgtgtttccttttattc

SEQ ID NO: 9474 - DNA, 60 bp, Artificial Sequence
  Description of Artificial Sequence: Synthetic probe
gcggaaccgactactttgggtgtccgtgtttcctcttattcttgtactggctgcttatgg

SEQ ID NO: 9475 - DNA, 60 bp, Artificial Sequence
  Description of Artificial Sequence: Synthetic probe
ctgcagcggaaccgactactttgggtgtccgtgtttccttttatctttattctggctgct

SEQ ID NO: 9476 - DNA, 60 bp, Artificial Sequence
  Description of Artificial Sequence: Synthetic probe
ggtgtgaagagcctattgagctacctaagagtcctccggcccctgaatgcggctaatccc

SEQ ID NO: 9477 - DNA, 56 bp, Artificial Sequence
  Description of Artificial Sequence: Synthetic probe
tgtgggttgttcccacccacagggcccactgggcgttagcacactggtatcacggt

SEQ ID NO: 9478 - DNA, 60 bp, Artificial Sequence
  Description of Artificial Sequence: Synthetic probe
ctgtggcggaaccgactactttgggtgtccgtgtttccttttattctcattatggctgct

SEQ ID NO: 9479 - DNA, 60 bp, Artificial Sequence
  Description of Artificial Sequence: Synthetic probe
cgtaatgggtaactctgtggcggaaccgactactttgggtgtccgtgtttcctgttttac

SEQ ID NO: 9480 - DNA, 60 bp, Artificial Sequence
  Description of Artificial Sequence: Synthetic probe
acgggcaactctgcagcggaaccgactactttgggtgtccgtgtttccttttattcttat

SEQ ID NO: 9481 - DNA, 60 bp, Artificial Sequence
  Description of Artificial Sequence: Synthetic probe
gtcgtaacgcgcaagtctgtggcggaaccgactactttgggtgtccgtgtttccttttgt

SEQ ID NO: 9482 - DNA, 60 bp, Artificial Sequence
  Description of Artificial Sequence: Synthetic probe
ggtgtgaagagcctattgagctacatgagagtcctccggcccctgaatgcggctaatcct

SEQ ID NO: 9483 - DNA, 60 bp, Artificial Sequence
  Description of Artificial Sequence: Synthetic probe
ggtgtgaagagcctattgagctacctgagagtcctccggcccctgaatgcggctaatcct

SEQ ID NO: 9484 - DNA, 60 bp, Artificial Sequence
  Description of Artificial Sequence: Synthetic probe
agtcctccggcccctgaatgcggctaatcccaaccacggagcaagtgctcacaaaccagt

SEQ ID NO: 9485 - DNA, 60 bp, Artificial Sequence
  Description of Artificial Sequence: Synthetic probe
gcgaagagcctattgagctagttggtagtcctccggcccctgaatgcggctaatcctaac

SEQ ID NO: 9486 - DNA, 60 bp, Artificial Sequence
  Description of Artificial Sequence: Synthetic probe
ggcggaaccgactactttgggtgtccgtgtttccttttattttataatggctgcttatgg

SEQ ID NO: 9487 - DNA, 55 bp, Artificial Sequence
  Description of Artificial Sequence: Synthetic probe
tggtgacaattgaaagattgttaccatatagctattggattggccatccggtgac

SEQ ID NO: 9488 - DNA, 60 bp, Artificial Sequence
  Description of Artificial Sequence: Synthetic probe
ccagtgggtagtgtgtcgtaacgggcaactctgcagcggaaccgactactttgggtgtcc

SEQ ID NO: 9489 - DNA, 60 bp, Artificial Sequence
  Description of Artificial Sequence: Synthetic probe
ggcctgtcgtaacgcgtaagtctgtggcggaaccgactactttgggtgtccgtgtttcct

SEQ ID NO: 9490 - DNA, 60 bp, Artificial Sequence
  Description of Artificial Sequence: Synthetic probe
ctgggacggaaccgactactttgggtgtccgtgtttcctgttttacttactttggctgct

SEQ ID NO: 9491 - DNA, 50 bp, Artificial Sequence
  Description of Artificial Sequence: Synthetic probe
tgtcgtaacgggtaactctgcagcggaaccgactactttgggtgtccgtg

SEQ ID NO: 9492 - DNA, 60 bp, Artificial Sequence
  Description of Artificial Sequence: Synthetic probe
ttaaaacagcctgtgggttgttcccacccacagggcccattgggcgctagcactctggta

SEQ ID NO: 9493 - DNA, 60 bp, Artificial Sequence
  Description of Artificial Sequence: Synthetic probe
gcctgtcgtaacgcgcaagtctgtggcggaaccgactactttgggtgtccgtgtttcctt

SEQ ID NO: 9494 - DNA, 60 bp, Artificial Sequence
  Description of Artificial Sequence: Synthetic probe
gtgtgtcgtaacgggcaactctgcagcggaaccgactactttgggtgtccgtgtttcctt

SEQ ID NO: 9495 - DNA, 60 bp, Artificial Sequence
  Description of Artificial Sequence: Synthetic probe
cctattgagctacctgagagtcctccggcccctgaatgcggctaatcccaaccacggagc

SEQ ID NO: 9496 - DNA, 60 bp, Artificial Sequence
  Description of Artificial Sequence: Synthetic probe
cagtgtgtcgtaatgggtaactctgcagcggaaccgactactttgggtgtccgtgtttcc

SEQ ID NO: 9497 - DNA, 60 bp, Artificial Sequence
  Description of Artificial Sequence: Synthetic probe
cagcttgtcgtaacgggcaactctgcagcggaaccgactactttgggtgtccgtgtttcc

SEQ ID NO: 9498 - DNA, 60 bp, Artificial Sequence
  Description of Artificial Sequence: Synthetic probe
ctattgagctagttagtaatcctccggcccctgaatgcggctaatcctaactgcggagca

SEQ ID NO: 9499 - DNA, 60 bp, Artificial Sequence
  Description of Artificial Sequence: Synthetic probe
attgagctagttggtagtcctccggcccctgaatgcggctaatcctaactgcggagcgcg

SEQ ID NO: 9500 - DNA, 60 bp, Artificial Sequence
  Description of Artificial Sequence: Synthetic probe
cgaagagtctattgagctaattggtagtcctccggcccctgaatgcggctaatcctaact

SEQ ID NO: 9501 - DNA, 60 bp, Artificial Sequence
  Description of Artificial Sequence: Synthetic probe
cgattgagctaattggtagtcctccggcccctgaatgcggctaatcctaactgcggagca

SEQ ID NO: 9502 - DNA, 60 bp, Artificial Sequence
  Description of Artificial Sequence: Synthetic probe
tggctgcttatggtgacaattgaaagattgttaccatatagctattggattggccatccg

SEQ ID NO: 9503 - DNA, 60 bp, Artificial Sequence
  Description of Artificial Sequence: Synthetic probe
gctcaggtactagtatattcaattccatgattaacaacatcataatcaggaccctcatgc

SEQ ID NO: 9504 - DNA, 60 bp, Artificial Sequence
  Description of Artificial Sequence: Synthetic probe
gggtgctcgggcactagtatattcaattccatgattaacaacatcataattaggactctc

SEQ ID NO: 9505 - DNA, 60 bp, Artificial Sequence
  Description of Artificial Sequence: Synthetic probe
agggtgctcgggcactagtatattcaattccatgattaacaacatcataattaggactct

SEQ ID NO: 9506 - DNA, 60 bp, Artificial Sequence
  Description of Artificial Sequence: Synthetic probe
gggatgctcaggtactagtatattcaattccatgattaacaacatcataatcaggaccct

SEQ ID NO: 9507 - DNA, 60 bp, Artificial Sequence
  Description of Artificial Sequence: Synthetic probe
aacagctacagctggcaaacgtccaccaacccgagtgtgttctggacggaagggagcgca

SEQ ID NO: 9508 - DNA, 60 bp, Artificial Sequence
  Description of Artificial Sequence: Synthetic probe
ggcacacgtcacaagttgtaccatcagacacaatgcaaactaggcatgtgaagaactacc

SEQ ID NO: 9509 - DNA, 60 bp, Artificial Sequence
  Description of Artificial Sequence: Synthetic probe
caccgggagctggggcaccgaccacacgcaaggaggcgatgctaggtactcacgtgatct

SEQ ID NO: 9510 - DNA, 60 bp, Artificial Sequence
  Description of Artificial Sequence: Synthetic probe
ggtcaggcagcattaaactaacatttatgttttgcgggtcagcgatggccactgggaagt

SEQ ID NO: 9511 - DNA, 60 bp, Artificial Sequence
  Description of Artificial Sequence: Synthetic probe
gcccattggtcaggcagcatcaaactaacatttatgttttgcgggtcagcgatggctaca

SEQ ID NO: 9512 - DNA, 60 bp, Artificial Sequence
  Description of Artificial Sequence: Synthetic probe
ttccccacaggtaactgtggcggtggctgcgttggcggcctgcccgtggggtgacccatg

SEQ ID NO: 9513 - DNA, 60 bp, Artificial Sequence
  Description of Artificial Sequence: Synthetic probe
caggggtgtttgctggtagtgtgcgtgccagaggcagagatggggtgcacacaaacagac

SEQ ID NO: 9514 - DNA, 60 bp, Artificial Sequence
  Description of Artificial Sequence: Synthetic probe
tccatcaggggtgtttgctggtagtgtgcgtgccagaggcagagatggggtgcacacaaa

SEQ ID NO: 9515 - DNA, 60 bp, Artificial Sequence
  Description of Artificial Sequence: Synthetic probe
cggcggagacggggcacacgtcacaagttgtacccagtgacaccatgcaaacaagacacg

SEQ ID NO: 9516 - DNA, 60 bp, Artificial Sequence
  Description of Artificial Sequence: Synthetic probe
ctgcggcggagacggggcacacgtcacaagttgtacccagtgacaccatgcaaacaagac

SEQ ID NO: 9517 - DNA, 60 bp, Artificial Sequence
  Description of Artificial Sequence: Synthetic probe
acttttctgaaaaggtacttcagggcagatgagcagtacccgttcctagttcaccctgtt

SEQ ID NO: 9518 - DNA, 60 bp, Artificial Sequence
  Description of Artificial Sequence: Synthetic probe
ggtaacctggacaaatgtgacttttctgaaaaggtacttcagggcagatgagcagtaccc

SEQ ID NO: 9519 - DNA, 60 bp, Artificial Sequence
  Description of Artificial Sequence: Synthetic probe
aatgaggtaacctggacaaatgtgacttttctgaaaaggtacttcagggcagatgagcag

SEQ ID NO: 9520 - DNA, 60 bp, Artificial Sequence
  Description of Artificial Sequence: Synthetic probe
aagtcgcccaactgcgccggaagctcgaaatgttcacgtatgcaagatttgatttggagt

SEQ ID NO: 9521 - DNA, 60 bp, Artificial Sequence
  Description of Artificial Sequence: Synthetic probe
tgtgcctagtgacacaatgcaaaccagacacgtgaagaattaccattcaaggtcagagtc

SEQ ID NO: 9522 - DNA, 60 bp, Artificial Sequence
  Description of Artificial Sequence: Synthetic probe
gcatacctctcaggttgtgcctagtgacacaatgcaaaccagacacgtgaagaattacca

SEQ ID NO: 9523 - DNA, 60 bp, Artificial Sequence
  Description of Artificial Sequence: Synthetic probe
aatccccacaggcgactgtggcggtggctgcgttggcggcctgcccatgaggcaacccat

SEQ ID NO: 9524 - DNA, 60 bp, Artificial Sequence
  Description of Artificial Sequence: Synthetic probe
aaggagaaaacgttcgttacccggccaattacttcgagaaacctagtatcaccatggagg

SEQ ID NO: 9525 - DNA, 60 bp, Artificial Sequence
  Description of Artificial Sequence: Synthetic probe
tcttatattggctgcttatggtgacaattgagagattgttgccatatagctattggattg

SEQ ID NO: 9526 - DNA, 60 bp, Artificial Sequence
  Description of Artificial Sequence: Synthetic probe
cagggataagcactactttgtgaggggcggaatgccatcaggatgttcaggcactagcat

SEQ ID NO: 9527 - DNA, 60 bp, Artificial Sequence
  Description of Artificial Sequence: Synthetic probe
cagggaaagtcctgggaatacacgtgggaggaaacggacatcaagggttctcagccgcac

SEQ ID NO: 9528 - DNA, 60 bp, Artificial Sequence
  Description of Artificial Sequence: Synthetic probe
cgtcctaatgtcgacagggaaagtcctgggaatacacgtgggaggaaacggacatcaagg

SEQ ID NO: 9529 - DNA, 60 bp, Artificial Sequence
  Description of Artificial Sequence: Synthetic probe
cttaccaatggtgacctacgtcaaagatgagctgagatctgctgagaaggtggccaaggg

SEQ ID NO: 9530 - DNA, 60 bp, Artificial Sequence
  Description of Artificial Sequence: Synthetic probe
acggcctaaacttaccaatggtgacctacgtcaaagatgagctgagatctgctgagaagg

SEQ ID NO: 9531 - DNA, 60 bp, Artificial Sequence
  Description of Artificial Sequence: Synthetic probe
tatactggctgcttatggtgacaattgagagattgttaccatatagctattggattggcc

SEQ ID NO: 9532 - DNA, 60 bp, Artificial Sequence
  Description of Artificial Sequence: Synthetic probe
ctcatgtacaatttcccaactagagcaggccaatgcggcggtgttcttatgtcaacggga

SEQ ID NO: 9533 - DNA, 60 bp, Artificial Sequence
  Description of Artificial Sequence: Synthetic probe
gtctataccatttatcagcataggcaatgcatacagtatgttctatgatgggtgggccat

SEQ ID NO: 9534 - DNA, 60 bp, Artificial Sequence
  Description of Artificial Sequence: Synthetic probe
atgtctataccatttatcagcataggcaatgcatacagtatgttctatgatgggtgggcc

SEQ ID NO: 9535 - DNA, 59 bp, Artificial Sequence
  Description of Artificial Sequence: Synthetic probe
gtacgctagttatgagtcctccggcccctgaatgcggctaatccaaccctgcagccatt

SEQ ID NO: 9536 - DNA, 60 bp, Artificial Sequence
  Description of Artificial Sequence: Synthetic probe
aggcgattttctccaagtacattggcaatgtcaacacgcatgtggatgagtacatgcaag

SEQ ID NO: 9537 - DNA, 60 bp, Artificial Sequence
  Description of Artificial Sequence: Synthetic probe
gctctcctcagacactatttcaatgaggagcaaggtgagatagagttcattgaaaattcc

SEQ ID NO: 9538 - DNA, 60 bp, Artificial Sequence
  Description of Artificial Sequence: Synthetic probe
tgctctcctcagacactatttcaatgaggagcaaggtgagatagagttcattgaaaattc

SEQ ID NO: 9539 - DNA, 60 bp, Artificial Sequence
  Description of Artificial Sequence: Synthetic probe
cccacgggcgaccgtggcggtggctgcgttggcggcctgcccatggggaaacccatggga

SEQ ID NO: 9540 - DNA, 60 bp, Artificial Sequence
  Description of Artificial Sequence: Synthetic probe
caactcaaccagatgtggccacgtgcaggttttacacgcttgattctgtgcaatggcaga

SEQ ID NO: 9541 - DNA, 55 bp, Artificial Sequence
  Description of Artificial Sequence: Synthetic probe
gccccgtgtgctaccaatgagtcctccggcccctgaatgcggctaatcttacccc

SEQ ID NO: 9542 - DNA, 60 bp, Artificial Sequence
  Description of Artificial Sequence: Synthetic probe
gccccgtgtgctaccaatgagtcctccggcccctgaatgcggctaatcttaccccgcagc

SEQ ID NO: 9543 - DNA, 60 bp, Artificial Sequence
  Description of Artificial Sequence: Synthetic probe
gccccgtgtgctaccaatgagtcctccggcccctgaatgcggctaatcttaccccacagc

SEQ ID NO: 9544 - DNA, 60 bp, Artificial Sequence
  Description of Artificial Sequence: Synthetic probe
aagagccccgtgtgctaccaatgagtcctccggcccctgaatgcggctaatcttacccca

SEQ ID NO: 9545 - DNA, 60 bp, Artificial Sequence
  Description of Artificial Sequence: Synthetic probe
ctagccggtaggcctacccaccgtacactaatgtacaatttcccaaccagggcaggccag

SEQ ID NO: 9546 - DNA, 60 bp, Artificial Sequence
  Description of Artificial Sequence: Synthetic probe
acgttcctttattttatactggctgcttatggtgacaattgagagattgttaccatatag

SEQ ID NO: 9547 - DNA, 60 bp, Artificial Sequence
  Description of Artificial Sequence: Synthetic probe
ctgtcgtaacgggtaactctgcagcggaaccgactactttgggtgtccgtgtttcctttt

SEQ ID NO: 9548 - DNA, 60 bp, Artificial Sequence
  Description of Artificial Sequence: Synthetic probe
cggggcacacgtcacaggtgactccgagtgacacaatgcaaactaggcacgtgaagaact

SEQ ID NO: 9549 - DNA, 60 bp, Artificial Sequence
  Description of Artificial Sequence: Synthetic probe
tagtcctccggcccctgaatgcggctaatcctaactgcggagcacataccctcgatccag

SEQ ID NO: 9550 - DNA, 60 bp, Artificial Sequence
  Description of Artificial Sequence: Synthetic probe
cgcttcagtacagacatggtgcgaagagtctattgagctagttagtagtcctccggcccc

SEQ ID NO: 9551 - DNA, 60 bp, Artificial Sequence
  Description of Artificial Sequence: Synthetic probe
ttacccatgggacgcttcaatactgacatggtgcgaagagtctattgagctaattggtac

SEQ ID NO: 9552 - DNA, 53 bp, Artificial Sequence
  Description of Artificial Sequence: Synthetic probe
gcaactcccatcacctgtacagggacaagcactactttgtgaggggtggcatg

SEQ ID NO: 9553 - DNA, 60 bp, Artificial Sequence
  Description of Artificial Sequence: Synthetic probe
cagaacccttatgttgaaggtatacaagggcatcgatttggaccaatttagaatgattgc

SEQ ID NO: 9554 - DNA, 60 bp, Artificial Sequence
  Description of Artificial Sequence: Synthetic probe
ggacaaccaaagtagtcggttccgctgcagagttgcccattacgacacaccaccccctgg

SEQ ID NO: 9555 - DNA, 60 bp, Artificial Sequence
  Description of Artificial Sequence: Synthetic probe
caaggtcgtaacgagcaattccgggacgggaccgactactttgggtgtccgtgtttcctt

SEQ ID NO: 9556 - DNA, 60 bp, Artificial Sequence
  Description of Artificial Sequence: Synthetic probe
gcaaggtcgtaatgagtaattccgggacgggaccgactactttgggtgtccgtgtttcct

SEQ ID NO: 9557 - DNA, 60 bp, Artificial Sequence
  Description of Artificial Sequence: Synthetic probe
gcaaggtcgtaacgagtaattctgggacgggaccgactactttgggtgtccgtgtttcct

SEQ ID NO: 9558 - DNA, 60 bp, Artificial Sequence
  Description of Artificial Sequence: Synthetic probe
aaagggcagtgtgtcgtaacgggcaactctgcagcggaaccgactactttgggtgtccgt

SEQ ID NO: 9559 - DNA, 60 bp, Artificial Sequence
  Description of Artificial Sequence: Synthetic probe
cagtggctgcgttggcggcctgcccatggggtaacccatgggacgctctaatacagacat

SEQ ID NO: 9560 - DNA, 60 bp, Artificial Sequence
  Description of Artificial Sequence: Synthetic probe
agaccaaagacttgacgaaactgaaggaatgcatggataaatatggtctaaatctcccca

SEQ ID NO: 9561 - DNA, 60 bp, Artificial Sequence
  Description of Artificial Sequence: Synthetic probe
ggggtcccggtcccattgtaagcacagtacgaatttacttcaagccaaagcacgtcaaaa

SEQ ID NO: 9562 - DNA, 60 bp, Artificial Sequence
  Description of Artificial Sequence: Synthetic probe
caccagtgctcacccaccaaataatgtatgtacctccaggtggtccagtacccacaaagg

SEQ ID NO: 9563 - DNA, 60 bp, Artificial Sequence
  Description of Artificial Sequence: Synthetic probe
cactagcactcaggaacaacccaccgttcgaggtcaagatgcaccagtgctcacccacca

SEQ ID NO: 9564 - DNA, 60 bp, Artificial Sequence
  Description of Artificial Sequence: Synthetic probe
actagacacgtgaagaattaccattcaagatcagagtcgacagtggagaacttcctgtgc

SEQ ID NO: 9565 - DNA, 60 bp, Artificial Sequence
  Description of Artificial Sequence: Synthetic probe
ttccagccctaaccgccgcagagacagggcacacgtcacaagttgtaccatcagacacaa

SEQ ID NO: 9566 - DNA, 60 bp, Artificial Sequence
  Description of Artificial Sequence: Synthetic probe
tgcccgcgtcgctgataccattgggagcggaccagttaactcggaatccattccagccct

SEQ ID NO: 9567 - DNA, 60 bp, Artificial Sequence
  Description of Artificial Sequence: Synthetic probe
gatgcacagagtgactgtaagatcttgtgttttgtgtcggcatgtaacgatttttcagtt

SEQ ID NO: 9568 - DNA, 60 bp, Artificial Sequence
  Description of Artificial Sequence: Synthetic probe
tctgggatgtgggtctacaatcgagctgcgtattgtgtataccatggattagtcaaacgc

SEQ ID NO: 9569 - DNA, 60 bp, Artificial Sequence
  Description of Artificial Sequence: Synthetic probe
caccgaccacacgcaaggaggcgatgctaggtactcacgtgatctgggatgtgggtctac

SEQ ID NO: 9570 - DNA, 60 bp, Artificial Sequence
  Description of Artificial Sequence: Synthetic probe
gatggctacaggaaaattcttactggcgtactcaccaccgggagctggggcaccgaccac

SEQ ID NO: 9571 - DNA, 60 bp, Artificial Sequence
  Description of Artificial Sequence: Synthetic probe
tcaccatcagccatgccacaattcgatgtcactcctgagatggatattccaggacaagtc

SEQ ID NO: 9572 - DNA, 60 bp, Artificial Sequence
  Description of Artificial Sequence: Synthetic probe
gtaacagtggcgccaatgtgcgctgaatataatgggctgcgtctggccggcaagcaaggt

SEQ ID NO: 9573 - DNA, 60 bp, Artificial Sequence
  Description of Artificial Sequence: Synthetic probe
tcatggtcatcccgttcgccccactgagctacagcacaggggctaccacgtacgtaccaa

SEQ ID NO: 9574 - DNA, 60 bp, Artificial Sequence
  Description of Artificial Sequence: Synthetic probe
gcactaacaacagcgctacgattgtcatgccatatataaacagcgtgcccatggacaaca

SEQ ID NO: 9575 - DNA, 60 bp, Artificial Sequence
  Description of Artificial Sequence: Synthetic probe
aaggggaaatagccaacatgtttgaatcccaaaactccaccggggaaacggccgtgcaag

SEQ ID NO: 9576 - DNA, 60 bp, Artificial Sequence
  Description of Artificial Sequence: Synthetic probe
gttcaccaggctggtggtggaagttccctgacgcgttgtccaacatggggctatttgggc

SEQ ID NO: 9577 - DNA, 60 bp, Artificial Sequence
  Description of Artificial Sequence: Synthetic probe
tccatgcctgctctcaattccccatcagcagaggagtgtggctacagtgacagggtaaga

SEQ ID NO: 9578 - DNA, 60 bp, Artificial Sequence
  Description of Artificial Sequence: Synthetic probe
gaatgcttacagtatgttctatgacgggtgggccaggtttgacaagcaagggacttacgg

SEQ ID NO: 9579 - DNA, 60 bp, Artificial Sequence
  Description of Artificial Sequence: Synthetic probe
cgctataatactgacatggtgtgaagagtctattgagctagttggtagtcctccggcccc

SEQ ID NO: 9580 - DNA, 60 bp, Artificial Sequence
  Description of Artificial Sequence: Synthetic probe
agatgcgggatttcccgtgatcaacactcccagcaagacgaaactagaaccaagtgtgtt

SEQ ID NO: 9581 - DNA, 60 bp, Artificial Sequence
  Description of Artificial Sequence: Synthetic probe
tattgaaagctcaaaagatgcgggatttcccgtgatcaacactcccagcaagacgaaact

SEQ ID NO: 9582 - DNA, 54 bp, Artificial Sequence
  Description of Artificial Sequence: Synthetic probe
ctgctcacgcggttgaaggagaaaacgttcgttacccggccaattacttcgaga

SEQ ID NO: 9583 - DNA, 60 bp, Artificial Sequence
  Description of Artificial Sequence: Synthetic probe
tgaagagtctattgagctagttggtaatcctccggcccctgaatgcggctaatcctaact

SEQ ID NO: 9584 - DNA, 60 bp, Artificial Sequence
  Description of Artificial Sequence: Synthetic probe
agcaacggatggctaaagaagttcaccgagatgaccaacgcttgtaagggcatggagtgg

SEQ ID NO: 9585 - DNA, 60 bp, Artificial Sequence
  Description of Artificial Sequence: Synthetic probe
cgaccgtggcggtggctgcgttggcggcctgcccatggggcatcccatgggacgcttcaa

SEQ ID NO: 9586 - DNA, 60 bp, Artificial Sequence
  Description of Artificial Sequence: Synthetic probe
gggcagtctgtcgtaacgggtaactctgcagcggaaccgactactttgggtgtccgtgtt

SEQ ID NO: 9587 - DNA, 60 bp, Artificial Sequence
  Description of Artificial Sequence: Synthetic probe
ctattgagctagttggtagtcctccggcccctgaatgcggctaatcccaactgtggagca

SEQ ID NO: 9588 - DNA, 60 bp, Artificial Sequence
  Description of Artificial Sequence: Synthetic probe
cgtaccaagtgataccatgcagaccaggcacgtgaagaactaccactcaaggtcagagtc

SEQ ID NO: 9589 - DNA, 60 bp, Artificial Sequence
  Description of Artificial Sequence: Synthetic probe
tttcgctccgcacaaccccagtgtagatcaggtcgatgagtcaccgcattcctcacgggc

SEQ ID NO: 9590 - DNA, 60 bp, Artificial Sequence
  Description of Artificial Sequence: Synthetic probe
tattgagctaattggtagtcctccggcccctgaatgcggctaatcctaactgcggagcag

SEQ ID NO: 9591 - DNA, 56 bp, Artificial Sequence
  Description of Artificial Sequence: Synthetic probe
tgctctcctcagacattacttcaatgaggagcaaggtgagatagagttcatcgaga

SEQ ID NO: 9592 - DNA, 60 bp, Artificial Sequence
  Description of Artificial Sequence: Synthetic probe
gacgctctaatacagacatggtgtgaagagtctattgagctagttagtagtcctccggcc

SEQ ID NO: 9593 - DNA, 60 bp, Artificial Sequence
  Description of Artificial Sequence: Synthetic probe
agttggtagtcctccggcccctgaatgcggctaatcctaactgcggagcacacactcaca

SEQ ID NO: 9594 - DNA, 51 bp, Artificial Sequence
  Description of Artificial Sequence: Synthetic probe
ggtgactgtggcggtggctgcgttggcggcctgcccatggggtaacccatg

SEQ ID NO: 9595 - DNA, 60 bp, Artificial Sequence
  Description of Artificial Sequence: Synthetic probe
gaataacatggggacactatacatgagacatgtgaatgatggcagccccggccccattgt

SEQ ID NO: 9596 - DNA, 60 bp, Artificial Sequence
  Description of Artificial Sequence: Synthetic probe
caagtccaaatgccgtattgaacctgtctgcctcttgctccatggatgtccaggtgccgg

SEQ ID NO: 9597 - DNA, 58 bp, Artificial Sequence
  Description of Artificial Sequence: Synthetic probe
aaagggcagtgtgtcgtaacgggtaactctgcagcggaaccgactactttgggtgtcc

SEQ ID NO: 9598 - DNA, 60 bp, Artificial Sequence
  Description of Artificial Sequence: Synthetic probe
ccacaaagagaatgctcatgtacaacttcccaaccagagctggtcagtgcgggggtgtcc

SEQ ID NO: 9599 - DNA, 54 bp, Artificial Sequence
  Description of Artificial Sequence: Synthetic probe
ccacaaagagaatgctcatgtacaacttcccaaccagagctggtcagtgcgggg

SEQ ID NO: 9600 - DNA, 60 bp, Artificial Sequence
  Description of Artificial Sequence: Synthetic probe
gatgggcggtgctaccacgccacgccaagcctggacccactatactgatgaatgatcaag

SEQ ID NO: 9601 - DNA, 60 bp, Artificial Sequence
  Description of Artificial Sequence: Synthetic probe
atgacagatgggcggtgctaccacgccacgccaagcctggacccactatactgatgaatg

SEQ ID NO: 9602 - DNA, 60 bp, Artificial Sequence
  Description of Artificial Sequence: Synthetic probe
acagggatgccaaatcagaagcctaaggtgcccaccctgagacaggctagagtgcagggc

SEQ ID NO: 9603 - DNA, 60 bp, Artificial Sequence
  Description of Artificial Sequence: Synthetic probe
tccaaggagcctacacagggatgccaaatcagaagcctaaggtgcccaccctgagacagg

SEQ ID NO: 9604 - DNA, 60 bp, Artificial Sequence
  Description of Artificial Sequence: Synthetic probe
agaagaccaaagacctcactaagctgaaggaatgcatggataaatatggtctaaatctgc

SEQ ID NO: 9605 - DNA, 60 bp, Artificial Sequence
  Description of Artificial Sequence: Synthetic probe
ggtacttcagggcagatgagcagtacccgttcctagttcaccctgttatgcccatgaaag

SEQ ID NO: 9606 - DNA, 60 bp, Artificial Sequence
  Description of Artificial Sequence: Synthetic probe
tcaggactctcatgctgaaggtttataaaggcattgacctagaccaattcagaatgatcg

SEQ ID NO: 9607 - DNA, 60 bp, Artificial Sequence
  Description of Artificial Sequence: Synthetic probe
caggcttccccgtgatcaacactcccagcaagacaaagctagagcctagtgttttccacc

SEQ ID NO: 9608 - DNA, 60 bp, Artificial Sequence
  Description of Artificial Sequence: Synthetic probe
acgcaggcttccccgtgatcaacactcccagcaagacaaagctagagcctagtgttttcc

SEQ ID NO: 9609 - DNA, 60 bp, Artificial Sequence
  Description of Artificial Sequence: Synthetic probe
cagagacaaacactactttgtgaggggtggcatgccgtcagggtgttcaggcaccagcat

SEQ ID NO: 9610 - DNA, 60 bp, Artificial Sequence
  Description of Artificial Sequence: Synthetic probe
caccacctgtacagagacaaacactactttgtgaggggtggcatgccgtcagggtgttca

SEQ ID NO: 9611 - DNA, 60 bp, Artificial Sequence
  Description of Artificial Sequence: Synthetic probe
catctctagacatcagcacggagcccatgaagctagaggacgcggtctatggtaccgagg

SEQ ID NO: 9612 - DNA, 60 bp, Artificial Sequence
  Description of Artificial Sequence: Synthetic probe
ctattgagctagttagtagtcctccggcccctgaatgcggctaatcccaactgcggagca

SEQ ID NO: 9613 - DNA, 60 bp, Artificial Sequence
  Description of Artificial Sequence: Synthetic probe
gatcaacactcccagtaagacgaaattggaaccaagtgtgttttaccaggtcttcgaggg

SEQ ID NO: 9614 - DNA, 60 bp, Artificial Sequence
  Description of Artificial Sequence: Synthetic probe
ccgtgatcaacactcccagtaagacgaaattggaaccaagtgtgttttaccaggtcttcg

SEQ ID NO: 9615 - DNA, 60 bp, Artificial Sequence
  Description of Artificial Sequence: Synthetic probe
cgctctaatacagacatggtgtgaagagtctattgagctagttagtagtcctccggcccc

SEQ ID NO: 9616 - DNA, 60 bp, Artificial Sequence
  Description of Artificial Sequence: Synthetic probe
ggggccggaggactactaactagctcaatagactcttcacaccatgtctgtattagagcg

SEQ ID NO: 9617 - DNA, 60 bp, Artificial Sequence
  Description of Artificial Sequence: Synthetic probe
tggctcaagaagtttactgaaatgaccaacgcctgtaagggcatggagtggatagccatt

SEQ ID NO: 9618 - DNA, 60 bp, Artificial Sequence
  Description of Artificial Sequence: Synthetic probe
ccgtgtttccttttattcttatactggctgcttatggtgacaattgagagattgttacca

SEQ ID NO: 9619 - DNA, 60 bp, Artificial Sequence
  Description of Artificial Sequence: Synthetic probe
gcgaggtcgtaacgagaaattctgggacgggaccgactactttgggtgtccgtgtttcct

SEQ ID NO: 9620 - DNA, 60 bp, Artificial Sequence
  Description of Artificial Sequence: Synthetic probe
cggaaccgactactttgggtgtccgtgtttccttttattccttactggctgcttatggtg

SEQ ID NO: 9621 - DNA, 60 bp, Artificial Sequence
  Description of Artificial Sequence: Synthetic probe
tgagtcaccgcgttccccacgggcgaccgtggcggtggctgcgttggcggcctgcccatg

SEQ ID NO: 9622 - DNA, 60 bp, Artificial Sequence
  Description of Artificial Sequence: Synthetic probe
gagctagttggtagtcctccggcccctgaatgcggctaatcctaactgcggagcagatgc

SEQ ID NO: 9623 - DNA, 60 bp, Artificial Sequence
  Description of Artificial Sequence: Synthetic probe
gtaacccacaggacgctctaatacagacatggtgcgaagagtctattgagctagttagta

SEQ ID NO: 9624 - DNA, 60 bp, Artificial Sequence
  Description of Artificial Sequence: Synthetic probe
tggcataaacacattgaataacatggggacactgtacatgagacatgtgaatgatggcag

SEQ ID NO: 9625 - DNA, 60 bp, Artificial Sequence
  Description of Artificial Sequence: Synthetic probe
ggtaacccatgggacgctctaatacagacatggtgtgaagagtctattgagctagttagt

SEQ ID NO: 9626 - DNA, 60 bp, Artificial Sequence
  Description of Artificial Sequence: Synthetic probe
gctagttagtagtcctccggcccctgaatgcggctaatcctaactgcggagcgcataccc

SEQ ID NO: 9627 - DNA, 60 bp, Artificial Sequence
  Description of Artificial Sequence: Synthetic probe
ttcgctcagcactaccccagtgtagatcaggtcgatgagtcactgcataccccacgggtg

SEQ ID NO: 9628 - DNA, 60 bp, Artificial Sequence
  Description of Artificial Sequence: Synthetic probe
aagagtctattgagctagttggtagtcctccggcccctgaatgcggctaatcctaactgc

SEQ ID NO: 9629 - DNA, 60 bp, Artificial Sequence
  Description of Artificial Sequence: Synthetic probe
ctattgagctaattggtaatcctccggcccctgaatgcggctaatcctaactgcggagca

SEQ ID NO: 9630 - DNA, 60 bp, Artificial Sequence
  Description of Artificial Sequence: Synthetic probe
gtgtccgtgtttccttttattcttatactggctgcttatggtgacaattgagagattgtt

SEQ ID NO: 9631 - DNA, 60 bp, Artificial Sequence
  Description of Artificial Sequence: Synthetic probe
tgtgaagagtctattgagctaattggtagtcctccggcccctgaatgcggctaatcctaa

SEQ ID NO: 9632 - DNA, 60 bp, Artificial Sequence
  Description of Artificial Sequence: Synthetic probe
tgggcggtctgtcgtaacgggcaactctgcagcggaaccgactactttgggtgtccgtgt

SEQ ID NO: 9633 - DNA, 60 bp, Artificial Sequence
  Description of Artificial Sequence: Synthetic probe
agctagttggtagtctccggcccctgaatgcggctaatcctaactgcggagcgcataccc

SEQ ID NO: 9634 - DNA, 60 bp, Artificial Sequence
  Description of Artificial Sequence: Synthetic probe
ttggtagtcctccggcccctgaatgcggctaatcctaactgcggagcacacaccctcaag

SEQ ID NO: 9635 - DNA, 60 bp, Artificial Sequence
  Description of Artificial Sequence: Synthetic probe
gtgggtagcgtgtcgtaatgggtaactctgcagcggaaccgactactttgggtgtccgtg

SEQ ID NO: 9636 - DNA, 60 bp, Artificial Sequence
  Description of Artificial Sequence: Synthetic probe
tttggtcgtaacgggtaactgtgggacggaaccgactactttgggtgtccgtgtttcctt

SEQ ID NO: 9637 - DNA, 58 bp, Artificial Sequence
  Description of Artificial Sequence: Synthetic probe
accgcgttccccacgggcgaccgtggcggtggctgcgttggcggcctgcccatggggc

SEQ ID NO: 9638 - DNA, 60 bp, Artificial Sequence
  Description of Artificial Sequence: Synthetic probe
cccatggcagagaggcaaaacaacagctggttgaagaagtttacagagatgactaatgcc

SEQ ID NO: 9639 - DNA, 60 bp, Artificial Sequence
  Description of Artificial Sequence: Synthetic probe
ccagtgggcagtctgtcgtaacgggcaactctgcagcggaaccgactactttgggtgtcc

SEQ ID NO: 9640 - DNA, 60 bp, Artificial Sequence
  Description of Artificial Sequence: Synthetic probe
accgtggcggtggctgcgttggcggcctgcccatgggtcaatccatgggacgcttcaata

SEQ ID NO: 9641 - DNA, 60 bp, Artificial Sequence
  Description of Artificial Sequence: Synthetic probe
ctattgagctagttagtagtctccggcccctgaatgcggctaatcctaactgcggagcac

SEQ ID NO: 9642 - DNA, 60 bp, Artificial Sequence
  Description of Artificial Sequence: Synthetic probe
acgctccgtagttgggattagccgcattcaggggccggaggactaccaactagctcaata

SEQ ID NO: 9643 - DNA, 60 bp, Artificial Sequence
  Description of Artificial Sequence: Synthetic probe
tgaagagtctattgagctagttagcagtcctccggcccctgaatgcggctaatcctaact

SEQ ID NO: 9644 - DNA, 51 bp, Artificial Sequence
  Description of Artificial Sequence: Synthetic probe
gggtagtctgtcgtaacgggcaactctgcagcggaaccgactactttgggt

SEQ ID NO: 9645 - DNA, 60 bp, Artificial Sequence
  Description of Artificial Sequence: Synthetic probe
ttgagctagttagtagtcctccggcccctgaatgcggctaatcctaactgcggagcacgc

SEQ ID NO: 9646 - DNA, 52 bp, Artificial Sequence
  Description of Artificial Sequence: Synthetic probe
attgtgggatggaaccgactactttgggtgtccgtgtttccttgttttcctt

SEQ ID NO: 9647 - DNA, 60 bp, Artificial Sequence
  Description of Artificial Sequence: Synthetic probe
cagacatggtgtgaagagtctattgagctagttagtagtcctccggcccctgaatgcggc

SEQ ID NO: 9648 - DNA, 60 bp, Artificial Sequence
  Description of Artificial Sequence: Synthetic probe
gtagtcctccggcccctgaatgcggctaatcctaactgcggagcatgcacccacaagcca

SEQ ID NO: 9649 - DNA, 60 bp, Artificial Sequence
  Description of Artificial Sequence: Synthetic probe
agtctattgagctaattggtaatcctccggcccctgaatgcggctaatcctaactgcgga

SEQ ID NO: 9650 - DNA, 60 bp, Artificial Sequence
  Description of Artificial Sequence: Synthetic probe
gagtctattgagctaattggtaatcctccggcccctgaatgcggctaatcctaactgcgg

SEQ ID NO: 9651 - DNA, 60 bp, Artificial Sequence
  Description of Artificial Sequence: Synthetic probe
tgaagagtctattgagctagttggtagtcctccggcccctgaatgcggctaatcctaact

SEQ ID NO: 9652 - DNA, 60 bp, Artificial Sequence
  Description of Artificial Sequence: Synthetic probe
cccacgggcgaccgtgacagtggctgcgttggcggcctgcccatggggtaacccatggga

SEQ ID NO: 9653 - DNA, 53 bp, Artificial Sequence
  Description of Artificial Sequence: Synthetic probe
tggtgacaattgagagattgttaccatatagctactggattggccatccgata

SEQ ID NO: 9654 - DNA, 60 bp, Artificial Sequence
  Description of Artificial Sequence: Synthetic probe
gggtaacccataggacgctctaaagtggacatggtgtgaagagtctattgagctagttag

SEQ ID NO: 9655 - DNA, 60 bp, Artificial Sequence
  Description of Artificial Sequence: Synthetic probe
tagtcctccggcccctgaatgcggctaatcctaactgcggagcgcatgccctcaatccag

SEQ ID NO: 9656 - DNA, 60 bp, Artificial Sequence
  Description of Artificial Sequence: Synthetic probe
cactggctgcttatggtgacaattgagagattgttaccatatagctattggattggccat

SEQ ID NO: 9657 - DNA, 60 bp, Artificial Sequence
  Description of Artificial Sequence: Synthetic probe
tggctgcgctggcggcctgcccatggggtaacccatgggacgcttcaatactgacacggt

SEQ ID NO: 9658 - DNA, 60 bp, Artificial Sequence
  Description of Artificial Sequence: Synthetic probe
tccccacaggcgactgtggcggtggctgcgttggcggcctgcccatggggcaacccatgg

SEQ ID NO: 9659 - DNA, 60 bp, Artificial Sequence
  Description of Artificial Sequence: Synthetic probe
ctgcagcggaaccgactactttgggtgtccgtgtttccttttattcttgtactggctgct

SEQ ID NO: 9660 - DNA, 60 bp, Artificial Sequence
  Description of Artificial Sequence: Synthetic probe
ctaccactcaagatcagagtcgacagtggagaactttctgtgtcgatcagcgtgcgtctt

SEQ ID NO: 9661 - DNA, 60 bp, Artificial Sequence
  Description of Artificial Sequence: Synthetic probe
acgtgaagaactaccactcaagatcagagtcgacagtggagaactttctgtgtcgatcag

SEQ ID NO: 9662 - DNA, 60 bp, Artificial Sequence
  Description of Artificial Sequence: Synthetic probe
agtgagtagtgtgtcgtaatgggcaactctgcagcggaaccgactactttgggtgtccgt

SEQ ID NO: 9663 - DNA, 60 bp, Artificial Sequence
  Description of Artificial Sequence: Synthetic probe
cctgcccatgaggcaacccatgggacgcttcaatactgacatggtgcgaagagtctattg

SEQ ID NO: 9664 - DNA, 60 bp, Artificial Sequence
  Description of Artificial Sequence: Synthetic probe
ggagaagaaaatgagcaactacatacagttcaagtccaaatgccgtattgaacctgtctg

SEQ ID NO: 9665 - DNA, 51 bp, Artificial Sequence
  Description of Artificial Sequence: Synthetic probe
gggaccaactactttgggtgtccgtgtttccttttattcctattatttgct

SEQ ID NO: 9666 - DNA, 56 bp, Artificial Sequence
  Description of Artificial Sequence: Synthetic probe
tcgtaacgggtaactctgcagcggaaccgactactttgggtgtccgtgtttctttt

SEQ ID NO: 9667 - DNA, 60 bp, Artificial Sequence
  Description of Artificial Sequence: Synthetic probe
agggcagtgtgtcgtaacgggcaactctgcagcggaaccgactactttgggtgtccgtgt

SEQ ID NO: 9668 - DNA, 60 bp, Artificial Sequence
  Description of Artificial Sequence: Synthetic probe
agtctattgagctaattggttgctccggcccctgaatgcggctaatcctaactgcggagc

SEQ ID NO: 9669 - DNA, 60 bp, Artificial Sequence
  Description of Artificial Sequence: Synthetic probe
atgagtcctccggcccctgaatgcggctaatccaaccccacagctatggcatgcaagcca

SEQ ID NO: 9670 - DNA, 60 bp, Artificial Sequence
  Description of Artificial Sequence: Synthetic probe
acgggcgaccgtggcggtggctgcgttggcggcctgcctatggggaaacccataggacgc

SEQ ID NO: 9671 - DNA, 60 bp, Artificial Sequence
  Description of Artificial Sequence: Synthetic probe
cgcttcaatactgacatggtgcgaagagtctattgagctaattggtactcctccggcccc

SEQ ID NO: 9672 - DNA, 60 bp, Artificial Sequence
  Description of Artificial Sequence: Synthetic probe
tgcgaagagtctattgagctagttagtagtcctccggcccctgaatgcggctaatcctaa

SEQ ID NO: 9673 - DNA, 60 bp, Artificial Sequence
  Description of Artificial Sequence: Synthetic probe
gcgaagagtctattgagctagttagtagtcctccggcccctgaatgcggctaatcctaac

SEQ ID NO: 9674 - DNA, 60 bp, Artificial Sequence
  Description of Artificial Sequence: Synthetic probe
cgaagagtctattgagctagttagtagtcctccggcccctgaatgcggctaatcctaact

SEQ ID NO: 9675 - DNA, 57 bp, Artificial Sequence
  Description of Artificial Sequence: Synthetic probe
ggtgactgtggcggtggctgcgttggcggcctgcccatggggtaacccatgggacgc

SEQ ID NO: 9676 - DNA, 60 bp, Artificial Sequence
  Description of Artificial Sequence: Synthetic probe
gctggattgagggtatgtgctccgcagttaggattagccgcattcaggggccggaggact

SEQ ID NO: 9677 - DNA, 60 bp, Artificial Sequence
  Description of Artificial Sequence: Synthetic probe
gtctattgagctagttggtagtctccggcccctgaatgcggctaatcctaactgcggagc

SEQ ID NO: 9678 - DNA, 60 bp, Artificial Sequence
  Description of Artificial Sequence: Synthetic probe
cctgcccatggggtaacccatgggacgcttcaatactgacatggtgcgaagagtctattg

SEQ ID NO: 9679 - DNA, 60 bp, Artificial Sequence
  Description of Artificial Sequence: Synthetic probe
tcaccgcactccccacgggcgaccgtggcggtggctgcgttggcggcctgcccatggggc

SEQ ID NO: 9680 - DNA, 60 bp, Artificial Sequence
  Description of Artificial Sequence: Synthetic probe
ggctgcttatggtgacaattgagagattgttaccatatagctattggattggccatccgg

SEQ ID NO: 9681 - DNA, 60 bp, Artificial Sequence
  Description of Artificial Sequence: Synthetic probe
agagtctattgagctagttggtagtctccggcccctgaatgcggctaatcctaactgcgg

SEQ ID NO: 9682 - DNA, 60 bp, Artificial Sequence
  Description of Artificial Sequence: Synthetic probe
ggtgcgaagagtctagtgagctagttagtagtcctccggcccctgaatgcggctaatcct

SEQ ID NO: 9683 - DNA, 60 bp, Artificial Sequence
  Description of Artificial Sequence: Synthetic probe
tgtgccagcagacacaatgcaaaccagacacgtgaagaattatcactcaagatcagagtc

SEQ ID NO: 9684 - DNA, 60 bp, Artificial Sequence
  Description of Artificial Sequence: Synthetic probe
tcgttccgcacaaccccagtgtagatcaggtcgatgagtcaccgcattcctcacgggcga

SEQ ID NO: 9685 - DNA, 60 bp, Artificial Sequence
  Description of Artificial Sequence: Synthetic probe
tgtgaagagtctattgagctagttggtagtcctccggcccctgaatgcggctaatcctaa

SEQ ID NO: 9686 - DNA, 60 bp, Artificial Sequence
  Description of Artificial Sequence: Synthetic probe
cgcttcaatactgacatggtgcgaagagtctattgagctagttggtagtcctccggcccc

SEQ ID NO: 9687 - DNA, 60 bp, Artificial Sequence
  Description of Artificial Sequence: Synthetic probe
gagtctattgagctagttggtagtcctccggcccctgaatgcggctaatcccaactgcgg

SEQ ID NO: 9688 - DNA, 51 bp, Artificial Sequence
  Description of Artificial Sequence: Synthetic probe
ggggactctggcggtggctgcgttggcggcctgcccatgggataacccatg

SEQ ID NO: 9689 - DNA, 60 bp, Artificial Sequence
  Description of Artificial Sequence: Synthetic probe
ctattgagctaattggtagtcctccggcccctgaatgcggctaatcctaactgcggagca

SEQ ID NO: 9690 - DNA, 60 bp, Artificial Sequence
  Description of Artificial Sequence: Synthetic probe
tgagctagttagtagtcctccggcccctgaatgcggctaatcctaactgcggagcacata

SEQ ID NO: 9691 - DNA, 60 bp, Artificial Sequence
  Description of Artificial Sequence: Synthetic probe
aacgggcaactctgcagcggaaccgactactttgggtgtccgtgtttccttttattctta

SEQ ID NO: 9692 - DNA, 60 bp, Artificial Sequence
  Description of Artificial Sequence: Synthetic probe
ctattgagctagttagtagtcctccggcccctgaatgcggctaatcctaactgcggagcg

SEQ ID NO: 9693 - DNA, 60 bp, Artificial Sequence
  Description of Artificial Sequence: Synthetic probe
gttccccacgggcgaccgtggcggtggctgcgttggcggcctgcccatggggcaacccat

SEQ ID NO: 9694 - DNA, 60 bp, Artificial Sequence
  Description of Artificial Sequence: Synthetic probe
actccccacgggcgaccgtggcggtggctgcgttggcggcctgcccatggggcaacccat

SEQ ID NO: 9695 - DNA, 60 bp, Artificial Sequence
  Description of Artificial Sequence: Synthetic probe
gggcagtgtgtcgtaacgggcaactctgcagcggaaccgactactttgggtgtccgtgtt

SEQ ID NO: 9696 - DNA, 60 bp, Artificial Sequence
  Description of Artificial Sequence: Synthetic probe
gctaattggtagtcctccggcccctgaatgcggctaatcccaactgcggagcagataccc

SEQ ID NO: 9697 - DNA, 60 bp, Artificial Sequence
  Description of Artificial Sequence: Synthetic probe
gggtaacccataggacgctctaaagtggacatggtgcgaagagtctattgagctagttag

SEQ ID NO: 9698 - DNA, 60 bp, Artificial Sequence
  Description of Artificial Sequence: Synthetic probe
ttaaggtcgtaatgagtaatttcgggatgggaccgactactttgggtgtccgtgtttcct

SEQ ID NO: 9699 - DNA, 60 bp, Artificial Sequence
  Description of Artificial Sequence: Synthetic probe
ctattgagctagttggtagtcctccggcccctgaatgcggctaatcccaactgcggagca

SEQ ID NO: 9700 - DNA, 60 bp, Artificial Sequence
  Description of Artificial Sequence: Synthetic probe
cgctctaatacagacatggtgcgaagagtctattgagctagttagtagtcctccggcccc

SEQ ID NO: 9701 - DNA, 60 bp, Artificial Sequence
  Description of Artificial Sequence: Synthetic probe
ccggaggactactaactagctcaatagactcttcacaccatgtctgtattagagcgcccc

SEQ ID NO: 9702 - DNA, 60 bp, Artificial Sequence
  Description of Artificial Sequence: Synthetic probe
attccccacgggcgaccgtggcggtggctgcgttggcggcctgcccatgggtcaatccat

SEQ ID NO: 9703 - DNA, 60 bp, Artificial Sequence
  Description of Artificial Sequence: Synthetic probe
cgagaaacctagtaacaccatgaaagttgcgcagtgtttcgctccgcacagccccagtgt

SEQ ID NO: 9704 - DNA, 60 bp, Artificial Sequence
  Description of Artificial Sequence: Synthetic probe
caacccatgggacgcttcaatactgacatggtgcgaagagtctattgagctaattggtag

SEQ ID NO: 9705 - DNA, 60 bp, Artificial Sequence
  Description of Artificial Sequence: Synthetic probe
ggtgcgaagagtcaattgagctagttggtagtcctccggcccctgaatgcggctaatcct

SEQ ID NO: 9706 - DNA, 60 bp, Artificial Sequence
  Description of Artificial Sequence: Synthetic probe
tgtggcggtggctgcgttggcggcctgcccatggggcaacccatgggatgcttcaatatg

SEQ ID NO: 9707 - DNA, 60 bp, Artificial Sequence
  Description of Artificial Sequence: Synthetic probe
attccccacgggcgaccgtggcggtggctgcgttggcggcctgcccatgggccaacccat

SEQ ID NO: 9708 - DNA, 60 bp, Artificial Sequence
  Description of Artificial Sequence: Synthetic probe
gagctagttagtagtcctccggcccctgaatgcggctaatcctaactgcggagcacatac

SEQ ID NO: 9709 - DNA, 60 bp, Artificial Sequence
  Description of Artificial Sequence: Synthetic probe
ggggtggtgcgtcgtaatgggcaactctgcagcggaaccgactactttgggtgtccgtga

SEQ ID NO: 9710 - DNA, 60 bp, Artificial Sequence
  Description of Artificial Sequence: Synthetic probe
gcgctgttgggtgtgacccagatgtgttttggagcaagatccctgtcatgctagacgggc

SEQ ID NO: 9711 - DNA, 60 bp, Artificial Sequence
  Description of Artificial Sequence: Synthetic probe
gatgagtcaccgcgttccccacgggcgaccgtggcggtggctgcgttggcggcctgccca

SEQ ID NO: 9712 - DNA, 60 bp, Artificial Sequence
  Description of Artificial Sequence: Synthetic probe
tgcgttggcggcctgcccatggggcaacccatgggacgcttcaatactgacatggtgtga

SEQ ID NO: 9713 - DNA, 60 bp, Artificial Sequence
  Description of Artificial Sequence: Synthetic probe
atacagacatggtgtgaagagtctattgagctagttagtagtcctccggcccctgaatgc

SEQ ID NO: 9714 - DNA, 60 bp, Artificial Sequence
  Description of Artificial Sequence: Synthetic probe
aatactgacatggtgcgaagagtctattgagctaattggtagtcctccggcccctgaatg

SEQ ID NO: 9715 - DNA, 60 bp, Artificial Sequence
  Description of Artificial Sequence: Synthetic probe
ctattgagctaattggtagtcctccggcccctgaatgcggctaatccttactgcggagca

SEQ ID NO: 9716 - DNA, 60 bp, Artificial Sequence
  Description of Artificial Sequence: Synthetic probe
ccgactactttgggtgtccgtgtttccttttattcttatattggctgcttatggtgacaa

SEQ ID NO: 9717 - DNA, 56 bp, Artificial Sequence
  Description of Artificial Sequence: Synthetic probe
ggggcagtgtgtcgtaacgggtaactctgcagcggaaccgactactttgggtgtcc

SEQ ID NO: 9718 - DNA, 60 bp, Artificial Sequence
  Description of Artificial Sequence: Synthetic probe
agtcaccgcattccccacgggcgaccgtggcggtggctgcgttggcggcctgcctgtggg

SEQ ID NO: 9719 - DNA, 60 bp, Artificial Sequence
  Description of Artificial Sequence: Synthetic probe
accgtggcggtggctgcgttggcggcctgcccatggggcaacccatgggacgcttcaata

SEQ ID NO: 9720 - DNA, 60 bp, Artificial Sequence
  Description of Artificial Sequence: Synthetic probe
gaccgtggcggtggctgcgttggcggcctgcccatggggcaacccatgggacgcttcaat

SEQ ID NO: 9721 - DNA, 60 bp, Artificial Sequence
  Description of Artificial Sequence: Synthetic probe
ttccccacgggcgaccgtggcggtggctgcgttggcggcctgcccatggggcgacccatg

SEQ ID NO: 9722 - DNA, 60 bp, Artificial Sequence
  Description of Artificial Sequence: Synthetic probe
gtaacccatgggacgcttcaatactgacatggtgcgaagagtctattgagctaattggta

SEQ ID NO: 9723 - DNA, 60 bp, Artificial Sequence
  Description of Artificial Sequence: Synthetic probe
gtgggcagtctgtcgtaatgggcaactctgcagcggaaccgactactttgggtgtccgtg

SEQ ID NO: 9724 - DNA, 60 bp, Artificial Sequence
  Description of Artificial Sequence: Synthetic probe
ttcctcacgggcgaccgtggcggtggctgcgttggcggcctgcccatgggataacccatg

SEQ ID NO: 9725 - DNA, 60 bp, Artificial Sequence
  Description of Artificial Sequence: Synthetic probe
taggtgtgattcctccggcccctgaatgcggctaatcctaaccccgcagccaccacatgc

SEQ ID NO: 9726 - DNA, 59 bp, Artificial Sequence
  Description of Artificial Sequence: Synthetic probe
tgtttcgctccgcacaaccccagtgtagatcaggtcgatgagtcaccgcattcctcacg

SEQ ID NO: 9727 - DNA, 60 bp, Artificial Sequence
  Description of Artificial Sequence: Synthetic probe
catggtgtgaagagtctattgagctagttagtagtcctccggcccctgaatgcggctaat

SEQ ID NO: 9728 - DNA, 55 bp, Artificial Sequence
  Description of Artificial Sequence: Synthetic probe
tggtgacaattgagagattgttaccatatagctattggattggctatccggtgtc

SEQ ID NO: 9729 - DNA, 60 bp, Artificial Sequence
  Description of Artificial Sequence: Synthetic probe
gtgtcgtaacgggcaactctgcagcggaaccgactactttgggtgtccgtgtttcctttt

SEQ ID NO: 9730 - DNA, 60 bp, Artificial Sequence
  Description of Artificial Sequence: Synthetic probe
cgcactccccacgggcgaccgtggcggtggctgcgttggcggcctgcccatggggcatcc

SEQ ID NO: 9731 - DNA, 60 bp, Artificial Sequence
  Description of Artificial Sequence: Synthetic probe
cagtggctgcgttggcggcctgcccatggggtaacccatgggacgctctaatacagacac

SEQ ID NO: 9732 - DNA, 60 bp, Artificial Sequence
  Description of Artificial Sequence: Synthetic probe
gctaattggtagtcctccggcccctgaatgcggctaatcctaactgcggagcagacacct

SEQ ID NO: 9733 - DNA, 60 bp, Artificial Sequence
  Description of Artificial Sequence: Synthetic probe
agcgtttcgctccgcacaaccccagtgtagatcaggtcgatgagtcaccgcaaccctcac

SEQ ID NO: 9734 - DNA, 60 bp, Artificial Sequence
  Description of Artificial Sequence: Synthetic probe
tgcgctggcggcctgcccatggggcaacccatgggacgcttcaatactgacatggtgcga

SEQ ID NO: 9735 - DNA, 60 bp, Artificial Sequence
  Description of Artificial Sequence: Synthetic probe
atatagacatggtgcgaagagtctattgagctagttagtagtcctccggcccctgaatgc

SEQ ID NO: 9736 - DNA, 60 bp, Artificial Sequence
  Description of Artificial Sequence: Synthetic probe
gtgcgaagagtctattgagctagttggtagtcctccggcccctgaatgcggctaatccta

SEQ ID NO: 9737 - DNA, 60 bp, Artificial Sequence
  Description of Artificial Sequence: Synthetic probe
cacacgtcacaagtgaccccaagtgacaccatgcaaaccagacacgtgaagaattatcat

SEQ ID NO: 9738 - DNA, 60 bp, Artificial Sequence
  Description of Artificial Sequence: Synthetic probe
gcacgtgaagaactatcactctagatcagagtcgacagtggaaaactttctgtgcagatc

SEQ ID NO: 9739 - DNA, 60 bp, Artificial Sequence
  Description of Artificial Sequence: Synthetic probe
tctattgagctaattggtattcctccggcccctgaatgcggctaatcctaactgcggagc

SEQ ID NO: 9740 - DNA, 56 bp, Artificial Sequence
  Description of Artificial Sequence: Synthetic probe
ggggcagcgcgtcgtaatgggtaactctgcagcggaaccgactactttgggtgtcc

SEQ ID NO: 9741 - DNA, 60 bp, Artificial Sequence
  Description of Artificial Sequence: Synthetic probe
ttggtagtcctccggcccctgaatgcggctaatcccaactgcggagcagatacccacaca

SEQ ID NO: 9742 - DNA, 60 bp, Artificial Sequence
  Description of Artificial Sequence: Synthetic probe
attggtagtcctccggcccctgaatgcggctaatcccaactgcggagcagatacccacac

SEQ ID NO: 9743 - DNA, 60 bp, Artificial Sequence
  Description of Artificial Sequence: Synthetic probe
cagtgggcagtgtgtcgtaacgggcaactctgcagcggaaccgactactttgggtgaccg

SEQ ID NO: 9744 - DNA, 60 bp, Artificial Sequence
  Description of Artificial Sequence: Synthetic probe
caccgcattccccacgggcgaccgtggcggtggctgcgttggcggcctgcctatggggca

SEQ ID NO: 9745 - DNA, 60 bp, Artificial Sequence
  Description of Artificial Sequence: Synthetic probe
caccgcattccccacgggcgaccgtggcggtggctgcgttggcggcctgcctacggggca

SEQ ID NO: 9746 - DNA, 60 bp, Artificial Sequence
  Description of Artificial Sequence: Synthetic probe
gctagttggtagtcctccggcccctgaatgcggctaatcctaactgcggagcacataccc

SEQ ID NO: 9747 - DNA, 54 bp, Artificial Sequence
  Description of Artificial Sequence: Synthetic probe
agggtcaagattcgccagtgctcacccaccaaattatgtatgtcccccccggcg

SEQ ID NO: 9748 - DNA, 60 bp, Artificial Sequence
  Description of Artificial Sequence: Synthetic probe
ccgcgtgtgctactaatgagtcctccggcccctgaatgcggctaatccaaccccacagct

SEQ ID NO: 9749 - DNA, 60 bp, Artificial Sequence
  Description of Artificial Sequence: Synthetic probe
ctactggcgccttcgggcagcagtctggtgctgtatacgtcggcaactacagagtggtga

SEQ ID NO: 9750 - DNA, 60 bp, Artificial Sequence
  Description of Artificial Sequence: Synthetic probe
caaactactggcgccttcgggcagcagtctggtgctgtatacgtcggcaactacagagtg

SEQ ID NO: 9751 - DNA, 60 bp, Artificial Sequence
  Description of Artificial Sequence: Synthetic probe
ggacactgtatatgagacatgtgaatgacggtagccccggtcccatcgtgagtacggtgc

SEQ ID NO: 9752 - DNA, 60 bp, Artificial Sequence
  Description of Artificial Sequence: Synthetic probe
cactaaacaacatggggacactgtatatgagacatgtgaatgacggtagccccggtccca

SEQ ID NO: 9753 - DNA, 51 bp, Artificial Sequence
  Description of Artificial Sequence: Synthetic probe
accttagtgatgaagaagcgacggcagaggatcaacccactcaaccagatg

SEQ ID NO: 9754 - DNA, 60 bp, Artificial Sequence
  Description of Artificial Sequence: Synthetic probe
gtgggtagtgtgtcgtaatgggcaactctgcagcggaaccgactactttgggtgtccgtg

SEQ ID NO: 9755 - DNA, 60 bp, Artificial Sequence
  Description of Artificial Sequence: Synthetic probe
cgtaacgggcaactctgcagcggaaccgactactttgggtgtccgtgtttccttttattc

SEQ ID NO: 9756 - DNA, 60 bp, Artificial Sequence
  Description of Artificial Sequence: Synthetic probe
atatggacatggtgtgaagagtctattgagctagttagtagtcctccggcccctgaatgc

SEQ ID NO: 9757 - DNA, 50 bp, Artificial Sequence
  Description of Artificial Sequence: Synthetic probe
catggtgcgaagagtctattgagctagttggtagtcctccggcccctgaa

SEQ ID NO: 9758 - DNA, 60 bp, Artificial Sequence
  Description of Artificial Sequence: Synthetic probe
gcctactgagctagactgtagtcctccggcccctgaatgcggctaatcctaaccctggag

SEQ ID NO: 9759 - DNA, 60 bp, Artificial Sequence
  Description of Artificial Sequence: Synthetic probe
gttccccacgggcgaccgtggcggtggctgcgttggcggcctgcccatggggcgacccat

SEQ ID NO: 9760 - DNA, 60 bp, Artificial Sequence
  Description of Artificial Sequence: Synthetic probe
ctcagcacaaccccagtgtagatcaggtcgatgagtcactgcataccccacgggtgaccg

SEQ ID NO: 9761 - DNA, 60 bp, Artificial Sequence
  Description of Artificial Sequence: Synthetic probe
tttagtcgtaatgggtaactgtgggacggaaccgactactttgggtgtccgtgtttcctt

SEQ ID NO: 9762 - DNA, 60 bp, Artificial Sequence
  Description of Artificial Sequence: Synthetic probe
gtatttggtcgtaacgggtaactgtgggacggaaccgactactttgggtgtccgtgtttc

SEQ ID NO: 9763 - DNA, 60 bp, Artificial Sequence
  Description of Artificial Sequence: Synthetic probe
tgcgctggcggcctgcccatggggtaacccatgggacgcttcaatactgacatggtgcga

SEQ ID NO: 9764 - DNA, 58 bp, Artificial Sequence
  Description of Artificial Sequence: Synthetic probe
gtttcgctccgcacagccccagtgtagatcaggtcgatgagtcaccgcaatccccacg

SEQ ID NO: 9765 - DNA, 60 bp, Artificial Sequence
  Description of Artificial Sequence: Synthetic probe
ttcttatattggctgcttatggtgacaattgagagattgttgccatatagctattggatt

SEQ ID NO: 9766 - DNA, 60 bp, Artificial Sequence
  Description of Artificial Sequence: Synthetic probe
attcttgtattggctgcttatggtgacaattgagagattgttaccatatagctattggat

SEQ ID NO: 9767 - DNA, 60 bp, Artificial Sequence
  Description of Artificial Sequence: Synthetic probe
gttggtagtcctccggcccctgaatgcggctaatcctaactgcggagcacacaccctcaa

SEQ ID NO: 9768 - DNA, 60 bp, Artificial Sequence
  Description of Artificial Sequence: Synthetic probe
gcccatggggcaacccatgggacgcttcaatactgacatggtgcgaagagtctattgagc

SEQ ID NO: 9769 - DNA, 60 bp, Artificial Sequence
  Description of Artificial Sequence: Synthetic probe
cgcttcaatactgacatggtgcgaagagtctattgagctaattggtagtcctccggcccc

SEQ ID NO: 9770 - DNA, 60 bp, Artificial Sequence
  Description of Artificial Sequence: Synthetic probe
gtctattgagctacttaggggtcctccggcccctgaatgcggctaatcctaactgcggag

SEQ ID NO: 9771 - DNA, 60 bp, Artificial Sequence
  Description of Artificial Sequence: Synthetic probe
ctcagcactaccccagtgtagatcaggtcgatgagtcactgcataccccacgggtgaccg

SEQ ID NO: 9772 - DNA, 60 bp, Artificial Sequence
  Description of Artificial Sequence: Synthetic probe
gctcagcactaccccagtgtagatcaggtcgatgagtcactgcactccccacgggtgacc

SEQ ID NO: 9773 - DNA, 60 bp, Artificial Sequence
  Description of Artificial Sequence: Synthetic probe
ctattgagctagttggtagtcctccggcccctgaatgcggctaatcctaactgcggagca

SEQ ID NO: 9774 - DNA, 60 bp, Artificial Sequence
  Description of Artificial Sequence: Synthetic probe
agtcctccggcccctgaatgcggctaatccaaccccacagctactgcgcagaaaccactg

SEQ ID NO: 9775 - DNA, 60 bp, Artificial Sequence
  Description of Artificial Sequence: Synthetic probe
ttcctcacgggcgaccgtggcggtggctgcgttggcggcctgcccatggggcaacccatg

SEQ ID NO: 9776 - DNA, 60 bp, Artificial Sequence
  Description of Artificial Sequence: Synthetic probe
ccatgtgaaaaattaccactcaagatctgagtcaacagttgaaaacttcttgtgcagatc

SEQ ID NO: 9777 - DNA, 60 bp, Artificial Sequence
  Description of Artificial Sequence: Synthetic probe
catgcaaacacgccacgtgaaaaattaccactcaagatctgagtcaacagttgagaactt

SEQ ID NO: 9778 - DNA, 60 bp, Artificial Sequence
  Description of Artificial Sequence: Synthetic probe
atgagtcaccgcattccccacgggcgaccgtggcggtggctgcgttggcggcctgcctac

SEQ ID NO: 9779 - DNA, 60 bp, Artificial Sequence
  Description of Artificial Sequence: Synthetic probe
tattgagctagttggtagtcctccggcccctgaatgcggctaatcctaactgcggagcac

SEQ ID NO: 9780 - DNA, 60 bp, Artificial Sequence
  Description of Artificial Sequence: Synthetic probe
gggtcgtaatgagcaattccgggacgggaccgactactttgggtgtccgtgtttcctttt

SEQ ID NO: 9781 - DNA, 60 bp, Artificial Sequence
  Description of Artificial Sequence: Synthetic probe
ggcaacccgtgggacgctctaatacagacatggtgtgaagagtctattgagctagttagt

SEQ ID NO: 9782 - DNA, 60 bp, Artificial Sequence
  Description of Artificial Sequence: Synthetic probe
agtcctccggcccctgaatgcggctaatcctaactgcggagcgcgtgccctcaaaccagg

SEQ ID NO: 9783 - DNA, 60 bp, Artificial Sequence
  Description of Artificial Sequence: Synthetic probe
caatgaggtgacttggacaaatgtgactttcctgaaaaggtacttcagggcagatgagca

SEQ ID NO: 9784 - DNA, 60 bp, Artificial Sequence
  Description of Artificial Sequence: Synthetic probe
gctagttagtagtcctccggcccctgaatgcggctaatcctaactgcggagcacacaccc

SEQ ID NO: 9785 - DNA, 53 bp, Artificial Sequence
  Description of Artificial Sequence: Synthetic probe
tgtcgtaacgggtaactccgcagcggaaccgactactttgggtgtccgtgttt

SEQ ID NO: 9786 - DNA, 60 bp, Artificial Sequence
  Description of Artificial Sequence: Synthetic probe
caatactgacatggtgcgaagagtctattgagctaattggtagtcctccggccccagaat

SEQ ID NO: 9787 - DNA, 60 bp, Artificial Sequence
  Description of Artificial Sequence: Synthetic probe
gcggcctgcccatggggtaacccatgggacgctctaatacggacatggtgtgaagagtct

SEQ ID NO: 9788 - DNA, 60 bp, Artificial Sequence
  Description of Artificial Sequence: Synthetic probe
cccaccaaataatgtacgtaccgccaggtggcccagtaccagacaaggtcgactcatatg

SEQ ID NO: 9789 - DNA, 60 bp, Artificial Sequence
  Description of Artificial Sequence: Synthetic probe
aaattcttacccaccaaataatgtacgtaccgccaggtggcccagtaccagacaaggtcg

SEQ ID NO: 9790 - DNA, 60 bp, Artificial Sequence
  Description of Artificial Sequence: Synthetic probe
tagttggtagtcctccggcccctgaatgcggctaatcctaactgtggagcacgcgccctc

SEQ ID NO: 9791 - DNA, 60 bp, Artificial Sequence
  Description of Artificial Sequence: Synthetic probe
tggaaaagaagatgagcaactacatacagttcaagtccaaatgccgtattgaacctgtat

SEQ ID NO: 9792 - DNA, 60 bp, Artificial Sequence
  Description of Artificial Sequence: Synthetic probe
gtttcgctcagcacaaccccagtgtagatcaggtcgatgagtcactgcataccccacggg

SEQ ID NO: 9793 - DNA, 60 bp, Artificial Sequence
  Description of Artificial Sequence: Synthetic probe
ctattgagctaaatggtagtcctccggcccctgaatgcggctaatcccaactgcggagca

SEQ ID NO: 9794 - DNA, 60 bp, Artificial Sequence
  Description of Artificial Sequence: Synthetic probe
ggtgcgaagagtctattgagctagttagtagtcctccggcccctgaatgcggctaatcct

SEQ ID NO: 9795 - DNA, 60 bp, Artificial Sequence
  Description of Artificial Sequence: Synthetic probe
gaggcaatcttctccaagtacattggtaacgtcaacacgcatgtggatgagtacatgcaa

SEQ ID NO: 9796 - DNA, 60 bp, Artificial Sequence
  Description of Artificial Sequence: Synthetic probe
actgtggcggtggctgcgttggcggcctgcccatggggcaacccatgggacgcttcaatg

SEQ ID NO: 9797 - DNA, 60 bp, Artificial Sequence
  Description of Artificial Sequence: Synthetic probe
agctagttagtattcctccggcccctgaatgcggctaatcctaactgcggagcacatacc

SEQ ID NO: 9798 - DNA, 60 bp, Artificial Sequence
  Description of Artificial Sequence: Synthetic probe
gctaattggtagtcctccggcccctgaatgcggctaatcctaactgcggagcagataccc

SEQ ID NO: 9799 - DNA, 56 bp, Artificial Sequence
  Description of Artificial Sequence: Synthetic probe
ggggcattgtgtcgtaacgggtaactctgcagcggaaccgactactttgggtgtcc

SEQ ID NO: 9800 - DNA, 60 bp, Artificial Sequence
  Description of Artificial Sequence: Synthetic probe
ttctgaaaaggtacttcagggcagatgaacaataccccttcctagtccaccccgtcatgc

SEQ ID NO: 9801 - DNA, 60 bp, Artificial Sequence
  Description of Artificial Sequence: Synthetic probe
ggagctcaagtgtcaacacaaaagaccggggcacatgagacggggttgaacgccagtggc

SEQ ID NO: 9802 - DNA, 60 bp, Artificial Sequence
  Description of Artificial Sequence: Synthetic probe
atgggagctcaagtgtcaacacaaaagaccggggcacatgagacggggttgaacgccagt

SEQ ID NO: 9803 - DNA, 60 bp, Artificial Sequence
  Description of Artificial Sequence: Synthetic probe
gcatacatcacaagttgtgccagcagacacaatgcaaaccagacacgtgaagaattatca

SEQ ID NO: 9804 - DNA, 60 bp, Artificial Sequence
  Description of Artificial Sequence: Synthetic probe
gaagagtctattgagctagttagtagtcctccggcccctgaatgcggctaatcctaactg

SEQ ID NO: 9805 - DNA, 52 bp, Artificial Sequence
  Description of Artificial Sequence: Synthetic probe
agtctgtcgtaacgggtaactctgcagcggaaccgactactttgggtgtccg

SEQ ID NO: 9806 - DNA, 60 bp, Artificial Sequence
  Description of Artificial Sequence: Synthetic probe
ttcttatactggctgcttatggtgacaattgagagattgttgccatatagctattggatt

SEQ ID NO: 9807 - DNA, 60 bp, Artificial Sequence
  Description of Artificial Sequence: Synthetic probe
ctactttgggtgtccgtgtttccttttattcttattatggctgcttatggtgacaattga

SEQ ID NO: 9808 - DNA, 60 bp, Artificial Sequence
  Description of Artificial Sequence: Synthetic probe
ctgcccatggggcaacccatgggacgcttcaatactgacatggtgcgaagagtctattga

SEQ ID NO: 9809 - DNA, 60 bp, Artificial Sequence
  Description of Artificial Sequence: Synthetic probe
cctgcccatggggcaacccatgggacgcttcaatactgacatggtgcgaagagtctattg

SEQ ID NO: 9810 - DNA, 60 bp, Artificial Sequence
  Description of Artificial Sequence: Synthetic probe
ggcctgcccatggggcaacccatgggacgcttcaatactgacatggtgcgaagagtctac

SEQ ID NO: 9811 - DNA, 60 bp, Artificial Sequence
  Description of Artificial Sequence: Synthetic probe
gaataacatggggacactgtacatgagacatgtgaatgatggcagccccggccccattgt

SEQ ID NO: 9812 - DNA, 60 bp, Artificial Sequence
  Description of Artificial Sequence: Synthetic probe
tcatgtgaaaaattaccactcaagatctgagtcaacaattgagaactttttgtgtagatc

SEQ ID NO: 9813 - DNA, 60 bp, Artificial Sequence
  Description of Artificial Sequence: Synthetic probe
cagggagtgcagtcgggtgtgacccagatgtgttttggagcaagatcccagttatgcttg

SEQ ID NO: 9814 - DNA, 60 bp, Artificial Sequence
  Description of Artificial Sequence: Synthetic probe
ttaagagtcctccggcccctgaatgcggctaatcccaaccacggagcaagtgcccacaag

SEQ ID NO: 9815 - DNA, 60 bp, Artificial Sequence
  Description of Artificial Sequence: Synthetic probe
tgggcagtctgtcgtaacgggtaactctgcagcggaaccgactactttgggtgtccgtgt

SEQ ID NO: 9816 - DNA, 60 bp, Artificial Sequence
  Description of Artificial Sequence: Synthetic probe
ctattgagctaattggtagtcctccggcccctgaatgcggctaatcccaactgcggagca

SEQ ID NO: 9817 - DNA, 60 bp, Artificial Sequence
  Description of Artificial Sequence: Synthetic probe
acccacagggcccactgggcgctagcacaccggtatcacggtgacccttgtgcgcctgtt

SEQ ID NO: 9818 - DNA, 60 bp, Artificial Sequence
  Description of Artificial Sequence: Synthetic probe
cttatacagagacaaacactactttgtgaggggtgggatgccgtcagggtgttcaggcac

SEQ ID NO: 9819 - DNA, 60 bp, Artificial Sequence
  Description of Artificial Sequence: Synthetic probe
gagtcctccggcccctgaatgcggctaatcctaaccacggagcaagtgccttcaaaccag

SEQ ID NO: 9820 - DNA, 60 bp, Artificial Sequence
  Description of Artificial Sequence: Synthetic probe
ggtgtgaagagccccgtgtgcttatcatgagtcctccggcccctgaatgcggctaatcca

SEQ ID NO: 9821 - DNA, 60 bp, Artificial Sequence
  Description of Artificial Sequence: Synthetic probe
ggtgtgaagagccccgtgtgctactaatgagtcctccggcccctgaatgcggctaatcca

SEQ ID NO: 9822 - DNA, 60 bp, Artificial Sequence
  Description of Artificial Sequence: Synthetic probe
cgctcagcacaaccccagtgtagatcaggtcgatgagtcactgcatccctcacaggtgac

SEQ ID NO: 9823 - DNA, 60 bp, Artificial Sequence
  Description of Artificial Sequence: Synthetic probe
atggggacactatacatgagacacgtgaatgatggcagccccggccccattgtgagcacc

SEQ ID NO: 9824 - DNA, 60 bp, Artificial Sequence
  Description of Artificial Sequence: Synthetic probe
gtaatgggtaactgtgggacggaaccgactactttgggtgtccgtgtttccttttattcc

SEQ ID NO: 9825 - DNA, 60 bp, Artificial Sequence
  Description of Artificial Sequence: Synthetic probe
cggtgtgtgtgggaagactacaacagagacctgctaattagcaccaccacggcccacggg

SEQ ID NO: 9826 - DNA, 60 bp, Artificial Sequence
  Description of Artificial Sequence: Synthetic probe
gcaacggtgtgtgtgggaagactacaacagagacctgctaattagcaccaccacggccca

SEQ ID NO: 9827 - DNA, 60 bp, Artificial Sequence
  Description of Artificial Sequence: Synthetic probe
tgcgaagagtctattgagctagttggtagtcctccggcccctgaatgcggctaatcctaa

SEQ ID NO: 9828 - DNA, 60 bp, Artificial Sequence
  Description of Artificial Sequence: Synthetic probe
tgagctagttggtagtcctccggcccctgaatgcggctaatcctaactgcggagcacata

SEQ ID NO: 9829 - DNA, 60 bp, Artificial Sequence
  Description of Artificial Sequence: Synthetic probe
attggctgcttatggtgacaattgagagattgttaccatatagctattggattggccatc

SEQ ID NO: 9830 - DNA, 60 bp, Artificial Sequence
  Description of Artificial Sequence: Synthetic probe
agcactcaagagcagtccactatacaaggccaagattcaccggtgctcacccaccaaatc

SEQ ID NO: 9831 - DNA, 60 bp, Artificial Sequence
  Description of Artificial Sequence: Synthetic probe
ggtcagagtcaacagtggagaacttcctgtgcagatcagcatgcgtcttttacaccactt

SEQ ID NO: 9832 - DNA, 60 bp, Artificial Sequence
  Description of Artificial Sequence: Synthetic probe
aactatcactcaaggtcagagtcaacagtggagaacttcctgtgcagatcagcatgcgtc

SEQ ID NO: 9833 - DNA, 60 bp, Artificial Sequence
  Description of Artificial Sequence: Synthetic probe
acgaagagaatgctcatgtacaacttcccaaccagagcaggccaatgtggaggtgtcctc

SEQ ID NO: 9834 - DNA, 60 bp, Artificial Sequence
  Description of Artificial Sequence: Synthetic probe
catagcttttgattactcaggttatgacgccagccttagcccagtctggtttgcatgcct

SEQ ID NO: 9835 - DNA, 60 bp, Artificial Sequence
  Description of Artificial Sequence: Synthetic probe
cccagatgtgttttggagcaagattcctgtcatgctcgacggacatctcatagcttttga

SEQ ID NO: 9836 - DNA, 60 bp, Artificial Sequence
  Description of Artificial Sequence: Synthetic probe
gacccagatgtgttttggagcaagattcctgtcatgctcgacggacatctcatagctttt

SEQ ID NO: 9837 - DNA, 60 bp, Artificial Sequence
  Description of Artificial Sequence: Synthetic probe
ttccccacgggcgaccgtggcggtggctgcgttggcggcctgcccatggggtaacccatg

SEQ ID NO: 9838 - DNA, 60 bp, Artificial Sequence
  Description of Artificial Sequence: Synthetic probe
tagtcctccggcccctgaatgcggctaatcctaactgcggagcacataccctcaacccag

SEQ ID NO: 9839 - DNA, 60 bp, Artificial Sequence
  Description of Artificial Sequence: Synthetic probe
gctagttggtagtcctccggcccctgaatgcggctaatcctaactgcggagcagatgctc

SEQ ID NO: 9840 - DNA, 60 bp, Artificial Sequence
  Description of Artificial Sequence: Synthetic probe
ggagctcaagtgtcaacacaaaagaccggtgctcacgagacaagcttaagtgcgacaggc

SEQ ID NO: 9841 - DNA, 54 bp, Artificial Sequence
  Description of Artificial Sequence: Synthetic probe
atgggagctcaagtgtcaacacaaaagaccggtgctcatgagaccagcttgagt

SEQ ID NO: 9842 - DNA, 60 bp, Artificial Sequence
  Description of Artificial Sequence: Synthetic probe
acgggcgaccgtggcggtggctgcgttggcggcctgcccatggggcaacccatgggacgc

SEQ ID NO: 9843 - DNA, 60 bp, Artificial Sequence
  Description of Artificial Sequence: Synthetic probe
gggcagtttgtcgtaacgggcaactctgcagcggaaccgactactttgggtgtccgtgtt

SEQ ID NO: 9844 - DNA, 60 bp, Artificial Sequence
  Description of Artificial Sequence: Synthetic probe
ggaggtcgtaatgagcaattctgggatgggaccgactactttgggtgtccgtgtttcctg

SEQ ID NO: 9845 - DNA, 60 bp, Artificial Sequence
  Description of Artificial Sequence: Synthetic probe
gctcgcgcggctgaaggagaaaacgttcgttacccggccaattacttcgagaaacctatt

SEQ ID NO: 9846 - DNA, 60 bp, Artificial Sequence
  Description of Artificial Sequence: Synthetic probe
atgggagctcaagtgtcaacacaaaagaccggtgctcacgagacaagcttaagtgcgaca

SEQ ID NO: 9847 - DNA, 60 bp, Artificial Sequence
  Description of Artificial Sequence: Synthetic probe
gcccttgggaccaactactttgggtgtccgtgtttccttttattccttattattagttca

SEQ ID NO: 9848 - DNA, 60 bp, Artificial Sequence
  Description of Artificial Sequence: Synthetic probe
aacccacaggacgctctaatacagacatggtgtgaagagtctattgagctagttagtact

SEQ ID NO: 9849 - DNA, 60 bp, Artificial Sequence
  Description of Artificial Sequence: Synthetic probe
ggacaaatgtgactttcctgaaaaggtacttcagggcagatgagcaatacccgtttctgg

SEQ ID NO: 9850 - DNA, 60 bp, Artificial Sequence
  Description of Artificial Sequence: Synthetic probe
gcgaagagtcaattgagctagttagtagtcctccggcccctgaatgcggctaatcctaac

SEQ ID NO: 9851 - DNA, 60 bp, Artificial Sequence
  Description of Artificial Sequence: Synthetic probe
tattactactcaatagtgtaaaatgggagctcaagtgtcaacacaaaagaccggagcaca

SEQ ID NO: 9852 - DNA, 60 bp, Artificial Sequence
  Description of Artificial Sequence: Synthetic probe
accgtggcggtggctgcgttggcggcctgcccatgggccaacccatgggacgctataata

SEQ ID NO: 9853 - DNA, 60 bp, Artificial Sequence
  Description of Artificial Sequence: Synthetic probe
caatgtcactttcctgaaaagatacttcagggcagatgaacagtatcctttccttgtcca

SEQ ID NO: 9854 - DNA, 60 bp, Artificial Sequence
  Description of Artificial Sequence: Synthetic probe
tgcgctggcggcctgcccatggtctattccatgggacgcttcaatactgacatggtgcga

SEQ ID NO: 9855 - DNA, 60 bp, Artificial Sequence
  Description of Artificial Sequence: Synthetic probe
agtggacatggtgcgaagagtctattgagctagttagtagtcctccggcccctgaatgcg

SEQ ID NO: 9856 - DNA, 60 bp, Artificial Sequence
  Description of Artificial Sequence: Synthetic probe
attccccacaggcgactgtggcggtggctgcgttggcggcctgcccatggggcaacccat

SEQ ID NO: 9857 - DNA, 60 bp, Artificial Sequence
  Description of Artificial Sequence: Synthetic probe
tgggcagtttgtcgtaacgggcaactctgcagcggaaccgactactttgggtgtccgtgt

SEQ ID NO: 9858 - DNA, 60 bp, Artificial Sequence
  Description of Artificial Sequence: Synthetic probe
aacgggtaactctgcagcggaaccgactactttgggtgtccgtgtttccttttattctta

SEQ ID NO: 9859 - DNA, 56 bp, Artificial Sequence
  Description of Artificial Sequence: Synthetic probe
ggggcggcgtgtcgtaatgggtaactctgcagcggaaccgactactttgggtgtcc

SEQ ID NO: 9860 - DNA, 60 bp, Artificial Sequence
  Description of Artificial Sequence: Synthetic probe
ttccccacgggtgaccgtgcggtggctgcgttggcggcctgcccatggggtagcccatgg

SEQ ID NO: 9861 - DNA, 59 bp, Artificial Sequence
  Description of Artificial Sequence: Synthetic probe
ttccccacgggtgaccgtgcggtggctgcgttggcggcctgcccatggggtagcccatg

SEQ ID NO: 9862 - DNA, 60 bp, Artificial Sequence
  Description of Artificial Sequence: Synthetic probe
actcctcacgggcgaccgtggcggtggctgcgttggcggcctgcccatggggcaacccat

SEQ ID NO: 9863 - DNA, 60 bp, Artificial Sequence
  Description of Artificial Sequence: Synthetic probe
ggttgtgccatctgacacaatgcaaactaggcatgtgaagaactatcactctagatcaga

SEQ ID NO: 9864 - DNA, 60 bp, Artificial Sequence
  Description of Artificial Sequence: Synthetic probe
tcacaggttgtgccatctgacacaatgcaaactaggcatgtgaagaactatcactctaga

SEQ ID NO: 9865 - DNA, 60 bp, Artificial Sequence
  Description of Artificial Sequence: Synthetic probe
gtcgggtgtgacccagatgtgttttggagcaagatcccagttatgcttgacgggcacctc

SEQ ID NO: 9866 - DNA, 60 bp, Artificial Sequence
  Description of Artificial Sequence: Synthetic probe
catggtgcgaagagtctattgagctagttagtagtcctccggcccctgaatgcggctaat

SEQ ID NO: 9867 - DNA, 60 bp, Artificial Sequence
  Description of Artificial Sequence: Synthetic probe
ggctgctcacgcggctgaaggagaaaacgttcgttacccggccaattacttcgagaaacc

SEQ ID NO: 9868 - DNA, 60 bp, Artificial Sequence
  Description of Artificial Sequence: Synthetic probe
gaagagtctattgagctaattggtagtcctccggcccctgaatgcggctaatcctaaccg

SEQ ID NO: 9869 - DNA, 60 bp, Artificial Sequence
  Description of Artificial Sequence: Synthetic probe
ggcccgactaccttagtgatgaggaagcaacagcagaggatcaacccactcaaccagatg

SEQ ID NO: 9870 - DNA, 60 bp, Artificial Sequence
  Description of Artificial Sequence: Synthetic probe
cctattgagctaattggtgttcctccggcccctgaatgcggctaatcctaactgcggagc

SEQ ID NO: 9871 - DNA, 60 bp, Artificial Sequence
  Description of Artificial Sequence: Synthetic probe
ctgcagcggaaccgactactttgggtgtccgtgtttccttttattcttatactggctgcc

SEQ ID NO: 9872 - DNA, 60 bp, Artificial Sequence
  Description of Artificial Sequence: Synthetic probe
tgtcgtaacgggtaactctgcagcggaaccgactactttgggtgtccgtgtttcctttta

SEQ ID NO: 9873 - DNA, 60 bp, Artificial Sequence
  Description of Artificial Sequence: Synthetic probe
acaacatcataattagaactctcatgctgaaggtttataaaggtattgatttggaccaat

SEQ ID NO: 9874 - DNA, 55 bp, Artificial Sequence
  Description of Artificial Sequence: Synthetic probe
gcaacgtgaactttgaacccactggtgtaactgagggtaggacagatataacaac

SEQ ID NO: 9875 - DNA, 60 bp, Artificial Sequence
  Description of Artificial Sequence: Synthetic probe
ctagttagtagtcctccggcccctgaatgcggctaatcccaactgcggagcacatgccca

SEQ ID NO: 9876 - DNA, 60 bp, Artificial Sequence
  Description of Artificial Sequence: Synthetic probe
aatccccacaggcgactgtggcggtggctgcgttggcggcctgcccatggggcaacccat

SEQ ID NO: 9877 - DNA, 60 bp, Artificial Sequence
  Description of Artificial Sequence: Synthetic probe
aagagtctattgagctaattggtagtcctccggcccctgaatgcggctaatcctaactgc

SEQ ID NO: 9878 - DNA, 60 bp, Artificial Sequence
  Description of Artificial Sequence: Synthetic probe
tgagctagttagtagtcctccggcccctgaatgcggctaatcctaactgcggagcaggtg

SEQ ID NO: 9879 - DNA, 60 bp, Artificial Sequence
  Description of Artificial Sequence: Synthetic probe
ctgaaaaggtacttcagggcagatgagcaatatccattcctggttcatcctgtaatgccc

SEQ ID NO: 9880 - DNA, 60 bp, Artificial Sequence
  Description of Artificial Sequence: Synthetic probe
ttattcttatattggctgcttatggtgacaattgagagattgttaccatatagctactgg

SEQ ID NO: 9881 - DNA, 60 bp, Artificial Sequence
  Description of Artificial Sequence: Synthetic probe
acccatgggacgcttcaatactgacatggtgcgaagagtatattgagctaattggtagtc

SEQ ID NO: 9882 - DNA, 60 bp, Artificial Sequence
  Description of Artificial Sequence: Synthetic probe
ctgcgccgaaagctcgaaatgttcacatacgcaagatttgatctggagctaacctttgtg

SEQ ID NO: 9883 - DNA, 60 bp, Artificial Sequence
  Description of Artificial Sequence: Synthetic probe
gctgcgccgaaagctcgaaatgttcacatacgcaagatttgatctggagctaacctttgt

SEQ ID NO: 9884 - DNA, 60 bp, Artificial Sequence
  Description of Artificial Sequence: Synthetic probe
tcgcccagctgcgccgaaagctcgaaatgttcacatacgcaagatttgatctggagctaa

SEQ ID NO: 9885 - DNA, 60 bp, Artificial Sequence
  Description of Artificial Sequence: Synthetic probe
gcccagctgcgccgaaagctcgaaatgttcacatacgcaagatttgatctggagctaacc

SEQ ID NO: 9886 - DNA, 60 bp, Artificial Sequence
  Description of Artificial Sequence: Synthetic probe
gcccagctgcgccgaaagctcgaaatgttcacatacgcaagatttgacctagagttaacc

SEQ ID NO: 9887 - DNA, 60 bp, Artificial Sequence
  Description of Artificial Sequence: Synthetic probe
gtcgcccagctgcgccgaaagctcgaaatgttcacatacgcaagatttgatctggagcta

SEQ ID NO: 9888 - DNA, 60 bp, Artificial Sequence
  Description of Artificial Sequence: Synthetic probe
ggcggcctgcccatggggtaacccatgggacgctctaatccagacacggtgtgaagagtc

SEQ ID NO: 9889 - DNA, 60 bp, Artificial Sequence
  Description of Artificial Sequence: Synthetic probe
ggcggcctgcccatggggtaacccatgggacgctctaatacccacacggtgtgaagagtc

SEQ ID NO: 9890 - DNA, 53 bp, Artificial Sequence
  Description of Artificial Sequence: Synthetic probe
atgggtaactctgcagcggaaccgactactttgggtgtccgtgtttcctttta

SEQ ID NO: 9891 - DNA, 60 bp, Artificial Sequence
  Description of Artificial Sequence: Synthetic probe
gttcattgagtggctgaaagtcaagatcctgccagaagtcaaggaaaagcatgagtttct

SEQ ID NO: 9892 - DNA, 60 bp, Artificial Sequence
  Description of Artificial Sequence: Synthetic probe
gattaagaagttcattgagtggctgaaagtcaagatcctgccagaagtcaaggaaaagca

SEQ ID NO: 9893 - DNA, 60 bp, Artificial Sequence
  Description of Artificial Sequence: Synthetic probe
agaatttacttcaagccaaagcacgtcaaagcgtggatacctagacccccaaggttgtgt

SEQ ID NO: 9894 - DNA, 60 bp, Artificial Sequence
  Description of Artificial Sequence: Synthetic probe
ggacatggtgtgaagagtctattgagctagttagtagtcctccggcccctgaatgcggct

SEQ ID NO: 9895 - DNA, 60 bp, Artificial Sequence
  Description of Artificial Sequence: Synthetic probe
cagcatgttctatgacgggtgggccaggtttgacaagcaagggacatacggcatcagcac

SEQ ID NO: 9896 - DNA, 51 bp, Artificial Sequence
  Description of Artificial Sequence: Synthetic probe
cgtgcagattctataccctagaatccgtgatgtggcaacagagttcacctg

SEQ ID NO: 9897 - DNA, 60 bp, Artificial Sequence
  Description of Artificial Sequence: Synthetic probe
caaaccaggcacgtgaagaactatcactctagatcagagtcgacagtggaaaactttctg

SEQ ID NO: 9898 - DNA, 60 bp, Artificial Sequence
  Description of Artificial Sequence: Synthetic probe
gtacagggacaagcattatttcgtgaggggtggtatgccatcaggatgctcaggcaccag

SEQ ID NO: 9899 - DNA, 60 bp, Artificial Sequence
  Description of Artificial Sequence: Synthetic probe
ctagttggtagtcctccggcccctgaatgcggctaatcccaactgtggagcagataccca

SEQ ID NO: 9900 - DNA, 56 bp, Artificial Sequence
  Description of Artificial Sequence: Synthetic probe
gtttccttttattcctaatctggctgcttatggtgacaattgagagattgttacca

SEQ ID NO: 9901 - DNA, 60 bp, Artificial Sequence
  Description of Artificial Sequence: Synthetic probe
aatgagtcctccggcccctgaatgcggctaatcttaccccacagctgttgcacgcagtcc

SEQ ID NO: 9902 - DNA, 60 bp, Artificial Sequence
  Description of Artificial Sequence: Synthetic probe
gccccgtgtgctaccaatgagtcctccggcccctgaatgcggctaatcttacccccacag

SEQ ID NO: 9903 - DNA, 60 bp, Artificial Sequence
  Description of Artificial Sequence: Synthetic probe
ctgtcgtaatgggcaactctgcagcggaaccgactactttgggtgtccgtgtttcctttt

SEQ ID NO: 9904 - DNA, 60 bp, Artificial Sequence
  Description of Artificial Sequence: Synthetic probe
gctaattggtagtcctccggcccctgaatgcggctaatcctaactgcggagcagacaccc

SEQ ID NO: 9905 - DNA, 60 bp, Artificial Sequence
  Description of Artificial Sequence: Synthetic probe
ccagtgggcagtctgtcgtaatgggcaactctgcagcggaaccgactactttgggtgtcc

SEQ ID NO: 9906 - DNA, 60 bp, Artificial Sequence
  Description of Artificial Sequence: Synthetic probe
cgtttcgttccgcacaaccccagtgtagatcaggtcgatgagtcaccgcattcctcacgg

SEQ ID NO: 9907 - DNA, 60 bp, Artificial Sequence
  Description of Artificial Sequence: Synthetic probe
gcccatgaggcaacccatgggacgcttcaatactgacatggtgcgaagagtctattgagc

SEQ ID NO: 9908 - DNA, 60 bp, Artificial Sequence
  Description of Artificial Sequence: Synthetic probe
gcgttccccacgggcgaccgtggcggtggctgcgttggcggcctgcccatggggcaaccc

SEQ ID NO: 9909 - DNA, 60 bp, Artificial Sequence
  Description of Artificial Sequence: Synthetic probe
aatgggcaactctgcagcggaaccgactactttgggtgtccgtgtttccttttattctta

SEQ ID NO: 9910 - DNA, 60 bp, Artificial Sequence
  Description of Artificial Sequence: Synthetic probe
tcaggggccggaggactactaactagctcaatagactcttcacaccatgtctgtattaga

SEQ ID NO: 9911 - DNA, 60 bp, Artificial Sequence
  Description of Artificial Sequence: Synthetic probe
aggggccggaggactactaactagctcaatagactcttcacaccatgtctgtattagagc

SEQ ID NO: 9912 - DNA, 60 bp, Artificial Sequence
  Description of Artificial Sequence: Synthetic probe
gggtggtgtgtcgtaatgggcaactctgcagcggaaccgactactttgggtgtccgtgtt

SEQ ID NO: 9913 - DNA, 60 bp, Artificial Sequence
  Description of Artificial Sequence: Synthetic probe
ctaccaatgagtcctccggcccctgaatgcggctaatcttaccccgcagctgttgcacac

SEQ ID NO: 9914 - DNA, 60 bp, Artificial Sequence
  Description of Artificial Sequence: Synthetic probe
gtggcccgactaccttagtgatgaagaggcgacggcagaggatcaacccactcaaccaga

SEQ ID NO: 9915 - DNA, 60 bp, Artificial Sequence
  Description of Artificial Sequence: Synthetic probe
atacactaaacaacatgggaacactatacatgagacatgtgaatgacggaagccctggac

SEQ ID NO: 9916 - DNA, 60 bp, Artificial Sequence
  Description of Artificial Sequence: Synthetic probe
cagttggcaaacatcaactaacccgagtgtgttctggacagaagggagtgcgccgcctcg

SEQ ID NO: 9917 - DNA, 60 bp, Artificial Sequence
  Description of Artificial Sequence: Synthetic probe
gttacagttggcaaacatcaactaacccgagtgtgttctggacagaagggagtgcgccgc

SEQ ID NO: 9918 - DNA, 60 bp, Artificial Sequence
  Description of Artificial Sequence: Synthetic probe
tctattgagctaattggtagtcctccggcccctgaatgcggctaatcctaactgcggagc

SEQ ID NO: 9919 - DNA, 60 bp, Artificial Sequence
  Description of Artificial Sequence: Synthetic probe
tccggcccctgaatgcggctaatcctaaccatggagcaagtgctcacaaaccagtgggtt

SEQ ID NO: 9920 - DNA, 60 bp, Artificial Sequence
  Description of Artificial Sequence: Synthetic probe
ctgtatagggacaagcactactttgtgaggggtggcatgccctcagggtgttctggcacc

SEQ ID NO: 9921 - DNA, 60 bp, Artificial Sequence
  Description of Artificial Sequence: Synthetic probe
ccacctgtacagagataaacactactttgtgaggggtggcatgccctcagggtgttctgg

SEQ ID NO: 9922 - DNA, 60 bp, Artificial Sequence
  Description of Artificial Sequence: Synthetic probe
caccacctgtacagagataaacactactttgtgaggggtggcatgccctcagggtgttct

SEQ ID NO: 9923 - DNA, 60 bp, Artificial Sequence
  Description of Artificial Sequence: Synthetic probe
tgggtgggctaggtttgacaagcaagggacatatggcataaacacactaaacaacatggg

SEQ ID NO: 9924 - DNA, 60 bp, Artificial Sequence
  Description of Artificial Sequence: Synthetic probe
tgggtgggctaggtttgacaagcaagggacatatggcataaatacactaaataacatggg

SEQ ID NO: 9925 - DNA, 60 bp, Artificial Sequence
  Description of Artificial Sequence: Synthetic probe
gcatgttctatgatgggtgggctaggtttgacaagcaagggacatacggcataaatacac

SEQ ID NO: 9926 - DNA, 60 bp, Artificial Sequence
  Description of Artificial Sequence: Synthetic probe
catatagcatgttctatgatgggtgggctaggtttgacaagcaagggacatacggcataa

SEQ ID NO: 9927 - DNA, 60 bp, Artificial Sequence
  Description of Artificial Sequence: Synthetic probe
tttcgctccgcacaaccccagtgtagatcaggtcgatgagtcaccgcaatccccacaggc

SEQ ID NO: 9928 - DNA, 60 bp, Artificial Sequence
  Description of Artificial Sequence: Synthetic probe
gggataagcactacttcgtaagaggcggtatgccatcaggatgctcaggcaccagcatat

SEQ ID NO: 9929 - DNA, 60 bp, Artificial Sequence
  Description of Artificial Sequence: Synthetic probe
accccaagtgacaccatgcaaaccagacacgtgaagaattatcattcgcgctctgaatcc

SEQ ID NO: 9930 - DNA, 60 bp, Artificial Sequence
  Description of Artificial Sequence: Synthetic probe
agtgaccccgagtgacaccatgcaaaccagacacgtgaagaattatcattcccgttctga

SEQ ID NO: 9931 - DNA, 58 bp, Artificial Sequence
  Description of Artificial Sequence: Synthetic probe
agtgaccccgagtgacaccatgcaaaccagacacgtgaagaattatcattcccgttct

SEQ ID NO: 9932 - DNA, 60 bp, Artificial Sequence
  Description of Artificial Sequence: Synthetic probe
ggtcgtaatgagtaatttcgggatgggaccgactactttgggtgtccgtgtttcctgttt

SEQ ID NO: 9933 - DNA, 60 bp, Artificial Sequence
  Description of Artificial Sequence: Synthetic probe
ctattgagctagttggtagtctccggcccctgaatgcggctaatcctaactgcggagcac

SEQ ID NO: 9934 - DNA, 60 bp, Artificial Sequence
  Description of Artificial Sequence: Synthetic probe
ggcctgcccatggggcaacccatgggacgcttcaatactgacatggtgcgaagagcctat

SEQ ID NO: 9935 - DNA, 60 bp, Artificial Sequence
  Description of Artificial Sequence: Synthetic probe
ttgagctacttaagagtcctccggcccctgaatgcggctaatcccaaccacggagcaagt

SEQ ID NO: 9936 - DNA, 60 bp, Artificial Sequence
  Description of Artificial Sequence: Synthetic probe
gccggacaactggcaaccttagacattagcactgaacccatgaagctggaagatgcagtc

SEQ ID NO: 9937 - DNA, 60 bp, Artificial Sequence
  Description of Artificial Sequence: Synthetic probe
gctagttggtagtcctccggcccctgaatgcggctaatcctaactgcggagcagataccc

SEQ ID NO: 9938 - DNA, 60 bp, Artificial Sequence
  Description of Artificial Sequence: Synthetic probe
agtcctccggcccctgaatgcggctaatcccaactgcggagcagatacccacaaaccagt

SEQ ID NO: 9939 - DNA, 60 bp, Artificial Sequence
  Description of Artificial Sequence: Synthetic probe
tggggtaacccatgggacgctctaatacagacatggtgtgaagagtctattgagctagtt

SEQ ID NO: 9940 - DNA, 60 bp, Artificial Sequence
  Description of Artificial Sequence: Synthetic probe
atgggagctcaagtgtcaacacaaaagaccggggcacacgagacggggttgaacgccagt

SEQ ID NO: 9941 - DNA, 60 bp, Artificial Sequence
  Description of Artificial Sequence: Synthetic probe
agccaactttgaggaagcgatcttctccaagtacattggcaatgtcaacatacatgtaga

SEQ ID NO: 9942 - DNA, 58 bp, Artificial Sequence
  Description of Artificial Sequence: Synthetic probe
agccaactttgaggaagcgatcttctccaagtacattggcaatgtcaacatacatgta

SEQ ID NO: 9943 - DNA, 60 bp, Artificial Sequence
  Description of Artificial Sequence: Synthetic probe
aatgggtaactctgcagcggaaccgactactttgggtgtccgtgtttccttttattcctt

SEQ ID NO: 9944 - DNA, 60 bp, Artificial Sequence
  Description of Artificial Sequence: Synthetic probe
ctgcagcggaaccgactactttgggtgtccgtgtttccttttattcttgtattggctgct

SEQ ID NO: 9945 - DNA, 60 bp, Artificial Sequence
  Description of Artificial Sequence: Synthetic probe
ctgcagcggaaccgactactttgggtgtccgtgtttccttttattctcatattggctgct

SEQ ID NO: 9946 - DNA, 60 bp, Artificial Sequence
  Description of Artificial Sequence: Synthetic probe
caagtccaaatgccgtattgaacctgtatgtctgctcctgcatggaagttccggtgctgg

SEQ ID NO: 9947 - DNA, 60 bp, Artificial Sequence
  Description of Artificial Sequence: Synthetic probe
gcggcctgcccatggggcaacccatgggacgctctaatacagacatggtgtgaagagtct

SEQ ID NO: 9948 - DNA, 60 bp, Artificial Sequence
  Description of Artificial Sequence: Synthetic probe
ctactgagctaattggtagtcctccggcccctgaatgcggctaatcctaactgcggagca

SEQ ID NO: 9949 - DNA, 60 bp, Artificial Sequence
  Description of Artificial Sequence: Synthetic probe
actgcaaagcgtttcgctcagcacaaccccagtgtagatcaggtcgatgagtcactgcat

SEQ ID NO: 9950 - DNA, 60 bp, Artificial Sequence
  Description of Artificial Sequence: Synthetic probe
ggatggctaaagaagttcaccgagatgaccaacgcttgtaagggcatggagtggattgcc

SEQ ID NO: 9951 - DNA, 60 bp, Artificial Sequence
  Description of Artificial Sequence: Synthetic probe
gagtctattgagctagttagtagtcctccggcccctgaatgcggctaatcctaactgcgg

SEQ ID NO: 9952 - DNA, 60 bp, Artificial Sequence
  Description of Artificial Sequence: Synthetic probe
gtgaagagtctattgagctagttagtagtcctccggcccctgaatgcggctaatcctaac

SEQ ID NO: 9953 - DNA, 60 bp, Artificial Sequence
  Description of Artificial Sequence: Synthetic probe
cgcttgtaagggcatggagtggatagccattaaaatccagaaattcattgagtggcttaa

SEQ ID NO: 9954 - DNA, 60 bp, Artificial Sequence
  Description of Artificial Sequence: Synthetic probe
aacgcttgtaagggcatggagtggatagccattaaaatccagaaattcattgagtggctt

SEQ ID NO: 9955 - DNA, 60 bp, Artificial Sequence
  Description of Artificial Sequence: Synthetic probe
ggctcaagaagttcactgagatgactaacgcttgtaagggcatggagtggatagccatta

SEQ ID NO: 9956 - DNA, 60 bp, Artificial Sequence
  Description of Artificial Sequence: Synthetic probe
tggctcaagaagttcactgagatgactaacgcttgtaagggcatggagtggatagccatt

SEQ ID NO: 9957 - DNA, 60 bp, Artificial Sequence
  Description of Artificial Sequence: Synthetic probe
gcgaagagtctattgagctaattggtaatcctccggcccctgaatgcggctaatcctaac

SEQ ID NO: 9958 - DNA, 60 bp, Artificial Sequence
  Description of Artificial Sequence: Synthetic probe
agagtctattgagctagttagtagtcctccggcccctgaatgcggctaatcctaactgcg

SEQ ID NO: 9959 - DNA, 60 bp, Artificial Sequence
  Description of Artificial Sequence: Synthetic probe
aagagtctattgagctagttagtagtcctccggcccctgaatgcggctaatcctaactgc

SEQ ID NO: 9960 - DNA, 57 bp, Artificial Sequence
  Description of Artificial Sequence: Synthetic probe
tttgtgaggggcggtatgccatcaggatgttcgggtaccagtatattcaattctatg

SEQ ID NO: 9961 - DNA, 60 bp, Artificial Sequence
  Description of Artificial Sequence: Synthetic probe
gggtgtccgtgtttccttttattcttataattttccttatggttacaagcttatggttgt

SEQ ID NO: 9962 - DNA, 60 bp, Artificial Sequence
  Description of Artificial Sequence: Synthetic probe
tagtctcagcccagtgtggtttgcgtgcttgaaacttcttttggagaaactagggtacac

SEQ ID NO: 9963 - DNA, 60 bp, Artificial Sequence
  Description of Artificial Sequence: Synthetic probe
gatgggagctcaagtgtcaacacaaaagactggcgcacacgagactagcctaagtgcaac

SEQ ID NO: 9964 - DNA, 60 bp, Artificial Sequence
  Description of Artificial Sequence: Synthetic probe
tgtgaagaccggcgtgcgctaggtatgagtcctccggcccctgaatgcggctaatcctaa

SEQ ID NO: 9965 - DNA, 58 bp, Artificial Sequence
  Description of Artificial Sequence: Synthetic probe
aggtcgtaacgagcaattctgggacgggaccgactactttgggtgtccgtgtttcctg

SEQ ID NO: 9966 - DNA, 60 bp, Artificial Sequence
  Description of Artificial Sequence: Synthetic probe
accgactactttgggtgtccgtgtttccttttattcttatattggctgcttatggtgaca

SEQ ID NO: 9967 - DNA, 60 bp, Artificial Sequence
  Description of Artificial Sequence: Synthetic probe
gagtgtcgtaacgcgaaagtccgaggcggaaccgactactttgggtgtccgtgtttcctg

SEQ ID NO: 9968 - DNA, 60 bp, Artificial Sequence
  Description of Artificial Sequence: Synthetic probe
ctattgagctagttagtagtcctccggcccctgaatgcggctaatcctaactgcggagca

SEQ ID NO: 9969 - DNA, 60 bp, Artificial Sequence
  Description of Artificial Sequence: Synthetic probe
tctattgagctagttagtagtcctccggcccctgaatgcggctaatcctaactgcggagc

SEQ ID NO: 9970 - DNA, 60 bp, Artificial Sequence
  Description of Artificial Sequence: Synthetic probe
tgcaactctcatcacctgtatagggacaagcactactttgtgaggggtggcatgccctca

SEQ ID NO: 9971 - DNA, 54 bp, Artificial Sequence
  Description of Artificial Sequence: Synthetic probe
ggcactagcatattcaattccatgattaacaacattataattaggaccctcatg

SEQ ID NO: 9972 - DNA, 60 bp, Artificial Sequence
  Description of Artificial Sequence: Synthetic probe
gttcaggcactagcatattcaattccatgattaacaacattataattaggaccctaatgc

SEQ ID NO: 9973 - DNA, 60 bp, Artificial Sequence
  Description of Artificial Sequence: Synthetic probe
aggatgttcaggcactagcatattcaattccatgattaacaacattataattaggaccct

SEQ ID NO: 9974 - DNA, 60 bp, Artificial Sequence
  Description of Artificial Sequence: Synthetic probe
aggtgtgaagagtttattgagctactatagagtcctccggcccctgaatgcggctaatcc

SEQ ID NO: 9975 - DNA, 60 bp, Artificial Sequence
  Description of Artificial Sequence: Synthetic probe
gagctacttggtactcctccggcccctgaatgcggctaatcctaactgcggagcagatgc

SEQ ID NO: 9976 - DNA, 60 bp, Artificial Sequence
  Description of Artificial Sequence: Synthetic probe
cgtggcggtggctgcgttggcggcctgcccatggggcaacccatgggacgcttcaatact

SEQ ID NO: 9977 - DNA, 60 bp, Artificial Sequence
  Description of Artificial Sequence: Synthetic probe
tttcgctccgcacagccccagtgtagatcaggtcgatgagccaccgcattccccacgggt

SEQ ID NO: 9978 - DNA, 60 bp, Artificial Sequence
  Description of Artificial Sequence: Synthetic probe
tgtttcgctccgcacagccccagtgtagatcaggtcgatgagccaccgcattccccacgg

SEQ ID NO: 9979 - DNA, 53 bp, Artificial Sequence
  Description of Artificial Sequence: Synthetic probe
cagagacagggcacacgtcacaagttgtaccagcggatacaatgcaaaccagg

SEQ ID NO: 9980 - DNA, 60 bp, Artificial Sequence
  Description of Artificial Sequence: Synthetic probe
tatactcaaacttaatagcgcaaaatgggagctcaggtgtcaacacaaaagactggtgca

SEQ ID NO: 9981 - DNA, 60 bp, Artificial Sequence
  Description of Artificial Sequence: Synthetic probe
acagacatggtgcgaagagtctattgagctagttggtagtcctccggcccctgaatgcgg

SEQ ID NO: 9982 - DNA, 60 bp, Artificial Sequence
  Description of Artificial Sequence: Synthetic probe
aatgtgggggtgtccttatgtcaacaggaaaagttctgggaattcatgtaggaggaaatg

SEQ ID NO: 9983 - DNA, 60 bp, Artificial Sequence
  Description of Artificial Sequence: Synthetic probe
ctatgcaaaccaggcacgtgaagaattatcactcgcgatctgagtccacagtggagaatt

SEQ ID NO: 9984 - DNA, 60 bp, Artificial Sequence
  Description of Artificial Sequence: Synthetic probe
agtcctccggcccctgaatgcggctaatcctaactgcggagcacataccctcaatccagg

SEQ ID NO: 9985 - DNA, 60 bp, Artificial Sequence
  Description of Artificial Sequence: Synthetic probe
cctggattgagggtatgtgctccgcagttaggattagccgcattcaggggccggaggact

SEQ ID NO: 9986 - DNA, 60 bp, Artificial Sequence
  Description of Artificial Sequence: Synthetic probe
ttccccacaggtaactgtggcggtggctgcgttggcggcctgcccatggggtgacccatg

SEQ ID NO: 9987 - DNA, 60 bp, Artificial Sequence
  Description of Artificial Sequence: Synthetic probe
tgtagatcgggtcgatgagtcaccgcattccccacgggcgaccgtggcggtggctgcgtt

SEQ ID NO: 9988 - DNA, 60 bp, Artificial Sequence
  Description of Artificial Sequence: Synthetic probe
ccacaggtgcttttgggcagcagtctggtgccgtgtatgttggtaactacagagtggtga

SEQ ID NO: 9989 - DNA, 60 bp, Artificial Sequence
  Description of Artificial Sequence: Synthetic probe
ccatgcagaccacaggtgcttttgggcagcagtctggtgccgtgtatgttggtaactaca

SEQ ID NO: 9990 - DNA, 60 bp, Artificial Sequence
  Description of Artificial Sequence: Synthetic probe
tacagctggcaaacatccaccaaccctagtgtgttctggacggaagggagtgcaccgccc

SEQ ID NO: 9991 - DNA, 60 bp, Artificial Sequence
  Description of Artificial Sequence: Synthetic probe
cctgaatgcggctaatcctaactgcggagcatgtgccctcgatccagagggtagcatgtc

SEQ ID NO: 9992 - DNA, 60 bp, Artificial Sequence
  Description of Artificial Sequence: Synthetic probe
tgggcggtctgtcgtaatgggcaactctgcagcggaaccgactactttgggtgtccgtgt

SEQ ID NO: 9993 - DNA, 60 bp, Artificial Sequence
  Description of Artificial Sequence: Synthetic probe
ggaccaaactactttgggtgtccgtgtttccttttattcttataattttccttatggtta

SEQ ID NO: 9994 - DNA, 60 bp, Artificial Sequence
  Description of Artificial Sequence: Synthetic probe
tggcataaacacattgaataacatggggacactatacatgagacatgtgaatgatggcag

SEQ ID NO: 9995 - DNA, 60 bp, Artificial Sequence
  Description of Artificial Sequence: Synthetic probe
tggtgacaattgagagattgttaccatatagctattggattggccatccggtgtccaaca

SEQ ID NO: 9996 - DNA, 60 bp, Artificial Sequence
  Description of Artificial Sequence: Synthetic probe
ctactttgggtgtccgtgtttccttttattcttatattggctgcttatggtgacaattga

SEQ ID NO: 9997 - DNA, 60 bp, Artificial Sequence
  Description of Artificial Sequence: Synthetic probe
tcactctagatcagagtcgacagtggaaaactttctgtgcagatccgcatgcgtctacta

SEQ ID NO: 9998 - DNA, 55 bp, Artificial Sequence
  Description of Artificial Sequence: Synthetic probe
ctatcactctagatcagagtcgacagtggaaaactttctgtgcagatccgcatgc

SEQ ID NO: 9999 - DNA, 50 bp, Artificial Sequence
  Description of Artificial Sequence: Synthetic probe
gtgtgtcgtaatgggcaactctgcagcggaaccgactactttgggtgacc

SEQ ID NO: 10000 - DNA, 60 bp, Artificial Sequence
  Description of Artificial Sequence: Synthetic probe
agtagtcctccggcccctgaatgcggctaatcctaactgcggagcgcatgccctcaatcc

SEQ ID NO: 10001 - DNA, 60 bp, Artificial Sequence
  Description of Artificial Sequence: Synthetic probe
ggcaacccatgggacgcttcaatactgacatggtgcgaagagtctattgagctagttggt

SEQ ID NO: 10002 - DNA, 51 bp, Artificial Sequence
  Description of Artificial Sequence: Synthetic probe
accttagtgatgaggaagcaacagcagaggatcaacccactcaaccagatg

SEQ ID NO: 10003 - DNA, 52 bp, Artificial Sequence
  Description of Artificial Sequence: Synthetic probe
ggggcggcgtgtcgtaacgggtaactctgcagcggaaccgactactttgggt

SEQ ID NO: 10004 - DNA, 60 bp, Artificial Sequence
  Description of Artificial Sequence: Synthetic probe
gcttcaacgaggtgacctggacaaatgtgaccttcctgaaaaggtacttcagggcagatg

SEQ ID NO: 10005 - DNA, 60 bp, Artificial Sequence
  Description of Artificial Sequence: Synthetic probe
ccaaccctagtgtgttctggacagaagggagtgcaccgccccgaatgtcaataccattca

SEQ ID NO: 10006 - DNA, 60 bp, Artificial Sequence
  Description of Artificial Sequence: Synthetic probe
accaaccctagtgtgttctggacagaagggagtgcaccgccccgaatgtcaataccattc

SEQ ID NO: 10007 - DNA, 60 bp, Artificial Sequence
  Description of Artificial Sequence: Synthetic probe
tgcgttggcggcctgcccatggggcaacccatgggacgcttcaatactgacatggtgcga

SEQ ID NO: 10008 - DNA, 60 bp, Artificial Sequence
  Description of Artificial Sequence: Synthetic probe
ggcctgcccgtggggcaacccatgggacgcttcaatactgacatggtgcgaagagtctat

SEQ ID NO: 10009 - DNA, 60 bp, Artificial Sequence
  Description of Artificial Sequence: Synthetic probe
gtgctagtcatgagtcctccggcccctgaatgcggctaatcttaaccccgtagccattgc

SEQ ID NO: 10010 - DNA, 60 bp, Artificial Sequence
  Description of Artificial Sequence: Synthetic probe
agctagttagtagtcctccggcccctgaatgcggctaatcctaactgcggagcacatacc

SEQ ID NO: 10011 - DNA, 60 bp, Artificial Sequence
  Description of Artificial Sequence: Synthetic probe
ccctcgagaagaaaatgagtaattacatacagttcaagtccaaatgccgtattgaacctg

SEQ ID NO: 10012 - DNA, 60 bp, Artificial Sequence
  Description of Artificial Sequence: Synthetic probe
ttcaggggccggaggactactaactagctcaatagactcttcacaccatgtctgtattag

SEQ ID NO: 10013 - DNA, 60 bp, Artificial Sequence
  Description of Artificial Sequence: Synthetic probe
ttgagctgcaagagagtcctccggcccctgaatgcggctaatcccaaccacggaacaggt

SEQ ID NO: 10014 - DNA, 57 bp, Artificial Sequence
  Description of Artificial Sequence: Synthetic probe
tcaggcaccagcatatttaacaccatgatcaataacgttataatcagaaccctcatg

SEQ ID NO: 10015 - DNA, 60 bp, Artificial Sequence
  Description of Artificial Sequence: Synthetic probe
cacaggtaaggaaacgaactacatagattacctctgcaattctcaccacctgtacagaga

SEQ ID NO: 10016 - DNA, 60 bp, Artificial Sequence
  Description of Artificial Sequence: Synthetic probe
ggtgtgaagagcctactgagctacatgagagtcctccggcccctgaatgcggctaatccc

SEQ ID NO: 10017 - DNA, 60 bp, Artificial Sequence
  Description of Artificial Sequence: Synthetic probe
catacccgtaggccgggtaactgactatgggttcttaaatctgggtggaacccccacgaa

SEQ ID NO: 10018 - DNA, 60 bp, Artificial Sequence
  Description of Artificial Sequence: Synthetic probe
agcctattgagctacacgagagtcctccggcccctgaatgcggctaatcccaaccacgga

SEQ ID NO: 10019 - DNA, 60 bp, Artificial Sequence
  Description of Artificial Sequence: Synthetic probe
gagcctattgagctacaagagagtcctccggcccctgaatgcggctaatcccaaccacgg

SEQ ID NO: 10020 - DNA, 60 bp, Artificial Sequence
  Description of Artificial Sequence: Synthetic probe
cgccgcagagacagggcacacgtcacaagttgtaccatcagacacaatgcaaaccagaca

SEQ ID NO: 10021 - DNA, 60 bp, Artificial Sequence
  Description of Artificial Sequence: Synthetic probe
gggtacacaagcaaggaaacgaacttcatagactacctctgtaattcccaccacttgtac

SEQ ID NO: 10022 - DNA, 60 bp, Artificial Sequence
  Description of Artificial Sequence: Synthetic probe
ttggcaaacgtccaccaacccgagtgtgttctggacagaaggaaacgccccgcctcgcat

SEQ ID NO: 10023 - DNA, 60 bp, Artificial Sequence
  Description of Artificial Sequence: Synthetic probe
gggttgcttgtcgtaacgcgcaagtccgtggcggaaccgactactttgggtgtccgtgtt

SEQ ID NO: 10024 - DNA, 58 bp, Artificial Sequence
  Description of Artificial Sequence: Synthetic probe
catgggataacccatgggacgcttcaatactgacatggtgtgaagagtctattgagct

SEQ ID NO: 10025 - DNA, 60 bp, Artificial Sequence
  Description of Artificial Sequence: Synthetic probe
gcccatggggcaacccatgggacgcttcaatactgacatggtgtgaagagtctattgagc

SEQ ID NO: 10026 - DNA, 60 bp, Artificial Sequence
  Description of Artificial Sequence: Synthetic probe
atgggacgcttcaatactgacatggtgtgaagagtctattgagctaattggtagtcctcc

SEQ ID NO: 10027 - DNA, 51 bp, Artificial Sequence
  Description of Artificial Sequence: Synthetic probe
taatgggcaactccgcagcggaaccgactactttgggtgtccgtgtttcat

SEQ ID NO: 10028 - DNA, 60 bp, Artificial Sequence
  Description of Artificial Sequence: Synthetic probe
acagctacagctggcaaacatccaccaacccgagtgtgttctggacggaagggagcgcac

SEQ ID NO: 10029 - DNA, 60 bp, Artificial Sequence
  Description of Artificial Sequence: Synthetic probe
acgcatacagcatgttctatgacgggtgggccaggtttgacaaacaggggacatacggca

SEQ ID NO: 10030 - DNA, 60 bp, Artificial Sequence
  Description of Artificial Sequence: Synthetic probe
acgcatacagcatgttctatgacgggtgggccaggtttgacaaacaagggacatacggca

SEQ ID NO: 10031 - DNA, 60 bp, Artificial Sequence
  Description of Artificial Sequence: Synthetic probe
ggcaacgcatacagcatgttctatgacgggtgggccaggtttgacaaacaggggacatac

SEQ ID NO: 10032 - DNA, 60 bp, Artificial Sequence
  Description of Artificial Sequence: Synthetic probe
ggcaacgcatacagcatgttctatgacgggtgggccaggtttgacaaacaagggacatac

SEQ ID NO: 10033 - DNA, 60 bp, Artificial Sequence
  Description of Artificial Sequence: Synthetic probe
ttccccacgggcgaccgtggcggtggctgcgttggcggcctgcccacggggcaacccatg

SEQ ID NO: 10034 - DNA, 60 bp, Artificial Sequence
  Description of Artificial Sequence: Synthetic probe
gataagcactactttgtgaggggtggtatgccgtcagggtgttctggcactagtatcttt

SEQ ID NO: 10035 - DNA, 60 bp, Artificial Sequence
  Description of Artificial Sequence: Synthetic probe
tgtttcgctccgcacaaccccagtgtagatcaggccgatgagtcaccgcactccccacgg

SEQ ID NO: 10036 - DNA, 60 bp, Artificial Sequence
  Description of Artificial Sequence: Synthetic probe
agcgtttcgctccgcacaaccccagtgtagatcaggccgatgagtcaccgcactcctcac

SEQ ID NO: 10037 - DNA, 60 bp, Artificial Sequence
  Description of Artificial Sequence: Synthetic probe
ttgcgcagcgtttcgctccgcacaaccccagtgtagatcaggccgatgagtcaccgcact

SEQ ID NO: 10038 - DNA, 60 bp, Artificial Sequence
  Description of Artificial Sequence: Synthetic probe
cgctacaatactgacatggtgtgaagagtctattgagctagttggtagtcctccggcccc

SEQ ID NO: 10039 - DNA, 60 bp, Artificial Sequence
  Description of Artificial Sequence: Synthetic probe
cgcttcaatactgacatggtgtgaagagtctattgagctagttggtagtcctccggcccc

SEQ ID NO: 10040 - DNA, 60 bp, Artificial Sequence
  Description of Artificial Sequence: Synthetic probe
ggggtgtccttatgtcaacagggaaagtcctgggaatacacgtaggaggaaacggacacc

SEQ ID NO: 10041 - DNA, 60 bp, Artificial Sequence
  Description of Artificial Sequence: Synthetic probe
gctgctcgcgcggctgaaggagaaaacgttcgttacccgactaactacttcgagaaacct

SEQ ID NO: 10042 - DNA, 60 bp, Artificial Sequence
  Description of Artificial Sequence: Synthetic probe
caaacttccacaaacccgagtgtgttctggacagaagggagcgcaccgccccgaatgtcg

SEQ ID NO: 10043 - DNA, 60 bp, Artificial Sequence
  Description of Artificial Sequence: Synthetic probe
gcaaacttccacaaacccgagtgtgttctggacagaagggagcgcaccgccccgaatgtc

SEQ ID NO: 10044 - DNA, 60 bp, Artificial Sequence
  Description of Artificial Sequence: Synthetic probe
agttatagctggcaaacttccacaaacccgagtgtgttctggacagaagggagcgcaccg

SEQ ID NO: 10045 - DNA, 60 bp, Artificial Sequence
  Description of Artificial Sequence: Synthetic probe
accttcgtgatcactagtactcaagaacaatcctccgttcaaggccaagacgcaccagtg

SEQ ID NO: 10046 - DNA, 60 bp, Artificial Sequence
  Description of Artificial Sequence: Synthetic probe
ccgccgcagagacagggcacacgtcacaagttgtaccatcagacacaatgcaaactagac

SEQ ID NO: 10047 - DNA, 60 bp, Artificial Sequence
  Description of Artificial Sequence: Synthetic probe
cctttgcaattctcatcacttgtacagggacaagcactactttgtgagaggtggtatgcc

SEQ ID NO: 10048 - DNA, 54 bp, Artificial Sequence
  Description of Artificial Sequence: Synthetic probe
ggcatacatcacaagttgtaccatcagacacaatgcaaactaggcatgtgaaga

SEQ ID NO: 10049 - DNA, 60 bp, Artificial Sequence
  Description of Artificial Sequence: Synthetic probe
gtgcagggaccagcgtgtgagtttgccgtggcgatgatgaaaagaaacgccagtacagtg

SEQ ID NO: 10050 - DNA, 60 bp, Artificial Sequence
  Description of Artificial Sequence: Synthetic probe
gtgcagggtccagcgtttgagtttgccgtggcgatgatgaaaagaaacgccagtacagtg

SEQ ID NO: 10051 - DNA, 60 bp, Artificial Sequence
  Description of Artificial Sequence: Synthetic probe
gtgcagggaccagcgtttgagtttgccgtggcgatgatgaaaagaaacgccagtacagtg

SEQ ID NO: 10052 - DNA, 60 bp, Artificial Sequence
  Description of Artificial Sequence: Synthetic probe
cagacatggtgcgaagagtctattgagctagttagtaatcctccggcccctgaatgcggc

SEQ ID NO: 10053 - DNA, 60 bp, Artificial Sequence
  Description of Artificial Sequence: Synthetic probe
cgctctaatacagacatggtgcgaagagtctattgagctagttagtaatcctccggcccc

SEQ ID NO: 10054 - DNA, 60 bp, Artificial Sequence
  Description of Artificial Sequence: Synthetic probe
ggacgctctaatacagacatggtgcgaagagtctattgagctagttagtaatcctccggc

SEQ ID NO: 10055 - DNA, 60 bp, Artificial Sequence
  Description of Artificial Sequence: Synthetic probe
ttgagctacaagagagtcctccggcccctgaatgcggctaatcccaaccacggagcaggt

SEQ ID NO: 10056 - DNA, 60 bp, Artificial Sequence
  Description of Artificial Sequence: Synthetic probe
ttgagctacatgagagtcctccggcccctgaatgcggctaatcccaaccacggagcaggt

SEQ ID NO: 10057 - DNA, 56 bp, Artificial Sequence
  Description of Artificial Sequence: Synthetic probe
gtgagaggtggtatgccatcaggatgctcaggcaccagtatattcaactctatgat

SEQ ID NO: 10058 - DNA, 56 bp, Artificial Sequence
  Description of Artificial Sequence: Synthetic probe
gtgaggggcggtatgccatcagggtgttcaggcaccagcatatttaacaccatgat

SEQ ID NO: 10059 - DNA, 60 bp, Artificial Sequence
  Description of Artificial Sequence: Synthetic probe
aggcagacatttggacacctatacaaggcttttcatctcaacccgggcattgttacgggg

SEQ ID NO: 10060 - DNA, 54 bp, Artificial Sequence
  Description of Artificial Sequence: Synthetic probe
ccaacccgagtgtgttctggacggaagggagcgcaccgcctcgaatgtcgatac

SEQ ID NO: 10061 - DNA, 60 bp, Artificial Sequence
  Description of Artificial Sequence: Synthetic probe
agtgtttcgctccgcacaaccccagtgtagatcaggtcgatgagccaccgcattccccac

SEQ ID NO: 10062 - DNA, 60 bp, Artificial Sequence
  Description of Artificial Sequence: Synthetic probe
cagtgtttcgctccgcacaaccccagtgtagatcaggtcgatgagccaccgcattcccca

SEQ ID NO: 10063 - DNA, 60 bp, Artificial Sequence
  Description of Artificial Sequence: Synthetic probe
ggacctcaataagttaaaggaatgcatggacaaatatggtctaaacctaccaatggtgac

SEQ ID NO: 10064 - DNA, 60 bp, Artificial Sequence
  Description of Artificial Sequence: Synthetic probe
atccaagaagaccaaggacctcaataagttaaaggaatgcatggacaaatatggtctaaa

SEQ ID NO: 10065 - DNA, 60 bp, Artificial Sequence
  Description of Artificial Sequence: Synthetic probe
gagcctattgagctacataagagtcctccggcccctgaatgcggctaatcctaaccacgg

SEQ ID NO: 10066 - DNA, 56 bp, Artificial Sequence
  Description of Artificial Sequence: Synthetic probe
accgcattccccacgggcgaccgtggcggtggctgcgttggcggcctgcccatggg

SEQ ID NO: 10067 - DNA, 60 bp, Artificial Sequence
  Description of Artificial Sequence: Synthetic probe
gtcaccgcattccccacgggcgaccgtggcggtggctgcgttggcggcctgcccatgggg

SEQ ID NO: 10068 - DNA, 60 bp, Artificial Sequence
  Description of Artificial Sequence: Synthetic probe
tgagccaccgcattccccacgggcgaccgtggcggtggctgcgttggcggcctgcccatg

SEQ ID NO: 10069 - DNA, 60 bp, Artificial Sequence
  Description of Artificial Sequence: Synthetic probe
tgagtcaccgcattccccacgggcgaccgtggcggtggctgcgttggcggcctgcccatg

SEQ ID NO: 10070 - DNA, 60 bp, Artificial Sequence
  Description of Artificial Sequence: Synthetic probe
gagctaattggtagtcctccggcccctgaatgcggctaatcctacctgcggagcagatac

SEQ ID NO: 10071 - DNA, 60 bp, Artificial Sequence
  Description of Artificial Sequence: Synthetic probe
ctcacccaccaaataatgtatgtacctccaggtggcccagtgcccacaaaggtgaacagc

SEQ ID NO: 10072 - DNA, 60 bp, Artificial Sequence
  Description of Artificial Sequence: Synthetic probe
tcttttggagcaagattcccgtcatgctcgatggacatctcatagcgtttgattattcag

SEQ ID NO: 10073 - DNA, 60 bp, Artificial Sequence
  Description of Artificial Sequence: Synthetic probe
cacggcaagttgctcaactgcgtcggaagctcgagatgttcacatacgcaagatttgatt

SEQ ID NO: 10074 - DNA, 60 bp, Artificial Sequence
  Description of Artificial Sequence: Synthetic probe
cacggcaagttgctcaactgcgtcggaagctcgagatgttcacgtacgcgagatttgatc

SEQ ID NO: 10075 - DNA, 60 bp, Artificial Sequence
  Description of Artificial Sequence: Synthetic probe
acacggcaagttgctcaactgcgtcggaagctcgagatgttcacatacgcaagatttgat

SEQ ID NO: 10076 - DNA, 60 bp, Artificial Sequence
  Description of Artificial Sequence: Synthetic probe
acacggcaagttgctcaactgcgtcggaagctcgagatgttcacgtacgcgagatttgat

SEQ ID NO: 10077 - DNA, 60 bp, Artificial Sequence
  Description of Artificial Sequence: Synthetic probe
cacacggcaagttgctcaactgcgtcggaagctcgagatgttcacgtacgcaaggtttga

SEQ ID NO: 10078 - DNA, 60 bp, Artificial Sequence
  Description of Artificial Sequence: Synthetic probe
acacacggcaagttgctcaactgcgtcggaagctcgagatgttcacgtacgcaaggtttg

SEQ ID NO: 10079 - DNA, 60 bp, Artificial Sequence
  Description of Artificial Sequence: Synthetic probe
cgttaccttcctgaaaaggtactttagggcagatgaacaataccccttccttgttcaccc

SEQ ID NO: 10080 - DNA, 54 bp, Artificial Sequence
  Description of Artificial Sequence: Synthetic probe
gacatacgtcacaagttgtaccatcagacacaatgcaaactaggcatgtgaaga

SEQ ID NO: 10081 - DNA, 60 bp, Artificial Sequence
  Description of Artificial Sequence: Synthetic probe
ctccaggtggtccagtgcccacaaaagtaaacagctacagttggcaaacgtccaccaacc

SEQ ID NO: 10082 - DNA, 60 bp, Artificial Sequence
  Description of Artificial Sequence: Synthetic probe
gatctgttgagctagttagtagtctccggcccctgaatgcggctaatcctaactgcggaa

SEQ ID NO: 10083 - DNA, 60 bp, Artificial Sequence
  Description of Artificial Sequence: Synthetic probe
cctctgcaactcccatcacctatatagggacaagcactactttgtgagaggcggcatgcc

SEQ ID NO: 10084 - DNA, 60 bp, Artificial Sequence
  Description of Artificial Sequence: Synthetic probe
cctctgtaattcccaccacctgtacagggacaagcactactttgtgagaggcggcatgcc

SEQ ID NO: 10085 - DNA, 60 bp, Artificial Sequence
  Description of Artificial Sequence: Synthetic probe
acctctgcaactcccatcacctatatagggacaagcactactttgtgagaggcggcatgc

SEQ ID NO: 10086 - DNA, 54 bp, Artificial Sequence
  Description of Artificial Sequence: Synthetic probe
catacccgtaggccgggtaactgactatgggttcttaaatctgggtggaacccc

SEQ ID NO: 10087 - DNA, 50 bp, Artificial Sequence
  Description of Artificial Sequence: Synthetic probe
taatcagaaccctcatgctgaaggtttataaaggcattgatttggaccaa

SEQ ID NO: 10088 - DNA, 53 bp, Artificial Sequence
  Description of Artificial Sequence: Synthetic probe
tcataatcagaaccctcatgctgaaggtttataaaggtattgatctggaccag

SEQ ID NO: 10089 - DNA, 53 bp, Artificial Sequence
  Description of Artificial Sequence: Synthetic probe
tcataatcagaaccctcatgctgaaggtttataaaggcattgacctggaccag

SEQ ID NO: 10090 - DNA, 60 bp, Artificial Sequence
  Description of Artificial Sequence: Synthetic probe
ctagcactcaggaacaatccaccactcaaggccaagatacaccagtgctcacccaccaaa

SEQ ID NO: 10091 - DNA, 60 bp, Artificial Sequence
  Description of Artificial Sequence: Synthetic probe
ttactagcactcaggaacaatccaccactcaaggccaagatacaccagtgctcacccacc

SEQ ID NO: 10092 - DNA, 60 bp, Artificial Sequence
  Description of Artificial Sequence: Synthetic probe
tgtgggggtgtccttatgtcaacagggaaagtcctgggaatacacgtaggaggaaacgga

SEQ ID NO: 10093 - DNA, 60 bp, Artificial Sequence
  Description of Artificial Sequence: Synthetic probe
agtttagagacatcaggggattcttagcacgagaggaggtcgaagtgaacgaagctgtcc

SEQ ID NO: 10094 - DNA, 60 bp, Artificial Sequence
  Description of Artificial Sequence: Synthetic probe
aatcattgcccgcgtcgctgataccgtagggagtggacctgtcaactcggagtccatccc

SEQ ID NO: 10095 - DNA, 60 bp, Artificial Sequence
  Description of Artificial Sequence: Synthetic probe
gtgacggaaggaatcattgcccgcgtcgctgataccgtagggagtggacctgtcaactcg

SEQ ID NO: 10096 - DNA, 60 bp, Artificial Sequence
  Description of Artificial Sequence: Synthetic probe
ggagtgacggaaggaatcattgcccgcgtcgctgataccgtagggagtggacctgtcaac

SEQ ID NO: 10097 - DNA, 60 bp, Artificial Sequence
  Description of Artificial Sequence: Synthetic probe
accagtgctcacccaccaaataatgtatgtacctccaggtggtccagtgcccacgaaggt

SEQ ID NO: 10098 - DNA, 60 bp, Artificial Sequence
  Description of Artificial Sequence: Synthetic probe
acagctacagttggcaaacgtccaccaacccgagtgtgttctggacggaagggagcgcac

SEQ ID NO: 10099 - DNA, 58 bp, Artificial Sequence
  Description of Artificial Sequence: Synthetic probe
catggggtaacccatgggacgcttcaatactgacatggtgcgaagagtctattgagct

SEQ ID NO: 10100 - DNA, 60 bp, Artificial Sequence
  Description of Artificial Sequence: Synthetic probe
cccatggggcaacccatgggacgcttcaatactgacatggtgcgaagagtctattgagct

SEQ ID NO: 10101 - DNA, 60 bp, Artificial Sequence
  Description of Artificial Sequence: Synthetic probe
catggtgcgaagagtctattgagctaattggtagtcctccggcccctgaatgcggctaat

SEQ ID NO: 10102 - DNA, 60 bp, Artificial Sequence
  Description of Artificial Sequence: Synthetic probe
tccccgttatgctcgatggacatctcatagcgtttgattattcaggctatgacgccagcc

SEQ ID NO: 10103 - DNA, 60 bp, Artificial Sequence
  Description of Artificial Sequence: Synthetic probe
gctggcaacgtgaattttatacccactagcgtgacagagggtagaacagatataacaact

SEQ ID NO: 10104 - DNA, 60 bp, Artificial Sequence
  Description of Artificial Sequence: Synthetic probe
atataaaaaagctggcaacgtgaattttatacccactagcgtgacagagggtagaacaga

SEQ ID NO: 10105 - DNA, 60 bp, Artificial Sequence
  Description of Artificial Sequence: Synthetic probe
aaaccaaagcatgtcaaaacatgggttccacgaccacccagactatgccaatataaaaaa

SEQ ID NO: 10106 - DNA, 58 bp, Artificial Sequence
  Description of Artificial Sequence: Synthetic probe
aaaccaaagcatgtcaaaacatgggttccacgaccacccagactatgccaatataaaa

SEQ ID NO: 10107 - DNA, 52 bp, Artificial Sequence
  Description of Artificial Sequence: Synthetic probe
tgtcgtaacgggcaactctgcagcggaaccgactactttgggtgtccgtgtt

SEQ ID NO: 10108 - DNA, 60 bp, Artificial Sequence
  Description of Artificial Sequence: Synthetic probe
gcaggccagtgtgggggtgtccttatgtcaacagggaaagtcctgggaatacatgtaggg

SEQ ID NO: 10109 - DNA, 60 bp, Artificial Sequence
  Description of Artificial Sequence: Synthetic probe
gcaggccagtgtgggggtgtccttatgtcaacagggaaagtcctgggaatacatgtagga

SEQ ID NO: 10110 - DNA, 60 bp, Artificial Sequence
  Description of Artificial Sequence: Synthetic probe
tagggcaggccagtgtgggggtgtccttatgtcaacagggaaagtcctgggaatacatgt

SEQ ID NO: 10111 - DNA, 60 bp, Artificial Sequence
  Description of Artificial Sequence: Synthetic probe
tgtacaatttcccaactagggcaggccagtgtgggggtgtccttatgtcaacagggaaag

SEQ ID NO: 10112 - DNA, 60 bp, Artificial Sequence
  Description of Artificial Sequence: Synthetic probe
tcatgtacaatttcccaactagggcaggccagtgtgggggtgtccttatgtcaacaggga

SEQ ID NO: 10113 - DNA, 60 bp, Artificial Sequence
  Description of Artificial Sequence: Synthetic probe
gagaatgctcatgtacaatttcccaactagggcaggccagtgtgggggtgtccttatgtc

SEQ ID NO: 10114 - DNA, 60 bp, Artificial Sequence
  Description of Artificial Sequence: Synthetic probe
gagtataggcaacgcatacagcatgttctacgatggctggtctgagttcaggcatgatgg

SEQ ID NO: 10115 - DNA, 60 bp, Artificial Sequence
  Description of Artificial Sequence: Synthetic probe
gtcaatcccattcatgagtataggcaacgcatacagcatgttctacgatggctggtctga

SEQ ID NO: 10116 - DNA, 60 bp, Artificial Sequence
  Description of Artificial Sequence: Synthetic probe
gggattagccgcattcaggggccggaggactaccaattagctcaatagactcttcgcacc

SEQ ID NO: 10117 - DNA, 60 bp, Artificial Sequence
  Description of Artificial Sequence: Synthetic probe
gtatcgtcacgggcagtgctgttgggtgtgacccagatgtgttttggagcaagataccag

SEQ ID NO: 10118 - DNA, 60 bp, Artificial Sequence
  Description of Artificial Sequence: Synthetic probe
gatgaggcagacatttggaaacctatacaagacctttcacctcaaccctggtatcgtcac

SEQ ID NO: 10119 - DNA, 60 bp, Artificial Sequence
  Description of Artificial Sequence: Synthetic probe
attgagctacgagagagtcctccggcccctgaatgcggctaatcccaaccacggagcagg

SEQ ID NO: 10120 - DNA, 60 bp, Artificial Sequence
  Description of Artificial Sequence: Synthetic probe
attgagctacatgagagtcctccggcccctgaatgcggctaatcccaaccacggagcagg

SEQ ID NO: 10121 - DNA, 56 bp, Artificial Sequence
  Description of Artificial Sequence: Synthetic probe
cacaaacaaggaaacgaactacatagactacctctgtaattcccaccacctgtaca

SEQ ID NO: 10122 - DNA, 60 bp, Artificial Sequence
  Description of Artificial Sequence: Synthetic probe
tgtacagagacaaacactactttgtgaggggcggtatgccatcaggatgttcaggcacca

SEQ ID NO: 10123 - DNA, 60 bp, Artificial Sequence
  Description of Artificial Sequence: Synthetic probe
caggtaaggaaacgaactacatagattacctctgcaattctcaccacctgtacagagaca

SEQ ID NO: 10124 - DNA, 60 bp, Artificial Sequence
  Description of Artificial Sequence: Synthetic probe
tgttacggggagcgccgttgggtgtgacccggacaccttctggagcaaaatccccgttat

SEQ ID NO: 10125 - DNA, 60 bp, Artificial Sequence
  Description of Artificial Sequence: Synthetic probe
tctcaacccgggcattgttacggggagcgccgttgggtgtgacccggacaccttctggag

SEQ ID NO: 10126 - DNA, 60 bp, Artificial Sequence
  Description of Artificial Sequence: Synthetic probe
aacatccaccaacccgagtgtgttttggacggaagggagcgcaccgcctcgaatgtcgat

SEQ ID NO: 10127 - DNA, 60 bp, Artificial Sequence
  Description of Artificial Sequence: Synthetic probe
cgcttcaatactgacatggtgtgaagagtctattgagctaattggtagtcctccggcccc

SEQ ID NO: 10128 - DNA, 60 bp, Artificial Sequence
  Description of Artificial Sequence: Synthetic probe
aaaggaaacacggacacccaaagtagtcggttccgctgcagagttgcccattacgacaga

SEQ ID NO: 10129 - DNA, 60 bp, Artificial Sequence
  Description of Artificial Sequence: Synthetic probe
ctaattagtagtcctccggcccctgaatgcggctaatcctaactgcggagcagataccca

SEQ ID NO: 10130 - DNA, 60 bp, Artificial Sequence
  Description of Artificial Sequence: Synthetic probe
ctagttggtagtcctccggcccctgaatgcggctaatcctaactgcggagcagataccca

SEQ ID NO: 10131 - DNA, 54 bp, Artificial Sequence
  Description of Artificial Sequence: Synthetic probe
taatgggtaactctgcagcggaaccgactactttgggtgtccgtgtttccattt

SEQ ID NO: 10132 - DNA, 60 bp, Artificial Sequence
  Description of Artificial Sequence: Synthetic probe
cgttggcggcctgcccatggggcaacccatgggacgcttcaatactgacatggtgcgaag

SEQ ID NO: 10133 - DNA, 60 bp, Artificial Sequence
  Description of Artificial Sequence: Synthetic probe
gactattcaggttatgacgccagcctcagcccagtgtggttcacgtgcttgaaactcctc

SEQ ID NO: 10134 - DNA, 60 bp, Artificial Sequence
  Description of Artificial Sequence: Synthetic probe
ttcctccggcccctgaatgcggctaatcctaactgcggagcagacacccacaaaccagtg

SEQ ID NO: 10135 - DNA, 60 bp, Artificial Sequence
  Description of Artificial Sequence: Synthetic probe
acaccatgggacgccttctttgtgacatggtgcgaagagcctattgagctagatagtagt

SEQ ID NO: 10136 - DNA, 60 bp, Artificial Sequence
  Description of Artificial Sequence: Synthetic probe
gtttacaccatgggacgccttctttgtgacatggtgcgaagagcctattgagctagatag

SEQ ID NO: 10137 - DNA, 60 bp, Artificial Sequence
  Description of Artificial Sequence: Synthetic probe
catggtttataccatgggacgccttctttgtgacatggtgcgaagagcctattgagctag

SEQ ID NO: 10138 - DNA, 60 bp, Artificial Sequence
  Description of Artificial Sequence: Synthetic probe
gcaccagcatattcaacaccatgatcaataacattataatcagaaccctcatgttaaagg

SEQ ID NO: 10139 - DNA, 60 bp, Artificial Sequence
  Description of Artificial Sequence: Synthetic probe
tcaggcaccagcatattcaacaccatgatcaataacattataatcagaaccctcatgtta

SEQ ID NO: 10140 - DNA, 60 bp, Artificial Sequence
  Description of Artificial Sequence: Synthetic probe
gggacaagcactactttgtgaggggtggtatgccatcaggatgctcaggcaccagcatat

SEQ ID NO: 10141 - DNA, 60 bp, Artificial Sequence
  Description of Artificial Sequence: Synthetic probe
tatatagggacaagcactactttgtgaggggtggtatgccatcaggatgctcaggcacca

SEQ ID NO: 10142 - DNA, 60 bp, Artificial Sequence
  Description of Artificial Sequence: Synthetic probe
cgaactacattgattacctctgtaattctcaccacctatatagggacaagcactactttg

SEQ ID NO: 10143 - DNA, 60 bp, Artificial Sequence
  Description of Artificial Sequence: Synthetic probe
tacaggtaaggaaacgaactacattgattacctctgtaattctcaccacctatataggga

SEQ ID NO: 10144 - DNA, 60 bp, Artificial Sequence
  Description of Artificial Sequence: Synthetic probe
ccttctggagcaaaatccccattatgctcgatgggcacctcatagcgtttgattattcag

SEQ ID NO: 10145 - DNA, 60 bp, Artificial Sequence
  Description of Artificial Sequence: Synthetic probe
gagacatcaggggattcttagcacgagaggaggtcgaagtgaacgaagctgtcctagcaa

SEQ ID NO: 10146 - DNA, 60 bp, Artificial Sequence
  Description of Artificial Sequence: Synthetic probe
tagagacatcaggggattcttagcacgagaggaggtcgaagtgaacgaagctgtcctagc

SEQ ID NO: 10147 - DNA, 58 bp, Artificial Sequence
  Description of Artificial Sequence: Synthetic probe
ccgcacaaccccagtgtagatcaggccgatgagtcactgcgttccccacgggcgaccg

SEQ ID NO: 10148 - DNA, 60 bp, Artificial Sequence
  Description of Artificial Sequence: Synthetic probe
ttcaccatgcttgggatttacgacaggtgggcggtgttaccacgccacgccaaacctggc

SEQ ID NO: 10149 - DNA, 60 bp, Artificial Sequence
  Description of Artificial Sequence: Synthetic probe
gggcggtctgtcgtaatgggcaactctgcagcggaaccgactactttgggtgtccgtgtt

SEQ ID NO: 10150 - DNA, 60 bp, Artificial Sequence
  Description of Artificial Sequence: Synthetic probe
ggcctgtcgtaacgcgcaagtctgtggcggaaccgactactttgggtgtccgtgtttcct

SEQ ID NO: 10151 - DNA, 60 bp, Artificial Sequence
  Description of Artificial Sequence: Synthetic probe
gttatgacgctagcctcagcccagtgtggttcacgtgcttgaagctcctcttagagaagc

SEQ ID NO: 10152 - DNA, 60 bp, Artificial Sequence
  Description of Artificial Sequence: Synthetic probe
caggttatgacgctagcctcagcccagtgtggttcacgtgcttgaagctcctcttagaga

SEQ ID NO: 10153 - DNA, 60 bp, Artificial Sequence
  Description of Artificial Sequence: Synthetic probe
cgggtagtgctgttgggtgtgacccagacgtcttctggagcaagattcccgtcatgctcg

SEQ ID NO: 10154 - DNA, 60 bp, Artificial Sequence
  Description of Artificial Sequence: Synthetic probe
ccgggcatcgttacgggtagtgctgttgggtgtgacccagacgtcttctggagcaagatt

SEQ ID NO: 10155 - DNA, 60 bp, Artificial Sequence
  Description of Artificial Sequence: Synthetic probe
caacgcatacagcatgttctacgacgggtggtccgagttcagacacgatggtgtttatgg

SEQ ID NO: 10156 - DNA, 60 bp, Artificial Sequence
  Description of Artificial Sequence: Synthetic probe
ataggcaacgcatacagcatgttctacgacgggtggtccgagttcagacacgatggtgtt

SEQ ID NO: 10157 - DNA, 60 bp, Artificial Sequence
  Description of Artificial Sequence: Synthetic probe
ggaaccgactactttgggtgtccgtgtttccttttatcttttgaatggctgcttatggtg

SEQ ID NO: 10158 - DNA, 60 bp, Artificial Sequence
  Description of Artificial Sequence: Synthetic probe
gcctgtcgtaacgcgaaagtctgtggcggaaccgactactttgggtgtccgtgtttcctt

SEQ ID NO: 10159 - DNA, 60 bp, Artificial Sequence
  Description of Artificial Sequence: Synthetic probe
gaaggtaaacagctacagctggcaaacgtccaccaacccgagtgtgttctggacggaagg

SEQ ID NO: 10160 - DNA, 60 bp, Artificial Sequence
  Description of Artificial Sequence: Synthetic probe
acacaagcaaattccctaatatgtacatacccgtgggccgggtaactgactatgggttcc

SEQ ID NO: 10161 - DNA, 50 bp, Artificial Sequence
  Description of Artificial Sequence: Synthetic probe
tgtcgtaacgggcaactctgcagcggaaccgactactttgggtgtccgtg

SEQ ID NO: 10162 - DNA, 60 bp, Artificial Sequence
  Description of Artificial Sequence: Synthetic probe
gaagctgtcctagcaataaacacaagcaaattcccgaatatgtacatacccgtgggccgg

SEQ ID NO: 10163 - DNA, 60 bp, Artificial Sequence
  Description of Artificial Sequence: Synthetic probe
cgaagctgtcctagcaataaacacaagcaaattcccgaatatgtacatacccgtgggccg

SEQ ID NO: 10164 - DNA, 60 bp, Artificial Sequence
  Description of Artificial Sequence: Synthetic probe
gcaggctatccttacgtggctcttggcatcaagaaaagagacattctatccaagaagacc

SEQ ID NO: 10165 - DNA, 60 bp, Artificial Sequence
  Description of Artificial Sequence: Synthetic probe
agcgcaggctatccttacgtggctcttggcatcaagaaaagagacattctatccaagaag

SEQ ID NO: 10166 - DNA, 60 bp, Artificial Sequence
  Description of Artificial Sequence: Synthetic probe
agcgcaggctatccttatgtggctcttggcatcaagaaaagagacattctatccaagaag

SEQ ID NO: 10167 - DNA, 60 bp, Artificial Sequence
  Description of Artificial Sequence: Synthetic probe
tgtcaactcggagtccatcccggctctaaccgccgcagagacagggcatacatcacaagt

SEQ ID NO: 10168 - DNA, 60 bp, Artificial Sequence
  Description of Artificial Sequence: Synthetic probe
agtcaactcggagtccatcccggctctaaccgccggagaaacagggcatacgtcacaagt

SEQ ID NO: 10169 - DNA, 58 bp, Artificial Sequence
  Description of Artificial Sequence: Synthetic probe
ccaacccgagtgtgttctggacggaagggagcgcaccgcctcgaatgtcgataccatt

SEQ ID NO: 10170 - DNA, 60 bp, Artificial Sequence
  Description of Artificial Sequence: Synthetic probe
gctgtcctagcaataaacacaagcaaattcccaaatatgtatatacccgtgggccgggta

SEQ ID NO: 10171 - DNA, 60 bp, Artificial Sequence
  Description of Artificial Sequence: Synthetic probe
gctgtcctagcaataaacacgagcaaattcccaaatatgtatatacccgtgggccgggta

SEQ ID NO: 10172 - DNA, 60 bp, Artificial Sequence
  Description of Artificial Sequence: Synthetic probe
cagtctgtcgtaacgggcaactctgcagcggaaccgactactttgggtgtccgtgtttcc

SEQ ID NO: 10173 - DNA, 60 bp, Artificial Sequence
  Description of Artificial Sequence: Synthetic probe
cggaaccgactactttgggtgtccgtgtttccttttatcttatactggctgcttatggtg

SEQ ID NO: 10174 - DNA, 60 bp, Artificial Sequence
  Description of Artificial Sequence: Synthetic probe
ctcacccaccaaataatgtatgtacctccaggtggtccagtgcccacaaaggtaaacagc

SEQ ID NO: 10175 - DNA, 60 bp, Artificial Sequence
  Description of Artificial Sequence: Synthetic probe
gtgctcacccaccaaataatgtatgtacctccaggtggtccagtgcccacaaaggtaaac

SEQ ID NO: 10176 - DNA, 60 bp, Artificial Sequence
  Description of Artificial Sequence: Synthetic probe
cagcatgttctatgacgggtgggccaggtttgacaaacaagggacatacggcaccagcac

SEQ ID NO: 10177 - DNA, 60 bp, Artificial Sequence
  Description of Artificial Sequence: Synthetic probe
ttatggtgacaattgagagattgttaccatatagctattggattggccatccggttacaa

SEQ ID NO: 10178 - DNA, 60 bp, Artificial Sequence
  Description of Artificial Sequence: Synthetic probe
cgaagagaatgctcatgtacaatttcccaaccagggcaggccagtgtgggggcgtcctta

SEQ ID NO: 10179 - DNA, 51 bp, Artificial Sequence
  Description of Artificial Sequence: Synthetic probe
cgaagagaatgctcatgtacaatttcccaaccagggcaggccagtgtgggg

SEQ ID NO: 10180 - DNA, 60 bp, Artificial Sequence
  Description of Artificial Sequence: Synthetic probe
gaggccgaagtgaacgaagctgtcctagcaataaacacaagtaaattccccaatatgtac

SEQ ID NO: 10181 - DNA, 50 bp, Artificial Sequence
  Description of Artificial Sequence: Synthetic probe
ctgagacaagccaaagtgcagggtccagcgtttgagttcgccgtggcgat

SEQ ID NO: 10182 - DNA, 60 bp, Artificial Sequence
  Description of Artificial Sequence: Synthetic probe
tggctcaaccctaccgcatgaaccgaacttgacaaaagtgcagtaggggtaaattctccc

SEQ ID NO: 10183 - DNA, 60 bp, Artificial Sequence
  Description of Artificial Sequence: Synthetic probe
ggcggcatgccatcaggatgttcaggcaccagtatatttaacactatgatcaacaacatc

SEQ ID NO: 10184 - DNA, 60 bp, Artificial Sequence
  Description of Artificial Sequence: Synthetic probe
ccagataccttctggagcaaaatccccgttatgctcgatggacatctcatagcgtttgac

SEQ ID NO: 10185 - DNA, 60 bp, Artificial Sequence
  Description of Artificial Sequence: Synthetic probe
ccagataccttctggagcaaaatccccgttatgctcgatggacatctcatagcgtttgat

SEQ ID NO: 10186 - DNA, 60 bp, Artificial Sequence
  Description of Artificial Sequence: Synthetic probe
gactcagtggcaatgaggcagacatttggacacctatacaaggcttttcatctcaacccg

SEQ ID NO: 10187 - DNA, 60 bp, Artificial Sequence
  Description of Artificial Sequence: Synthetic probe
tatcactttcctgaaaagatacttcagggcagatgaacagtatcctttccttgttcaccc

SEQ ID NO: 10188 - DNA, 60 bp, Artificial Sequence
  Description of Artificial Sequence: Synthetic probe
gtgcagggtccagcgtttgagttcgccgtggcgatgatgaaaagaaacgccagcacagtg

SEQ ID NO: 10189 - DNA, 60 bp, Artificial Sequence
  Description of Artificial Sequence: Synthetic probe
gtgcagggtccagcgtttgagttcgccgtggcgatgatgaaaagaaacgccggtacagtg

SEQ ID NO: 10190 - DNA, 60 bp, Artificial Sequence
  Description of Artificial Sequence: Synthetic probe
ctgagacaagccaaagtacagggtccagcgtttgagttcgccgtggcgatgatgaaaaga

SEQ ID NO: 10191 - DNA, 60 bp, Artificial Sequence
  Description of Artificial Sequence: Synthetic probe
ctgagacaagctaaggtgcagggtccagcgtttgagttcgccgtggcgatgatgaaaaga

SEQ ID NO: 10192 - DNA, 60 bp, Artificial Sequence
  Description of Artificial Sequence: Synthetic probe
cactaaacaacatggggacactatatatgagacatgtgaatggtggaggtcccggtccca

SEQ ID NO: 10193 - DNA, 60 bp, Artificial Sequence
  Description of Artificial Sequence: Synthetic probe
gactcagtagcaatgaggcagacatttggaaacctatacaagactttccacctcaacccg

SEQ ID NO: 10194 - DNA, 60 bp, Artificial Sequence
  Description of Artificial Sequence: Synthetic probe
gactcagtagcaatgaggcagacatttggaaacctatataagacttttcacctcaaccca

SEQ ID NO: 10195 - DNA, 60 bp, Artificial Sequence
  Description of Artificial Sequence: Synthetic probe
gactcagtagcaatgaggcagacatttggaaacctatacaaggctttccacctcaacccg

SEQ ID NO: 10196 - DNA, 60 bp, Artificial Sequence
  Description of Artificial Sequence: Synthetic probe
ggtttgtcgtaatgcgcaagtccgtggcggaaccgactactttgggtgtccgtgtttcct

SEQ ID NO: 10197 - DNA, 60 bp, Artificial Sequence
  Description of Artificial Sequence: Synthetic probe
gcccctgaatgcggctaatcctaactgcggagcagacacccacacgccagtgggcagtct

SEQ ID NO: 10198 - DNA, 60 bp, Artificial Sequence
  Description of Artificial Sequence: Synthetic probe
aatccaccgttcaaggccaagacgcaccagtgcttacccaccaaataatgtacgtacccc

SEQ ID NO: 10199 - DNA, 60 bp, Artificial Sequence
  Description of Artificial Sequence: Synthetic probe
actagtactcaagaacaatcctccgttcaaggccaagacgcaccagtgcttacccaccaa

SEQ ID NO: 10200 - DNA, 60 bp, Artificial Sequence
  Description of Artificial Sequence: Synthetic probe
acgcaagattcgacctggagctgaccttcgtgatcactagtactcaagaacaatcctccg

SEQ ID NO: 10201 - DNA, 60 bp, Artificial Sequence
  Description of Artificial Sequence: Synthetic probe
gagatgttcacgtacgcaaggtttgatctggagctgaccttcgtgatcactagtactcaa

SEQ ID NO: 10202 - DNA, 60 bp, Artificial Sequence
  Description of Artificial Sequence: Synthetic probe
ctgtgcagatctgcgtgtgtcttttacactacatacaagaaccatgactccgacggcgac

SEQ ID NO: 10203 - DNA, 60 bp, Artificial Sequence
  Description of Artificial Sequence: Synthetic probe
ggcatcgttacagggagcgccgttgggtgtgacccagataccttctggagcaaaatcccc

SEQ ID NO: 10204 - DNA, 60 bp, Artificial Sequence
  Description of Artificial Sequence: Synthetic probe
cgggcatcgttacgggaagcgccgttgggtgtgacccagataccttctggagcaaaatcc

SEQ ID NO: 10205 - DNA, 60 bp, Artificial Sequence
  Description of Artificial Sequence: Synthetic probe
cctcaacccgggcatcgttacagggagcgccgttgggtgtgacccagataccttctggag

SEQ ID NO: 10206 - DNA, 60 bp, Artificial Sequence
  Description of Artificial Sequence: Synthetic probe
aaagcacgtcaaaacgtgggtcccaagaccgcccagactatgtcaataccaaaaggctgg

SEQ ID NO: 10207 - DNA, 60 bp, Artificial Sequence
  Description of Artificial Sequence: Synthetic probe
aaccaaagcacgtcaaaacgtgggtcccaagaccgcccagactatgtcaataccaaaagg

SEQ ID NO: 10208 - DNA, 60 bp, Artificial Sequence
  Description of Artificial Sequence: Synthetic probe
gccaaagcacgtcaaaacgtgggtcccaagaccgcccagactatgtcaataccaaaaggc

SEQ ID NO: 10209 - DNA, 60 bp, Artificial Sequence
  Description of Artificial Sequence: Synthetic probe
aagccaaagcacgtcaaaacgtgggtcccaagaccgcccagactatgtcaataccaaaag

SEQ ID NO: 10210 - DNA, 60 bp, Artificial Sequence
  Description of Artificial Sequence: Synthetic probe
cagggatgcctaatcagaagcccaaggtgcccaccctgagacaagctaaggtgcagggtc

SEQ ID NO: 10211 - DNA, 60 bp, Artificial Sequence
  Description of Artificial Sequence: Synthetic probe
ctagttagtagtcctccggcccctgaatgcggctaatcctaactgcggagcacatgccca

SEQ ID NO: 10212 - DNA, 56 bp, Artificial Sequence
  Description of Artificial Sequence: Synthetic probe
cacaagcaaggaaacgaactacatagactacctctgtaattcccaccacttgtaca

SEQ ID NO: 10213 - DNA, 60 bp, Artificial Sequence
  Description of Artificial Sequence: Synthetic probe
cgttaccttcctgaaaaggtactttagggcagatgagcaataccccttccttgttcaccc

SEQ ID NO: 10214 - DNA, 60 bp, Artificial Sequence
  Description of Artificial Sequence: Synthetic probe
ggcaagttgctcaactgcgtcggaagctcgagatgttcacgtacgcaaggtttgatctgg

SEQ ID NO: 10215 - DNA, 60 bp, Artificial Sequence
  Description of Artificial Sequence: Synthetic probe
catagcttttgactattcaggttatgacgccagcctcagcccagtgtggtttgcgtgctt

SEQ ID NO: 10216 - DNA, 60 bp, Artificial Sequence
  Description of Artificial Sequence: Synthetic probe
tattgggtgattaacacacggcaagttgctcaactgcgtcggaagctcgagatgttcacg

SEQ ID NO: 10217 - DNA, 60 bp, Artificial Sequence
  Description of Artificial Sequence: Synthetic probe
tactgggtgatcaacacacggcaagttgctcaactgcgtcggaagctcgagatgttcacg

SEQ ID NO: 10218 - DNA, 60 bp, Artificial Sequence
  Description of Artificial Sequence: Synthetic probe
cgcctattgggtgattaacacacggcaagttgctcaactgcgtcggaagctcgagatgtt

SEQ ID NO: 10219 - DNA, 60 bp, Artificial Sequence
  Description of Artificial Sequence: Synthetic probe
gcttgcgcggtcgaaggagaaaacgtccgttacccgactaactacttcgagaaacccagt

SEQ ID NO: 10220 - DNA, 60 bp, Artificial Sequence
  Description of Artificial Sequence: Synthetic probe
ctgcttgcgcggtcgaaggagaaaacgtccgttacccgactaactacttcgagaaaccca

SEQ ID NO: 10221 - DNA, 60 bp, Artificial Sequence
  Description of Artificial Sequence: Synthetic probe
agcctgtcgtaacgcgcaagtctgtggcggaaccgactactttgggtgtccgtgtttcct

SEQ ID NO: 10222 - DNA, 60 bp, Artificial Sequence
  Description of Artificial Sequence: Synthetic probe
taattggtagtcctccggcccctgaatgcggctaatcccaactgcggagcagatacccac

SEQ ID NO: 10223 - DNA, 60 bp, Artificial Sequence
  Description of Artificial Sequence: Synthetic probe
tggcctgtcgtaacgcgcaagtctgtggcggaaccgactactttgggtgtccgtgtttcc

SEQ ID NO: 10224 - DNA, 60 bp, Artificial Sequence
  Description of Artificial Sequence: Synthetic probe
ggagctcaagtgtcaacacaaaagaccggagcacatgagactggcttgagcgccagtggg

SEQ ID NO: 10225 - DNA, 60 bp, Artificial Sequence
  Description of Artificial Sequence: Synthetic probe
gtgtttcgctccgcacaaccccagtgtagatcaggtcgatgagtcaccgcattccccacg

SEQ ID NO: 10226 - DNA, 60 bp, Artificial Sequence
  Description of Artificial Sequence: Synthetic probe
gtcgtaacgggcaactctgcagcggaaccgactactttgggtgtccgtgtttccttttat

SEQ ID NO: 10227 - DNA, 60 bp, Artificial Sequence
  Description of Artificial Sequence: Synthetic probe
ttgcctggcagacatcaaccaacccaagtgtgttctggacggaaggcaacgcccctccca

SEQ ID NO: 10228 - DNA, 60 bp, Artificial Sequence
  Description of Artificial Sequence: Synthetic probe
gaagattttgcctggcagacatcaaccaacccaagtgtgttctggacggaaggcaacgcc

SEQ ID NO: 10229 - DNA, 60 bp, Artificial Sequence
  Description of Artificial Sequence: Synthetic probe
accatgaaggttgcgcagtgtttcgctccgcacaaccccagtgtagatcaggtcgatgag

SEQ ID NO: 10230 - DNA, 60 bp, Artificial Sequence
  Description of Artificial Sequence: Synthetic probe
gtttcgctccgcacaaccccagtgtagatcaggccgatgagtcaccgcaaaccccacggg

SEQ ID NO: 10231 - DNA, 60 bp, Artificial Sequence
  Description of Artificial Sequence: Synthetic probe
agcgtttcgctccgcacaaccccagtgtagatcaggccgatgagtcactgcaatccccac

SEQ ID NO: 10232 - DNA, 60 bp, Artificial Sequence
  Description of Artificial Sequence: Synthetic probe
ctagcactcaggagcaatccaccactcaaggccaagatacaccagtgctcacccaccaaa

SEQ ID NO: 10233 - DNA, 60 bp, Artificial Sequence
  Description of Artificial Sequence: Synthetic probe
ggcttggcacaatggggagcacgaatatgaggagtttattcgaaagatcagaagcgtgcc

SEQ ID NO: 10234 - DNA, 60 bp, Artificial Sequence
  Description of Artificial Sequence: Synthetic probe
ctcttagagaagctagggtacacaagcaaggaaacgaacttcatagactacctctgtaat

SEQ ID NO: 10235 - DNA, 60 bp, Artificial Sequence
  Description of Artificial Sequence: Synthetic probe
gaaactcctcttggagaagctagggtacacaagcaaggaaacgaactacatagactacct

SEQ ID NO: 10236 - DNA, 52 bp, Artificial Sequence
  Description of Artificial Sequence: Synthetic probe
acgcggcaagttgctcaactgcgtcggaagctcgaaatgttcacgtacgcaa

SEQ ID NO: 10237 - DNA, 52 bp, Artificial Sequence
  Description of Artificial Sequence: Synthetic probe
acacggcaagttgctcaactgcgtcggaagctcgaaatgttcacgtacgcaa

SEQ ID NO: 10238 - DNA, 60 bp, Artificial Sequence
  Description of Artificial Sequence: Synthetic probe
gtgatcaacacacggcaagttgctcaactgcgtcggaagctcgaaatgttcacgtacgca

SEQ ID NO: 10239 - DNA, 60 bp, Artificial Sequence
  Description of Artificial Sequence: Synthetic probe
tttcgctccacacaaccccagtgtagatcaggtcgatgagtcaccgcaatccccacgggc

SEQ ID NO: 10240 - DNA, 60 bp, Artificial Sequence
  Description of Artificial Sequence: Synthetic probe
agacctcactaagttaaaggaatgcatggataaatatggtctaaatctaccaatggtgac

SEQ ID NO: 10241 - DNA, 59 bp, Artificial Sequence
  Description of Artificial Sequence: Synthetic probe
aaggggaaaccgttcgttacccgactaactacttcgagaaacctagtaccaccatgaaa

SEQ ID NO: 10242 - DNA, 60 bp, Artificial Sequence
  Description of Artificial Sequence: Synthetic probe
gtgatcaacacacggcaagttgctcaactgcgtcggaagctcgagatgttcacgtacgcg

SEQ ID NO: 10243 - DNA, 60 bp, Artificial Sequence
  Description of Artificial Sequence: Synthetic probe
ggtgattaacacacggcaagttgctcaactgcgtcggaagctcgagatgttcacgtacgc

SEQ ID NO: 10244 - DNA, 60 bp, Artificial Sequence
  Description of Artificial Sequence: Synthetic probe
ggtgatcaacacacggcaagttgctcaactgcgtcggaagctcgagatgttcacgtacgc

SEQ ID NO: 10245 - DNA, 60 bp, Artificial Sequence
  Description of Artificial Sequence: Synthetic probe
gtggcggtggctgcgctggcggcctgcccatggggcaacccatgggacgcttcaatactg

SEQ ID NO: 10246 - DNA, 60 bp, Artificial Sequence
  Description of Artificial Sequence: Synthetic probe
atcgtggcggtggctgcgctggcggcctgcccatggggcaacccatgggacgcttcaata

SEQ ID NO: 10247 - DNA, 60 bp, Artificial Sequence
  Description of Artificial Sequence: Synthetic probe
cgtggcggtggctgcgctggcggcctgcccatggggcaacccatgggacgcttcaatact

SEQ ID NO: 10248 - DNA, 60 bp, Artificial Sequence
  Description of Artificial Sequence: Synthetic probe
ggtaacttggacaaatgtgacctttctgaaaaggtacttcagggcagatgaacaataccc

SEQ ID NO: 10249 - DNA, 60 bp, Artificial Sequence
  Description of Artificial Sequence: Synthetic probe
tgaggtaacttggacaaatgtgacctttctgaaaaggtacttcagggcagatgaacaata

SEQ ID NO: 10250 - DNA, 59 bp, Artificial Sequence
  Description of Artificial Sequence: Synthetic probe
gcagcactcctcagacactacttcaatgaggagcagggtgagatagaattcattgagag

SEQ ID NO: 10251 - DNA, 59 bp, Artificial Sequence
  Description of Artificial Sequence: Synthetic probe
gcggcactcctcagacactacttcaatgaggagcagggtgagatagaattcattgagag

SEQ ID NO: 10252 - DNA, 59 bp, Artificial Sequence
  Description of Artificial Sequence: Synthetic probe
gcggcactcctcagacactatttcaatgaggagcagggtgagatagaattcattgagag

SEQ ID NO: 10253 - DNA, 60 bp, Artificial Sequence
  Description of Artificial Sequence: Synthetic probe
atgggagctcaagtgtcaacacaaaagaccggagcgcatgagactggcttgagcgccagt

SEQ ID NO: 10254 - DNA, 60 bp, Artificial Sequence
  Description of Artificial Sequence: Synthetic probe
atgggagctcaagtgtcaacacaaaagaccggagcgcatgagactggcttgagtgccagt

SEQ ID NO: 10255 - DNA, 60 bp, Artificial Sequence
  Description of Artificial Sequence: Synthetic probe
atgggagctcaagtgtcaacacaaaagaccggagcacatgagactggcttgagcgccagt

SEQ ID NO: 10256 - DNA, 60 bp, Artificial Sequence
  Description of Artificial Sequence: Synthetic probe
gtgaagagcctattgagctactgaagagtcctccggcccctgaatgcggctaatcctaac

SEQ ID NO: 10257 - DNA, 60 bp, Artificial Sequence
  Description of Artificial Sequence: Synthetic probe
aggccgatgagtcaccgcaatccccacgggcgaccgtggcggtggctgcgttggcggcct

SEQ ID NO: 10258 - DNA, 60 bp, Artificial Sequence
  Description of Artificial Sequence: Synthetic probe
gcggcctgcccatggggcaacccatgggacgcttcaatactgacatggtgcgaagaatct

SEQ ID NO: 10259 - DNA, 60 bp, Artificial Sequence
  Description of Artificial Sequence: Synthetic probe
ccgcatgcgtattctacaccacttataagaaccacgactctgatggtgacaacttcgcct

SEQ ID NO: 10260 - DNA, 60 bp, Artificial Sequence
  Description of Artificial Sequence: Synthetic probe
tgtcactttcctgaaaagatacttcagggcagatgagcagtatcctttccttgtccaccc

SEQ ID NO: 10261 - DNA, 60 bp, Artificial Sequence
  Description of Artificial Sequence: Synthetic probe
tcaggccgatgagtcaccgcgttccccacgggcgaccgtggcggtggctgcgttggcggc

SEQ ID NO: 10262 - DNA, 60 bp, Artificial Sequence
  Description of Artificial Sequence: Synthetic probe
tccccattatgctcgatgggcacctcatagcgtttgattattcaggctatgacgccagcc

SEQ ID NO: 10263 - DNA, 60 bp, Artificial Sequence
  Description of Artificial Sequence: Synthetic probe
agtagcaatgaggcagacatttggaaacctatataagactttccacctcaacccgggcac

SEQ ID NO: 10264 - DNA, 59 bp, Artificial Sequence
  Description of Artificial Sequence: Synthetic probe
taacgcgcaagtctgtggcggaaccgactactttgggtgtccgtgtttcctgttatttt

SEQ ID NO: 10265 - DNA, 59 bp, Artificial Sequence
  Description of Artificial Sequence: Synthetic probe
taatgcgcaagtctgtggcggaaccgactactttgggtgtccgtgtttcctgttatttt

SEQ ID NO: 10266 - DNA, 60 bp, Artificial Sequence
  Description of Artificial Sequence: Synthetic probe
gaatggtcatcaagggttttcagctgcactcctcagacattacttcaatgaagaacaggg

SEQ ID NO: 10267 - DNA, 60 bp, Artificial Sequence
  Description of Artificial Sequence: Synthetic probe
aggaatggtcatcaagggttttcagctgcactcctcagacattacttcaatgaagaacag

SEQ ID NO: 10268 - DNA, 60 bp, Artificial Sequence
  Description of Artificial Sequence: Synthetic probe
attgagctaattggtagtcctccggcccctgaatgcggctaatcctaactgcggagcaga

SEQ ID NO: 10269 - DNA, 60 bp, Artificial Sequence
  Description of Artificial Sequence: Synthetic probe
aggtgtgaagagcctattgagctactcaagagtcctccggcccctgaatgcggctaatcc

SEQ ID NO: 10270 - DNA, 60 bp, Artificial Sequence
  Description of Artificial Sequence: Synthetic probe
gcgctcgttgtgtctactggcctggcacaacggggagcacgaatatgaggagtttattcg

SEQ ID NO: 10271 - DNA, 60 bp, Artificial Sequence
  Description of Artificial Sequence: Synthetic probe
ctcggagtccatcccggctctaaccgccgcagagacagggcatacatcacaagttgtacc

SEQ ID NO: 10272 - DNA, 60 bp, Artificial Sequence
  Description of Artificial Sequence: Synthetic probe
aggtggtccagtgcccacaaaggtaaacagctacagttggcaaacgtccaccaacccgag

SEQ ID NO: 10273 - DNA, 60 bp, Artificial Sequence
  Description of Artificial Sequence: Synthetic probe
gcgcagtgtttcgctccgcacaaacccagtgtagatcaggtcgatgagtcaccgcattcc

SEQ ID NO: 10274 - DNA, 60 bp, Artificial Sequence
  Description of Artificial Sequence: Synthetic probe
ggccgctcgcgcggctgaaggagaaaacgttcgttacccggccaattacttcgagaaact

SEQ ID NO: 10275 - DNA, 60 bp, Artificial Sequence
  Description of Artificial Sequence: Synthetic probe
taacgcgtaagtctgtggcggaaccgactactttgggtgtccgtgtttccttttattctt

SEQ ID NO: 10276 - DNA, 60 bp, Artificial Sequence
  Description of Artificial Sequence: Synthetic probe
tgcccacaaaggtaaacagctacagttggcaaacgtccaccaacccgagtgtgttctgga

SEQ ID NO: 10277 - DNA, 60 bp, Artificial Sequence
  Description of Artificial Sequence: Synthetic probe
tgcccacaaaggtcaacagctacagttggcaaacgtccaccaacccgagtgtgttctgga

SEQ ID NO: 10278 - DNA, 60 bp, Artificial Sequence
  Description of Artificial Sequence: Synthetic probe
ctattgagctagttggtagtcctccggcccctgaatgcggctaatcctaactgtggagca

SEQ ID NO: 10279 - DNA, 60 bp, Artificial Sequence
  Description of Artificial Sequence: Synthetic probe
aactgactatgggttcctaaatctgggtggaacccccacgaagagaatgctcatgtacaa

SEQ ID NO: 10280 - DNA, 60 bp, Artificial Sequence
  Description of Artificial Sequence: Synthetic probe
cgcttcaatatggacatggtgcgaagagtctattgagctagttagtagtcctccggcccc

SEQ ID NO: 10281 - DNA, 60 bp, Artificial Sequence
  Description of Artificial Sequence: Synthetic probe
cctgaaaagatacttcagggcagatgagcagtatcctttccttgtccaccccgtgatgcc

SEQ ID NO: 10282 - DNA, 60 bp, Artificial Sequence
  Description of Artificial Sequence: Synthetic probe
gtggtttgtcgtaatgcgcaagtccgtggcggaaccgactactttgggtgtccgtgtttc

SEQ ID NO: 10283 - DNA, 60 bp, Artificial Sequence
  Description of Artificial Sequence: Synthetic probe
gttaggattagccgcattcaggggccggaggactcttgagtagctcaataggctcttcac

SEQ ID NO: 10284 - DNA, 60 bp, Artificial Sequence
  Description of Artificial Sequence: Synthetic probe
ctccgcagttgggattagccgcattcaggggccggaggactaccaattagctcaatagac

SEQ ID NO: 10285 - DNA, 60 bp, Artificial Sequence
  Description of Artificial Sequence: Synthetic probe
aaaggtaaacagctacagctggcaaacgtccaccaacccgagtgtgttctggacggaagg

SEQ ID NO: 10286 - DNA, 60 bp, Artificial Sequence
  Description of Artificial Sequence: Synthetic probe
tgcgaagagtctactgagctagtcggtagtcctccggcccctgaatgcggctaatcctaa

SEQ ID NO: 10287 - DNA, 60 bp, Artificial Sequence
  Description of Artificial Sequence: Synthetic probe
tttctctctagaaaagaaaatgagcaattacatacagttcaagtccaaatgccgtattga

SEQ ID NO: 10288 - DNA, 60 bp, Artificial Sequence
  Description of Artificial Sequence: Synthetic probe
gactattcaggttatgacgccagccttagcccagtgtggtttacgtgcttgaaactcctc

SEQ ID NO: 10289 - DNA, 60 bp, Artificial Sequence
  Description of Artificial Sequence: Synthetic probe
cacaccagtgctcacccaccaaataatgtatgtgcctccaggtggtccagtacccacaaa

SEQ ID NO: 10290 - DNA, 60 bp, Artificial Sequence
  Description of Artificial Sequence: Synthetic probe
cacaccagtgcttacccaccaaataatgtatgtacctccaggtggtccagtgcccacaaa

SEQ ID NO: 10291 - DNA, 60 bp, Artificial Sequence
  Description of Artificial Sequence: Synthetic probe
ccgatggcgacaacttcgcctactgggtgatcaacacacggcaagttgctcaactgcgtc

SEQ ID NO: 10292 - DNA, 51 bp, Artificial Sequence
  Description of Artificial Sequence: Synthetic probe
tgcagatccgcatgcgtattctacaccacttataagaaccacgactctgat

SEQ ID NO: 10293 - DNA, 60 bp, Artificial Sequence
  Description of Artificial Sequence: Synthetic probe
tatgcagatccgcatgcgtattctacaccacttataagaaccacgactctgatggtgaca

SEQ ID NO: 10294 - DNA, 60 bp, Artificial Sequence
  Description of Artificial Sequence: Synthetic probe
ggagaacttcctatgcaggtccgcatgcgtattctacaccacttataagaaccacgactc

SEQ ID NO: 10295 - DNA, 60 bp, Artificial Sequence
  Description of Artificial Sequence: Synthetic probe
gaggcagacgtttggaaacctatataagactttccacctcaacccgggcatcgttacggg

SEQ ID NO: 10296 - DNA, 60 bp, Artificial Sequence
  Description of Artificial Sequence: Synthetic probe
gcacgagaggaggccgaagtgaacgaagctgtcctagcaataaacacaagcaaattcccg

SEQ ID NO: 10297 - DNA, 60 bp, Artificial Sequence
  Description of Artificial Sequence: Synthetic probe
caacccatgggacgcttcaatactgacatggtgcgaagagtctattgagctagctggtag

SEQ ID NO: 10298 - DNA, 59 bp, Artificial Sequence
  Description of Artificial Sequence: Synthetic probe
gtctgtggcggaaccgactactttgggtgtccgtgtttccttttatttttatattggct

SEQ ID NO: 10299 - DNA, 60 bp, Artificial Sequence
  Description of Artificial Sequence: Synthetic probe
cactaaataacatggggacactatatatgagacatgtgaatagtgggggccccggtccca

SEQ ID NO: 10300 - DNA, 60 bp, Artificial Sequence
  Description of Artificial Sequence: Synthetic probe
cccgtcatgctcgatggacatctcatagcgtttgactattcaggctatgacgccagcctc

SEQ ID NO: 10301 - DNA, 60 bp, Artificial Sequence
  Description of Artificial Sequence: Synthetic probe
caccagtgcttacccaccaaataatgtatgtacctccaggtggtccagtgcccacaaagg

SEQ ID NO: 10302 - DNA, 54 bp, Artificial Sequence
  Description of Artificial Sequence: Synthetic probe
ggcatacgtcacaagttgtaccatcagacacaatgcaaaccaggcatgtgaaga

SEQ ID NO: 10303 - DNA, 54 bp, Artificial Sequence
  Description of Artificial Sequence: Synthetic probe
catacccgtgggccgggtaaccgactatgggttcttaaatctgggtggaacccc

SEQ ID NO: 10304 - DNA, 60 bp, Artificial Sequence
  Description of Artificial Sequence: Synthetic probe
gaatatgtacatacctgtgggccgggtaaccgactatgggttcttaaatctgggtggaac

SEQ ID NO: 10305 - DNA, 60 bp, Artificial Sequence
  Description of Artificial Sequence: Synthetic probe
aaggttgcgcagtgtttcgctccgcacaaccccagtgtagatcaggtcgatgagccaccg

SEQ ID NO: 10306 - DNA, 60 bp, Artificial Sequence
  Description of Artificial Sequence: Synthetic probe
ctattgagctaattggtgttcctccggcccctgaatgcggctaatcctaactgcggagca

SEQ ID NO: 10307 - DNA, 60 bp, Artificial Sequence
  Description of Artificial Sequence: Synthetic probe
ggtccagtgcccacaaaggtaaacagctacagctggcaaacgtccaccaacccgagtgtg

SEQ ID NO: 10308 - DNA, 60 bp, Artificial Sequence
  Description of Artificial Sequence: Synthetic probe
ctattgagctggttggtagtcctccggcccctgaatgcggctaatcctaactgcggagca

SEQ ID NO: 10309 - DNA, 60 bp, Artificial Sequence
  Description of Artificial Sequence: Synthetic probe
agctaattggtagtcctccggcccctgaatgcggctaatcctaactgcggagcagatacc

SEQ ID NO: 10310 - DNA, 60 bp, Artificial Sequence
  Description of Artificial Sequence: Synthetic probe
caccagtgctcacccaccaaataatgtatgtacctccaggtggtccagtgcccacaaagg

SEQ ID NO: 10311 - DNA, 60 bp, Artificial Sequence
  Description of Artificial Sequence: Synthetic probe
gattattcaggctatgacgccagccttagcccagtgtggttcacgtgcttgaaactcctc

SEQ ID NO: 10312 - DNA, 60 bp, Artificial Sequence
  Description of Artificial Sequence: Synthetic probe
ccttctggagcaaaatccccgttatgctcgatggacatctcatagcgtttgattattcag

SEQ ID NO: 10313 - DNA, 60 bp, Artificial Sequence
  Description of Artificial Sequence: Synthetic probe
cctcacgggcgaccgtggcggtggctgcgttggcggcctgcccatgggactactcatggg

SEQ ID NO: 10314 - DNA, 60 bp, Artificial Sequence
  Description of Artificial Sequence: Synthetic probe
tggtgcgaagaatctactgagctagttggtagtcctccggcccctgaatgcggctaatcc

SEQ ID NO: 10315 - DNA, 60 bp, Artificial Sequence
  Description of Artificial Sequence: Synthetic probe
tctattgagctaattggtagtcctccggcccctgaatgcggctaatcctaactgtggagc

SEQ ID NO: 10316 - DNA, 51 bp, Artificial Sequence
  Description of Artificial Sequence: Synthetic probe
ccttttactcttatactggctgcttatggtgacaattgagagattgttacc

SEQ ID NO: 10317 - DNA, 57 bp, Artificial Sequence
  Description of Artificial Sequence: Synthetic probe
gctgcttatggtgacaattgagagattgttaccatatagctattggattggccatca

SEQ ID NO: 10318 - DNA, 60 bp, Artificial Sequence
  Description of Artificial Sequence: Synthetic probe
ggaaccgactactttgggtgtccgtgtttccttttgttcttatactggctgcttatggtg

SEQ ID NO: 10319 - DNA, 60 bp, Artificial Sequence
  Description of Artificial Sequence: Synthetic probe
ggaaccgactactttgggtgtccgtgtttccttttattcttatactggctgcttatggtg

SEQ ID NO: 10320 - DNA, 60 bp, Artificial Sequence
  Description of Artificial Sequence: Synthetic probe
gagtctattgagctagttggtagtcctccggcccctgaatgcggctaatcctaactgcgg

SEQ ID NO: 10321 - DNA, 60 bp, Artificial Sequence
  Description of Artificial Sequence: Synthetic probe
ggcgtgtcgtaacgggcaactctgcagcggaaccgactactttgggtgtccgtgtttcct

SEQ ID NO: 10322 - DNA, 60 bp, Artificial Sequence
  Description of Artificial Sequence: Synthetic probe
atcaattgcaattggctcaaccctaccgcatgaaccgaacttacaaaagtgcggcagggg

SEQ ID NO: 10323 - DNA, 60 bp, Artificial Sequence
  Description of Artificial Sequence: Synthetic probe
aaatatgtatatacccgtgggccgggtaaccgactatgggttcttaaatctgggcggaac

SEQ ID NO: 10324 - DNA, 58 bp, Artificial Sequence
  Description of Artificial Sequence: Synthetic probe
ggggtgtccttatgtcaacagggaaagtcctgggaatacatgtaggagggaatggaca

SEQ ID NO: 10325 - DNA, 54 bp, Artificial Sequence
  Description of Artificial Sequence: Synthetic probe
taacgcgcaagtctgtggcggaaccgactactttgggtgtccgtgtttcctttt

SEQ ID NO: 10326 - DNA, 60 bp, Artificial Sequence
  Description of Artificial Sequence: Synthetic probe
ctcctcttggagaagctagggtacacaagcaaggaaacgaactacatagactacctctgt

SEQ ID NO: 10327 - DNA, 60 bp, Artificial Sequence
  Description of Artificial Sequence: Synthetic probe
tggcgacaacttcgcctactgggtgatcaacacacggcaagttgctcaactgcgtcggaa

SEQ ID NO: 10328 - DNA, 60 bp, Artificial Sequence
  Description of Artificial Sequence: Synthetic probe
gtaccatcagacacaatgcaaaccagacacgtgaagaattatcattcaagatcagagtcg

SEQ ID NO: 10329 - DNA, 60 bp, Artificial Sequence
  Description of Artificial Sequence: Synthetic probe
gaggtcgaagtgaacgaagctgtcctagcaataaacacaagcaaattcccgaatatgtac

SEQ ID NO: 10330 - DNA, 60 bp, Artificial Sequence
  Description of Artificial Sequence: Synthetic probe
cacaccagtgctcacccaccaaataatgtatgtacctccaggtggtccagtacccacaaa

SEQ ID NO: 10331 - DNA, 60 bp, Artificial Sequence
  Description of Artificial Sequence: Synthetic probe
tgggcggaacccccacgaagagaatgctcatgtacaatttcccaaccagggcaggccagt

SEQ ID NO: 10332 - DNA, 50 bp, Artificial Sequence
  Description of Artificial Sequence: Synthetic probe
gagagtcctccggcccctgaatgcggctaatcctaaccacggagcaggtg

SEQ ID NO: 10333 - DNA, 60 bp, Artificial Sequence
  Description of Artificial Sequence: Synthetic probe
gagctactaaagagtcctccggcccctgaatgcggctaatcctacccatggatcaagtgc

SEQ ID NO: 10334 - DNA, 60 bp, Artificial Sequence
  Description of Artificial Sequence: Synthetic probe
ttggcagaactgtgtgtgggaagattacagtagagaccttctagtgagcaccaccaccgc

SEQ ID NO: 10335 - DNA, 60 bp, Artificial Sequence
  Description of Artificial Sequence: Synthetic probe
ttcaatactgacatggtgtgaagagtctattgagctaattggtagtcctccggcccctga

SEQ ID NO: 10336 - DNA, 60 bp, Artificial Sequence
  Description of Artificial Sequence: Synthetic probe
gcaacccatgggacgcttcaatactgacatggtgcgaagagtctattgagctagttggta

SEQ ID NO: 10337 - DNA, 60 bp, Artificial Sequence
  Description of Artificial Sequence: Synthetic probe
ctattgagctagttggtagtcctccggcccctgaatgcggctaatcctaactgcggagcg

SEQ ID NO: 10338 - DNA, 60 bp, Artificial Sequence
  Description of Artificial Sequence: Synthetic probe
ccagtgctcacccaccaaataatgtatgtacctccaggtggtccagtgcccacgaaggta

SEQ ID NO: 10339 - DNA, 60 bp, Artificial Sequence
  Description of Artificial Sequence: Synthetic probe
tccggcccctgaatgcggctaatcccaactgcggagcacattcccacaaaccagtgggta

SEQ ID NO: 10340 - DNA, 60 bp, Artificial Sequence
  Description of Artificial Sequence: Synthetic probe
cggaaccgactactttgggtgtccgtgtttccttttatccttatactggctgcttatggt

SEQ ID NO: 10341 - DNA, 60 bp, Artificial Sequence
  Description of Artificial Sequence: Synthetic probe
ttgagctacaagggagtcctccggcccctgaatgcggctaatcctaaccacggagcaggt

SEQ ID NO: 10342 - DNA, 60 bp, Artificial Sequence
  Description of Artificial Sequence: Synthetic probe
ggcaacgcatacagcatgttctatgacgggtgggccaggttcgacaagcaggggacatac

SEQ ID NO: 10343 - DNA, 60 bp, Artificial Sequence
  Description of Artificial Sequence: Synthetic probe
ccacgaaggtaaacagctacagctggcaaacgtccaccaacccgagtgtgttctggacgg

SEQ ID NO: 10344 - DNA, 60 bp, Artificial Sequence
  Description of Artificial Sequence: Synthetic probe
gaagctgtcctagcaataaacacaagcaaattcccaaatatgtatatacccgtgggccgg

SEQ ID NO: 10345 - DNA, 60 bp, Artificial Sequence
  Description of Artificial Sequence: Synthetic probe
tgtgaagagtctattgagctaattggtagtcctccggcccctgaatgcggctaatcctac

SEQ ID NO: 10346 - DNA, 56 bp, Artificial Sequence
  Description of Artificial Sequence: Synthetic probe
ccccacgaagagaatgctcatgtacaatttcccaactagggcaggccagtgtgggg

SEQ ID NO: 10347 - DNA, 60 bp, Artificial Sequence
  Description of Artificial Sequence: Synthetic probe
acgggagaccgtggcggtggctgcgctggcggcctgcccatggggcaacccatgggacgc

SEQ ID NO: 10348 - DNA, 60 bp, Artificial Sequence
  Description of Artificial Sequence: Synthetic probe
gtctattgagctagttagtagtcctccggcccctgaatgcggctaatcctaaccgcggag

SEQ ID NO: 10349 - DNA, 60 bp, Artificial Sequence
  Description of Artificial Sequence: Synthetic probe
gtgaagagcctattgagctactaaagagtcctccggcccctgaatgcggctaatcctacc

SEQ ID NO: 10350 - DNA, 60 bp, Artificial Sequence
  Description of Artificial Sequence: Synthetic probe
cgccagtgctcacccaccaaataatgtatgtacctccaggtggtccagtgcccacaaaag

SEQ ID NO: 10351 - DNA, 60 bp, Artificial Sequence
  Description of Artificial Sequence: Synthetic probe
tacttcaagccaaagcacgtcaaaacgtgggtcccaagaccgcccagactatgtcaatac

SEQ ID NO: 10352 - DNA, 60 bp, Artificial Sequence
  Description of Artificial Sequence: Synthetic probe
ggggtcccggtcccattgtgagtacagtacgaatttacttcaagccaaagcatgtcaaaa

SEQ ID NO: 10353 - DNA, 60 bp, Artificial Sequence
  Description of Artificial Sequence: Synthetic probe
catgactccgatggcgacaacttcgcctactgggtgatcaacacacggcaagttgctcaa

SEQ ID NO: 10354 - DNA, 60 bp, Artificial Sequence
  Description of Artificial Sequence: Synthetic probe
ccatgactccgatggcgacaacttcgcctactgggtgatcaacacacggcaagttgctca

SEQ ID NO: 10355 - DNA, 60 bp, Artificial Sequence
  Description of Artificial Sequence: Synthetic probe
acggatttatttcaagccaaagcacgtcaaaacgtgggtcccgagaccacccagattatg

SEQ ID NO: 10356 - DNA, 60 bp, Artificial Sequence
  Description of Artificial Sequence: Synthetic probe
actgacatggtgtgaagagtctattgagctaattggtagtcctccggcccctgaatgcgg

SEQ ID NO: 10357 - DNA, 60 bp, Artificial Sequence
  Description of Artificial Sequence: Synthetic probe
tgtgaagagcctattgagctacatgagagtcctccggcccctgaatgcggctaatcctaa

SEQ ID NO: 10358 - DNA, 60 bp, Artificial Sequence
  Description of Artificial Sequence: Synthetic probe
gtgtttcgctcagcacaaccccagtgtagatcaggtcgatgagtcaccgcattccccacg

SEQ ID NO: 10359 - DNA, 60 bp, Artificial Sequence
  Description of Artificial Sequence: Synthetic probe
ttcctcacgggcgaccgtggcggtggctgcgttggcggcctgcctatggggcaacccatg

SEQ ID NO: 10360 - DNA, 60 bp, Artificial Sequence
  Description of Artificial Sequence: Synthetic probe
gccaaagcacgtcaaaacgtgggtcccgagaccacccagattatgtcaatatcagaaggc

SEQ ID NO: 10361 - DNA, 60 bp, Artificial Sequence
  Description of Artificial Sequence: Synthetic probe
ctattgagctacatgagagtcctccggcccctgaatgcggctaatcccaaccacggagca

SEQ ID NO: 10362 - DNA, 60 bp, Artificial Sequence
  Description of Artificial Sequence: Synthetic probe
cctgtcgtaatgggtaactctgcggcggaaccgactactttgggtgtccgtgtttccctt

SEQ ID NO: 10363 - DNA, 60 bp, Artificial Sequence
  Description of Artificial Sequence: Synthetic probe
tccggcccctgaatgcggctaatcctaaccatggagcaagtgctcacaagccagtgagtt

SEQ ID NO: 10364 - DNA, 60 bp, Artificial Sequence
  Description of Artificial Sequence: Synthetic probe
ggtttagagacatcaggggattcttagcacgagaggaggccgaagtgagcgaagctgtct

SEQ ID NO: 10365 - DNA, 60 bp, Artificial Sequence
  Description of Artificial Sequence: Synthetic probe
tcaaccgtaacgagaagtttagagacatcaggggattcttagcacgagaggaggccgagg

SEQ ID NO: 10366 - DNA, 60 bp, Artificial Sequence
  Description of Artificial Sequence: Synthetic probe
tcagccgcaatgagaggtttagagacatcaggggattcttagcacgagaggaggccgaag

SEQ ID NO: 10367 - DNA, 56 bp, Artificial Sequence
  Description of Artificial Sequence: Synthetic probe
cacaagcaaggaaacgaactacatagactacctctgtaattcccaccacctgtaca

SEQ ID NO: 10368 - DNA, 60 bp, Artificial Sequence
  Description of Artificial Sequence: Synthetic probe
gcattctcaacactacgcaggaagtggctggactccttttaaaactagagtacaattggt

SEQ ID NO: 10369 - DNA, 60 bp, Artificial Sequence
  Description of Artificial Sequence: Synthetic probe
cctgcattctcaacactacgcaggaagtggctggactccttttaaaactagagtacaatt

SEQ ID NO: 10370 - DNA, 60 bp, Artificial Sequence
  Description of Artificial Sequence: Synthetic probe
cgcgtaagtctgtggcggaaccgactactttgggtgtccgtgtttccttttattcttaca

SEQ ID NO: 10371 - DNA, 60 bp, Artificial Sequence
  Description of Artificial Sequence: Synthetic probe
ggtgcgaagagtctactgagctagtcggtagtcctccggcccctgaatgcggctaatcct

SEQ ID NO: 10372 - DNA, 60 bp, Artificial Sequence
  Description of Artificial Sequence: Synthetic probe
cacaagtaaattccccaatatgtacatacccgtgggccgggtaactgactatgggttcct

SEQ ID NO: 10373 - DNA, 60 bp, Artificial Sequence
  Description of Artificial Sequence: Synthetic probe
caatatgtacatacccgtgggccgggtaaccgactatgggttcttaaatctgggtggaac

SEQ ID NO: 10374 - DNA, 53 bp, Artificial Sequence
  Description of Artificial Sequence: Synthetic probe
gatgaaaagaaacgccagtacagtgaaaactgagtacggtgaattcaccatgc

SEQ ID NO: 10375 - DNA, 60 bp, Artificial Sequence
  Description of Artificial Sequence: Synthetic probe
gatgaaaagaaacgccagtacagtgaaaactgagtacggtgaattcaccatgcttgggat

SEQ ID NO: 10376 - DNA, 60 bp, Artificial Sequence
  Description of Artificial Sequence: Synthetic probe
tccccacgggcgaccgtggcggtggctgcgttggcggcctgcctatggggcaacccatag

SEQ ID NO: 10377 - DNA, 60 bp, Artificial Sequence
  Description of Artificial Sequence: Synthetic probe
gggacactatatatgagacacgtgaatggtgggggccccggtcccattgtgagcgcagtg

SEQ ID NO: 10378 - DNA, 50 bp, Artificial Sequence
  Description of Artificial Sequence: Synthetic probe
agttagtagtcctccggcccctgaatgcggctaatcctaactgcggagca

SEQ ID NO: 10379 - DNA, 57 bp, Artificial Sequence
  Description of Artificial Sequence: Synthetic probe
gctgcttatggtgacaattgagagattgttaccatatagctattggatgggccatca

SEQ ID NO: 10380 - DNA, 60 bp, Artificial Sequence
  Description of Artificial Sequence: Synthetic probe
ggtgatcaacacgcggcaagttgctcaactgcgtcggaagctcgaaatgttcacgtacgc

SEQ ID NO: 10381 - DNA, 60 bp, Artificial Sequence
  Description of Artificial Sequence: Synthetic probe
ggaaccgactactttgggtgtccgtgtttccttccgttcttatactggctgcttatggtg

SEQ ID NO: 10382 - DNA, 60 bp, Artificial Sequence
  Description of Artificial Sequence: Synthetic probe
gagctacatgagattcctccggcccctgaatgcggctaatcccaaccacggagcaggtga

SEQ ID NO: 10383 - DNA, 60 bp, Artificial Sequence
  Description of Artificial Sequence: Synthetic probe
cgtttcgctccgcacaaccccagtgtagatcaggtcgatgagtcaccgcaaaccccacgg

SEQ ID NO: 10384 - DNA, 60 bp, Artificial Sequence
  Description of Artificial Sequence: Synthetic probe
gcctaatcagaagcctaaggtgcccaccctgagacaagccaaagtgcagggaccagcgtt

SEQ ID NO: 10385 - DNA, 60 bp, Artificial Sequence
  Description of Artificial Sequence: Synthetic probe
gcctctagcctcaatgactcagtggcgatgaggcagacatttggaaacctatataagacc

SEQ ID NO: 10386 - DNA, 54 bp, Artificial Sequence
  Description of Artificial Sequence: Synthetic probe
catacccgtgggccgggtaactgactatgggttcctaaatctgggtggaacccc

SEQ ID NO: 10387 - DNA, 60 bp, Artificial Sequence
  Description of Artificial Sequence: Synthetic probe
catacccgtgggccgggtaactgactatgggttcctaaatctgggtggaacccccacgaa

SEQ ID NO: 10388 - DNA, 60 bp, Artificial Sequence
  Description of Artificial Sequence: Synthetic probe
cacaaacaaggaaacgaactacatagactacctctgtaattcccaccacctgtacaggga

SEQ ID NO: 10389 - DNA, 60 bp, Artificial Sequence
  Description of Artificial Sequence: Synthetic probe
tgtagatcaggtcgatgagtcaccgcattccccacgggcgaccgtggcggtggctgcgtt

SEQ ID NO: 10390 - DNA, 60 bp, Artificial Sequence
  Description of Artificial Sequence: Synthetic probe
acagtggagaacttcctgtgcagatctgcatgcgtcttctacaccacgtataagaaccat

SEQ ID NO: 10391 - DNA, 60 bp, Artificial Sequence
  Description of Artificial Sequence: Synthetic probe
gcaataaacacaagtaaattccccaatatgtacatacccgtgggccgggtaactgactat

SEQ ID NO: 10392 - DNA, 60 bp, Artificial Sequence
  Description of Artificial Sequence: Synthetic probe
ccaggtggtccagtgcccacaaaggtaaacagctacagctggcaaacatccaccaacccg

SEQ ID NO: 10393 - DNA, 60 bp, Artificial Sequence
  Description of Artificial Sequence: Synthetic probe
tggcctgtcgtaacgcgtaagtctgcggcggaaccgactactttgggtgtccgtgtttcc

SEQ ID NO: 10394 - DNA, 60 bp, Artificial Sequence
  Description of Artificial Sequence: Synthetic probe
gtgcgaagagcctactgagctactagagagtcctccggcccctgaatgcggctaatccca

SEQ ID NO: 10395 - DNA, 60 bp, Artificial Sequence
  Description of Artificial Sequence: Synthetic probe
gtacctccaggtggtccagtgcccacaaaggtaaacagctacagctggcaaacatccacc

SEQ ID NO: 10396 - DNA, 60 bp, Artificial Sequence
  Description of Artificial Sequence: Synthetic probe
gcctgtcgtaacgcgtaagtctgtggcggaaccgactactttgggtgtccgtgtttcctt

SEQ ID NO: 10397 - DNA, 60 bp, Artificial Sequence
  Description of Artificial Sequence: Synthetic probe
ctcattatgcctattggcttggcacaatggggagcacgaatatgaggagtttattcgaaa

SEQ ID NO: 10398 - DNA, 60 bp, Artificial Sequence
  Description of Artificial Sequence: Synthetic probe
gcgctcattgtgcttattggcttggcacaatggggagcacgaatatgaggagtttattcg

SEQ ID NO: 10399 - DNA, 60 bp, Artificial Sequence
  Description of Artificial Sequence: Synthetic probe
gcgctcactatgcctattggcttggcacaatggggagcacgaatatgaggagttcatccg

SEQ ID NO: 10400 - DNA, 60 bp, Artificial Sequence
  Description of Artificial Sequence: Synthetic probe
gagctactgaagagtcctccggcccctgaatgcggctaatcctaaccatggatcaagtgc

SEQ ID NO: 10401 - DNA, 60 bp, Artificial Sequence
  Description of Artificial Sequence: Synthetic probe
gcttatggtgacaattgagagattgttaccatattgctattggattggccatccggtgac

SEQ ID NO: 10402 - DNA, 60 bp, Artificial Sequence
  Description of Artificial Sequence: Synthetic probe
tgcttatggtgacaattgagagattgttaccatattgctattggattggccatccggtga

SEQ ID NO: 10403 - DNA, 60 bp, Artificial Sequence
  Description of Artificial Sequence: Synthetic probe
tgcttatggtgacaattgagagattgttaccatattgctattggattggccacccggtga

SEQ ID NO: 10404 - DNA, 60 bp, Artificial Sequence
  Description of Artificial Sequence: Synthetic probe
ccagtgctcacccaccaaataatgtatgtacctccaggtggtccagtgcccacaaaggtc

SEQ ID NO: 10405 - DNA, 60 bp, Artificial Sequence
  Description of Artificial Sequence: Synthetic probe
catggtgtgaagagtctattgagctaattggtagtcctccggcccctgaatgcggctaat

SEQ ID NO: 10406 - DNA, 60 bp, Artificial Sequence
  Description of Artificial Sequence: Synthetic probe
ccaactttgaggaagcaatcttctccaagtacattggcaacgtcaacacacatgtagacg

SEQ ID NO: 10407 - DNA, 60 bp, Artificial Sequence
  Description of Artificial Sequence: Synthetic probe
ggctaaaagccaactttgaggaagcaatcttctccaagtacattggcaacgtcaacacac

SEQ ID NO: 10408 - DNA, 60 bp, Artificial Sequence
  Description of Artificial Sequence: Synthetic probe
aagagtcctccggcccctgaatgcggctaatcctaaccacggagcaagcggtcacgaacc

SEQ ID NO: 10409 - DNA, 60 bp, Artificial Sequence
  Description of Artificial Sequence: Synthetic probe
tggtgacaattgagagattgttaccatatagctattggattggccatccggtgacaaata

SEQ ID NO: 10410 - DNA, 60 bp, Artificial Sequence
  Description of Artificial Sequence: Synthetic probe
cagggaacatatggcatcagtacactaaataacatggggacactatatatgagacacgtg

SEQ ID NO: 10411 - DNA, 60 bp, Artificial Sequence
  Description of Artificial Sequence: Synthetic probe
ggggtcccggtcccattgtgagcacagtacgaatttacttcaagccaaagcatgtcaaaa

SEQ ID NO: 10412 - DNA, 60 bp, Artificial Sequence
  Description of Artificial Sequence: Synthetic probe
acacgtcacaagttgtaccatcagacacaatgcaaaccagacacgtgaagaattatcatt

SEQ ID NO: 10413 - DNA, 60 bp, Artificial Sequence
  Description of Artificial Sequence: Synthetic probe
ttgagctaattggtagtcctccggcccctgaatgcggctaatcctaactgcggagcagat

SEQ ID NO: 10414 - DNA, 60 bp, Artificial Sequence
  Description of Artificial Sequence: Synthetic probe
tccccacgggcgaccgtggcggtggctgcgttggcggcctgcctatggggaaacccatag

SEQ ID NO: 10415 - DNA, 60 bp, Artificial Sequence
  Description of Artificial Sequence: Synthetic probe
acgtccaccaacccgagtgtgttctggacggaagggagcgcaccgccccgaatgtcaata

SEQ ID NO: 10416 - DNA, 60 bp, Artificial Sequence
  Description of Artificial Sequence: Synthetic probe
acacgtgaatgacgggggtcccgttcccattgtgagcacagtacgaatttacttcaagcc

SEQ ID NO: 10417 - DNA, 60 bp, Artificial Sequence
  Description of Artificial Sequence: Synthetic probe
actgagctagttggtagtcctccggcccctgaatgcggctaatcctaactgcggagcaca

SEQ ID NO: 10418 - DNA, 60 bp, Artificial Sequence
  Description of Artificial Sequence: Synthetic probe
tgtgaagagcctattgagctacacgagagtcctccggcccctgaatgcggctaatcctaa

SEQ ID NO: 10419 - DNA, 60 bp, Artificial Sequence
  Description of Artificial Sequence: Synthetic probe
tgaggcagacatttggaaacctatacaagactttccacctcaacccgggcatcgttacgg

SEQ ID NO: 10420 - DNA, 60 bp, Artificial Sequence
  Description of Artificial Sequence: Synthetic probe
ctgagacaagccaaagtgcagggtccagcgtttgagttcgccgtggcgatgatgaaaaga

SEQ ID NO: 10421 - DNA, 60 bp, Artificial Sequence
  Description of Artificial Sequence: Synthetic probe
gaggcagacatttggaaacctatataagactttccacctcaacccgggcatcgttacggg

SEQ ID NO: 10422 - DNA, 60 bp, Artificial Sequence
  Description of Artificial Sequence: Synthetic probe
tgcgaagagcctattgagctacatgagagtcctccggcccctgaatgcggctaatcccaa

SEQ ID NO: 10423 - DNA, 60 bp, Artificial Sequence
  Description of Artificial Sequence: Synthetic probe
ggtaacatggactaacgttaccttcctgaaaaggtactttagggcagatgagcaataccc

SEQ ID NO: 10424 - DNA, 60 bp, Artificial Sequence
  Description of Artificial Sequence: Synthetic probe
ccttatgtggctcttggcatcaagaaaagagacattctatccaagaagaccaaggacctc

SEQ ID NO: 10425 - DNA, 60 bp, Artificial Sequence
  Description of Artificial Sequence: Synthetic probe
attccccacgggcgaccgtggcggtggctgcgttggcggcctgcccatggagcaatccat

SEQ ID NO: 10426 - DNA, 60 bp, Artificial Sequence
  Description of Artificial Sequence: Synthetic probe
catggtgcgaagagtctattgagctagttggtagtcctccggcccctgaatgcggctaat

SEQ ID NO: 10427 - DNA, 60 bp, Artificial Sequence
  Description of Artificial Sequence: Synthetic probe
catggtgcaaagagtctattgagctagttggtagtcctccggcccctgaatgcggctaat

SEQ ID NO: 10428 - DNA, 60 bp, Artificial Sequence
  Description of Artificial Sequence: Synthetic probe
catacccgtgggccgggtaaccgactatgggttcttaaatctgggtggaacccccacgaa

SEQ ID NO: 10429 - DNA, 60 bp, Artificial Sequence
  Description of Artificial Sequence: Synthetic probe
tccaaggtgcatacacagggatgcctaatcaaaaacccagggagcccaccctagggcaag

SEQ ID NO: 10430 - DNA, 60 bp, Artificial Sequence
  Description of Artificial Sequence: Synthetic probe
tccaaggtgcatacacagggatgcctaatcaaaaacccagggtgcccaccctgaggcaag

SEQ ID NO: 10431 - DNA, 60 bp, Artificial Sequence
  Description of Artificial Sequence: Synthetic probe
caaggcgcctacacagggatgcctaatcagaagcccaaggtgcccaccctgagacaagct

SEQ ID NO: 10432 - DNA, 60 bp, Artificial Sequence
  Description of Artificial Sequence: Synthetic probe
ccagggtgcttacacagggatgcctaatcagaagcccaaggtgcccaccctgagacaagc

SEQ ID NO: 10433 - DNA, 60 bp, Artificial Sequence
  Description of Artificial Sequence: Synthetic probe
ggtgcgaagagtctattgagctaattggtagtcctccggcccctgaatgcggctaatcct

SEQ ID NO: 10434 - DNA, 60 bp, Artificial Sequence
  Description of Artificial Sequence: Synthetic probe
tgaaagtcgcgcagcgtttcgctccgcacaaccccagtgtagatcaggccgatgagtcac

SEQ ID NO: 10435 - DNA, 60 bp, Artificial Sequence
  Description of Artificial Sequence: Synthetic probe
ttccccacgggcgaccgtggcggtggctgcgttggcggcctgcccgtggagcaatccatg

SEQ ID NO: 10436 - DNA, 60 bp, Artificial Sequence
  Description of Artificial Sequence: Synthetic probe
gagtcaactgtggagaacttcctgtgcagatccgcatgcgtattctacaccacttataag

SEQ ID NO: 10437 - DNA, 53 bp, Artificial Sequence
  Description of Artificial Sequence: Synthetic probe
gtcgctgataccgtagggagtggacctgtcaactcggagtccatcccggctct

SEQ ID NO: 10438 - DNA, 60 bp, Artificial Sequence
  Description of Artificial Sequence: Synthetic probe
catgctcgatggacatctcatagcgtttgactactcaggttatgacgctagcctcagccc

SEQ ID NO: 10439 - DNA, 60 bp, Artificial Sequence
  Description of Artificial Sequence: Synthetic probe
ccccacgggcgaccgtggcggtggctgcgttggcggcctgcccatggggcaacccatggg

SEQ ID NO: 10440 - DNA, 60 bp, Artificial Sequence
  Description of Artificial Sequence: Synthetic probe
ttccccacgggcgaccgtggcggtggctgcgttggcggcctgcccatggggcaacccatg

SEQ ID NO: 10441 - DNA, 60 bp, Artificial Sequence
  Description of Artificial Sequence: Synthetic probe
aacatggggacactatatatgagacatgtgaatgatgggggtcccggtcccattgtgagc

SEQ ID NO: 10442 - DNA, 60 bp, Artificial Sequence
  Description of Artificial Sequence: Synthetic probe
acactaaacaacatggggacactatatatgagacatgtgaatgatgggggtcccggtccc

SEQ ID NO: 10443 - DNA, 60 bp, Artificial Sequence
  Description of Artificial Sequence: Synthetic probe
cgactatgggttcttaaatctgggtggaacccccacgaagagaatgctcatgtacaattt

SEQ ID NO: 10444 - DNA, 60 bp, Artificial Sequence
  Description of Artificial Sequence: Synthetic probe
tgcaccagtgctcacccaccaaataatgtatgtacctccaggtggtccagtgcccacaaa

SEQ ID NO: 10445 - DNA, 60 bp, Artificial Sequence
  Description of Artificial Sequence: Synthetic probe
acgccagtgctcacccaccaaataatgtatgtacctccaggtggtccagtgcccacaaaa

SEQ ID NO: 10446 - DNA, 60 bp, Artificial Sequence
  Description of Artificial Sequence: Synthetic probe
cagggatacctaatcagaagcccaaggtgcccaccctgagacaagccaaagtgcagggtc

SEQ ID NO: 10447 - DNA, 60 bp, Artificial Sequence
  Description of Artificial Sequence: Synthetic probe
cagggatgcctaatcagaagcccaaggtgcccaccctgagacaagccaaagtgcagggac

SEQ ID NO: 10448 - DNA, 60 bp, Artificial Sequence
  Description of Artificial Sequence: Synthetic probe
cagggatgcctaatcagaagcccaaggtgcccaccctgagacaagccaaagtgcagggtc

SEQ ID NO: 10449 - DNA, 60 bp, Artificial Sequence
  Description of Artificial Sequence: Synthetic probe
acagggatgcccaatcagaagcccaaggtgcccaccctgagacaagccaaagtgcagggt

SEQ ID NO: 10450 - DNA, 60 bp, Artificial Sequence
  Description of Artificial Sequence: Synthetic probe
acagggatgcctagtcagaagcccaaggtgcccaccctgagacaagccaaagtgcaggga

SEQ ID NO: 10451 - DNA, 60 bp, Artificial Sequence
  Description of Artificial Sequence: Synthetic probe
atgagtcaccgcgttccccacgggcgaccgtggcggtggctgcgttggcggcctgcccat

SEQ ID NO: 10452 - DNA, 60 bp, Artificial Sequence
  Description of Artificial Sequence: Synthetic probe
gaggtcgaagtgaatgaagctgtcctagcaataaacacaagcaaattcccgaatatgtac

SEQ ID NO: 10453 - DNA, 60 bp, Artificial Sequence
  Description of Artificial Sequence: Synthetic probe
tggaaccgactactttgggtgtccgtgtttccttttgttcttatactggctgcttatggt

SEQ ID NO: 10454 - DNA, 60 bp, Artificial Sequence
  Description of Artificial Sequence: Synthetic probe
ccgttcccattgtgagtacagtacgaatttacttcaagccaaagcatgtcaaaacgtggg

SEQ ID NO: 10455 - DNA, 60 bp, Artificial Sequence
  Description of Artificial Sequence: Synthetic probe
cccgttcccattgtgagtacagtacgaatttacttcaagccaaagcatgtcaaaacgtgg

SEQ ID NO: 10456 - DNA, 60 bp, Artificial Sequence
  Description of Artificial Sequence: Synthetic probe
ttgagctacatgagattcctccggcccctgaatgcggctaatcccaaccgcggagcaggt

SEQ ID NO: 10457 - DNA, 60 bp, Artificial Sequence
  Description of Artificial Sequence: Synthetic probe
tacggcattagcacactaaacaacatggggacactatatatgagacatgtgaatggtgga

SEQ ID NO: 10458 - DNA, 60 bp, Artificial Sequence
  Description of Artificial Sequence: Synthetic probe
tccaaggtgcttacacagggatgcctaatcagaagcccaaggtgcccaccctgagacaag

SEQ ID NO: 10459 - DNA, 60 bp, Artificial Sequence
  Description of Artificial Sequence: Synthetic probe
tccagggtgcttacacagggatgcctaatcagaagcccaaggtgcccaccctgagacaag

SEQ ID NO: 10460 - DNA, 60 bp, Artificial Sequence
  Description of Artificial Sequence: Synthetic probe
tccaaggcgcctacacagggatgcctaatcagaagcccaaggtgcccaccctgagacaag

SEQ ID NO: 10461 - DNA, 60 bp, Artificial Sequence
  Description of Artificial Sequence: Synthetic probe
gcgaccgtggcggtggctgcgttggcggcctgcccatggggcaacctatgggacgcttca

SEQ ID NO: 10462 - DNA, 55 bp, Artificial Sequence
  Description of Artificial Sequence: Synthetic probe
ttcaggctatgacgccagcctcagcccagtgtggtttacgtgcttgaaactcctc

SEQ ID NO: 10463 - DNA, 60 bp, Artificial Sequence
  Description of Artificial Sequence: Synthetic probe
aaaagtaaacagctacagctggcaaacatccaccaacccgagtgtgttctggacagaagg

SEQ ID NO: 10464 - DNA, 60 bp, Artificial Sequence
  Description of Artificial Sequence: Synthetic probe
ttgagctacacgagagtcctccggcccctgaatgcggctaatcctaaccacggagcaagc

SEQ ID NO: 10465 - DNA, 60 bp, Artificial Sequence
  Description of Artificial Sequence: Synthetic probe
gcaagtctgtggcggaaccgactactttgggtgtccgtgtttcctgttatttttatcatg

SEQ ID NO: 10466 - DNA, 60 bp, Artificial Sequence
  Description of Artificial Sequence: Synthetic probe
aggtggtccagtgcccacaaaggtaaacagctacagctggcaaacgtccaccaacccgag

SEQ ID NO: 10467 - DNA, 60 bp, Artificial Sequence
  Description of Artificial Sequence: Synthetic probe
gtcagaacgtgggtcccgagaccacccagattatgtcaatatcagaaggctggcaacgtg

SEQ ID NO: 10468 - DNA, 60 bp, Artificial Sequence
  Description of Artificial Sequence: Synthetic probe
ggctgctcacgcggctgaaggggaaaccgttcgttacccgactaactacttcgagaaacc

SEQ ID NO: 10469 - DNA, 60 bp, Artificial Sequence
  Description of Artificial Sequence: Synthetic probe
aaagtcaactttgaggaagcaatcttctccaagtacattggtaatgtcaacacacatgta

SEQ ID NO: 10470 - DNA, 60 bp, Artificial Sequence
  Description of Artificial Sequence: Synthetic probe
tggtagtggctgcgttggcggcctgcccatggggcaacccatgggacgcttcaatactga

SEQ ID NO: 10471 - DNA, 60 bp, Artificial Sequence
  Description of Artificial Sequence: Synthetic probe
cgtgggccgggtaactgactatgggttcttaaatctgggcggaacccccacgaagagaat

SEQ ID NO: 10472 - DNA, 60 bp, Artificial Sequence
  Description of Artificial Sequence: Synthetic probe
cggaaccgactactttgggtgtccgtgtttccttccgttcttatactggctgcttatggt

SEQ ID NO: 10473 - DNA, 60 bp, Artificial Sequence
  Description of Artificial Sequence: Synthetic probe
ctaattggtagtcctccggcccctgaatgcggctaatcctaactgcggagcagataccca

SEQ ID NO: 10474 - DNA, 60 bp, Artificial Sequence
  Description of Artificial Sequence: Synthetic probe
aagtctgtggcggaaccgactactttgggtgtccgtgtttctctttatcttatcatggct

SEQ ID NO: 10475 - DNA, 60 bp, Artificial Sequence
  Description of Artificial Sequence: Synthetic probe
tactgggtgatcaacacacggcaagttgctcaactgcgtcggaagctcgaaatgttcacg

SEQ ID NO: 10476 - DNA, 60 bp, Artificial Sequence
  Description of Artificial Sequence: Synthetic probe
attccccacgggcgaccgtggcggtggctgcgttggcggcctgcccatggggtaacccat

SEQ ID NO: 10477 - DNA, 60 bp, Artificial Sequence
  Description of Artificial Sequence: Synthetic probe
ttcccgtcatgctcgatggacatctcatagcgtttgattattcaggctatgacgccagcc

SEQ ID NO: 10478 - DNA, 60 bp, Artificial Sequence
  Description of Artificial Sequence: Synthetic probe
gtcgtaacgcgcaagtctgtggcggaaccgactactttgggtgtccgtgtttcctgttat

SEQ ID NO: 10479 - DNA, 60 bp, Artificial Sequence
  Description of Artificial Sequence: Synthetic probe
gtgaacgaagctgtcttagcaataaacacaagtaaatttcccaatatgtacatacccgtg

SEQ ID NO: 10480 - DNA, 60 bp, Artificial Sequence
  Description of Artificial Sequence: Synthetic probe
gtgaatgaagctgtcttagcaataaacacaagtaaatttcccaatatgtacatacccgtg

SEQ ID NO: 10481 - DNA, 60 bp, Artificial Sequence
  Description of Artificial Sequence: Synthetic probe
ggtccagtgcccacaaaggtaaacagctacagttggcaaacgtccaccaacccgagtgtg

SEQ ID NO: 10482 - DNA, 60 bp, Artificial Sequence
  Description of Artificial Sequence: Synthetic probe
acttgtgcaactcccaccatctgtacagagacaaacactactttgtgagaggaggaatgc

SEQ ID NO: 10483 - DNA, 60 bp, Artificial Sequence
  Description of Artificial Sequence: Synthetic probe
ggtccagtgcccacaaaggtgaacagctacagctggcaaacgtccaccaacccgagtgtg

SEQ ID NO: 10484 - DNA, 60 bp, Artificial Sequence
  Description of Artificial Sequence: Synthetic probe
gtgcagggtccagcgtttgagttcgccgtggcgatgatgaaaagaaacgccagtacagta

SEQ ID NO: 10485 - DNA, 60 bp, Artificial Sequence
  Description of Artificial Sequence: Synthetic probe
gtacagggtccagcgtttgagttcgccgtggcgatgatgaaaagaaacgccagtacagtg

SEQ ID NO: 10486 - DNA, 60 bp, Artificial Sequence
  Description of Artificial Sequence: Synthetic probe
gtgcagggtccagcgtttgagttcgccgtggcgatgatgaaaagaaacgccagtacagtg

SEQ ID NO: 10487 - DNA, 60 bp, Artificial Sequence
  Description of Artificial Sequence: Synthetic probe
ggagctcaagtgtcaacacaaaagaccggagcgcatgagactggcttgagcgccagtggg

SEQ ID NO: 10488 - DNA, 60 bp, Artificial Sequence
  Description of Artificial Sequence: Synthetic probe
ggagctcaagtgtcaacacaaaagaccggagcgcatgagactggcttgagtgccagtggg

SEQ ID NO: 10489 - DNA, 60 bp, Artificial Sequence
  Description of Artificial Sequence: Synthetic probe
atggcatcagcacactaaacaacatggggacactatatatgagacatgtgaatgatgggg

SEQ ID NO: 10490 - DNA, 60 bp, Artificial Sequence
  Description of Artificial Sequence: Synthetic probe
tacggcatcagcacactaaacaacatggggacactatatatgagacatgtgaatgatggg

SEQ ID NO: 10491 - DNA, 56 bp, Artificial Sequence
  Description of Artificial Sequence: Synthetic probe
actccccacgggcgaccgtggcggtggctgcgttggcggcctgcccatggggcaac

SEQ ID NO: 10492 - DNA, 60 bp, Artificial Sequence
  Description of Artificial Sequence: Synthetic probe
cacaccagtgctcacccaccaaataatgtatgtacctccaggtggtccagtgcccacaaa

SEQ ID NO: 10493 - DNA, 60 bp, Artificial Sequence
  Description of Artificial Sequence: Synthetic probe
ttagcaataaacacaagtaaatttcccaatatgtacatacccgtgggccgggtaaccgac

SEQ ID NO: 10494 - DNA, 60 bp, Artificial Sequence
  Description of Artificial Sequence: Synthetic probe
ggaaccgactactttgggtgtccgtgtttccttttatccttatactggctgcttatggtg

SEQ ID NO: 10495 - DNA, 60 bp, Artificial Sequence
  Description of Artificial Sequence: Synthetic probe
ggaaccgactactttgggtgtccgtgtttccttttattcttatattggctgcttatggtg

SEQ ID NO: 10496 - DNA, 60 bp, Artificial Sequence
  Description of Artificial Sequence: Synthetic probe
catacagttcaagtccaaatgccgtattgaacctgtctgtttattgctgcatggaagtcc

SEQ ID NO: 10497 - DNA, 60 bp, Artificial Sequence
  Description of Artificial Sequence: Synthetic probe
tacggtgactcatcgacctgatctacactggggttgtgcggagcgaaacgctgcgcaact

SEQ ID NO: 10498 - DNA, 60 bp, Artificial Sequence
  Description of Artificial Sequence: Synthetic probe
ctgagctagttggtagtcctccggcccctgaatgcggctaatcctaactgcggagcaggt

SEQ ID NO: 10499 - DNA, 60 bp, Artificial Sequence
  Description of Artificial Sequence: Synthetic probe
aacatatggcatcagtacactaaacaacatggggacactatatatgagacacgtgaatgg

SEQ ID NO: 10500 - DNA, 60 bp, Artificial Sequence
  Description of Artificial Sequence: Synthetic probe
agagtctattgagctagttggtagccctccggcccctgaatgcggctaatcctaactgcg

SEQ ID NO: 10501 - DNA, 50 bp, Artificial Sequence
  Description of Artificial Sequence: Synthetic probe
caacacaaccccagtgtagatcaggtcgatgagtcaccgcactcctcacg

SEQ ID NO: 10502 - DNA, 60 bp, Artificial Sequence
  Description of Artificial Sequence: Synthetic probe
gaccaggtagtcggggtattggatgccaaggagctagttgaccaggatgggaccaacctg

SEQ ID NO: 10503 - DNA, 60 bp, Artificial Sequence
  Description of Artificial Sequence: Synthetic probe
caggtcaatgagccaccgcactccccacgggcgaccgtggcggtggctgcgttggcggcc

SEQ ID NO: 10504 - DNA, 60 bp, Artificial Sequence
  Description of Artificial Sequence: Synthetic probe
gcatgttctatgacgggtgggccaggtttgacaagcaagggacatatggcatcagcacac

SEQ ID NO: 10505 - DNA, 60 bp, Artificial Sequence
  Description of Artificial Sequence: Synthetic probe
tacagcatgttctatgacgggtgggccaggtttgacaagcaagggacatacggcatcagc

SEQ ID NO: 10506 - DNA, 60 bp, Artificial Sequence
  Description of Artificial Sequence: Synthetic probe
aatgcgcaagtccgtggcggaaccgactactttgggtgtccgtgtttccttttattttta

SEQ ID NO: 10507 - DNA, 60 bp, Artificial Sequence
  Description of Artificial Sequence: Synthetic probe
ctcacccaccaaataatgtatgtacctccaggtggtccagtgcccacgaaggtaaacagc

SEQ ID NO: 10508 - DNA, 60 bp, Artificial Sequence
  Description of Artificial Sequence: Synthetic probe
ggtaacctggacaaacgtgaccttcctgaaaaggtactttagggcagatgaacagtaccc

SEQ ID NO: 10509 - DNA, 60 bp, Artificial Sequence
  Description of Artificial Sequence: Synthetic probe
agtcctccggcccctgaatgcggctaatcccaactgtggagcagatacccacacaccagt

SEQ ID NO: 10510 - DNA, 60 bp, Artificial Sequence
  Description of Artificial Sequence: Synthetic probe
agtcctccggcccctgaatgcggctaatcccaactgcggagcagatacccacataccagt

SEQ ID NO: 10511 - DNA, 60 bp, Artificial Sequence
  Description of Artificial Sequence: Synthetic probe
tactgggtgatcaacacgcggcaagttgctcaactgcgtcggaagctcgaaatgttcacg

SEQ ID NO: 10512 - DNA, 60 bp, Artificial Sequence
  Description of Artificial Sequence: Synthetic probe
ttagtaatcctccggcccctgaatgcggctaatcccaactgcggaacacattcccacaaa

SEQ ID NO: 10513 - DNA, 60 bp, Artificial Sequence
  Description of Artificial Sequence: Synthetic probe
tatgtacatacccgtgggccgggtaaccgactatgggttcttaaatctgggtggaacccc

SEQ ID NO: 10514 - DNA, 60 bp, Artificial Sequence
  Description of Artificial Sequence: Synthetic probe
ctagttggtagtcctccggcccctgaatgcggctaatcctaactgcggagcacatacccc

SEQ ID NO: 10515 - DNA, 58 bp, Artificial Sequence
  Description of Artificial Sequence: Synthetic probe
aatgcgcaagtccgtggcggaaccgactactttgggtgtccgtgtttccttttatttt

SEQ ID NO: 10516 - DNA, 60 bp, Artificial Sequence
  Description of Artificial Sequence: Synthetic probe
gccctaaccgccgcagagacagggcacacgtcacaggttgtaccatcagacacaatgcaa

SEQ ID NO: 10517 - DNA, 60 bp, Artificial Sequence
  Description of Artificial Sequence: Synthetic probe
gccctaaccgccgcagagacagggcacacgtcacaggttgtaccatcagatacaatgcag

SEQ ID NO: 10518 - DNA, 60 bp, Artificial Sequence
  Description of Artificial Sequence: Synthetic probe
cagccctaaccgccgcagagacagggcacacgtcacaggttgtaccatcagacacaatgc

SEQ ID NO: 10519 - DNA, 60 bp, Artificial Sequence
  Description of Artificial Sequence: Synthetic probe
ttggcaaacgtccaccaacccgagtgtgttctggacagaaggaaacgccccgcctcggat

SEQ ID NO: 10520 - DNA, 59 bp, Artificial Sequence
  Description of Artificial Sequence: Synthetic probe
ggcctgtcgtaatgcgcaagtctgcggcggaaccgactactttgggtgtccgtgtttcc

SEQ ID NO: 10521 - DNA, 60 bp, Artificial Sequence
  Description of Artificial Sequence: Synthetic probe
agcactgcccccgtgtagatcaggtcgatgagtcaccgcaatccccacgggcgaccgtgg

SEQ ID NO: 10522 - DNA, 60 bp, Artificial Sequence
  Description of Artificial Sequence: Synthetic probe
cgtggcggtggctgcgttggcggcctgcctatggggcaacccatgggacgcttcaatact

SEQ ID NO: 10523 - DNA, 60 bp, Artificial Sequence
  Description of Artificial Sequence: Synthetic probe
ctagcactcaggagcaatccaccactcaaggccaagacacatcagtgctcacccaccaaa

SEQ ID NO: 10524 - DNA, 60 bp, Artificial Sequence
  Description of Artificial Sequence: Synthetic probe
aaaggtgaacagctacagctggcaaacgtccaccaacccgagtgtgttctggacggaagg

SEQ ID NO: 10525 - DNA, 60 bp, Artificial Sequence
  Description of Artificial Sequence: Synthetic probe
ggtgtgaagagcctattgagctacataagaatcctccggcccctgaatgcggctaatccc

SEQ ID NO: 10526 - DNA, 60 bp, Artificial Sequence
  Description of Artificial Sequence: Synthetic probe
ggtgtgaagagcctattgagctaccaaagaatcctccggcccctgaatgcggctaatcct

SEQ ID NO: 10527 - DNA, 60 bp, Artificial Sequence
  Description of Artificial Sequence: Synthetic probe
ggtgtgaagagcctactgagctacatgagaatcctccggcccctgaatgcggctaatccc

SEQ ID NO: 10528 - DNA, 60 bp, Artificial Sequence
  Description of Artificial Sequence: Synthetic probe
gcgctcgctgtgcctattggcctggcacaacggggagcacgaatatgaggaattcattcg

SEQ ID NO: 10529 - DNA, 60 bp, Artificial Sequence
  Description of Artificial Sequence: Synthetic probe
accatgtgcgctcgctgtgcctattggcctggcacaacggggagcacgaatatgaggaat

SEQ ID NO: 10530 - DNA, 60 bp, Artificial Sequence
  Description of Artificial Sequence: Synthetic probe
tagatcaggtcgatgagtcaccgcattccccacgggcgaccgtggcggtggctgcgttgg

SEQ ID NO: 10531 - DNA, 60 bp, Artificial Sequence
  Description of Artificial Sequence: Synthetic probe
tgtcgtaatgggcaactctgcagcggaaccgactactttgggtgtccgtgtttcctttta

SEQ ID NO: 10532 - DNA, 53 bp, Artificial Sequence
  Description of Artificial Sequence: Synthetic probe
gcaagtctgtggcggaaccgactactttgggtgtccgtgtttcctgttatttt

SEQ ID NO: 10533 - DNA, 60 bp, Artificial Sequence
  Description of Artificial Sequence: Synthetic probe
ttcgacaagcagggaacatatggcatcagtacactaaataacatggggacactatatatg

SEQ ID NO: 10534 - DNA, 60 bp, Artificial Sequence
  Description of Artificial Sequence: Synthetic probe
gtgaacgaagctgtcctagcaataaacacaagtaaatttcccaatatgtacatacccgtg

SEQ ID NO: 10535 - DNA, 60 bp, Artificial Sequence
  Description of Artificial Sequence: Synthetic probe
ggcaatgaggcagacatttggacacctatacaaggcttttcacctcaacccgggcatcgt

SEQ ID NO: 10536 - DNA, 60 bp, Artificial Sequence
  Description of Artificial Sequence: Synthetic probe
ggtgatcaacacacggcaagttgctcaactgcgtcggaagctcgaaatgttcacgtacgc

SEQ ID NO: 10537 - DNA, 60 bp, Artificial Sequence
  Description of Artificial Sequence: Synthetic probe
ctagcactcaggagcaatccaccactcaaggccaagatgcaccagtgctcacccaccaaa

SEQ ID NO: 10538 - DNA, 60 bp, Artificial Sequence
  Description of Artificial Sequence: Synthetic probe
ttactagcactcaggagcaatccaccactcaaggccaagatgcaccagtgctcacccacc

SEQ ID NO: 10539 - DNA, 60 bp, Artificial Sequence
  Description of Artificial Sequence: Synthetic probe
tcaaccgcaacgagaagtttagagacatcaggggattcttagcacgagaggaggtcgaag

SEQ ID NO: 10540 - DNA, 60 bp, Artificial Sequence
  Description of Artificial Sequence: Synthetic probe
ggcaacgcatacagcatgttctatgacgggtgggccaggtttgacaagcaagggacatac

SEQ ID NO: 10541 - DNA, 60 bp, Artificial Sequence
  Description of Artificial Sequence: Synthetic probe
ggcaacgcatacagcatgttctatgacgggtgggccaggtttgacaagcaagggacatat

SEQ ID NO: 10542 - DNA, 52 bp, Artificial Sequence
  Description of Artificial Sequence: Synthetic probe
tcgtaacgggcaactctgcagcggaaccgactactttgggtgtccgtgtttc

SEQ ID NO: 10543 - DNA, 60 bp, Artificial Sequence
  Description of Artificial Sequence: Synthetic probe
ttgtcgtaacgcgcaagtctgtggcggaaccgactactttgggtgtccgtgtttcctgtt

SEQ ID NO: 10544 - DNA, 60 bp, Artificial Sequence
  Description of Artificial Sequence: Synthetic probe
tatgtatatacccgtgggccgggtaaccgactatgggttcttaaatctgggcggaacccc

SEQ ID NO: 10545 - DNA, 60 bp, Artificial Sequence
  Description of Artificial Sequence: Synthetic probe
attccccacgggcgaccgtggcggtggctgcgttggcggcctgcccatggggcaacccat

SEQ ID NO: 10546 - DNA, 60 bp, Artificial Sequence
  Description of Artificial Sequence: Synthetic probe
ggggattcttagcacgagaggaggccgaagtgaacgaagctgtcctagcaataaacacaa

SEQ ID NO: 10547 - DNA, 60 bp, Artificial Sequence
  Description of Artificial Sequence: Synthetic probe
tgtgaagagcctattgagctacaagggagtcctccggcccctgaatgcggctaatcctaa

SEQ ID NO: 10548 - DNA, 60 bp, Artificial Sequence
  Description of Artificial Sequence: Synthetic probe
ctgagacaagctaaagtgcagggtccagcgtttgagttcgccgtggcgatgatgaaaaga

SEQ ID NO: 10549 - DNA, 60 bp, Artificial Sequence
  Description of Artificial Sequence: Synthetic probe
gagtctattgagctaattggtagtcctccggcccctgaatgcggctaatcctaactgcgg

SEQ ID NO: 10550 - DNA, 60 bp, Artificial Sequence
  Description of Artificial Sequence: Synthetic probe
agagtctattgagctaattggtagtcctccggcccctgaatgcggctaatcctaactgcg

SEQ ID NO: 10551 - DNA, 60 bp, Artificial Sequence
  Description of Artificial Sequence: Synthetic probe
cgtaacgcgcaagtctgtggcggaaccgactactttgggtgtccgtgtttccttttattc

SEQ ID NO: 10552 - DNA, 60 bp, Artificial Sequence
  Description of Artificial Sequence: Synthetic probe
aacacaagtagatttcccaatatgtacatacccgtgggccgggtaactgactatgggttc

SEQ ID NO: 10553 - DNA, 60 bp, Artificial Sequence
  Description of Artificial Sequence: Synthetic probe
gaggcagacatttggaaacctatataagactttccacctcaacccaggcatcgttacggg

SEQ ID NO: 10554 - DNA, 60 bp, Artificial Sequence
  Description of Artificial Sequence: Synthetic probe
gggtcccgttcccattgtgagcacagtacgaatttacttcaagccaaagcatgtcaaaac

SEQ ID NO: 10555 - DNA, 58 bp, Artificial Sequence
  Description of Artificial Sequence: Synthetic probe
tgtcgtaacgggcaactctgcagcggaaccgactactttgggtgtccgtgtttccctt

SEQ ID NO: 10556 - DNA, 55 bp, Artificial Sequence
  Description of Artificial Sequence: Synthetic probe
tttctctttatcctcatactggctgcttatggtgacaattgagagattgttacca

SEQ ID NO: 10557 - DNA, 60 bp, Artificial Sequence
  Description of Artificial Sequence: Synthetic probe
ctccacacaaccccagtgtagatcaggtcgatgagtcaccgcaatccccacgggcgaccg

SEQ ID NO: 10558 - DNA, 60 bp, Artificial Sequence
  Description of Artificial Sequence: Synthetic probe
taatgcgtaagtctgtggcggaaccgactactttgggtgtccgtgtttccttttattttt

SEQ ID NO: 10559 - DNA, 60 bp, Artificial Sequence
  Description of Artificial Sequence: Synthetic probe
cggcctgcccatgcggcaacccatgggacgcttcaatactgacatggtgcgaagagtcta

SEQ ID NO: 10560 - DNA, 60 bp, Artificial Sequence
  Description of Artificial Sequence: Synthetic probe
gcggcctgcccatgcggcaacccatgggacgcttcaatactgacatggtgcgaagagtct

SEQ ID NO: 10561 - DNA, 60 bp, Artificial Sequence
  Description of Artificial Sequence: Synthetic probe
gcgaccgtggcggtggctgcgttggcggcctgcctgtggaacaatccacaggacgctcta

SEQ ID NO: 10562 - DNA, 60 bp, Artificial Sequence
  Description of Artificial Sequence: Synthetic probe
tgcaccagtgctcacccaccaaataatgtatgtacctccaggtggtccagtacccacaaa

SEQ ID NO: 10563 - DNA, 58 bp, Artificial Sequence
  Description of Artificial Sequence: Synthetic probe
ccgccgcagagacagggcacacgtcacaagttgtaccatcagacacaatgcaaactag

SEQ ID NO: 10564 - DNA, 60 bp, Artificial Sequence
  Description of Artificial Sequence: Synthetic probe
cacaatgcaaaccagacacgtgaagaattatcactcaagatcggagtcaacagtggagaa

SEQ ID NO: 10565 - DNA, 60 bp, Artificial Sequence
  Description of Artificial Sequence: Synthetic probe
gactattcaggttatgacgccagcctcagcccagtgtggtttacgtgcttgaaactcctc

SEQ ID NO: 10566 - DNA, 60 bp, Artificial Sequence
  Description of Artificial Sequence: Synthetic probe
atccaagaagaccaaagacctcactaagttaaaggaatgcatggataaatatggtctaaa

SEQ ID NO: 10567 - DNA, 60 bp, Artificial Sequence
  Description of Artificial Sequence: Synthetic probe
gacatttggaaacctatataagactttccacctcaacccgggcaccgttacgggtagcgc

SEQ ID NO: 10568 - DNA, 60 bp, Artificial Sequence
  Description of Artificial Sequence: Synthetic probe
gactcagtagctatgaggcagacgtttggaaacctatataagactttccacctcaacccg

SEQ ID NO: 10569 - DNA, 60 bp, Artificial Sequence
  Description of Artificial Sequence: Synthetic probe
attgagctacgcaagagtcctccggcccctgaatgcggctaatcccaaccacggagcaag

SEQ ID NO: 10570 - DNA, 60 bp, Artificial Sequence
  Description of Artificial Sequence: Synthetic probe
tacccacaaaggtaaacagctacagctggcaaacgtccaccaacccgagtgtgttctgga

SEQ ID NO: 10571 - DNA, 60 bp, Artificial Sequence
  Description of Artificial Sequence: Synthetic probe
atggcatcagcacactaaataacatggggacactatatatgagacacgtgaatggtgggg

SEQ ID NO: 10572 - DNA, 60 bp, Artificial Sequence
  Description of Artificial Sequence: Synthetic probe
ttcccgaatatgtacatacccgtgggccgggtaaccgactatgggttcttaaatctgggt

SEQ ID NO: 10573 - DNA, 60 bp, Artificial Sequence
  Description of Artificial Sequence: Synthetic probe
gtgatcaacacacggcaagttgctcaactgcgtcggaagctcgaactgttcacgtacgca

SEQ ID NO: 10574 - DNA, 60 bp, Artificial Sequence
  Description of Artificial Sequence: Synthetic probe
gtgcgaacagtctactgagctagttggtagtcctccggcccctgaatgcggctaatccta

SEQ ID NO: 10575 - DNA, 52 bp, Artificial Sequence
  Description of Artificial Sequence: Synthetic probe
atgtaggggggaatggacaccaggggttctcagcggcactcctcagacacta

SEQ ID NO: 10576 - DNA, 52 bp, Artificial Sequence
  Description of Artificial Sequence: Synthetic probe
atgtaggagggaatggacaccaggggttctcagcggcactcctcagacacta

SEQ ID NO: 10577 - DNA, 60 bp, Artificial Sequence
  Description of Artificial Sequence: Synthetic probe
gcaacccatgggacgcttcaatactgacatggtgcgaagagtctattgagctaattggta

SEQ ID NO: 10578 - DNA, 60 bp, Artificial Sequence
  Description of Artificial Sequence: Synthetic probe
cgtggcggtggctgcgttggcggcctgcctgtggaacaatccacaggacgctctaataca

SEQ ID NO: 10579 - DNA, 60 bp, Artificial Sequence
  Description of Artificial Sequence: Synthetic probe
gtggctgcgttggcggcctgcccatggggcaacccatgggacgcttcaatactgacatgg

SEQ ID NO: 10580 - DNA, 60 bp, Artificial Sequence
  Description of Artificial Sequence: Synthetic probe
gtgacggaaggaatcattgcccgcgtcgctgataccgtagggagtggaccagtcaactcg

SEQ ID NO: 10581 - DNA, 60 bp, Artificial Sequence
  Description of Artificial Sequence: Synthetic probe
ggagtgacggaaggaatcattgcccgcgtcgctgataccgtagggagtggaccagtcaac

SEQ ID NO: 10582 - DNA, 60 bp, Artificial Sequence
  Description of Artificial Sequence: Synthetic probe
accgtggcggtggctgcgttggcggcctgcccatggggcaacccatgggacgctacaata

SEQ ID NO: 10583 - DNA, 60 bp, Artificial Sequence
  Description of Artificial Sequence: Synthetic probe
tccaaggcgcttacacagggatgcctaatcagaagcccaaggtgcccaccctgagacaag

SEQ ID NO: 10584 - DNA, 60 bp, Artificial Sequence
  Description of Artificial Sequence: Synthetic probe
caaaccagtgggtagtgtgtcgtaacgggcaactctgcagcggaaccgactactttgggt

SEQ ID NO: 10585 - DNA, 59 bp, Artificial Sequence
  Description of Artificial Sequence: Synthetic probe
taatgcgtaagtctgtggcggaaccgactactttgggtgtccgtgtttccttttatttt

SEQ ID NO: 10586 - DNA, 54 bp, Artificial Sequence
  Description of Artificial Sequence: Synthetic probe
ctagttggtagtcctccggcccctgaatgcggctaatcccaactgcggagcatg

SEQ ID NO: 10587 - DNA, 60 bp, Artificial Sequence
  Description of Artificial Sequence: Synthetic probe
tatgtacatacctgtgggccgggtaaccgactatgggttcttaaatctgggtggaacccc

SEQ ID NO: 10588 - DNA, 60 bp, Artificial Sequence
  Description of Artificial Sequence: Synthetic probe
gcaagtccgtggcggaaccgactactttgggtgtccgtgtttccttttatctttattatg

SEQ ID NO: 10589 - DNA, 60 bp, Artificial Sequence
  Description of Artificial Sequence: Synthetic probe
ggggtcccggtcccattgtgagtacagtacgaatttacttcaagccaaagcacgtcaaaa

SEQ ID NO: 10590 - DNA, 54 bp, Artificial Sequence
  Description of Artificial Sequence: Synthetic probe
ggcacacgtcacaggttgtgccatcagacacaatgcaaactaggcatgtgaaga

SEQ ID NO: 10591 - DNA, 60 bp, Artificial Sequence
  Description of Artificial Sequence: Synthetic probe
attgagctacatgagagtcctccggcccctgaatgcggctaatcccaaccacggagcaga

SEQ ID NO: 10592 - DNA, 60 bp, Artificial Sequence
  Description of Artificial Sequence: Synthetic probe
tgtttcgctccgcacaaccccagtgtagatcaggtcgatgagtcaccgcaaaccccacgg

SEQ ID NO: 10593 - DNA, 60 bp, Artificial Sequence
  Description of Artificial Sequence: Synthetic probe
agtcctccggcccctgaatgcggctaatcctaactgcggagcacatgcccacaaaccagt

SEQ ID NO: 10594 - DNA, 60 bp, Artificial Sequence
  Description of Artificial Sequence: Synthetic probe
ggtgtgaagagcctattgagctacaagagagtcctccggcccctgaatgcggctaatccc

SEQ ID NO: 10595 - DNA, 60 bp, Artificial Sequence
  Description of Artificial Sequence: Synthetic probe
ggtgtgaagagcctattgagctacatgagagtcctccggcccctgaatgcggctaatccc

SEQ ID NO: 10596 - DNA, 60 bp, Artificial Sequence
  Description of Artificial Sequence: Synthetic probe
gaaaagaaaatgagcaattacatacagttcaagtccaaatgccgtattgaacccgtctgc

SEQ ID NO: 10597 - DNA, 60 bp, Artificial Sequence
  Description of Artificial Sequence: Synthetic probe
atcctccggcccctgaatgcggctaatcccaactgcggagcacattcccacaaaccagtg

SEQ ID NO: 10598 - DNA, 60 bp, Artificial Sequence
  Description of Artificial Sequence: Synthetic probe
ggccgggtgaccgactatgggtttttaaatctgggtggaacccccacgaagagaatgctc

SEQ ID NO: 10599 - DNA, 59 bp, Artificial Sequence
  Description of Artificial Sequence: Synthetic probe
agctaattggtagtcctccggcccctgaatgcggctaatcctaactgcggagcagatac

SEQ ID NO: 10600 - DNA, 51 bp, Artificial Sequence
  Description of Artificial Sequence: Synthetic probe
cacggcaagtcgctcaactgcgtcggaagctcgaaatgttcacgtacgcaa

SEQ ID NO: 10601 - DNA, 60 bp, Artificial Sequence
  Description of Artificial Sequence: Synthetic probe
cggcctgcccatggggcaacccatgggacgcttcaatactgacatggtgcgaagagtcta

SEQ ID NO: 10602 - DNA, 60 bp, Artificial Sequence
  Description of Artificial Sequence: Synthetic probe
gtgctcacccaccaaataatgtatgtacctccaggtggcccagtgcccacaaaggtgaac

SEQ ID NO: 10603 - DNA, 60 bp, Artificial Sequence
  Description of Artificial Sequence: Synthetic probe
gtgctcacccaccaaataatgtatgtacctccaggtggcccagtgcccacaaaggtaaac

SEQ ID NO: 10604 - DNA, 60 bp, Artificial Sequence
  Description of Artificial Sequence: Synthetic probe
gtgctcacccaccaaataatgtatgtacctccaggtggtccagtgcccacgaaggtaaac

SEQ ID NO: 10605 - DNA, 60 bp, Artificial Sequence
  Description of Artificial Sequence: Synthetic probe
cgtaacgcgtaagtctgtggcggaaccgactactttgggtgtccgtgtttccttttattt

SEQ ID NO: 10606 - DNA, 60 bp, Artificial Sequence
  Description of Artificial Sequence: Synthetic probe
cagtacggatttatttcaagccaaagcacgtcaaaacgtgggtcccgagaccacccagat

SEQ ID NO: 10607 - DNA, 53 bp, Artificial Sequence
  Description of Artificial Sequence: Synthetic probe
gtagctgataccgtagggagtggacctgtcaactcggagtccatgccggctct

SEQ ID NO: 10608 - DNA, 60 bp, Artificial Sequence
  Description of Artificial Sequence: Synthetic probe
gggcaacccatgggacgcttcaatactgacatggtgcgaagagtctattgagctaattgg

SEQ ID NO: 10609 - DNA, 60 bp, Artificial Sequence
  Description of Artificial Sequence: Synthetic probe
tacagctggcaaacatccactaacccgagtgtgttctggacggaagggagcgcaccgcct

SEQ ID NO: 10610 - DNA, 60 bp, Artificial Sequence
  Description of Artificial Sequence: Synthetic probe
acagctacagctggcaaacgtccacaaacccgagtgtgttctggacggaagggagcgcac

SEQ ID NO: 10611 - DNA, 60 bp, Artificial Sequence
  Description of Artificial Sequence: Synthetic probe
acagttacagttggcaaacgtccaccaacccgagtgtgttctggacagaaggaaacgccc

SEQ ID NO: 10612 - DNA, 60 bp, Artificial Sequence
  Description of Artificial Sequence: Synthetic probe
gttgcgtagtgtttcgctccgcacaaccccagtgtagatcaggtcgatgagtcaccgcat

SEQ ID NO: 10613 - DNA, 60 bp, Artificial Sequence
  Description of Artificial Sequence: Synthetic probe
agtgtttcgctccgcacaaccccagtgtagatcaggtcgatgagtcaccgcattccccac

SEQ ID NO: 10614 - DNA, 60 bp, Artificial Sequence
  Description of Artificial Sequence: Synthetic probe
cgaagagtctattgagctaattggtagtcctccggcccctgaatgcggctaatcccaact

SEQ ID NO: 10615 - DNA, 54 bp, Artificial Sequence
  Description of Artificial Sequence: Synthetic probe
ggcacacgtcacaagttgtaccatcagacacaatgcaaactaggcatgtgaaga

SEQ ID NO: 10616 - DNA, 60 bp, Artificial Sequence
  Description of Artificial Sequence: Synthetic probe
cctccctgcgttttcaacgctgcgcaggaagtggctggactccttttaaaactagagcac

SEQ ID NO: 10617 - DNA, 60 bp, Artificial Sequence
  Description of Artificial Sequence: Synthetic probe
cacggcaagttgctcaactgcgtcggaagctcgaaatgttcacgtacgcaagatttgatc

SEQ ID NO: 10618 - DNA, 60 bp, Artificial Sequence
  Description of Artificial Sequence: Synthetic probe
acacggcaagttgctcaactgcgtcggaagctcgaaatgttcacgtacgcaagatttgat

SEQ ID NO: 10619 - DNA, 60 bp, Artificial Sequence
  Description of Artificial Sequence: Synthetic probe
gtgtgaagagtctattgagctagttagtagtcctccggcccctgaatgcggctaatccta

SEQ ID NO: 10620 - DNA, 60 bp, Artificial Sequence
  Description of Artificial Sequence: Synthetic probe
gaagctgtcttagcaataaacacaagtaaattcccaaatatgtatatacccgtgggccgg

SEQ ID NO: 10621 - DNA, 60 bp, Artificial Sequence
  Description of Artificial Sequence: Synthetic probe
cccgggcatcgttacgggtagcgccgttgggtgtgacccagatgtcttttggagcaagat

SEQ ID NO: 10622 - DNA, 60 bp, Artificial Sequence
  Description of Artificial Sequence: Synthetic probe
ctcaacccaggcatcgttacgggtagcgccgttgggtgtgacccagatgtcttttggagc

SEQ ID NO: 10623 - DNA, 60 bp, Artificial Sequence
  Description of Artificial Sequence: Synthetic probe
cctcaacccaggcatcgttacgggtagcgccgttgggtgtgacccagatgtcttttggag

SEQ ID NO: 10624 - DNA, 60 bp, Artificial Sequence
  Description of Artificial Sequence: Synthetic probe
aaacacgagtaaattcccgaatatgtacatacccgtgggccgggtaaccgactacgggtt

SEQ ID NO: 10625 - DNA, 60 bp, Artificial Sequence
  Description of Artificial Sequence: Synthetic probe
ataaacacaagcaaattcccgaatatgtacatacccgtgggccgggtaaccgactatggg

SEQ ID NO: 10626 - DNA, 60 bp, Artificial Sequence
  Description of Artificial Sequence: Synthetic probe
tggcaaacgtccaccaacccgagtgtgttctggacagaaggaaacgctccacctcggatg

SEQ ID NO: 10627 - DNA, 58 bp, Artificial Sequence
  Description of Artificial Sequence: Synthetic probe
ccccacgggcgaccgtggcggtggctgcgttggcggcctgcctatgggtcaacccata

SEQ ID NO: 10628 - DNA, 60 bp, Artificial Sequence
  Description of Artificial Sequence: Synthetic probe
gctaattggtagtcctccggcccctgaatgcggctaatcccaactgcggagcagattccc

SEQ ID NO: 10629 - DNA, 60 bp, Artificial Sequence
  Description of Artificial Sequence: Synthetic probe
ccgcagagacagggcacacgtcacaagttgtaccatcagacacaatgcaaaccagacacg

SEQ ID NO: 10630 - DNA, 60 bp, Artificial Sequence
  Description of Artificial Sequence: Synthetic probe
ggaaccgactactttgggtgtccgtgtttccttttattcttactttggctgcttatggtg

SEQ ID NO: 10631 - DNA, 50 bp, Artificial Sequence
  Description of Artificial Sequence: Synthetic probe
tagactacctctgtaattcccaccacctgtacagggacaaacactacttc

SEQ ID NO: 10632 - DNA, 60 bp, Artificial Sequence
  Description of Artificial Sequence: Synthetic probe
ggtgcgaagagtctattgagctaccaaagagtcctccggcccctgaatgcggctaatccc

SEQ ID NO: 10633 - DNA, 60 bp, Artificial Sequence
  Description of Artificial Sequence: Synthetic probe
gatgagttaagatctgctgagaaggtggctaagggaaagtccagactcatcgaggcctct

SEQ ID NO: 10634 - DNA, 60 bp, Artificial Sequence
  Description of Artificial Sequence: Synthetic probe
gactcagtagcaatgaggcagacatttggaaacctatataagactttccacctcaacccg

SEQ ID NO: 10635 - DNA, 60 bp, Artificial Sequence
  Description of Artificial Sequence: Synthetic probe
gactcggtagcaatgaggcagacatttggaaacctatataagactttccacctcaaccca

SEQ ID NO: 10636 - DNA, 60 bp, Artificial Sequence
  Description of Artificial Sequence: Synthetic probe
gacatgtgaatgatgggggtcccggtcccattgtgagtacagtacgaatttacttcaagc

SEQ ID NO: 10637 - DNA, 59 bp, Artificial Sequence
  Description of Artificial Sequence: Synthetic probe
tccccacgggcgaccgtggcggtggctgcgttggcggcctgcccatgggagatcccatg

SEQ ID NO: 10638 - DNA, 60 bp, Artificial Sequence
  Description of Artificial Sequence: Synthetic probe
ccggcccctgaatgcggctaatcccaactgcggaacacattcccacaaaccactgggtag

SEQ ID NO: 10639 - DNA, 60 bp, Artificial Sequence
  Description of Artificial Sequence: Synthetic probe
gcctaatcagaggcctaaggtgcccaccctgagacaagccaaagtgcagggaccagcgtt

SEQ ID NO: 10640 - DNA, 60 bp, Artificial Sequence
  Description of Artificial Sequence: Synthetic probe
gaggcagacatttggaaacctatataagacttttcacctcaacccaggcattgttacggg

SEQ ID NO: 10641 - DNA, 60 bp, Artificial Sequence
  Description of Artificial Sequence: Synthetic probe
ctagcactcaggagcaatctaccactcaaggccaagatacacctgtgctcacccaccaaa

SEQ ID NO: 10642 - DNA, 60 bp, Artificial Sequence
  Description of Artificial Sequence: Synthetic probe
actttcgtaattactagcactcaggagcaatctaccactcaaggccaagatacacctgtg

SEQ ID NO: 10643 - DNA, 60 bp, Artificial Sequence
  Description of Artificial Sequence: Synthetic probe
cccacaaaccagtgggtggtgtgtcgtaacgggcaactctgcagcggaaccgactacttt

SEQ ID NO: 10644 - DNA, 58 bp, Artificial Sequence
  Description of Artificial Sequence: Synthetic probe
caatccccacgggcgaccgtggcggtggctgcgttggcggcctgcctatggggaaacc

SEQ ID NO: 10645 - DNA, 60 bp, Artificial Sequence
  Description of Artificial Sequence: Synthetic probe
tgggtggaacccccacgaagagaatgctcatgtacaatttcccaactagggcaggccagt

SEQ ID NO: 10646 - DNA, 60 bp, Artificial Sequence
  Description of Artificial Sequence: Synthetic probe
aatctgggtggaacccccacgaagagaatgctcatgtacaatttcccaactagggcaggc

SEQ ID NO: 10647 - DNA, 60 bp, Artificial Sequence
  Description of Artificial Sequence: Synthetic probe
gagaagagtctattgagctagttggtagtcctccggcccctgaatgcggctaatcctaac

SEQ ID NO: 10648 - DNA, 60 bp, Artificial Sequence
  Description of Artificial Sequence: Synthetic probe
gcacgggaggaggttgaagtgaacgaagctgtcctagcaataaacacaagcaaattccct

SEQ ID NO: 10649 - DNA, 60 bp, Artificial Sequence
  Description of Artificial Sequence: Synthetic probe
ttcccgtcatgctcgatggacatctcatagcgttcgactattcaggttatgacgccagcc

SEQ ID NO: 10650 - DNA, 60 bp, Artificial Sequence
  Description of Artificial Sequence: Synthetic probe
gagcaagattcccgtcatgctcgatggacatctcatagcgtttgactactcaggttatga

SEQ ID NO: 10651 - DNA, 60 bp, Artificial Sequence
  Description of Artificial Sequence: Synthetic probe
tcttttggagcaagattcccgtcatgctcgatggacatctcatagcgttcgactattcag

SEQ ID NO: 10652 - DNA, 58 bp, Artificial Sequence
  Description of Artificial Sequence: Synthetic probe
tgtgaagagcctattgagctacatgagagtcctccggcccctgaatgcggctaatcct

SEQ ID NO: 10653 - DNA, 60 bp, Artificial Sequence
  Description of Artificial Sequence: Synthetic probe
ggggttcttggcacgagaggaaaccgaagtgaacgaagctgtcctagcaataaacacaag

SEQ ID NO: 10654 - DNA, 60 bp, Artificial Sequence
  Description of Artificial Sequence: Synthetic probe
ttttatttatccttatactggctgcttatggtgacaattgagagattgttaccatatagc

SEQ ID NO: 10655 - DNA, 60 bp, Artificial Sequence
  Description of Artificial Sequence: Synthetic probe
gggtagcgtgtcgtaacgggtaactccgcagcggaaccgactactttgggtgtccgtgtt

SEQ ID NO: 10656 - DNA, 60 bp, Artificial Sequence
  Description of Artificial Sequence: Synthetic probe
gtctgtcgtaacgggtaactctgcagcggaaccgactactttgggtgtccgtgtttcctt

SEQ ID NO: 10657 - DNA, 60 bp, Artificial Sequence
  Description of Artificial Sequence: Synthetic probe
gattattcaggctatgacgccagccttagcccagtgtggtttacgtgcttgaaactcctc

SEQ ID NO: 10658 - DNA, 60 bp, Artificial Sequence
  Description of Artificial Sequence: Synthetic probe
gactattcaggctatgacgccagccttagcccagtgtggtttacgtgcttgaaactcctc

SEQ ID NO: 10659 - DNA, 60 bp, Artificial Sequence
  Description of Artificial Sequence: Synthetic probe
gaatttacttcaagccaaagcacgtcaaaacgtgggtcccaagaccgcccagactatgtc

SEQ ID NO: 10660 - DNA, 60 bp, Artificial Sequence
  Description of Artificial Sequence: Synthetic probe
gtttcgctccacacaaccccagtgtagatcaggtcgatgagtcaccgcaatccccacggg

SEQ ID NO: 10661 - DNA, 60 bp, Artificial Sequence
  Description of Artificial Sequence: Synthetic probe
ccaccaacccgagtgtgttttggacggaagggagcgcaccgcctcgaatgtcgataccat

SEQ ID NO: 10662 - DNA, 50 bp, Artificial Sequence
  Description of Artificial Sequence: Synthetic probe
tacacctgtgctcacccaccaaataatgtacgtgccgccaggtggcccag

SEQ ID NO: 10663 - DNA, 60 bp, Artificial Sequence
  Description of Artificial Sequence: Synthetic probe
ctacatacagttcaagtccaaatgccgtattgaacctgtctgtttattgctgcatggaag

SEQ ID NO: 10664 - DNA, 60 bp, Artificial Sequence
  Description of Artificial Sequence: Synthetic probe
gtttgcctgtcgtaacgcgaaagtctgtggcggaaccgactactttgggtgtccgtgttt

SEQ ID NO: 10665 - DNA, 56 bp, Artificial Sequence
  Description of Artificial Sequence: Synthetic probe
ccccacgaagagaatgctcatgtacaatttcccaaccagggcaggccagtgtgggg

SEQ ID NO: 10666 - DNA, 60 bp, Artificial Sequence
  Description of Artificial Sequence: Synthetic probe
cccccacgaagagaatgctcatgtacaatttcccaaccagggcaggccagtgtgggggtg

SEQ ID NO: 10667 - DNA, 60 bp, Artificial Sequence
  Description of Artificial Sequence: Synthetic probe
ctcgcatcacttgtacagggacaagcactactttgtgagaggcggcatgccgtcaggatg

SEQ ID NO: 10668 - DNA, 59 bp, Artificial Sequence
  Description of Artificial Sequence: Synthetic probe
acaacatcataatcagaactctcatgctgaaggtctataaaggcattgatttggaccaa

SEQ ID NO: 10669 - DNA, 60 bp, Artificial Sequence
  Description of Artificial Sequence: Synthetic probe
ctacatagactacctctgtaattcccaccacctgtacagggacaagcactactttgtgag

SEQ ID NO: 10670 - DNA, 60 bp, Artificial Sequence
  Description of Artificial Sequence: Synthetic probe
ccagatgtgttttggagcaagatccccgtcatgctcgatggacatctcatagcttttgac

SEQ ID NO: 10671 - DNA, 60 bp, Artificial Sequence
  Description of Artificial Sequence: Synthetic probe
gacccagatgtgttttggagcaagatccccgtcatgctcgatggacatctcatagctttt

SEQ ID NO: 10672 - DNA, 60 bp, Artificial Sequence
  Description of Artificial Sequence: Synthetic probe
aaacgtccaccaacccgagtgtgttctggacggaagggagcgcaccgccccgaatgtcaa

SEQ ID NO: 10673 - DNA, 55 bp, Artificial Sequence
  Description of Artificial Sequence: Synthetic probe
tcactcagcacattcccagtgtagatcaggtcgatgagtcaccgcattccccacg

SEQ ID NO: 10674 - DNA, 60 bp, Artificial Sequence
  Description of Artificial Sequence: Synthetic probe
ctattcaggttatgacgccagcctcagcccagtgtggtttgcgtgcttgaaactccttct

SEQ ID NO: 10675 - DNA, 60 bp, Artificial Sequence
  Description of Artificial Sequence: Synthetic probe
atggcatcagtacactaaacaacatggggacactatatatgagacacgtgaatggtgggg

SEQ ID NO: 10676 - DNA, 60 bp, Artificial Sequence
  Description of Artificial Sequence: Synthetic probe
atgagtcaccgcaatccccacgggcgaccgtggcggtggctgcgctggcggcctgcccat

SEQ ID NO: 10677 - DNA, 60 bp, Artificial Sequence
  Description of Artificial Sequence: Synthetic probe
ttccccacgggcgaccgtggcggtggctgcgttggcggcctgcctatgggataacccata

SEQ ID NO: 10678 - DNA, 60 bp, Artificial Sequence
  Description of Artificial Sequence: Synthetic probe
ttcccgtcatgctcgatggacatctcatagcgtttgactattcaggctatgacgccagcc

SEQ ID NO: 10679 - DNA, 60 bp, Artificial Sequence
  Description of Artificial Sequence: Synthetic probe
ttcccgtcatgctcgatggacatctcatagcgtttgactattcaggttatgacgccagcc

SEQ ID NO: 10680 - DNA, 60 bp, Artificial Sequence
  Description of Artificial Sequence: Synthetic probe
tggagcaagattcccgtcatgctcgatggacatctcatagcgtttgactattcaggctat

SEQ ID NO: 10681 - DNA, 60 bp, Artificial Sequence
  Description of Artificial Sequence: Synthetic probe
tcttttggagcaagattcccgtcatgctcgatggacatctcatagcgtttgactattcag

SEQ ID NO: 10682 - DNA, 60 bp, Artificial Sequence
  Description of Artificial Sequence: Synthetic probe
ctcctcacgggcgaccgtggcggtggctgcgttggcggcctgcctgcggggcaacccgca

SEQ ID NO: 10683 - DNA, 50 bp, Artificial Sequence
  Description of Artificial Sequence: Synthetic probe
ctgtggcggaaccgactactttgggtgtccgtgtttcccttttactttat

SEQ ID NO: 10684 - DNA, 60 bp, Artificial Sequence
  Description of Artificial Sequence: Synthetic probe
ggtgtgaagagtctattgagctaattggtagtcctccggcccctgaatgcggctaatccc

SEQ ID NO: 10685 - DNA, 60 bp, Artificial Sequence
  Description of Artificial Sequence: Synthetic probe
ggtgcgaagagtctattgagctaattggtagtcctccggcccctgaatgcggctaatccc

SEQ ID NO: 10686 - DNA, 60 bp, Artificial Sequence
  Description of Artificial Sequence: Synthetic probe
tggtgcgaagagtctattgagctaattggtagtcctccggcccctgaatgcggctaatcc

SEQ ID NO: 10687 - DNA, 60 bp, Artificial Sequence
  Description of Artificial Sequence: Synthetic probe
gcataggcaacgcatacagcatgttctatgatggttggtctgagtttagacacgatggtg

SEQ ID NO: 10688 - DNA, 60 bp, Artificial Sequence
  Description of Artificial Sequence: Synthetic probe
gagcataggcaacgcatacagcatgttctatgatggttggtctgagtttagacacgatgg

SEQ ID NO: 10689 - DNA, 60 bp, Artificial Sequence
  Description of Artificial Sequence: Synthetic probe
tggcggtggctgcgctggcggcctgcccatggggcaacccatgggacgctacaatactga

SEQ ID NO: 10690 - DNA, 60 bp, Artificial Sequence
  Description of Artificial Sequence: Synthetic probe
tccccacgggcgaccgtggcggtggctgcgttggcggcctgcctgtggggcaacccacag

SEQ ID NO: 10691 - DNA, 60 bp, Artificial Sequence
  Description of Artificial Sequence: Synthetic probe
tccaaggcgcatacacagggatgcctaatcagaagcccaaggtgcctaccctgagacaag

SEQ ID NO: 10692 - DNA, 60 bp, Artificial Sequence
  Description of Artificial Sequence: Synthetic probe
ggcggtatgccatcaggatgttcaggcaccagcatatttaattccatgatcaacaacatt

SEQ ID NO: 10693 - DNA, 60 bp, Artificial Sequence
  Description of Artificial Sequence: Synthetic probe
cagagacaaacactactttgtgaggggcggtatgccatcaggatgttcaggcaccagcat

SEQ ID NO: 10694 - DNA, 60 bp, Artificial Sequence
  Description of Artificial Sequence: Synthetic probe
cgggcgaccgtggcggtggctgcgttggcggcctgcccatggggcaacccatgggacgct

SEQ ID NO: 10695 - DNA, 60 bp, Artificial Sequence
  Description of Artificial Sequence: Synthetic probe
tccaaggcgcatacacagggatgcctaatcagaagcccaaggtgcccaccctgagacaag

SEQ ID NO: 10696 - DNA, 60 bp, Artificial Sequence
  Description of Artificial Sequence: Synthetic probe
agtccgtggcggaaccgactactttgggtgtccgtgtttccttttatctttattatggct

SEQ ID NO: 10697 - DNA, 60 bp, Artificial Sequence
  Description of Artificial Sequence: Synthetic probe
atgggagctcaggtgtcaacacaaaagactggagcacatgagactggtctaaacgccagt

SEQ ID NO: 10698 - DNA, 60 bp, Artificial Sequence
  Description of Artificial Sequence: Synthetic probe
atgggagctcaggtgtcaacacaaaagactggagcacacgagactggcttaagcgctagt

SEQ ID NO: 10699 - DNA, 60 bp, Artificial Sequence
  Description of Artificial Sequence: Synthetic probe
aaggttgcgcagcgtttcgctccgcacaaccccagtgtagatcaggtcgatgagtcaccg

SEQ ID NO: 10700 - DNA, 60 bp, Artificial Sequence
  Description of Artificial Sequence: Synthetic probe
ggtgtgaagagcctattgagctacctaagagtcctccggcccctgaatgcggctaatcct

SEQ ID NO: 10701 - DNA, 60 bp, Artificial Sequence
  Description of Artificial Sequence: Synthetic probe
ggtgtgaagagcctattgagctaccaaagagtcctccggcccctgaatgcggctaatcct

SEQ ID NO: 10702 - DNA, 60 bp, Artificial Sequence
  Description of Artificial Sequence: Synthetic probe
ctctaatacagacatggtgcgaagagtctattgagctagttaagtaatcctccggcccct

SEQ ID NO: 10703 - DNA, 60 bp, Artificial Sequence
  Description of Artificial Sequence: Synthetic probe
ggggaaatccaggctcattgaggcttccagccttaacgactcagtggcaatgaggcaaac

SEQ ID NO: 10704 - DNA, 60 bp, Artificial Sequence
  Description of Artificial Sequence: Synthetic probe
aaggggaaatccaggctcattgaggcttccagccttaacgactcagtggcaatgaggcaa

SEQ ID NO: 10705 - DNA, 60 bp, Artificial Sequence
  Description of Artificial Sequence: Synthetic probe
gcatgtcgtaacgggcaactctgcagcggaaccgactactttgggtgtccgtgtttcctt

SEQ ID NO: 10706 - DNA, 60 bp, Artificial Sequence
  Description of Artificial Sequence: Synthetic probe
cacaccagtgctcacccaccaaataatgtatgtacccccaggtggtccagtacccacaaa

SEQ ID NO: 10707 - DNA, 53 bp, Artificial Sequence
  Description of Artificial Sequence: Synthetic probe
tcccagctctaaccgccgcagagacagggcacacgtcacaagttgtaccatca

SEQ ID NO: 10708 - DNA, 60 bp, Artificial Sequence
  Description of Artificial Sequence: Synthetic probe
ggaatccatcccagccctaaccgccgcagagacagggcacacgtcacaagttgtaccatc

SEQ ID NO: 10709 - DNA, 55 bp, Artificial Sequence
  Description of Artificial Sequence: Synthetic probe
cgtcgtaatgggtaactctgcagcggaaccgactactttgggtgtccgtgtttcc

SEQ ID NO: 10710 - DNA, 60 bp, Artificial Sequence
  Description of Artificial Sequence: Synthetic probe
tccaaggcgcatacacagggatgcctagtcagaagcccaaggtgcccaccctgagacaag

SEQ ID NO: 10711 - DNA, 60 bp, Artificial Sequence
  Description of Artificial Sequence: Synthetic probe
tccaaggcgcatacacagggatgcccaatcagaagcccaaggtgcccaccctgagacaag

SEQ ID NO: 10712 - DNA, 60 bp, Artificial Sequence
  Description of Artificial Sequence: Synthetic probe
agcgtttcgctccgcacaaccccagtgtagatcaggtcgatgagtcaccgcattccccac

SEQ ID NO: 10713 - DNA, 60 bp, Artificial Sequence
  Description of Artificial Sequence: Synthetic probe
ttttcacctcaacccgggcatcgttacggggagcgccgttgggtgtgacccagatacctt

SEQ ID NO: 10714 - DNA, 60 bp, Artificial Sequence
  Description of Artificial Sequence: Synthetic probe
agacagacattcggacacctatacaaggcttttcacctcaacccgggcatcgttacaggg

SEQ ID NO: 10715 - DNA, 60 bp, Artificial Sequence
  Description of Artificial Sequence: Synthetic probe
gactcagtggcaatgagacagacattcggacacctatacaaggcttttcacctcaacccg

SEQ ID NO: 10716 - DNA, 60 bp, Artificial Sequence
  Description of Artificial Sequence: Synthetic probe
aaacagctacagctggcaaacgtccaccaacccgagtgtgttctggacggaagggagcgc

SEQ ID NO: 10717 - DNA, 60 bp, Artificial Sequence
  Description of Artificial Sequence: Synthetic probe
ttggtagtcctccggcccctgaatgcggctaatcccaactgcggagcacacaccctcaaa

SEQ ID NO: 10718 - DNA, 60 bp, Artificial Sequence
  Description of Artificial Sequence: Synthetic probe
gtcaatcataattggctcaaccctaccgcatgaaccgaacttgataaaagtgcggtaggg

SEQ ID NO: 10719 - DNA, 60 bp, Artificial Sequence
  Description of Artificial Sequence: Synthetic probe
tttgtaaattacaattggctcaaccctaccgcatgaaccgaacttgacaaaagtgcagta

SEQ ID NO: 10720 - DNA, 60 bp, Artificial Sequence
  Description of Artificial Sequence: Synthetic probe
ggtaacatggactaacgttaccttcctgaaaaggtactttagggcagatgaacaataccc

SEQ ID NO: 10721 - DNA, 60 bp, Artificial Sequence
  Description of Artificial Sequence: Synthetic probe
gctacattgatcctcctgaactcatccatgaagaacattgtgcaacaaacggaacctggc

SEQ ID NO: 10722 - DNA, 60 bp, Artificial Sequence
  Description of Artificial Sequence: Synthetic probe
cagctacattgatcctcctgaactcatccatgaagaacattgtgcaacaaacggaacctg

SEQ ID NO: 10723 - DNA, 60 bp, Artificial Sequence
  Description of Artificial Sequence: Synthetic probe
cccaccttgagggagactccttcagaagatccctcggtgttgtcatgtccgataaggatg

SEQ ID NO: 10724 - DNA, 60 bp, Artificial Sequence
  Description of Artificial Sequence: Synthetic probe
ttgaatctgtcccccatctcgagggagactccttcaggagatcccttggcgttgttatgt

SEQ ID NO: 10725 - DNA, 60 bp, Artificial Sequence
  Description of Artificial Sequence: Synthetic probe
gtaccctctttccgctccatgttcgcgtggatgcgttttcatgatttgtcgctgtgggaa

SEQ ID NO: 10726 - DNA, 60 bp, Artificial Sequence
  Description of Artificial Sequence: Synthetic probe
acggtcttgtgttcctccggcggaccatttcacatgatgccagaggtttccagggccgtc

SEQ ID NO: 10727 - DNA, 60 bp, Artificial Sequence
  Description of Artificial Sequence: Synthetic probe
gacggtcttgtgttcctccggcggaccatttcacatgatgccagaggtttccaaggccgc

SEQ ID NO: 10728 - DNA, 60 bp, Artificial Sequence
  Description of Artificial Sequence: Synthetic probe
gtgaaacagcaggtcgacggtcttgtgttcctccggcggaccatttcacatgatgccaga

SEQ ID NO: 10729 - DNA, 57 bp, Artificial Sequence
  Description of Artificial Sequence: Synthetic probe
cggtcaacagatctagactagaatcagttccccatctcgagggagactccttcagga

SEQ ID NO: 10730 - DNA, 60 bp, Artificial Sequence
  Description of Artificial Sequence: Synthetic probe
cgtgatctccagagaagataacttcagaggaaaagcattcacggtcaacagatctagact

SEQ ID NO: 10731 - DNA, 60 bp, Artificial Sequence
  Description of Artificial Sequence: Synthetic probe
ccatgttcacgtgatctctagggaagacaacttcagaggaaaagcattcacggtcaacag

SEQ ID NO: 10732 - DNA, 60 bp, Artificial Sequence
  Description of Artificial Sequence: Synthetic probe
cggtccaccgcgaacgttgaaactaacttcacgttcagggccgaatcggatggtccagga

SEQ ID NO: 10733 - DNA, 53 bp, Artificial Sequence
  Description of Artificial Sequence: Synthetic probe
catcacaagttgtgaggattgcaacgctcccagaagcctttacacaaggaggg

SEQ ID NO: 10734 - DNA, 59 bp, Artificial Sequence
  Description of Artificial Sequence: Synthetic probe
caaactcatcacaagttgtgaggattgcaacgctcccagaagcctttacacaaggaggg

SEQ ID NO: 10735 - DNA, 60 bp, Artificial Sequence
  Description of Artificial Sequence: Synthetic probe
atcgctccatgtttgcttggatgagatttcatgatttgtctctgtgggaaggtagtcgcg

SEQ ID NO: 10736 - DNA, 60 bp, Artificial Sequence
  Description of Artificial Sequence: Synthetic probe
gcaaacctgaaacagtttggcctgaaaccgacccggaccgacaaatcggatgctgagata

SEQ ID NO: 10737 - DNA, 60 bp, Artificial Sequence
  Description of Artificial Sequence: Synthetic probe
tcttgaggactcaggcgtgcaagtgacttggaacatcttcgactcgatggaccttttcac

SEQ ID NO: 10738 - DNA, 60 bp, Artificial Sequence
  Description of Artificial Sequence: Synthetic probe
tttggcctaaagccgacccggaccgacaaaacggacgctgagataacgccaatccccgct

SEQ ID NO: 10739 - DNA, 60 bp, Artificial Sequence
  Description of Artificial Sequence: Synthetic probe
gccttctggtatgccactaacatccatcatcaactcactcaaccactgcctcatggtggg

SEQ ID NO: 10740 - DNA, 60 bp, Artificial Sequence
  Description of Artificial Sequence: Synthetic probe
agaagtcaccaatctggacccagatgtggtgcaggcaaacagctatttctccttctatgg

SEQ ID NO: 10741 - DNA, 60 bp, Artificial Sequence
  Description of Artificial Sequence: Synthetic probe
ccatcaaccactggattttgaccctgtgcgcgctctcagaagtcaccaatctggacccag

SEQ ID NO: 10742 - DNA, 60 bp, Artificial Sequence
  Description of Artificial Sequence: Synthetic probe
tctcaggtgaactccatcaaccactggattttgaccctgtgcgcgctctcagaagtcacc

SEQ ID NO: 10743 - DNA, 60 bp, Artificial Sequence
  Description of Artificial Sequence: Synthetic probe
cggtgcatgagggccttccatctggcttcccgtgcacttctcaggtgaactccatcaacc

SEQ ID NO: 10744 - DNA, 60 bp, Artificial Sequence
  Description of Artificial Sequence: Synthetic probe
acttcctggtggcggtgcatgagggccttccatctggcttcccgtgcacttctcaggtga

SEQ ID NO: 10745 - DNA, 60 bp, Artificial Sequence
  Description of Artificial Sequence: Synthetic probe
cgacatcatgaccaaacttactgcagagcctgagcttgcccgcgtcgttgcggaggacct

SEQ ID NO: 10746 - DNA, 60 bp, Artificial Sequence
  Description of Artificial Sequence: Synthetic probe
cgccacagcctcgacatcatgaccaaacttactgcagagcctgagcttgcccgcgtcgtt

SEQ ID NO: 10747 - DNA, 60 bp, Artificial Sequence
  Description of Artificial Sequence: Synthetic probe
cagcctgggacagcactcagcagagggagattatgcgcctcagccttgacatcatgacca

SEQ ID NO: 10748 - DNA, 60 bp, Artificial Sequence
  Description of Artificial Sequence: Synthetic probe
tcagcctgggacagcactcagcagagggagattatgcgcctcagccttgacatcatgacc

SEQ ID NO: 10749 - DNA, 60 bp, Artificial Sequence
  Description of Artificial Sequence: Synthetic probe
cactaggtcagcaactctacaatgctagtctctatgccagccaacacggagaggaattct

SEQ ID NO: 10750 - DNA, 60 bp, Artificial Sequence
  Description of Artificial Sequence: Synthetic probe
cacgaggtcagcaactctacaatgctagtctctatgccagccaacacggagaggaattct

SEQ ID NO: 10751 - DNA, 60 bp, Artificial Sequence
  Description of Artificial Sequence: Synthetic probe
atcacgaggtcagcaactctacaatgctagtctctatgccagccaacacggagaggaatt

SEQ ID NO: 10752 - DNA, 60 bp, Artificial Sequence
  Description of Artificial Sequence: Synthetic probe
atcactaggtcagcaactctacaatgctagtctctatgccagccaacacggagaggaatt

SEQ ID NO: 10753 - DNA, 60 bp, Artificial Sequence
  Description of Artificial Sequence: Synthetic probe
gttgtcatgtccgacaaggacgtcacaacaatgttctactacatcaaggggaaagtgatc

SEQ ID NO: 10754 - DNA, 60 bp, Artificial Sequence
  Description of Artificial Sequence: Synthetic probe
gagatcccttggcgttgtcatgtccgacaaggatgtaacgacaatgttctactacatcaa

SEQ ID NO: 10755 - DNA, 53 bp, Artificial Sequence
  Description of Artificial Sequence: Synthetic probe
tcgaggattctggcgtgcaagtgacatggaatatcttcgactcgatggacctg

SEQ ID NO: 10756 - DNA, 60 bp, Artificial Sequence
  Description of Artificial Sequence: Synthetic probe
ttgcctcatggtgggctcggctgttgtcaaggctctcgaggattctggcgtgcaagtgac

SEQ ID NO: 10757 - DNA, 60 bp, Artificial Sequence
  Description of Artificial Sequence: Synthetic probe
caattccctgaaccattgcctcatggtgggctcggctgttgtcaaggctctcgaggattc

SEQ ID NO: 10758 - DNA, 60 bp, Artificial Sequence
  Description of Artificial Sequence: Synthetic probe
ccttctggtatgccactaacatccatcatcaactcactcaaccactgcctcatggtgggc

SEQ ID NO: 10759 - DNA, 60 bp, Artificial Sequence
  Description of Artificial Sequence: Synthetic probe
gcacgatcgatattgtgttgactactcaaaatgggactccacacaaccaccaaaggtcac

SEQ ID NO: 10760 - DNA, 60 bp, Artificial Sequence
  Description of Artificial Sequence: Synthetic probe
aagcaaagattcgaaaccaatgcagacctgcgcgtgaatggagatctgtaccggatgcaa

SEQ ID NO: 10761 - DNA, 60 bp, Artificial Sequence
  Description of Artificial Sequence: Synthetic probe
ggtacccggactacctgacggttggccggacacaacaattcccacagcaatgactgcgtc

SEQ ID NO: 10762 - DNA, 60 bp, Artificial Sequence
  Description of Artificial Sequence: Synthetic probe
ctgacaacccttgcggcggcgtcaactggtaaaacggtcgactgcgagtggacaaccttc

SEQ ID NO: 10763 - DNA, 60 bp, Artificial Sequence
  Description of Artificial Sequence: Synthetic probe
cacgaggtcaacaactctacaatgccggtctctacgccagtcaacacggagaggaattct

SEQ ID NO: 10764 - DNA, 60 bp, Artificial Sequence
  Description of Artificial Sequence: Synthetic probe
ctgtcgtgccgccttcaaacgcgtctcagaatcaatcatggcaaaccacgctctcggctt

SEQ ID NO: 10765 - DNA, 60 bp, Artificial Sequence
  Description of Artificial Sequence: Synthetic probe
tacaatacaacatctggtaacatctacggtgcctgcggctcttcgtgttcattgacgaga

SEQ ID NO: 10766 - DNA, 60 bp, Artificial Sequence
  Description of Artificial Sequence: Synthetic probe
ggtaagaacaagaacaaaggcccacggaagaacacgggcgttgccctcacggacgatgag

SEQ ID NO: 10767 - DNA, 60 bp, Artificial Sequence
  Description of Artificial Sequence: Synthetic probe
ccaggaaaaccagtcccaaaatggtgcttcaacaaagacttctcccacctccacctgtcc

SEQ ID NO: 10768 - DNA, 60 bp, Artificial Sequence
  Description of Artificial Sequence: Synthetic probe
ctaactagccttgctgagctctacggaatggttgaggtcgcaatcgacttcgtccccacc

SEQ ID NO: 10769 - DNA, 60 bp, Artificial Sequence
  Description of Artificial Sequence: Synthetic probe
ccaaggctgtcagcttcttcccggcccaaacggatggacttactggtgacgaacccgaat

SEQ ID NO: 10770 - DNA, 60 bp, Artificial Sequence
  Description of Artificial Sequence: Synthetic probe
tcgcaccttgacgtgggagatttcctggtggcagtgcacgagggccttccatcgggtttt

SEQ ID NO: 10771 - DNA, 60 bp, Artificial Sequence
  Description of Artificial Sequence: Synthetic probe
aggacttgctcaagccctcgcaccttgacgtgggggacttcctggtggcagtgcatgagg

SEQ ID NO: 10772 - DNA, 60 bp, Artificial Sequence
  Description of Artificial Sequence: Synthetic probe
cctgaagacgtttggcctgaaaccgacccggaccgacaaaacggatgctgagataacgcc

SEQ ID NO: 10773 - DNA, 60 bp, Artificial Sequence
  Description of Artificial Sequence: Synthetic probe
ccaatctggacccagatgtggtgcaggcaaacagctatttctccttctatggtgatgatg

SEQ ID NO: 10774 - DNA, 60 bp, Artificial Sequence
  Description of Artificial Sequence: Synthetic probe
ccaacttggacccggacgtggtgcaggcaaacagctatttctccttctatggtgatgatg

SEQ ID NO: 10775 - DNA, 60 bp, Artificial Sequence
  Description of Artificial Sequence: Synthetic probe
ctctggcgtgcaggtaacgtggaacatcttcgactcgatggacctcttcacctatggcga

SEQ ID NO: 10776 - DNA, 60 bp, Artificial Sequence
  Description of Artificial Sequence: Synthetic probe
agaggactctggcgtgcaggtaacgtggaacatcttcgactcgatggacctcttcaccta

SEQ ID NO: 10777 - DNA, 60 bp, Artificial Sequence
  Description of Artificial Sequence: Synthetic probe
gtgggctgtgctgttgttaaggctctcgaggactctggcgtgcaggtaacgtggaacatc

SEQ ID NO: 10778 - DNA, 60 bp, Artificial Sequence
  Description of Artificial Sequence: Synthetic probe
gtaccgtagtgcaacaacaacctgcacccgcgccaacggcattagcaacccttgctactg

SEQ ID NO: 10779 - DNA, 60 bp, Artificial Sequence
  Description of Artificial Sequence: Synthetic probe
aggtaccgtagtgcaacaacaacctgcacccgcgccaacggcattagcaacccttgctac

SEQ ID NO: 10780 - DNA, 60 bp, Artificial Sequence
  Description of Artificial Sequence: Synthetic probe
ctgcagacgtgagcaacagcttcacgtttagggctgaatcggacggtccaggtagtgctg

SEQ ID NO: 10781 - DNA, 60 bp, Artificial Sequence
  Description of Artificial Sequence: Synthetic probe
actgcagacgtgagcaacagcttcacgtttagggctgaatcggacggtccaggtagtgct

SEQ ID NO: 10782 - DNA, 60 bp, Artificial Sequence
  Description of Artificial Sequence: Synthetic probe
cactgcagacgtgagcaacagcttcacgtttagggctgaatcggacggtccaggtagtgc

SEQ ID NO: 10783 - DNA, 50 bp, Artificial Sequence
  Description of Artificial Sequence: Synthetic probe
agtgggattttgtccaaactcggatcttcttgggatccaatccttcggtc

SEQ ID NO: 10784 - DNA, 60 bp, Artificial Sequence
  Description of Artificial Sequence: Synthetic probe
agtgggattttgtccaaactcggatcttcttgggatccatcccttcggtccactgcagac

SEQ ID NO: 10785 - DNA, 52 bp, Artificial Sequence
  Description of Artificial Sequence: Synthetic probe
cgaacggtacatggcctaacggtgacccatgtgaacctatcctacccccgtt

SEQ ID NO: 10786 - DNA, 60 bp, Artificial Sequence
  Description of Artificial Sequence: Synthetic probe
tcctcctgaactcatccatgaagaacactgcgcaacgaacggtacatggcctaacggtga

SEQ ID NO: 10787 - DNA, 60 bp, Artificial Sequence
  Description of Artificial Sequence: Synthetic probe
gttgcttccctgatgtctatgcctctataggaactgagtatagctacattgatcctcctg

SEQ ID NO: 10788 - DNA, 60 bp, Artificial Sequence
  Description of Artificial Sequence: Synthetic probe
ggcgatgacggtgtttacattgtcccgccactcatctcatccgtcatgccaaaagtcttc

SEQ ID NO: 10789 - DNA, 60 bp, Artificial Sequence
  Description of Artificial Sequence: Synthetic probe
cctacggcgatgacggtgtttacattgtcccgccactcatatcatctgtcatgccaaaag

SEQ ID NO: 10790 - DNA, 53 bp, Artificial Sequence
  Description of Artificial Sequence: Synthetic probe
ccccaaaagtcacatctcaatcaattgacattctcaggcacttcactgacaaa

SEQ ID NO: 10791 - DNA, 60 bp, Artificial Sequence
  Description of Artificial Sequence: Synthetic probe
ggactccacacaaccaccaaaagtcacatctcaatcaattgacattctcaggcatttcac

SEQ ID NO: 10792 - DNA, 60 bp, Artificial Sequence
  Description of Artificial Sequence: Synthetic probe
tcaaaatgggactccacacaacccccaaaagtcacatctcaatcaattgacattctcagg

SEQ ID NO: 10793 - DNA, 50 bp, Artificial Sequence
  Description of Artificial Sequence: Synthetic probe
cacttacggtgacgacggtgtctacatcgtcccgccactcatttcctctg

SEQ ID NO: 10794 - DNA, 60 bp, Artificial Sequence
  Description of Artificial Sequence: Synthetic probe
gtgacgtggaacatcttcgattcgatggacctgttcacttacggtgacgacggtgtctac

SEQ ID NO: 10795 - DNA, 60 bp, Artificial Sequence
  Description of Artificial Sequence: Synthetic probe
ctcatggtgggctcggctgtcgttaaggctcttgaagactcaggtgtgcaagtgacgtgg

SEQ ID NO: 10796 - DNA, 60 bp, Artificial Sequence
  Description of Artificial Sequence: Synthetic probe
ccctgaatcactgtctcatggtgggctcggctgtcgttaaggctcttgaagactcaggtg

SEQ ID NO: 10797 - DNA, 60 bp, Artificial Sequence
  Description of Artificial Sequence: Synthetic probe
accctcgggtatgccactaacgtccatcatcaactccctgaatcactgtctcatggtggg

SEQ ID NO: 10798 - DNA, 60 bp, Artificial Sequence
  Description of Artificial Sequence: Synthetic probe
ggttgctggtggtctaccctcgggtatgccactaacgtccatcatcaactccctgaatca

SEQ ID NO: 10799 - DNA, 60 bp, Artificial Sequence
  Description of Artificial Sequence: Synthetic probe
aacccaattggcatcttcaacggtgtcgcgttcaaggttgctggtggtctaccctcgggt

SEQ ID NO: 10800 - DNA, 60 bp, Artificial Sequence
  Description of Artificial Sequence: Synthetic probe
cctcaggcacttcactgataaatccccaattgttgattcggcctgcgcgacactcaaatc

SEQ ID NO: 10801 - DNA, 60 bp, Artificial Sequence
  Description of Artificial Sequence: Synthetic probe
acatcctcaggcacttcactgataaatccccaattgttgattcggcctgcgcgacactca

SEQ ID NO: 10802 - DNA, 60 bp, Artificial Sequence
  Description of Artificial Sequence: Synthetic probe
ggactctacccaaccaccaaaagtcacatctcagtcaattgacatcctcaggcacttcac

SEQ ID NO: 10803 - DNA, 57 bp, Artificial Sequence
  Description of Artificial Sequence: Synthetic probe
tgcttggatgagatttcatgatttgtcgctgtgggaaggtagtcgcgacatcctccc

SEQ ID NO: 10804 - DNA, 60 bp, Artificial Sequence
  Description of Artificial Sequence: Synthetic probe
cgctaacctgaagcagtttggcctgaaaccgacccggaccgacaaaacggatgctgagat

SEQ ID NO: 10805 - DNA, 60 bp, Artificial Sequence
  Description of Artificial Sequence: Synthetic probe
cgctctatgttcgcatggatgcgctttcatgatttgtcgctgtgggagggtagtcgcgac

SEQ ID NO: 10806 - DNA, 60 bp, Artificial Sequence
  Description of Artificial Sequence: Synthetic probe
ttccttctttccgctctatgttcgcatggatgcgctttcatgatttgtcgctgtgggagg

SEQ ID NO: 10807 - DNA, 60 bp, Artificial Sequence
  Description of Artificial Sequence: Synthetic probe
agccgaggcccgcagtggcggcatggagatctttgttccttctttccgctctatgttcgc

SEQ ID NO: 10808 - DNA, 60 bp, Artificial Sequence
  Description of Artificial Sequence: Synthetic probe
cggctctctagtgacagccgaggcccgcagtggcggcatggagatctttgttccttcttt

SEQ ID NO: 10809 - DNA, 60 bp, Artificial Sequence
  Description of Artificial Sequence: Synthetic probe
ttggggaggcctcgctccatggtgagaaattctaccgccgcgtcggctctctagtgacag

SEQ ID NO: 10810 - DNA, 60 bp, Artificial Sequence
  Description of Artificial Sequence: Synthetic probe
tgcctccttggggaggcctcgctccatggtgagaaattctaccgccgcgtcggctctcta

SEQ ID NO: 10811 - DNA, 57 bp, Artificial Sequence
  Description of Artificial Sequence: Synthetic probe
cagctttactggacccgtggttcaaaccacgacgacccctcagagagcttggtcccc

SEQ ID NO: 10812 - DNA, 60 bp, Artificial Sequence
  Description of Artificial Sequence: Synthetic probe
cagctttactggacccgtggttcaaaccacgacgacccctcagagagcttggtcccccac

SEQ ID NO: 10813 - DNA, 60 bp, Artificial Sequence
  Description of Artificial Sequence: Synthetic probe
tccaggggcgccttgatcgtgagtccatcctgcgccagctttactggacccgtggttcaa

SEQ ID NO: 10814 - DNA, 60 bp, Artificial Sequence
  Description of Artificial Sequence: Synthetic probe
atgatgccagggggttccaggggcgccttgatcgtgagtccatcctgcgccagctttact

SEQ ID NO: 10815 - DNA, 60 bp, Artificial Sequence
  Description of Artificial Sequence: Synthetic probe
caagcaacaagtggatggccttgttttcctccgccgcaccatctcccatgatgccagggg

SEQ ID NO: 10816 - DNA, 60 bp, Artificial Sequence
  Description of Artificial Sequence: Synthetic probe
ggtcaagcaacaagtggatggccttgttttcctccgccgcaccatctcccatgatgccag

SEQ ID NO: 10817 - DNA, 60 bp, Artificial Sequence
  Description of Artificial Sequence: Synthetic probe
aaacccacccggcccgacaagagtgaaggcccgattgaggtcaagcaacaagtggatggc

SEQ ID NO: 10818 - DNA, 60 bp, Artificial Sequence
  Description of Artificial Sequence: Synthetic probe
aaatatggactcaaacccacccggcccgacaagagtgaaggcccgattgaggtcaagcaa

SEQ ID NO: 10819 - DNA, 59 bp, Artificial Sequence
  Description of Artificial Sequence: Synthetic probe
tgcgcactttcagaggtcaccaacttggacccggatgtggtgcaggcaaacagctattt

SEQ ID NO: 10820 - DNA, 59 bp, Artificial Sequence
  Description of Artificial Sequence: Synthetic probe
gtgaacaaagttaaaattgggtattttgacaaagcatcaactgattgctacaacagcca

SEQ ID NO: 10821 - DNA, 60 bp, Artificial Sequence
  Description of Artificial Sequence: Synthetic probe
ccctgagccagctcgggtacacactcgtggatgatcaacccatcggctcaaactcatcac

SEQ ID NO: 10822 - DNA, 60 bp, Artificial Sequence
  Description of Artificial Sequence: Synthetic probe
aaccctgagccagctcgggtacacactcgtggatgatcaacccatcggctcaaactcatc

SEQ ID NO: 10823 - DNA, 60 bp, Artificial Sequence
  Description of Artificial Sequence: Synthetic probe
cttcgatggtccagcaaatgagatgaccatgaatgtaaccctgagccagctcgggtacac

SEQ ID NO: 10824 - DNA, 60 bp, Artificial Sequence
  Description of Artificial Sequence: Synthetic probe
aagttaattgtgtacttcgatggtccagcaaatgagatgaccatgaatgtaaccctgagc

SEQ ID NO: 10825 - DNA, 53 bp, Artificial Sequence
  Description of Artificial Sequence: Synthetic probe
cgacaccgaaaaggccctcgtgcctgggttaccagatgggtggcccgacacaa

SEQ ID NO: 10826 - DNA, 60 bp, Artificial Sequence
  Description of Artificial Sequence: Synthetic probe
gcccaaggctccaacaaccactggtacaaggttgtcgacaccgaaaaggccctcgtgcct

SEQ ID NO: 10827 - DNA, 60 bp, Artificial Sequence
  Description of Artificial Sequence: Synthetic probe
aagctccaaagcggtgcccaaggctccaacaaccactggtacaaggttgtcgacaccgaa

SEQ ID NO: 10828 - DNA, 60 bp, Artificial Sequence
  Description of Artificial Sequence: Synthetic probe
gtttggcctgaaaccgacccggaccgacaaaacggatgctgagataacgcctatccctca

SEQ ID NO: 10829 - DNA, 57 bp, Artificial Sequence
  Description of Artificial Sequence: Synthetic probe
cacttggccagatggaactccttgcgagaccatccttcctccatttgtcatcgaggg

SEQ ID NO: 10830 - DNA, 60 bp, Artificial Sequence
  Description of Artificial Sequence: Synthetic probe
cgctaacctaaaacagtttggcctgaaaccgacccggaccgacaaaacggatgctgagat

SEQ ID NO: 10831 - DNA, 59 bp, Artificial Sequence
  Description of Artificial Sequence: Synthetic probe
tgcgcactctcagaggttaccaacttggacccggatgtggtgcaggcgaacagctattt

SEQ ID NO: 10832 - DNA, 60 bp, Artificial Sequence
  Description of Artificial Sequence: Synthetic probe
gccttctggtatgccactaacatccatcatcaactctctcaaccactgtctcatggtggg

SEQ ID NO: 10833 - DNA, 60 bp, Artificial Sequence
  Description of Artificial Sequence: Synthetic probe
acaatgtacataacaactgctaacattggggatggcaatgccagtccacaacacaaaatt

SEQ ID NO: 10834 - DNA, 60 bp, Artificial Sequence
  Description of Artificial Sequence: Synthetic probe
cagaactacgcaaagaaagaagcacaaaagaaatcccaaacaatgtacataacaactgct

SEQ ID NO: 10835 - DNA, 60 bp, Artificial Sequence
  Description of Artificial Sequence: Synthetic probe
cggcaaaggcacatacatctgtggcactttatcaacggtcaccatacccgaggttgacaa

SEQ ID NO: 10836 - DNA, 60 bp, Artificial Sequence
  Description of Artificial Sequence: Synthetic probe
ccggcaaccaaaactgttgaccctaccaagaacaccacgcccggcaaaggcacatacatc

SEQ ID NO: 10837 - DNA, 60 bp, Artificial Sequence
  Description of Artificial Sequence: Synthetic probe
ttctacaatccggcaaccaaaactgttgaccctaccaagaacaccacgcccggcaaaggc

SEQ ID NO: 10838 - DNA, 60 bp, Artificial Sequence
  Description of Artificial Sequence: Synthetic probe
tgcttggatgagatttcatgatttgtcgctgtgggaaggtagtcgcgacacccttcccga

SEQ ID NO: 10839 - DNA, 60 bp, Artificial Sequence
  Description of Artificial Sequence: Synthetic probe
caacttgtataagggcatgacaagaactgcacacgagaacagtgggtgtggggcccatgt

SEQ ID NO: 10840 - DNA, 60 bp, Artificial Sequence
  Description of Artificial Sequence: Synthetic probe
caatttgtataagggcatggtaagaactgcacacgagaacagtgggtgtggggcccatgt

SEQ ID NO: 10841 - DNA, 58 bp, Artificial Sequence
  Description of Artificial Sequence: Synthetic probe
gcttgggatccagaccttcagtccaaggtggacacgagcgtgaacttcgccactatgg

SEQ ID NO: 10842 - DNA, 60 bp, Artificial Sequence
  Description of Artificial Sequence: Synthetic probe
ggactcaggcgtgcaagtgacttggaacatcttcgactcgatggaccttttcacctacgg

SEQ ID NO: 10843 - DNA, 60 bp, Artificial Sequence
  Description of Artificial Sequence: Synthetic probe
caccttgacgtgggagatttcctggtggcagtgcacgagggcctcccatcaggttttcca

SEQ ID NO: 10844 - DNA, 60 bp, Artificial Sequence
  Description of Artificial Sequence: Synthetic probe
cgagaggtcaacaactttacaatgcctgtctctatgccagccaacacggagaggaattct

SEQ ID NO: 10845 - DNA, 60 bp, Artificial Sequence
  Description of Artificial Sequence: Synthetic probe
atcgagaggtcaacaactttacaatgcctgtctctatgccagccaacacggagaggaatt

SEQ ID NO: 10846 - DNA, 60 bp, Artificial Sequence
  Description of Artificial Sequence: Synthetic probe
tgtctcatggtgggctgtgctgtcgttaaggctctagaggactctggcgtgcaggtaacg

SEQ ID NO: 10847 - DNA, 60 bp, Artificial Sequence
  Description of Artificial Sequence: Synthetic probe
aactccttaaatcactgtctcatggtgggctgtgctgtcgttaaggctctagaggactct

SEQ ID NO: 10848 - DNA, 60 bp, Artificial Sequence
  Description of Artificial Sequence: Synthetic probe
ggcacttcactgacaaatctccaattgttgattcggcctgtgctacactcaagtcaagcc

SEQ ID NO: 10849 - DNA, 60 bp, Artificial Sequence
  Description of Artificial Sequence: Synthetic probe
ccaacttggacccggatgtggtgcaggcaaacagctacttctccttctatggtgatgatg

SEQ ID NO: 10850 - DNA, 60 bp, Artificial Sequence
  Description of Artificial Sequence: Synthetic probe
gatctttgtgccatcacaccgctctatgtttgcttggatgagatttcatgatttgtcgct

SEQ ID NO: 10851 - DNA, 60 bp, Artificial Sequence
  Description of Artificial Sequence: Synthetic probe
ttctaaccttgtgcgcgctttcagaggtcaccaacttggacccggatgtggtgcaggcaa

SEQ ID NO: 10852 - DNA, 60 bp, Artificial Sequence
  Description of Artificial Sequence: Synthetic probe
cttctgtcgtttgacgacctcgaatttctcctacacaaaaaggacctaaccgatctctac

SEQ ID NO: 10853 - DNA, 60 bp, Artificial Sequence
  Description of Artificial Sequence: Synthetic probe
cctcttacctcgaccttcatgggagtgcagctagcacgtgtcaagctagcgtctaaggtc

SEQ ID NO: 10854 - DNA, 60 bp, Artificial Sequence
  Description of Artificial Sequence: Synthetic probe
tcctctttccgcgaccttcatgggagtgcagctagcacgtgtcaagctagcatctaaggt

SEQ ID NO: 10855 - DNA, 60 bp, Artificial Sequence
  Description of Artificial Sequence: Synthetic probe
catgaataagattcaaattggccatttcgatcggcaatacacagattgcttcaacagcca

SEQ ID NO: 10856 - DNA, 51 bp, Artificial Sequence
  Description of Artificial Sequence: Synthetic probe
aaaactgatacgtgggattcaaccatgttacacttagggtacgttctcgtc

SEQ ID NO: 10857 - DNA, 60 bp, Artificial Sequence
  Description of Artificial Sequence: Synthetic probe
gccgacaacactagcccaacatcaaaaactgatacgtgggattcaaccatgttacactta

SEQ ID NO: 10858 - DNA, 60 bp, Artificial Sequence
  Description of Artificial Sequence: Synthetic probe
ccaacacacaagattacatcaaattccactgattggttatgatgccgacaacactagccc

SEQ ID NO: 10859 - DNA, 60 bp, Artificial Sequence
  Description of Artificial Sequence: Synthetic probe
tctatgtccaacacacaagattacatcaaattccactgattggttatgatgccgacaaca

SEQ ID NO: 10860 - DNA, 60 bp, Artificial Sequence
  Description of Artificial Sequence: Synthetic probe
gacatcaagaactctatttggcaccactgggactttgtcaagggggatactctatgtcca

SEQ ID NO: 10861 - DNA, 60 bp, Artificial Sequence
  Description of Artificial Sequence: Synthetic probe
tgattccacaacaactggttggtcaactccctattttactccaattgagatcacactcaa

SEQ ID NO: 10862 - DNA, 60 bp, Artificial Sequence
  Description of Artificial Sequence: Synthetic probe
ccactatggctactactcacacgcttctgtcgtttgtcgacctcgaatttctcctacaca

SEQ ID NO: 10863 - DNA, 60 bp, Artificial Sequence
  Description of Artificial Sequence: Synthetic probe
gccactatggctactactcacacgcttctgtcgtttaacgacctcgaatttctcttacac

SEQ ID NO: 10864 - DNA, 60 bp, Artificial Sequence
  Description of Artificial Sequence: Synthetic probe
gcgaacctacgacagtttggcctgaaaccgacccggaccgacaaagcggatgctgagata

SEQ ID NO: 10865 - DNA, 60 bp, Artificial Sequence
  Description of Artificial Sequence: Synthetic probe
gtttcagggccgtctcgatcgagagtcgatactccggcagctctactggactcgtggacc

SEQ ID NO: 10866 - DNA, 60 bp, Artificial Sequence
  Description of Artificial Sequence: Synthetic probe
gtttcaaggtcgtctcgatcgagagtcgatactccggcagctctactggactcgtggacc

SEQ ID NO: 10867 - DNA, 60 bp, Artificial Sequence
  Description of Artificial Sequence: Synthetic probe
gccaaggggttccaaggtcgcctcgatcgagagtcgatactccggcagctctactggact

SEQ ID NO: 10868 - DNA, 60 bp, Artificial Sequence
  Description of Artificial Sequence: Synthetic probe
cgacctcgaatttctcttacacaagaaggacctaaccgatctctacggagagaggtgtgg

SEQ ID NO: 10869 - DNA, 60 bp, Artificial Sequence
  Description of Artificial Sequence: Synthetic probe
cgctacaaaacctggcgaagtggtgagcggaatcctatcgaaactcggatctacttggga

SEQ ID NO: 10870 - DNA, 60 bp, Artificial Sequence
  Description of Artificial Sequence: Synthetic probe
aacccatcactactacgctacaaaacctggcgaagtggtgagcggaatcctatcgaaact

SEQ ID NO: 10871 - DNA, 60 bp, Artificial Sequence
  Description of Artificial Sequence: Synthetic probe
gagcactgcgcaacaaatggaacttggcctgatggcactccctgtgagcccatcctgcct

SEQ ID NO: 10872 - DNA, 60 bp, Artificial Sequence
  Description of Artificial Sequence: Synthetic probe
tctcattcatgatgagcactgcgcaacaaatggaacttggcctgatggcactccctgtga

SEQ ID NO: 10873 - DNA, 60 bp, Artificial Sequence
  Description of Artificial Sequence: Synthetic probe
ctcacacgcttctgtctgacgacctcgaatttcccttacacaagaaggacctaaccgatc

SEQ ID NO: 10874 - DNA, 60 bp, Artificial Sequence
  Description of Artificial Sequence: Synthetic probe
ccactatggctactactcacacgcttctgtctgacgacctcgaatttcccttacacaaga

SEQ ID NO: 10875 - DNA, 53 bp, Artificial Sequence
  Description of Artificial Sequence: Synthetic probe
tggcccgatggcacaccatgtgagccaatcctccccccgttcacaatcacggg

SEQ ID NO: 10876 - DNA, 60 bp, Artificial Sequence
  Description of Artificial Sequence: Synthetic probe
aacgggagttggccagacggcactccttgtgaacccatcctgcctccattcgtcatcgag

SEQ ID NO: 10877 - DNA, 60 bp, Artificial Sequence
  Description of Artificial Sequence: Synthetic probe
aacgggagttgggcagacggcactccttgtgaacccatcctgcctccattcgtcatcgag

SEQ ID NO: 10878 - DNA, 60 bp, Artificial Sequence
  Description of Artificial Sequence: Synthetic probe
cgacaaacgggagttggccagacggcactccttgtgaacccatcctgcctccattcgtca

SEQ ID NO: 10879 - DNA, 60 bp, Artificial Sequence
  Description of Artificial Sequence: Synthetic probe
cactgtgcgacaaacgggagttgggcagacggcactccttgtgaacccatcctgcctcca

SEQ ID NO: 10880 - DNA, 55 bp, Artificial Sequence
  Description of Artificial Sequence: Synthetic probe
ccccagagttcattcatgaagagcactgtgcgacaaacgggagttggccagacgg

SEQ ID NO: 10881 - DNA, 50 bp, Artificial Sequence
  Description of Artificial Sequence: Synthetic probe
ccccagagttcattcatgaagagcactgtgcgacaaacgggagttggcca

SEQ ID NO: 10882 - DNA, 60 bp, Artificial Sequence
  Description of Artificial Sequence: Synthetic probe
tgaatatagctatattgaccccccagagttcattcatgaagagcactgtgcgacaaacgg

SEQ ID NO: 10883 - DNA, 60 bp, Artificial Sequence
  Description of Artificial Sequence: Synthetic probe
taggaactgaatatagctatattgaccccccagagttcattcatgaagagcactgtgcga

SEQ ID NO: 10884 - DNA, 60 bp, Artificial Sequence
  Description of Artificial Sequence: Synthetic probe
gatgatcctttcaactgctgctattgtgatgtttataactctataggaactgaatatagc

SEQ ID NO: 10885 - DNA, 60 bp, Artificial Sequence
  Description of Artificial Sequence: Synthetic probe
gttctgtgatgatcctttcaactgctgctattgtgatgtttataactctataggaactga

SEQ ID NO: 10886 - DNA, 60 bp, Artificial Sequence
  Description of Artificial Sequence: Synthetic probe
ctcacacgcttctgtcgtttgacgacctcgaatttctcttgcacaagaaggacctaaccg

SEQ ID NO: 10887 - DNA, 60 bp, Artificial Sequence
  Description of Artificial Sequence: Synthetic probe
gccctcgcaccttgatgtgggggacttcctggtggcagtgcacgagggccttccatctgg

SEQ ID NO: 10888 - DNA, 60 bp, Artificial Sequence
  Description of Artificial Sequence: Synthetic probe
cctatgtcggactatcggatctccctggtgatctacagtttcccctctctgcgaccttca

SEQ ID NO: 10889 - DNA, 60 bp, Artificial Sequence
  Description of Artificial Sequence: Synthetic probe
aactttccgaaggcaattacaaccttccccccgattcccttgctgtctatagaatcactg

SEQ ID NO: 10890 - DNA, 60 bp, Artificial Sequence
  Description of Artificial Sequence: Synthetic probe
ccaacaatcaactgactgctacaacagccaaattcttatgaccacacagaaactttccga

SEQ ID NO: 10891 - DNA, 60 bp, Artificial Sequence
  Description of Artificial Sequence: Synthetic probe
ttctacgtcaacaaggcaaagattgggtacttcgaccaacaatcaactgactgctacaac

SEQ ID NO: 10892 - DNA, 60 bp, Artificial Sequence
  Description of Artificial Sequence: Synthetic probe
aagtaaggttcgtgagaatcgcaacgctcccagaagcctttacacaaggagggaactatc

SEQ ID NO: 10893 - DNA, 60 bp, Artificial Sequence
  Description of Artificial Sequence: Synthetic probe
ccgctagggttcgtgttggtcgatgaccaactattggctctgactcaagtaaggttcgtg

SEQ ID NO: 10894 - DNA, 60 bp, Artificial Sequence
  Description of Artificial Sequence: Synthetic probe
ggttgtgtacttcgatgggccgacaaaagaagagaccatacacgcaaccctaagccgcta

SEQ ID NO: 10895 - DNA, 51 bp, Artificial Sequence
  Description of Artificial Sequence: Synthetic probe
tatgttaccactgccaacatcactgggaacacggtctcaccacaacacaaa

SEQ ID NO: 10896 - DNA, 60 bp, Artificial Sequence
  Description of Artificial Sequence: Synthetic probe
gggacatacatctgtggaacactgtcaactgttgccaagggtagtggtgacatactggca

SEQ ID NO: 10897 - DNA, 60 bp, Artificial Sequence
  Description of Artificial Sequence: Synthetic probe
ctgcctccaatgggaactttgcctatgatcctggcttctacgatgccgacaaacaagtgg

SEQ ID NO: 10898 - DNA, 60 bp, Artificial Sequence
  Description of Artificial Sequence: Synthetic probe
ggctcccagatggctggcccgacacaacaatcccaactgagcaaactgcctccaatggga

SEQ ID NO: 10899 - DNA, 60 bp, Artificial Sequence
  Description of Artificial Sequence: Synthetic probe
ggcattggtcccagggctcccagatggctggcccgacacaacaatcccaactgagcaaac

SEQ ID NO: 10900 - DNA, 60 bp, Artificial Sequence
  Description of Artificial Sequence: Synthetic probe
accccgtgttttccaatcaaaccggcactttgactttgattcgacaacaactggctggtc

SEQ ID NO: 10901 - DNA, 60 bp, Artificial Sequence
  Description of Artificial Sequence: Synthetic probe
ggctctatcccgtctgacttgataccccgcaactctgctcattggatgggaaatcgctgg

SEQ ID NO: 10902 - DNA, 60 bp, Artificial Sequence
  Description of Artificial Sequence: Synthetic probe
ccagacctctgctgactttagctttgcgttgctaaaaccccctggttctttgatcaaaca

SEQ ID NO: 10903 - DNA, 60 bp, Artificial Sequence
  Description of Artificial Sequence: Synthetic probe
atggatgaaacaggcacaacaaagctcgggatcatggtttacaatgaattgatcaaccca

SEQ ID NO: 10904 - DNA, 60 bp, Artificial Sequence
  Description of Artificial Sequence: Synthetic probe
cgatgtcaggttcaccgtctctggctccggggtgttcggcggaaaactagccgcactcct

SEQ ID NO: 10905 - DNA, 60 bp, Artificial Sequence
  Description of Artificial Sequence: Synthetic probe
atctcaaaactgtactctacatggtcgggcggaatcgatgtcaggttcaccgtctctggc

SEQ ID NO: 10906 - DNA, 60 bp, Artificial Sequence
  Description of Artificial Sequence: Synthetic probe
ccttacccagatcacatctcaaaactgtactctacatggtcgggcggaatcgatgtcagg

SEQ ID NO: 10907 - DNA, 60 bp, Artificial Sequence
  Description of Artificial Sequence: Synthetic probe
ggatgaccttcttttcctatcacacctccatcaactggtccacagtggagtctcaaggaa

SEQ ID NO: 10908 - DNA, 60 bp, Artificial Sequence
  Description of Artificial Sequence: Synthetic probe
gtgacggagggacagggcaccgttgtgcagcaacaacctgcgccagcaccagctgccttg

SEQ ID NO: 10909 - DNA, 60 bp, Artificial Sequence
  Description of Artificial Sequence: Synthetic probe
ctcggatcttcttgggatccgtcccttcagtctgcagtaaacgttgacacaaacttcacg

SEQ ID NO: 10910 - DNA, 60 bp, Artificial Sequence
  Description of Artificial Sequence: Synthetic probe
gccgtgcacaccaatcctcccccccattcaacatcgtgggcacccaccactactacgcca

SEQ ID NO: 10911 - DNA, 60 bp, Artificial Sequence
  Description of Artificial Sequence: Synthetic probe
aagagcattgtgcaacaaacggaacctggctgacggctcgccgtgcacaccaatcctccc

SEQ ID NO: 10912 - DNA, 60 bp, Artificial Sequence
  Description of Artificial Sequence: Synthetic probe
ggcgtggcgtttaaggttgcgggtggactaccgtctggtatgccactcacttccatcatc

SEQ ID NO: 10913 - DNA, 60 bp, Artificial Sequence
  Description of Artificial Sequence: Synthetic probe
caattgttgattcggcctgtgcacgactcaaatcaaacccagttggcatcttcaatggcg

SEQ ID NO: 10914 - DNA, 60 bp, Artificial Sequence
  Description of Artificial Sequence: Synthetic probe
agttacatcccaatcaattgacatccacaggcacttcactgacaaatctccaattgttga

SEQ ID NO: 10915 - DNA, 60 bp, Artificial Sequence
  Description of Artificial Sequence: Synthetic probe
gaacagtgggtgtggggcccatgttcacgtgatctctagggaagataacttcagaggaaa

SEQ ID NO: 10916 - DNA, 60 bp, Artificial Sequence
  Description of Artificial Sequence: Synthetic probe
ccctgagcccgctcgggtttgttctggtagacgaccaaccaattggatcaaattcttcaa

SEQ ID NO: 10917 - DNA, 60 bp, Artificial Sequence
  Description of Artificial Sequence: Synthetic probe
caaccctgagcccgctcgggtttgttctggtagacgaccaaccaattggatcaaattctt

SEQ ID NO: 10918 - DNA, 51 bp, Artificial Sequence
  Description of Artificial Sequence: Synthetic probe
aagtcgcagtcaatgtacatcacgaccgtcaattacagtgaagctagggtc

SEQ ID NO: 10919 - DNA, 60 bp, Artificial Sequence
  Description of Artificial Sequence: Synthetic probe
cgaaatcaagatccaagccaaaagtggggacaccacccgctggtttcacgtcgtggacac

SEQ ID NO: 10920 - DNA, 60 bp, Artificial Sequence
  Description of Artificial Sequence: Synthetic probe
ctacgtcccgatcgaaatcaagatccaagccaaaagtggggacaccacccgctggtttca

SEQ ID NO: 10921 - DNA, 60 bp, Artificial Sequence
  Description of Artificial Sequence: Synthetic probe
atcacgaggtcaacaactctacaatgccggtctctacgccagtcaacacggagaggaatt

SEQ ID NO: 10922 - DNA, 60 bp, Artificial Sequence
  Description of Artificial Sequence: Synthetic probe
gtttggactgaaaccgactcggaccgacaaaacggatgctgaaataacgcctatccctgc

SEQ ID NO: 10923 - DNA, 60 bp, Artificial Sequence
  Description of Artificial Sequence: Synthetic probe
gtttggactgaaaccgactcggaccgacaaaacggatgctgaaataacgcccatccctgc

SEQ ID NO: 10924 - DNA, 60 bp, Artificial Sequence
  Description of Artificial Sequence: Synthetic probe
tcaaacctacgacagtttggactgaaaccgactcggaccgacaaaacggatgctgaaata

SEQ ID NO: 10925 - DNA, 60 bp, Artificial Sequence
  Description of Artificial Sequence: Synthetic probe
ctccatggggaaaagttctaccgccgcgttggctcgctggtgaccgccgaagcccgcagc

SEQ ID NO: 10926 - DNA, 60 bp, Artificial Sequence
  Description of Artificial Sequence: Synthetic probe
ggatcaacccaagccctggtcattttctgatgcctgtcaatccctcgacaagaccaccag

SEQ ID NO: 10927 - DNA, 60 bp, Artificial Sequence
  Description of Artificial Sequence: Synthetic probe
ggtggtgcaccgcgccgtgcagagaatacggtcgtctcccacccagctggagtcccacaa

SEQ ID NO: 10928 - DNA, 60 bp, Artificial Sequence
  Description of Artificial Sequence: Synthetic probe
tgctatgtccaagacctcgttgtccagactgttggcctcagccacggccctcgccctaga

SEQ ID NO: 10929 - DNA, 60 bp, Artificial Sequence
  Description of Artificial Sequence: Synthetic probe
aacaatatcacggaggtcgtccgggaccgctcctctacccaggcctacatacgcaccctt

SEQ ID NO: 10930 - DNA, 60 bp, Artificial Sequence
  Description of Artificial Sequence: Synthetic probe
tggccctttccaccaccctacccagccgtggaatcaggcggtcccagaattccaccaaga

SEQ ID NO: 10931 - DNA, 57 bp, Artificial Sequence
  Description of Artificial Sequence: Synthetic probe
cgcgggcctccaccggaccctccgcaggcctcgagtgatacccctcaaggcagcccc

SEQ ID NO: 10932 - DNA, 60 bp, Artificial Sequence
  Description of Artificial Sequence: Synthetic probe
ccaccaaaagtaacactacaatcaattgacattctcaggcatttcactgacaaatcccca

SEQ ID NO: 10933 - DNA, 60 bp, Artificial Sequence
  Description of Artificial Sequence: Synthetic probe
ccaaccaccaaaagtaacactacaatcaattgacattctcaggcatttcactgacaaatc

SEQ ID NO: 10934 - DNA, 52 bp, Artificial Sequence
  Description of Artificial Sequence: Synthetic probe
tatgccactaacatccatcatcaactcactgaaccactgccttatggtgggc

SEQ ID NO: 10935 - DNA, 60 bp, Artificial Sequence
  Description of Artificial Sequence: Synthetic probe
ggtgagaactgcacacgagaacagtgggtgtggggcccacgttcacgtggtctccagaga

SEQ ID NO: 10936 - DNA, 60 bp, Artificial Sequence
  Description of Artificial Sequence: Synthetic probe
gtttggcctgaaaccgacccggaccgacaagtcggatgctgagataacgcctatccctgc

SEQ ID NO: 10937 - DNA, 60 bp, Artificial Sequence
  Description of Artificial Sequence: Synthetic probe
ctcgatggacctgttcacatacggtgacgacggtgtctacattgtcccgccgctcatctc

SEQ ID NO: 10938 - DNA, 60 bp, Artificial Sequence
  Description of Artificial Sequence: Synthetic probe
gactcgatggacctgttcacatacggtgacgacggtgtctacattgtcccgccgctcatc

SEQ ID NO: 10939 - DNA, 60 bp, Artificial Sequence
  Description of Artificial Sequence: Synthetic probe
gccaatcctccctcccttcaacatcgttgggacccaccactactacgcaacaaaacccgg

SEQ ID NO: 10940 - DNA, 60 bp, Artificial Sequence
  Description of Artificial Sequence: Synthetic probe
catgcgagccaatcctccctcccttcaacatcgttgggacccaccactactacgcaacaa

SEQ ID NO: 10941 - DNA, 60 bp, Artificial Sequence
  Description of Artificial Sequence: Synthetic probe
catgcgagccaatcctccctcccttcaacatcgtggggacccaccactactacgcaacaa

SEQ ID NO: 10942 - DNA, 60 bp, Artificial Sequence
  Description of Artificial Sequence: Synthetic probe
ctgatgtctatgcttctataggaactgaatatagctacatggatcctccagacctcatcc

SEQ ID NO: 10943 - DNA, 54 bp, Artificial Sequence
  Description of Artificial Sequence: Synthetic probe
gtggtacactcaatctggtcatcaatccttatgaactctttcttcctgatgaac

SEQ ID NO: 10944 - DNA, 54 bp, Artificial Sequence
  Description of Artificial Sequence: Synthetic probe
gtggtacactcaatctggtaatcaatccttatgaactctttcttcctgatgaac

SEQ ID NO: 10945 - DNA, 60 bp, Artificial Sequence
  Description of Artificial Sequence: Synthetic probe
aacttcagaggaaaggcattcacggttaacagatccagactcgaatctgttccccatctt

SEQ ID NO: 10946 - DNA, 50 bp, Artificial Sequence
  Description of Artificial Sequence: Synthetic probe
aacttcagaggaaaggcattcacggttaacagatccagactcgaatctgt

SEQ ID NO: 10947 - DNA, 60 bp, Artificial Sequence
  Description of Artificial Sequence: Synthetic probe
caggtatggtgcaaatttcaatctgtacaaaggtgtagtcaggactgttcacgagaacag

SEQ ID NO: 10948 - DNA, 57 bp, Artificial Sequence
  Description of Artificial Sequence: Synthetic probe
gtcccagtattcggatttgtctgccaaaatgatgaaattgacactgtgtacaaccta

SEQ ID NO: 10949 - DNA, 60 bp, Artificial Sequence
  Description of Artificial Sequence: Synthetic probe
cccttggcgttgtcatgtccgacaaggatgtaacgacaatgttctactacatcaagggga

SEQ ID NO: 10950 - DNA, 60 bp, Artificial Sequence
  Description of Artificial Sequence: Synthetic probe
tacggtgcaaatttcaatttgtataagggcatggtaagaactgcacacgagaacagtggg

SEQ ID NO: 10951 - DNA, 60 bp, Artificial Sequence
  Description of Artificial Sequence: Synthetic probe
gacactgtcctcaacctacttgccgccgttaaggccaggtacggtgcaaatttcaatttg

SEQ ID NO: 10952 - DNA, 60 bp, Artificial Sequence
  Description of Artificial Sequence: Synthetic probe
acaatgaaattgacactgtcctcaacctacttgccgccgttaaggccaggtacggtgcaa

SEQ ID NO: 10953 - DNA, 60 bp, Artificial Sequence
  Description of Artificial Sequence: Synthetic probe
cccatctcgagggagactccttcaggagatcccttggcgttgttatgtctgacaaagacg

SEQ ID NO: 10954 - DNA, 60 bp, Artificial Sequence
  Description of Artificial Sequence: Synthetic probe
ttcaatggcgtggcgtttaaggttgcgggtggactaccgtctggtatgccactcacttcc

SEQ ID NO: 10955 - DNA, 60 bp, Artificial Sequence
  Description of Artificial Sequence: Synthetic probe
ggcatcttcaatggcgtggcgtttaaggttgcgggtggaccaccgtctggtatgccactc

SEQ ID NO: 10956 - DNA, 60 bp, Artificial Sequence
  Description of Artificial Sequence: Synthetic probe
aagtcaagcccagttggcatcttcaatggcgtggcgtttaaggttgcgggtggaccaccg

SEQ ID NO: 10957 - DNA, 60 bp, Artificial Sequence
  Description of Artificial Sequence: Synthetic probe
cggcctgtgcacgactcaaatcaaacccagttggcatcttcaatggcgtggcgtttaagg

SEQ ID NO: 10958 - DNA, 55 bp, Artificial Sequence
  Description of Artificial Sequence: Synthetic probe
tgctgagataacgcctatccctgctgatgaacctgttgagtttctcaagcgaaca

SEQ ID NO: 10959 - DNA, 53 bp, Artificial Sequence
  Description of Artificial Sequence: Synthetic probe
cagtgggtgtggggcccacgttcacgtgatctctagggaagataacttcagag

SEQ ID NO: 10960 - DNA, 55 bp, Artificial Sequence
  Description of Artificial Sequence: Synthetic probe
ggcgccggcacaatctgctctgacaaccctagcagcagcgtcaaccggtaaaacg

SEQ ID NO: 10961 - DNA, 60 bp, Artificial Sequence
  Description of Artificial Sequence: Synthetic probe
ggcgccggcacaatctgctctgacaaccctagcagcagcgtcaaccggtaaaacggttga

SEQ ID NO: 10962 - DNA, 60 bp, Artificial Sequence
  Description of Artificial Sequence: Synthetic probe
cacttggccagatggaactccttgcgagcccatccttcctccatttgtcatcgagggaac

SEQ ID NO: 10963 - DNA, 57 bp, Artificial Sequence
  Description of Artificial Sequence: Synthetic probe
cacttggccagatggaactccttgcgagcccatccttcctccatttgtcatcgaggg

SEQ ID NO: 10964 - DNA, 60 bp, Artificial Sequence
  Description of Artificial Sequence: Synthetic probe
gtgctgccgctttcaaacgtgtttccgaatcaatcatggcaaaccacgctctcggcttca

SEQ ID NO: 10965 - DNA, 60 bp, Artificial Sequence
  Description of Artificial Sequence: Synthetic probe
gccgtcaaggctaggtatggtgcaaatttcaatctgtacaagggcatggctcgaactgca

SEQ ID NO: 10966 - DNA, 60 bp, Artificial Sequence
  Description of Artificial Sequence: Synthetic probe
ttccccaaacggacggacccaacggcaacgaacccgaattcatcgctgaagcttgcccca

SEQ ID NO: 10967 - DNA, 60 bp, Artificial Sequence
  Description of Artificial Sequence: Synthetic probe
cagaggaaaggcattcacagttaacaaatctagacttgaatcagttccccacctcgaggg

SEQ ID NO: 10968 - DNA, 60 bp, Artificial Sequence
  Description of Artificial Sequence: Synthetic probe
cgggaagagaacttcagaggaaaggcattcacagttaacaaatctagacttgaatcagtt

SEQ ID NO: 10969 - DNA, 60 bp, Artificial Sequence
  Description of Artificial Sequence: Synthetic probe
gtccgcactgagaacggcataagagcattgcttgatagatcttccataattcggcaattc

SEQ ID NO: 10970 - DNA, 60 bp, Artificial Sequence
  Description of Artificial Sequence: Synthetic probe
tcaagcggacaattgtccgcactgagaacggcataagagcattgcttgatagatcttcca

SEQ ID NO: 10971 - DNA, 60 bp, Artificial Sequence
  Description of Artificial Sequence: Synthetic probe
gtcccacccaagagaattgacaccccatctcggggccaacaactctacaatgcatgcctg

SEQ ID NO: 10972 - DNA, 60 bp, Artificial Sequence
  Description of Artificial Sequence: Synthetic probe
aaattggactgtcccacccaagagaattgacaccccatctcggggccaacaactctacaa

SEQ ID NO: 10973 - DNA, 60 bp, Artificial Sequence
  Description of Artificial Sequence: Synthetic probe
cggcaattctactacatcaaagcggaaaacactgaaaattggactgtcccacccaagaga

SEQ ID NO: 10974 - DNA, 60 bp, Artificial Sequence
  Description of Artificial Sequence: Synthetic probe
agatcatccataattcggcaattctactacatcaaagcggaaaacactgaaaattggact

SEQ ID NO: 10975 - DNA, 60 bp, Artificial Sequence
  Description of Artificial Sequence: Synthetic probe
caagcggacgatagttcgcactgagaacggcgtacgtgcattgcttgatagatcatccat

SEQ ID NO: 10976 - DNA, 60 bp, Artificial Sequence
  Description of Artificial Sequence: Synthetic probe
tcaagcggacgatagttcgcactgagaacggcgtacgtgcattgcttgatagatcatcca

SEQ ID NO: 10977 - DNA, 60 bp, Artificial Sequence
  Description of Artificial Sequence: Synthetic probe
atgttggcctgtctgacctttctcatgatcttcaattccctctttctgcgaccttcatgg

SEQ ID NO: 10978 - DNA, 60 bp, Artificial Sequence
  Description of Artificial Sequence: Synthetic probe
ggcaattacaacctcccccctgactctcttgccgtctatggaatcactgactctgcatct

SEQ ID NO: 10979 - DNA, 60 bp, Artificial Sequence
  Description of Artificial Sequence: Synthetic probe
ggcccgcaaccaagcagaccattcacgcaaccctgagtccactcggatacgttttggtcg

SEQ ID NO: 10980 - DNA, 60 bp, Artificial Sequence
  Description of Artificial Sequence: Synthetic probe
caagctgatgcacagaagaaatcccagacaatgtacattgcaactgctgaagtgtcgggc

SEQ ID NO: 10981 - DNA, 60 bp, Artificial Sequence
  Description of Artificial Sequence: Synthetic probe
caacctcgagaccaagactgttgacccgagtaagaacaacacacacttcaagggcacata

SEQ ID NO: 10982 - DNA, 60 bp, Artificial Sequence
  Description of Artificial Sequence: Synthetic probe
aggcgctggtcccaggaattccagacggttggccggacacaacgattccagccgccacct

SEQ ID NO: 10983 - DNA, 60 bp, Artificial Sequence
  Description of Artificial Sequence: Synthetic probe
cctgttcagcccccgagtcttccaatcggcactttgacttcgattcgactacaacaggat

SEQ ID NO: 10984 - DNA, 60 bp, Artificial Sequence
  Description of Artificial Sequence: Synthetic probe
cactgatcaagcacgggtcgataccatccgacctcatccctcggaactcagcccactgga

SEQ ID NO: 10985 - DNA, 60 bp, Artificial Sequence
  Description of Artificial Sequence: Synthetic probe
gaaactaggccttcccctgacttcactttcgccctcctgaaacctcctggctcactgatc

SEQ ID NO: 10986 - DNA, 60 bp, Artificial Sequence
  Description of Artificial Sequence: Synthetic probe
ttaggttcaccgtatctgggtctggggtgtttggcggtaaactcgccgcgcttctggtcc

SEQ ID NO: 10987 - DNA, 60 bp, Artificial Sequence
  Description of Artificial Sequence: Synthetic probe
ttcttaccacacttctatcaactggtcaacagtggaaccccagggcaaggtgctctactc

SEQ ID NO: 10988 - DNA, 60 bp, Artificial Sequence
  Description of Artificial Sequence: Synthetic probe
cggaggagcaaggtaccgtggtgcaacaacaacctgcacccgcaccagccgccttggcga

SEQ ID NO: 10989 - DNA, 60 bp, Artificial Sequence
  Description of Artificial Sequence: Synthetic probe
acggaacctggcccgatggtacaccgtgcgagccaatcctccccccgttcacatcgacgg

SEQ ID NO: 10990 - DNA, 51 bp, Artificial Sequence
  Description of Artificial Sequence: Synthetic probe
acagatctagactagaatcagttccccatctcgagggagactccttcagga

SEQ ID NO: 10991 - DNA, 60 bp, Artificial Sequence
  Description of Artificial Sequence: Synthetic probe
tcgcaccttgacgtgggagatttcctggtggcagtgcacgagggccttccatcaggtttt

SEQ ID NO: 10992 - DNA, 60 bp, Artificial Sequence
  Description of Artificial Sequence: Synthetic probe
cgcaccttgacgtgggagatttcctggtggcagtgcacgagggccttccatcaggttttc

SEQ ID NO: 10993 - DNA, 58 bp, Artificial Sequence
  Description of Artificial Sequence: Synthetic probe
caccttgacgtgggagatttcctggtggcagtgcacgagggccttccatcaggttttc

SEQ ID NO: 10994 - DNA, 58 bp, Artificial Sequence
  Description of Artificial Sequence: Synthetic probe
catcttgacgtgggagatttcctggtggcagtgcacgagggccttccatcaggttttc

SEQ ID NO: 10995 - DNA, 60 bp, Artificial Sequence
  Description of Artificial Sequence: Synthetic probe
ccctgtgtgcgctctcagaagtcaccaacctggacccagatgtggtgcaggcaaacagct

SEQ ID NO: 10996 - DNA, 60 bp, Artificial Sequence
  Description of Artificial Sequence: Synthetic probe
tcttacacaagaaagacctaaccgatctctacggagaacggtgcggcacactcaatttgg

SEQ ID NO: 10997 - DNA, 56 bp, Artificial Sequence
  Description of Artificial Sequence: Synthetic probe
gatggtccaggaaattccgagattgtgacggaagaacaaggcactgtcgttcaaca

SEQ ID NO: 10998 - DNA, 60 bp, Artificial Sequence
  Description of Artificial Sequence: Synthetic probe
ttcggtccaccgcgaacgttgaaactaacttcacgttcagggccgaatcggatggtccag

SEQ ID NO: 10999 - DNA, 60 bp, Artificial Sequence
  Description of Artificial Sequence: Synthetic probe
gagcattgtgcgacaaatggtgcttggcctgatggtacaccatgtgagccaatcctcccc

SEQ ID NO: 11000 - DNA, 60 bp, Artificial Sequence
  Description of Artificial Sequence: Synthetic probe
gtacagctatattgatcctcctgacctcatctatgaagagcattgtgcgacaaatggtgc

SEQ ID NO: 11001 - DNA, 60 bp, Artificial Sequence
  Description of Artificial Sequence: Synthetic probe
caataggaactgagtacagctatattgatcctcctgacctcatctatgaagagcattgtg

SEQ ID NO: 11002 - DNA, 60 bp, Artificial Sequence
  Description of Artificial Sequence: Synthetic probe
gatgatcctttcaattgttgtttccctgatgtttacgcttcaataggaactgagtacagc

SEQ ID NO: 11003 - DNA, 60 bp, Artificial Sequence
  Description of Artificial Sequence: Synthetic probe
tgattggtgtgatgatcctttcaattgttgtttccctgatgtttacgcttcaataggaac

SEQ ID NO: 11004 - DNA, 60 bp, Artificial Sequence
  Description of Artificial Sequence: Synthetic probe
cgcaagtggtggaattgggctcggtggtgaggtgtttgagaattagccactatggctact

SEQ ID NO: 11005 - DNA, 60 bp, Artificial Sequence
  Description of Artificial Sequence: Synthetic probe
cgagtggtggaactgggttcggtggtgaggtgtttgagaattagccactatggctactac

SEQ ID NO: 11006 - DNA, 60 bp, Artificial Sequence
  Description of Artificial Sequence: Synthetic probe
ccatcaaccattggattctgaccctgtgcgcgctctcagaagtcaccaacctggacccag

SEQ ID NO: 11007 - DNA, 60 bp, Artificial Sequence
  Description of Artificial Sequence: Synthetic probe
aagggcatggctcgaactgcacacgagaacagtgggtgtggggcccatgttcacgtggtc

SEQ ID NO: 11008 - DNA, 60 bp, Artificial Sequence
  Description of Artificial Sequence: Synthetic probe
gcttctgtcgtttgacgacctcgaatttctcttacacaaaaaggacctaaccgatctcta

SEQ ID NO: 11009 - DNA, 60 bp, Artificial Sequence
  Description of Artificial Sequence: Synthetic probe
tggaccctgttcaaagcacttctatgcttcagtacccacatgttctatttgacgctcgtc

SEQ ID NO: 11010 - DNA, 52 bp, Artificial Sequence
  Description of Artificial Sequence: Synthetic probe
ttcaggtgacttggaacatcttcgattcgatggacctgttcacttacggtga

SEQ ID NO: 11011 - DNA, 60 bp, Artificial Sequence
  Description of Artificial Sequence: Synthetic probe
ctgatgcgagtggtggacttgggctcggtggtgaggtgtttgagaattagccactatggc

SEQ ID NO: 11012 - DNA, 60 bp, Artificial Sequence
  Description of Artificial Sequence: Synthetic probe
gctgatgcgagtggtggacttgggctcggtggtgaggtgtttgagaattagccactatgg

SEQ ID NO: 11013 - DNA, 60 bp, Artificial Sequence
  Description of Artificial Sequence: Synthetic probe
gaccttgcaaatctgcactcttactatagcttctacaaaacggactagttccaacctgct

SEQ ID NO: 11014 - DNA, 60 bp, Artificial Sequence
  Description of Artificial Sequence: Synthetic probe
aagctgaccttgcaaatctgcactcttactatagcttctacaaaacggactagttccaac

SEQ ID NO: 11015 - DNA, 60 bp, Artificial Sequence
  Description of Artificial Sequence: Synthetic probe
gacaaatctccaattgttgattcggcctgtgctacactcaagtcaagcccagttggcatc

SEQ ID NO: 11016 - DNA, 60 bp, Artificial Sequence
  Description of Artificial Sequence: Synthetic probe
tgtcgtttgacgacctcgaatttctcttacacaagaaggacctaaccgatctctacggag

SEQ ID NO: 11017 - DNA, 60 bp, Artificial Sequence
  Description of Artificial Sequence: Synthetic probe
ccacatctggacacatctatggtgcttcagcatcatcctgttccttaacccgccaggtga

SEQ ID NO: 11018 - DNA, 60 bp, Artificial Sequence
  Description of Artificial Sequence: Synthetic probe
agaatttaacaccacatctggacacatctatggtgcttcagcatcatcctgttccttaac

SEQ ID NO: 11019 - DNA, 60 bp, Artificial Sequence
  Description of Artificial Sequence: Synthetic probe
gctactttcaggctgaacagcaccctcccaactgctgttccagtcggaacatccaaaccc

SEQ ID NO: 11020 - DNA, 60 bp, Artificial Sequence
  Description of Artificial Sequence: Synthetic probe
tgaattggctactttcaggctgaacagcaccctcccaactgctgttccagtcggaacatc

SEQ ID NO: 11021 - DNA, 60 bp, Artificial Sequence
  Description of Artificial Sequence: Synthetic probe
cggtgatgcgttacgcgtccatgctcttcggaacgctggcctacgcataaacccgtactc

SEQ ID NO: 11022 - DNA, 60 bp, Artificial Sequence
  Description of Artificial Sequence: Synthetic probe
agcatgttgcagtacccacacgttttatttgacgcacgccaaactgaacctgtgatcttc

SEQ ID NO: 11023 - DNA, 60 bp, Artificial Sequence
  Description of Artificial Sequence: Synthetic probe
atgaagaacattgtgcatcgaacggcacctggctgacggaacaccgtgtcacgccgatcc

SEQ ID NO: 11024 - DNA, 60 bp, Artificial Sequence
  Description of Artificial Sequence: Synthetic probe
cagcacagtttgtgccgctgccttcaaacgcgtctcagagtcaatcatggcaaaccacgc

SEQ ID NO: 11025 - DNA, 60 bp, Artificial Sequence
  Description of Artificial Sequence: Synthetic probe
ttccacgtctcgccagcccacactgacgactatgaggagtgtacacaccaacccgcgtca

SEQ ID NO: 11026 - DNA, 60 bp, Artificial Sequence
  Description of Artificial Sequence: Synthetic probe
cagttcattgcccctggtggaaccatcatcctcgagtcatgctatggcgcacgcatgtgg

SEQ ID NO: 11027 - DNA, 60 bp, Artificial Sequence
  Description of Artificial Sequence: Synthetic probe
ggatcccactggtagaaaccaccaatcccggcgagctccccatccccagcaaatcacact

SEQ ID NO: 11028 - DNA, 60 bp, Artificial Sequence
  Description of Artificial Sequence: Synthetic probe
atccaagcccactggcattgtggcggggatcaaggccatccagactcttgcggccatgtt

SEQ ID NO: 11029 - DNA, 60 bp, Artificial Sequence
  Description of Artificial Sequence: Synthetic probe
ggagacagaccctaccattctaccaacagagacttgaagctcgcaggacttggcgtgaga

SEQ ID NO: 11030 - DNA, 51 bp, Artificial Sequence
  Description of Artificial Sequence: Synthetic probe
tccctccactcatatcctctgtcatgcccaaggtcttcgcgaacttgcgac

SEQ ID NO: 11031 - DNA, 55 bp, Artificial Sequence
  Description of Artificial Sequence: Synthetic probe
ctgtctcatggtaggactagctgttgctaaggctctcgaggattctggtgtgcag

SEQ ID NO: 11032 - DNA, 60 bp, Artificial Sequence
  Description of Artificial Sequence: Synthetic probe
ggcatcttcaatggtgtggctttcaaggttgcgggtggtctgccgtcaggcatgccactc

SEQ ID NO: 11033 - DNA, 60 bp, Artificial Sequence
  Description of Artificial Sequence: Synthetic probe
aatcaaacccaatcggcatcttcaatggtgtggctttcaaggttgcgggtggtctgccgt

SEQ ID NO: 11034 - DNA, 60 bp, Artificial Sequence
  Description of Artificial Sequence: Synthetic probe
ccaccaaaagtcacatcccaatcaattgatatcctcagacacttcacagacaaatctcca

SEQ ID NO: 11035 - DNA, 60 bp, Artificial Sequence
  Description of Artificial Sequence: Synthetic probe
gactcaactcaaccaccaaaagtcacatcccaatcaattgatatcctcagacacttcaca

SEQ ID NO: 11036 - DNA, 60 bp, Artificial Sequence
  Description of Artificial Sequence: Synthetic probe
atgtgggccacaggccagcgcctcatccgcgctggtgggatcacagaggctggtggtcca

SEQ ID NO: 11037 - DNA, 60 bp, Artificial Sequence
  Description of Artificial Sequence: Synthetic probe
acgcatgtgggccacaggccagcgcctcatccgcgctggtggactcacggaggctggtgg

SEQ ID NO: 11038 - DNA, 55 bp, Artificial Sequence
  Description of Artificial Sequence: Synthetic probe
tgcttggatgagatttcatgatttgtcgctgtgggaaggtagtcgcgacatcctt

SEQ ID NO: 11039 - DNA, 60 bp, Artificial Sequence
  Description of Artificial Sequence: Synthetic probe
catgtttgcttggatgaggtttcatgatttgtcgctgtgggaaggtagtcgcgacaccct

SEQ ID NO: 11040 - DNA, 60 bp, Artificial Sequence
  Description of Artificial Sequence: Synthetic probe
cggtgcgtccactctccctgaatttaactttcctcttactgcgaccttcatgggagtgca

SEQ ID NO: 11041 - DNA, 60 bp, Artificial Sequence
  Description of Artificial Sequence: Synthetic probe
gggttcagctacgtcggtgcgtccactctccctgaatttaactttcctcttactgcgacc

SEQ ID NO: 11042 - DNA, 60 bp, Artificial Sequence
  Description of Artificial Sequence: Synthetic probe
ctggtttgatctcggtatcgaccatgatgggttctgctacgtcggtgcgtccactctccc

SEQ ID NO: 11043 - DNA, 60 bp, Artificial Sequence
  Description of Artificial Sequence: Synthetic probe
tcaccgattctagctccagctggtttgatctcggtatcgaccatgatgggttcagctacg

SEQ ID NO: 11044 - DNA, 60 bp, Artificial Sequence
  Description of Artificial Sequence: Synthetic probe
gcgaatccacgaaagttgtgaggatcgcaacgctaccagaggcattcgctaatggtggca

SEQ ID NO: 11045 - DNA, 60 bp, Artificial Sequence
  Description of Artificial Sequence: Synthetic probe
ccatgtctcagctcggttatgtgctcgtcgatgagaaaccaattgggagcgaatccacga

SEQ ID NO: 11046 - DNA, 60 bp, Artificial Sequence
  Description of Artificial Sequence: Synthetic probe
cacttctcctctacaatgctgacaacagagaagtcatgacaaaaactgaagtggctcatt

SEQ ID NO: 11047 - DNA, 60 bp, Artificial Sequence
  Description of Artificial Sequence: Synthetic probe
caaattggaaccaagtcacaaaattagctccaactcacttctcctctacaatgctgacaa

SEQ ID NO: 11048 - DNA, 60 bp, Artificial Sequence
  Description of Artificial Sequence: Synthetic probe
gggcaacctcatgacaagggctgataataaatccacaaaccaagaagaaatgcaacgcac

SEQ ID NO: 11049 - DNA, 60 bp, Artificial Sequence
  Description of Artificial Sequence: Synthetic probe
acaactggtgcctgggatccctgatggttggcctgacacaaccatccctgagaacaccat

SEQ ID NO: 11050 - DNA, 60 bp, Artificial Sequence
  Description of Artificial Sequence: Synthetic probe
ccgttggtggacaaccatcgacggttttgttgtccagcccagggtgttccagtcaaacag

SEQ ID NO: 11051 - DNA, 60 bp, Artificial Sequence
  Description of Artificial Sequence: Synthetic probe
cttcaccttttccttacttaaaccccccggttctctcttgaaacatggttccgtaccatc

SEQ ID NO: 11052 - DNA, 60 bp, Artificial Sequence
  Description of Artificial Sequence: Synthetic probe
gacatcaaatcaagttgctccatcactgttgagaccagaccatctactgacttcaccttt

SEQ ID NO: 11053 - DNA, 60 bp, Artificial Sequence
  Description of Artificial Sequence: Synthetic probe
ggaagaccctctaccactcaatggatgacactgatacaacaaaacttgtcatcatggttt

SEQ ID NO: 11054 - DNA, 60 bp, Artificial Sequence
  Description of Artificial Sequence: Synthetic probe
gcctgtggaatcaccatccatgctacaatacccacgcgtgctatttgatgctcgccaaac

SEQ ID NO: 11055 - DNA, 60 bp, Artificial Sequence
  Description of Artificial Sequence: Synthetic probe
gacacgagcgtgaacttcgtgttccgggctgaatcggatggtcccagtaaccccgatgtc

SEQ ID NO: 11056 - DNA, 60 bp, Artificial Sequence
  Description of Artificial Sequence: Synthetic probe
ttggccagacggcactccttgtgaacccatcctgcctccattcgtcatcgagggaaccac

SEQ ID NO: 11057 - DNA, 60 bp, Artificial Sequence
  Description of Artificial Sequence: Synthetic probe
aggcgtgcaagtgacttggaacatcttcgactcgatggaccttttctacggtgatgacgg

SEQ ID NO: 11058 - DNA, 60 bp, Artificial Sequence
  Description of Artificial Sequence: Synthetic probe
ggggcatggagatctttgtgccatcacaccgctccatgtttgcttggatgagatttcatg

SEQ ID NO: 11059 - DNA, 60 bp, Artificial Sequence
  Description of Artificial Sequence: Synthetic probe
ggggaatggagatctttgtaccatcacaccgctccatgtttgcttggatgagatttcatg

SEQ ID NO: 11060 - DNA, 60 bp, Artificial Sequence
  Description of Artificial Sequence: Synthetic probe
ctcgaggacaacaactctacaatgcaagtctctatgccagccaacacggggaggaattct

SEQ ID NO: 11061 - DNA, 60 bp, Artificial Sequence
  Description of Artificial Sequence: Synthetic probe
atctcgaggacaacaactctacaatgcaagtctctatgccagccaacacggggaggaatt

SEQ ID NO: 11062 - DNA, 60 bp, Artificial Sequence
  Description of Artificial Sequence: Synthetic probe
gtccgaactgagaatggcatacgagcacttctggacaaatcctcaataattcggcagttc

SEQ ID NO: 11063 - DNA, 60 bp, Artificial Sequence
  Description of Artificial Sequence: Synthetic probe
tcaaacgaacacttgtccgaactgagaatggcatacgagcacttctggacaaatcctcaa

SEQ ID NO: 11064 - DNA, 60 bp, Artificial Sequence
  Description of Artificial Sequence: Synthetic probe
cggcctgaaaccgacccggaccgataaaacggatgctgagataacgcctatccctgcaga

SEQ ID NO: 11065 - DNA, 60 bp, Artificial Sequence
  Description of Artificial Sequence: Synthetic probe
gaacctacgacagttcggcctgaaaccgacccggaccgataaaacggatgctgagataac

SEQ ID NO: 11066 - DNA, 60 bp, Artificial Sequence
  Description of Artificial Sequence: Synthetic probe
tcaaacttacgacagtttggcctgaagccgacccggaccgacaaaacggatgctgagata

SEQ ID NO: 11067 - DNA, 60 bp, Artificial Sequence
  Description of Artificial Sequence: Synthetic probe
gatttcctggtggcagtgcacgagggccttccatcaggttttccatgcacctcccaggtc

SEQ ID NO: 11068 - DNA, 56 bp, Artificial Sequence
  Description of Artificial Sequence: Synthetic probe
ggggacttcctggtggcagtgcacgagggccttccatctggctttccgtgcacctc

SEQ ID NO: 11069 - DNA, 60 bp, Artificial Sequence
  Description of Artificial Sequence: Synthetic probe
gagtcagttccccatctcgagggagactccttcaggagatcccttggcgtcgtcatgtct

SEQ ID NO: 11070 - DNA, 55 bp, Artificial Sequence
  Description of Artificial Sequence: Synthetic probe
cttcgatcggcagcacaccgattgttggaacagccagattctgatgtacatctca

SEQ ID NO: 11071 - DNA, 60 bp, Artificial Sequence
  Description of Artificial Sequence: Synthetic probe
ccagttggaagtgaatcttcaaaggtcgtgagaattgcaacactgccagaagcattcgct

SEQ ID NO: 11072 - DNA, 60 bp, Artificial Sequence
  Description of Artificial Sequence: Synthetic probe
aaaatccagttggaagtgaatcttcaaaggtcgtgagaattgcaacactgccagaagcat

SEQ ID NO: 11073 - DNA, 60 bp, Artificial Sequence
  Description of Artificial Sequence: Synthetic probe
cccattcaaccatgtcccagctcggttacgtgcttgtcgacgaaaatccagttggaagtg

SEQ ID NO: 11074 - DNA, 60 bp, Artificial Sequence
  Description of Artificial Sequence: Synthetic probe
caaagttgcccattcaaccatgtcccagctcggttacgtgcttgtcgacgaaaatccagt

SEQ ID NO: 11075 - DNA, 60 bp, Artificial Sequence
  Description of Artificial Sequence: Synthetic probe
aacacacttcggtgacgttgtttgcaacaaacgcaaagaggaatggcaataatttggaac

SEQ ID NO: 11076 - DNA, 60 bp, Artificial Sequence
  Description of Artificial Sequence: Synthetic probe
gaactacaacacacttcggtgacgttgtttgcaacaaacgcaaagaggaatggcaataat

SEQ ID NO: 11077 - DNA, 60 bp, Artificial Sequence
  Description of Artificial Sequence: Synthetic probe
caagaaccaggaatgagcagaaaaccaatgatgaagaactacaacacacttcggtgacgt

SEQ ID NO: 11078 - DNA, 60 bp, Artificial Sequence
  Description of Artificial Sequence: Synthetic probe
tgggcaatctcacaacaagaaccaggaatgagcagaaaaccaatgatgaagaactacaac

SEQ ID NO: 11079 - DNA, 60 bp, Artificial Sequence
  Description of Artificial Sequence: Synthetic probe
agagaatcccacccacttcaagggattctacataatgggcaatctcacaacaagaaccag

SEQ ID NO: 11080 - DNA, 60 bp, Artificial Sequence
  Description of Artificial Sequence: Synthetic probe
tgtctataagatcagagagaatcccacccacttcaagggattctacataatgggcaatct

SEQ ID NO: 11081 - DNA, 51 bp, Artificial Sequence
  Description of Artificial Sequence: Synthetic probe
cgaacccgcaatcatgtccaacggcaagtacgactacactttggatgagca

SEQ ID NO: 11082 - DNA, 60 bp, Artificial Sequence
  Description of Artificial Sequence: Synthetic probe
ttgtgccaggaatccccgacggttggccggacacaaccatccccgaacccgcaatcatgt

SEQ ID NO: 11083 - DNA, 60 bp, Artificial Sequence
  Description of Artificial Sequence: Synthetic probe
aaacaacttgtgccaggaatccccgacggttggccggacacaaccatccccgaacccgca

SEQ ID NO: 11084 - DNA, 60 bp, Artificial Sequence
  Description of Artificial Sequence: Synthetic probe
aacaaggtcaatatgcccaagtagtcgatgccgagaaacaacttgtgccaggaatccccg

SEQ ID NO: 11085 - DNA, 60 bp, Artificial Sequence
  Description of Artificial Sequence: Synthetic probe
tgacggtcaagctagaacaaggtcaatatgcccaagtagtcgatgccgagaaacaacttg

SEQ ID NO: 11086 - DNA, 60 bp, Artificial Sequence
  Description of Artificial Sequence: Synthetic probe
ctggttggtcgactccttacttcatccccattgaagtgacggtcaagctagaacaaggtc

SEQ ID NO: 11087 - DNA, 60 bp, Artificial Sequence
  Description of Artificial Sequence: Synthetic probe
tgattccacaacaactggttggtcgactccttacttcatccccattgaagtgacggtcaa

SEQ ID NO: 11088 - DNA, 60 bp, Artificial Sequence
  Description of Artificial Sequence: Synthetic probe
cctgaaacagtttgggctgaaaccgacccggaccgacaaaacggacgctgagataacgcc

SEQ ID NO: 11089 - DNA, 56 bp, Artificial Sequence
  Description of Artificial Sequence: Synthetic probe
aagggcatgacaagaactgcacacgagaacagtgggtgtggggcccatgttcacgt

SEQ ID NO: 11090 - DNA, 60 bp, Artificial Sequence
  Description of Artificial Sequence: Synthetic probe
tgacaagcaatcaacagagtgttacaacagccaaatcctccttaccacacaaaagcttgc

SEQ ID NO: 11091 - DNA, 60 bp, Artificial Sequence
  Description of Artificial Sequence: Synthetic probe
tcacaactgctgactacagaaatgacattgtgtcaccacaacacaaggcaacctcgcaga

SEQ ID NO: 11092 - DNA, 60 bp, Artificial Sequence
  Description of Artificial Sequence: Synthetic probe
tcattgaccccaccaaaaacaccactcactttaaagggacatacatttgtggcaccttgt

SEQ ID NO: 11093 - DNA, 60 bp, Artificial Sequence
  Description of Artificial Sequence: Synthetic probe
gatgggtggcctgacacaacaattcctggcactgtcaccgcgtcaaatggcaacttcgcc

SEQ ID NO: 11094 - DNA, 60 bp, Artificial Sequence
  Description of Artificial Sequence: Synthetic probe
ggtgcaaccacgagtgtttcaatcaaaccggcattttgactttgattcgacaacgacggg

SEQ ID NO: 11095 - DNA, 60 bp, Artificial Sequence
  Description of Artificial Sequence: Synthetic probe
acccccgggatccctcatcaagcatggctccattccctctgatcttatacctaggaattc

SEQ ID NO: 11096 - DNA, 60 bp, Artificial Sequence
  Description of Artificial Sequence: Synthetic probe
gcggcaagctcgcagcactcctggtccctcctggcgttgagccgatcgaatctgtctcca

SEQ ID NO: 11097 - DNA, 60 bp, Artificial Sequence
  Description of Artificial Sequence: Synthetic probe
caactggtcaacagtggaaccacagggtaaggtgctctactcccaggcgctcaacccatc

SEQ ID NO: 11098 - DNA, 60 bp, Artificial Sequence
  Description of Artificial Sequence: Synthetic probe
ccactgtgaacgttgaaacagacttcacgttcagggctgaatcggatggtccagggggtg

SEQ ID NO: 11099 - DNA, 60 bp, Artificial Sequence
  Description of Artificial Sequence: Synthetic probe
acggaacttggcctgatggtacgccttgcgagccaatcctcccccctttcaacatcactg

SEQ ID NO: 11100 - DNA, 60 bp, Artificial Sequence
  Description of Artificial Sequence: Synthetic probe
ttttctgggatctttatttggtggggctgtatcggcggcaatttccactggggcgcaggc

SEQ ID NO: 11101 - DNA, 60 bp, Artificial Sequence
  Description of Artificial Sequence: Synthetic probe
tccttgcccctgacggtccagttccagaacggccgctgctccgtggagggcgatttgctt

SEQ ID NO: 11102 - DNA, 60 bp, Artificial Sequence
  Description of Artificial Sequence: Synthetic probe
gtacggcctcaaaccaactcgccccgacaagacggagggccccatcgaagtgaagcagca

SEQ ID NO: 11103 - DNA, 60 bp, Artificial Sequence
  Description of Artificial Sequence: Synthetic probe
tgaacgcgacctagcagagcgccaggctgatgatgcggactatgacgttggggctattcg

SEQ ID NO: 11104 - DNA, 60 bp, Artificial Sequence
  Description of Artificial Sequence: Synthetic probe
tgagatgtccaaccgcgtccgccctgtggtaatcatgctgagtggcccccctggcatagg

SEQ ID NO: 11105 - DNA, 60 bp, Artificial Sequence
  Description of Artificial Sequence: Synthetic probe
gccttctggtatgccactaacatccatcatcaactccctgaaccactgtctcatggtggg

SEQ ID NO: 11106 - DNA, 60 bp, Artificial Sequence
  Description of Artificial Sequence: Synthetic probe
cctcgcaccttgacgtgggagatttcctggtggcagtgcacgagggccttccatcgggtt

SEQ ID NO: 11107 - DNA, 60 bp, Artificial Sequence
  Description of Artificial Sequence: Synthetic probe
tggaatcagttccccaccttgagggagactccttcaggagatcccttggcgttgtcatgt

SEQ ID NO: 11108 - DNA, 60 bp, Artificial Sequence
  Description of Artificial Sequence: Synthetic probe
tccaacctgaaacagtttggcctgaaaccgacccggaccgacaaaacggatgctgagata

SEQ ID NO: 11109 - DNA, 60 bp, Artificial Sequence
  Description of Artificial Sequence: Synthetic probe
caccacgctgttgcagcgtataacgggtatttcaatggtactgagggccaaccaaaccag

SEQ ID NO: 11110 - DNA, 60 bp, Artificial Sequence
  Description of Artificial Sequence: Synthetic probe
ggaattccaccacgctgttgcagcgtataacgggtatttcaatggtactgagggccaacc

SEQ ID NO: 11111 - DNA, 60 bp, Artificial Sequence
  Description of Artificial Sequence: Synthetic probe
gtttggcctgaaaccgacccggaccgacaaagcggatgctgagataacgcctatccctgc

SEQ ID NO: 11112 - DNA, 60 bp, Artificial Sequence
  Description of Artificial Sequence: Synthetic probe
cttctgtcatgcccagagtcttcaccaacctgaaacagtttggcctgaaaccgacccgga

SEQ ID NO: 11113 - DNA, 60 bp, Artificial Sequence
  Description of Artificial Sequence: Synthetic probe
acgcttctgtcgtttgacgacctcgaatttctcctacacaagaaagacctaaccgacctc

SEQ ID NO: 11114 - DNA, 60 bp, Artificial Sequence
  Description of Artificial Sequence: Synthetic probe
cagtttggcctgaaaccgacccggaccgacaaaacggacgctgagataacgccaatcccc

SEQ ID NO: 11115 - DNA, 60 bp, Artificial Sequence
  Description of Artificial Sequence: Synthetic probe
gatgtctatgcttctataggaactgaatacagctacattcatcctcctgaactcatctat

SEQ ID NO: 11116 - DNA, 60 bp, Artificial Sequence
  Description of Artificial Sequence: Synthetic probe
cgtgcaggtgacttggaacatcttcgattcgatggacctattcacctacggcgatgacgg

SEQ ID NO: 11117 - DNA, 60 bp, Artificial Sequence
  Description of Artificial Sequence: Synthetic probe
cgagaacagtgggtgtggggcccatgttcacgtgatctctagagaggacaacttcagagg

SEQ ID NO: 11118 - DNA, 60 bp, Artificial Sequence
  Description of Artificial Sequence: Synthetic probe
cgcttctgtcgtttgacgacctcgaatttctcttgcacaagaaggacctaaccgatctct

SEQ ID NO: 11119 - DNA, 60 bp, Artificial Sequence
  Description of Artificial Sequence: Synthetic probe
gacccaagcacgatcgatattgtgttgactactcaaaatgggactccacacaaccaccaa

SEQ ID NO: 11120 - DNA, 60 bp, Artificial Sequence
  Description of Artificial Sequence: Synthetic probe
gagggaacccacgactactacgccacaaaacctggcgaagtggtgagtggaatactctcc

SEQ ID NO: 11121 - DNA, 60 bp, Artificial Sequence
  Description of Artificial Sequence: Synthetic probe
tcgagggaacccacgactactacgccacaaaacctggcgaagtggtgagtggaatactct

SEQ ID NO: 11122 - DNA, 60 bp, Artificial Sequence
  Description of Artificial Sequence: Synthetic probe
ggccagatggaactccttgcgagcccatccttcctccatttgtcatcgagggaacccacg

SEQ ID NO: 11123 - DNA, 60 bp, Artificial Sequence
  Description of Artificial Sequence: Synthetic probe
acacaagaaagacctaaccgatctctacggagaacggtgcggcacactcaatttggtcat

SEQ ID NO: 11124 - DNA, 60 bp, Artificial Sequence
  Description of Artificial Sequence: Synthetic probe
acagtttggcctgaaaccgacccggaccgacaaaacggatgctgagataacgcctatccc

SEQ ID NO: 11125 - DNA, 60 bp, Artificial Sequence
  Description of Artificial Sequence: Synthetic probe
ccagagtcttcaccaacctgaaacagtttggcctgaaaccgacccggaccgacaaaacgg

SEQ ID NO: 11126 - DNA, 60 bp, Artificial Sequence
  Description of Artificial Sequence: Synthetic probe
tcatgcccagagtcttcaccaacctgaaacagtttggcctgaaaccgacccggaccgaca

SEQ ID NO: 11127 - DNA, 60 bp, Artificial Sequence
  Description of Artificial Sequence: Synthetic probe
ttcgactcgatggacctctttacctacggcgatgacggtgtttacattgtcccgccactc

SEQ ID NO: 11128 - DNA, 60 bp, Artificial Sequence
  Description of Artificial Sequence: Synthetic probe
ccgcgtcgttgcggaggacctacttaagccctcgcaccttgacgtgggggacttcctggt

SEQ ID NO: 11129 - DNA, 60 bp, Artificial Sequence
  Description of Artificial Sequence: Synthetic probe
catcttgacgtgggagatttcctggtagcagtgcacgagggccttccatcaggttttccg

SEQ ID NO: 11130 - DNA, 60 bp, Artificial Sequence
  Description of Artificial Sequence: Synthetic probe
caccttgacgtgggagatttcctggtggcagtgcacgagggccttccatcaggttttccg

SEQ ID NO: 11131 - DNA, 60 bp, Artificial Sequence
  Description of Artificial Sequence: Synthetic probe
caccttgacgtgggagatttcctggtggcagtgcacgagggccttccatcaggttttcca

SEQ ID NO: 11132 - DNA, 60 bp, Artificial Sequence
  Description of Artificial Sequence: Synthetic probe
ggcaaggtggtgagtgggatcctgtcaaaactcggatctgcttgggatccagaccttcag

SEQ ID NO: 11133 - DNA, 60 bp, Artificial Sequence
  Description of Artificial Sequence: Synthetic probe
tcggaccgctgcaaacgttgaaccaaacctcacgtttagggctgaatcggatggtccagg

SEQ ID NO: 11134 - DNA, 60 bp, Artificial Sequence
  Description of Artificial Sequence: Synthetic probe
gtcatgcccaatgtcttcgcaaacctgaaacagtttggcctgaaaccgacccggaccgac

SEQ ID NO: 11135 - DNA, 60 bp, Artificial Sequence
  Description of Artificial Sequence: Synthetic probe
gccactatggctactactcatacgcttctgtcgtttgacgacctcgaatttctcttacac

SEQ ID NO: 11136 - DNA, 60 bp, Artificial Sequence
  Description of Artificial Sequence: Synthetic probe
ccaattggcatcttcaacggtgttgcattcaaggtggccggtggcgtccccactggcatg

SEQ ID NO: 11137 - DNA, 60 bp, Artificial Sequence
  Description of Artificial Sequence: Synthetic probe
cagtacggcctgaaaccgacccggaccgacaaaacggatgctgagataacgcctgtcccc

SEQ ID NO: 11138 - DNA, 60 bp, Artificial Sequence
  Description of Artificial Sequence: Synthetic probe
gtacaagggcatggctcgaactgcacacgagaacagtgggtgtggggcccatgttcacgt

SEQ ID NO: 11139 - DNA, 60 bp, Artificial Sequence
  Description of Artificial Sequence: Synthetic probe
cctttcaactgctgtttccctgatgtctatgcttctataggaactgaatacagctacatt

SEQ ID NO: 11140 - DNA, 60 bp, Artificial Sequence
  Description of Artificial Sequence: Synthetic probe
ctgatgtctatacttctataggaactgaatacagctacattgatcctcctgagctcatct

SEQ ID NO: 11141 - DNA, 60 bp, Artificial Sequence
  Description of Artificial Sequence: Synthetic probe
tgatgtcaggttcaccgtctctgggtctggagtgttcggcggaaaacttgccgcactcct

SEQ ID NO: 11142 - DNA, 60 bp, Artificial Sequence
  Description of Artificial Sequence: Synthetic probe
ctggcggaatcgatgtcaggttcaccgtctctgggtctggagtgtttggcggtaagcttg

SEQ ID NO: 11143 - DNA, 60 bp, Artificial Sequence
  Description of Artificial Sequence: Synthetic probe
gattcggcttgtgcaacactaaaatcaaacccaattggcattttcaacggtgttgcattc

SEQ ID NO: 11144 - DNA, 60 bp, Artificial Sequence
  Description of Artificial Sequence: Synthetic probe
tcaaacctacgacagtttggcctgaaaccgacccggaccgacaaaacggatgctgagata

SEQ ID NO: 11145 - DNA, 60 bp, Artificial Sequence
  Description of Artificial Sequence: Synthetic probe
tctttgtgccatcacatcgctccatgtttgcttggatgagatttcatgatttgtctctgt

SEQ ID NO: 11146 - DNA, 60 bp, Artificial Sequence
  Description of Artificial Sequence: Synthetic probe
catctcaatcaattgacattctcagacacttcactgataaatccccaattgttgattcgg

SEQ ID NO: 11147 - DNA, 60 bp, Artificial Sequence
  Description of Artificial Sequence: Synthetic probe
ccttgtgcgcgctttcagaggtcaccaacttggacccggatgtggtgcaggcaaacagct

SEQ ID NO: 11148 - DNA, 60 bp, Artificial Sequence
  Description of Artificial Sequence: Synthetic probe
catcctcaggcacttcactgacaaatccccaattgttgattcggcttgtgcaacactcaa

SEQ ID NO: 11149 - DNA, 53 bp, Artificial Sequence
  Description of Artificial Sequence: Synthetic probe
gtgacttggaacatcttcgactcgatggacctgtttacctatggtgacgaccg

SEQ ID NO: 11150 - DNA, 60 bp, Artificial Sequence
  Description of Artificial Sequence: Synthetic probe
cggtccactgcgaacgttgacacaacattcacgttcagggctgaatcggatggtccaggg

SEQ ID NO: 11151 - DNA, 60 bp, Artificial Sequence
  Description of Artificial Sequence: Synthetic probe
tcggtccactgcgaacgttgacacaacattcacgttcagggctgaatcggatggtccagg

SEQ ID NO: 11152 - DNA, 60 bp, Artificial Sequence
  Description of Artificial Sequence: Synthetic probe
ctcaggcgtgcaggtgacatggaacatcttcgactcgatggaccttttcacctacggtga

SEQ ID NO: 11153 - DNA, 60 bp, Artificial Sequence
  Description of Artificial Sequence: Synthetic probe
gcttgaagactcaggcgtgcaggtgacatggaacatcttcgactcgatggaccttttcac

SEQ ID NO: 11154 - DNA, 58 bp, Artificial Sequence
  Description of Artificial Sequence: Synthetic probe
gtggtggaattgggctcagtggtgaggtgtttgagaattagccactatggctactact

SEQ ID NO: 11155 - DNA, 60 bp, Artificial Sequence
  Description of Artificial Sequence: Synthetic probe
cgagtggtggaattgggctcagtggtgaggtgtttgagaattagccactatggctactac

SEQ ID NO: 11156 - DNA, 60 bp, Artificial Sequence
  Description of Artificial Sequence: Synthetic probe
cgatcgtccgcactgagaacggcataagagcattgcttgacaaatcatccataattcggc

SEQ ID NO: 11157 - DNA, 57 bp, Artificial Sequence
  Description of Artificial Sequence: Synthetic probe
tggcgtacaggtgacatggaacatcttcgattcgatggacctcttcacctacggcga

SEQ ID NO: 11158 - DNA, 60 bp, Artificial Sequence
  Description of Artificial Sequence: Synthetic probe
ctcatggtaggctctgctgttgtcaaggctctcgaggactctggcgtacaggtgacatgg

SEQ ID NO: 11159 - DNA, 60 bp, Artificial Sequence
  Description of Artificial Sequence: Synthetic probe
aatcactgtctcatggtaggctctgctgttgtcaaggctctcgaggactctggcgtacag

SEQ ID NO: 11160 - DNA, 60 bp, Artificial Sequence
  Description of Artificial Sequence: Synthetic probe
cctcaggcacttcactgacaaatccccaattgttgattcggcttgtgcaacactcaaatc

SEQ ID NO: 11161 - DNA, 55 bp, Artificial Sequence
  Description of Artificial Sequence: Synthetic probe
tctgacaaagacgtcaccacgatgttctactacatcaaggggaaagtgatcaaag

SEQ ID NO: 11162 - DNA, 60 bp, Artificial Sequence
  Description of Artificial Sequence: Synthetic probe
tgggcccaaccatgatgacccgaatgagaccctggtcccccacagcaaccggaaggttca

SEQ ID NO: 11163 - DNA, 60 bp, Artificial Sequence
  Description of Artificial Sequence: Synthetic probe
cgctaacctgaagacgtttggcctgaaaccgacccggaccgacaaaacggatgctgagat

SEQ ID NO: 11164 - DNA, 56 bp, Artificial Sequence
  Description of Artificial Sequence: Synthetic probe
aagggcatggctcgaactgcacacgagaacagtgggtgtggggcccatgttcacgt

SEQ ID NO: 11165 - DNA, 60 bp, Artificial Sequence
  Description of Artificial Sequence: Synthetic probe
ctttgtgccatcacaccgctccatgtttgcttggatgagatttcatgatttgtcgctgtg

SEQ ID NO: 11166 - DNA, 60 bp, Artificial Sequence
  Description of Artificial Sequence: Synthetic probe
ctttgtaccatcacaccgctccatgtttgcttggatgagatttcatgatttgtcgctgtg

SEQ ID NO: 11167 - DNA, 60 bp, Artificial Sequence
  Description of Artificial Sequence: Synthetic probe
ggggatggagatctttgtgccatcacaccgctccatgtttgcttggatgagatttcatga

SEQ ID NO: 11168 - DNA, 60 bp, Artificial Sequence
  Description of Artificial Sequence: Synthetic probe
ccactatggctactactcacacgcttctgtcgtttgacgacctcgaatttctcttgcaca

SEQ ID NO: 11169 - DNA, 60 bp, Artificial Sequence
  Description of Artificial Sequence: Synthetic probe
gatactccggcagctctactggactcgtggacccaaccacgatgacccaagtgaaaccct

SEQ ID NO: 11170 - DNA, 60 bp, Artificial Sequence
  Description of Artificial Sequence: Synthetic probe
gaactgtccacgagaacagtgggtgtggggcccatgttcacgtgttgactcgggaagaga

SEQ ID NO: 11171 - DNA, 53 bp, Artificial Sequence
  Description of Artificial Sequence: Synthetic probe
gtgccgccttcaagcgcgtctcagaatcaatcatggcaaaccacgctctcggc

SEQ ID NO: 11172 - DNA, 60 bp, Artificial Sequence
  Description of Artificial Sequence: Synthetic probe
ttctctgatgtctatgcttctatgggaactgaatacagctacattgatcctcctgaactc

SEQ ID NO: 11173 - DNA, 60 bp, Artificial Sequence
  Description of Artificial Sequence: Synthetic probe
gatccttttaattgctgcttccctattgtctatacttctataggaactgaatacagctac

SEQ ID NO: 11174 - DNA, 60 bp, Artificial Sequence
  Description of Artificial Sequence: Synthetic probe
cctaaaacagtttggcctgaaaccgacccggaccgacaaaacggacgctgagataacgcc

SEQ ID NO: 11175 - DNA, 60 bp, Artificial Sequence
  Description of Artificial Sequence: Synthetic probe
aacctaaaacagtttggcctgaaaccgacccggaccgacaaaacggacgctgagataacg

SEQ ID NO: 11176 - DNA, 60 bp, Artificial Sequence
  Description of Artificial Sequence: Synthetic probe
atgactgacaaggatgtgcaggaagcggctccggcccttggccaagtcctccctcctgag

SEQ ID NO: 11177 - DNA, 60 bp, Artificial Sequence
  Description of Artificial Sequence: Synthetic probe
agatgactgacaaggacacgcaggaagcggctccggcccttggccaagtcctcccccccg

SEQ ID NO: 11178 - DNA, 56 bp, Artificial Sequence
  Description of Artificial Sequence: Synthetic probe
agatgactgacaaggacacgcaggaagcggctccggcccttggccaagtcctcccc

SEQ ID NO: 11179 - DNA, 60 bp, Artificial Sequence
  Description of Artificial Sequence: Synthetic probe
tgacaagaccgagggccccatcgaagtgaagcagcaggtcgatggcctcgtgttcctccg

SEQ ID NO: 11180 - DNA, 60 bp, Artificial Sequence
  Description of Artificial Sequence: Synthetic probe
ctgaccttgaatttgacccagacaagctcaccaaggtactcaaggggtacggcctcaagc

SEQ ID NO: 11181 - DNA, 60 bp, Artificial Sequence
  Description of Artificial Sequence: Synthetic probe
actgaccttgaatttgacccagacaagctcaccagggttcttaaagggtatggcctcaag

SEQ ID NO: 11182 - DNA, 60 bp, Artificial Sequence
  Description of Artificial Sequence: Synthetic probe
gcgaacctgagacagtttggcctgaaaccgacccggaccgacaagtcggatgctgagata

SEQ ID NO: 11183 - DNA, 60 bp, Artificial Sequence
  Description of Artificial Sequence: Synthetic probe
gctccatcactgttgagaccagaccatctactgacttcaccttttccttacttaaacccc

SEQ ID NO: 11184 - DNA, 60 bp, Artificial Sequence
  Description of Artificial Sequence: Synthetic probe
ctgtgcgacaaacgggagttggccagacggcactccttgtgaacccatcctgcctccatt

SEQ ID NO: 11185 - DNA, 60 bp, Artificial Sequence
  Description of Artificial Sequence: Synthetic probe
ggtgttgcattcaaggtggctggagggctaccgtcaggtatgccacttacatccatcatc

SEQ ID NO: 11186 - DNA, 60 bp, Artificial Sequence
  Description of Artificial Sequence: Synthetic probe
cctgcacacgattccaaggctgtcagcttctcacttccccaaacggacggatccaccgga

SEQ ID NO: 11187 - DNA, 60 bp, Artificial Sequence
  Description of Artificial Sequence: Synthetic probe
cgagaacagtgggtgtggggcccatgttcacgtgttgactcgggaagagaacttcagagg

SEQ ID NO: 11188 - DNA, 56 bp, Artificial Sequence
  Description of Artificial Sequence: Synthetic probe
tgcttggatgagatttcatgatttgtcgctgtgggaaggtagtcgcgacatccttc

SEQ ID NO: 11189 - DNA, 60 bp, Artificial Sequence
  Description of Artificial Sequence: Synthetic probe
cagtttggcctgaaaccgacccggaccgacaaaacggatgctgagataacgcctatccct

SEQ ID NO: 11190 - DNA, 60 bp, Artificial Sequence
  Description of Artificial Sequence: Synthetic probe
cagtttggcctgaaaccgacccggaccgacaaaacggatgctgagataacgccaatccct

SEQ ID NO: 11191 - DNA, 60 bp, Artificial Sequence
  Description of Artificial Sequence: Synthetic probe
gcagtttggcctgaaaccgacccggaccgacaaaacggatgctgagataacgcctatccc

SEQ ID NO: 11192 - DNA, 60 bp, Artificial Sequence
  Description of Artificial Sequence: Synthetic probe
gctgtttccctgatgtctatgcttctataggaactgaatacagctacattgatcctcctg

SEQ ID NO: 11193 - DNA, 60 bp, Artificial Sequence
  Description of Artificial Sequence: Synthetic probe
gaccttgcaaatctgcactcttactatagcttctacaaaacggactagttccaacctgca

SEQ ID NO: 11194 - DNA, 60 bp, Artificial Sequence
  Description of Artificial Sequence: Synthetic probe
caagatgaagctgaccttgcaaatctgcactcttactatagcttctacaaaacggactag

SEQ ID NO: 11195 - DNA, 60 bp, Artificial Sequence
  Description of Artificial Sequence: Synthetic probe
tcgccaaatttatcaagatgaagctgaccttgcaaatctgcactcttactatagcttcta

SEQ ID NO: 11196 - DNA, 60 bp, Artificial Sequence
  Description of Artificial Sequence: Synthetic probe
acagatctagactagaatcagttccccatctcgagggagactccttcaggaggtccctcg

SEQ ID NO: 11197 - DNA, 58 bp, Artificial Sequence
  Description of Artificial Sequence: Synthetic probe
acagatctagactagaatcagttccccatctcgagggagactccttcaggaggtccct

SEQ ID NO: 11198 - DNA, 60 bp, Artificial Sequence
  Description of Artificial Sequence: Synthetic probe
aacagatctagacttgagtcagttccccatctcgagggagactccttcaggagatccctt

SEQ ID NO: 11199 - DNA, 60 bp, Artificial Sequence
  Description of Artificial Sequence: Synthetic probe
ggctcgaacgaccaaagcacgatcggtattgtgttgactactcaaagtgggactcaaccc

SEQ ID NO: 11200 - DNA, 60 bp, Artificial Sequence
  Description of Artificial Sequence: Synthetic probe
gtggtgaggtgtttgagaattagccactatggctactactcatacgcttctgtcgtttga

SEQ ID NO: 11201 - DNA, 60 bp, Artificial Sequence
  Description of Artificial Sequence: Synthetic probe
tagcgagtggtggaactgggttcggtggtgaggtgtttgagaattagccactatggctac

SEQ ID NO: 11202 - DNA, 60 bp, Artificial Sequence
  Description of Artificial Sequence: Synthetic probe
tatcaagggcatggtaagaactgcacacgagaacagtgggtgtggggcccatgttcacgt

SEQ ID NO: 11203 - DNA, 60 bp, Artificial Sequence
  Description of Artificial Sequence: Synthetic probe
gcaccgctccatgtttgcttggatgagatttcatgatttgtcattgtgggaaggtagtcg

SEQ ID NO: 11204 - DNA, 60 bp, Artificial Sequence
  Description of Artificial Sequence: Synthetic probe
ggggatggagatctttgtaccatcacatcgctccatgtttgcttggatgagatttcatga

SEQ ID NO: 11205 - DNA, 60 bp, Artificial Sequence
  Description of Artificial Sequence: Synthetic probe
agtctttgcgaacctgaaacagtttgggctgaaaccgacccggaccgacaaaacggacgc

SEQ ID NO: 11206 - DNA, 51 bp, Artificial Sequence
  Description of Artificial Sequence: Synthetic probe
atcaccaattgttgattcggcttgtgcaacactcaaatcaaaccctattgg

SEQ ID NO: 11207 - DNA, 60 bp, Artificial Sequence
  Description of Artificial Sequence: Synthetic probe
cattctcaggcacttcactgacaaatcaccaattgttgattcggcttgtgcaacactcaa

SEQ ID NO: 11208 - DNA, 60 bp, Artificial Sequence
  Description of Artificial Sequence: Synthetic probe
gctcggctgttgtcaaggctctcgaggattctggcgtgcaagtgacatggaacatcttcg

SEQ ID NO: 11209 - DNA, 60 bp, Artificial Sequence
  Description of Artificial Sequence: Synthetic probe
tgggctcggctgttgtcaaggctctcgaggattctggcgtgcaagtgacatggaacatct

SEQ ID NO: 11210 - DNA, 60 bp, Artificial Sequence
  Description of Artificial Sequence: Synthetic probe
caagcggacaatagtccgcaccgagaatggcatacgtgcattgcttgatagatcatccat

SEQ ID NO: 11211 - DNA, 60 bp, Artificial Sequence
  Description of Artificial Sequence: Synthetic probe
tcaagcggacaatagtccgcaccgagaatggcatacgtgcattgcttgatagatcatcca

SEQ ID NO: 11212 - DNA, 60 bp, Artificial Sequence
  Description of Artificial Sequence: Synthetic probe
cgtgcaagtgacgtggaacatcttcgactcgatggctctgttcacgtacggtgatgacgg

SEQ ID NO: 11213 - DNA, 60 bp, Artificial Sequence
  Description of Artificial Sequence: Synthetic probe
cttgaggattctggcgtgcaagtgacgtggaacatcttcgactcgatggatctgttcacg

SEQ ID NO: 11214 - DNA, 60 bp, Artificial Sequence
  Description of Artificial Sequence: Synthetic probe
tcttgaggattctggcgtgcaagtgacgtggaacatcttcgactcgatggctctgttcac

SEQ ID NO: 11215 - DNA, 60 bp, Artificial Sequence
  Description of Artificial Sequence: Synthetic probe
ccttctggtatgccactaacatccatcatcaattcactaaaccactgcctcatggtgggc

SEQ ID NO: 11216 - DNA, 60 bp, Artificial Sequence
  Description of Artificial Sequence: Synthetic probe
gccttctggtatgccactaacatccatcatcaactcactgaatcactgtctcatggtagg

SEQ ID NO: 11217 - DNA, 60 bp, Artificial Sequence
  Description of Artificial Sequence: Synthetic probe
caagcggacaatagttcgcactgagaacggcatacgtgcattgcttgacagatcatccat

SEQ ID NO: 11218 - DNA, 60 bp, Artificial Sequence
  Description of Artificial Sequence: Synthetic probe
tcaagcggacaatagttcgcactgagaacggcatacgtgcattgcttgacagatcatcca

SEQ ID NO: 11219 - DNA, 60 bp, Artificial Sequence
  Description of Artificial Sequence: Synthetic probe
acgagaacagtgggtgtggggcccatgttcacgtgatctctagggaagataacttcagag

SEQ ID NO: 11220 - DNA, 51 bp, Artificial Sequence
  Description of Artificial Sequence: Synthetic probe
ttgtgcaagccccccaaggtgaatttactatttccccaaataatacccccg

SEQ ID NO: 11221 - DNA, 60 bp, Artificial Sequence
  Description of Artificial Sequence: Synthetic probe
cagtttggcctaaagccgacccggaccgacaaaacggacgctgagataacgccaatcccc

SEQ ID NO: 11222 - DNA, 60 bp, Artificial Sequence
  Description of Artificial Sequence: Synthetic probe
cccaccttgagggagactccttcaggagatcccttggcgttgtcatgtccgacaaggacg

SEQ ID NO: 11223 - DNA, 60 bp, Artificial Sequence
  Description of Artificial Sequence: Synthetic probe
ccgtctggtatgccactcacttccatcatcaactcactgaatcactgtctcatggtaggc

SEQ ID NO: 11224 - DNA, 60 bp, Artificial Sequence
  Description of Artificial Sequence: Synthetic probe
gccgtcaggcatgccactcacctccatcatcaactcactgaatcactgtctcatggtagg

SEQ ID NO: 11225 - DNA, 60 bp, Artificial Sequence
  Description of Artificial Sequence: Synthetic probe
cgtcggactacctgacctcccttctaatctccaatttcctctttccgcgaccttcatggg

SEQ ID NO: 11226 - DNA, 60 bp, Artificial Sequence
  Description of Artificial Sequence: Synthetic probe
aaaacttgctgaaggtaattacaacctcccccctgactctcttgctgtctatagaattac

SEQ ID NO: 11227 - DNA, 60 bp, Artificial Sequence
  Description of Artificial Sequence: Synthetic probe
ccaaggtggtgagaatcgccacccttccagaggcatacacccaaggaggaaactacccaa

SEQ ID NO: 11228 - DNA, 60 bp, Artificial Sequence
  Description of Artificial Sequence: Synthetic probe
tcgacggaccaacagtgagcaaactgtttcatgccaccctcagtccactcgggtacgtga

SEQ ID NO: 11229 - DNA, 60 bp, Artificial Sequence
  Description of Artificial Sequence: Synthetic probe
gtcaactgccgtcaaaacccaaaccaaccaagctgacgcacagaagaaatcccagacaat

SEQ ID NO: 11230 - DNA, 60 bp, Artificial Sequence
  Description of Artificial Sequence: Synthetic probe
tcccctaccagaatggcttctacgacagaactattgacaagattgttgacccgaccaaaa

SEQ ID NO: 11231 - DNA, 60 bp, Artificial Sequence
  Description of Artificial Sequence: Synthetic probe
ggccggatacaacaatcccggtcaccaacagggcatccaatgggaacttcccctaccaga

SEQ ID NO: 11232 - DNA, 60 bp, Artificial Sequence
  Description of Artificial Sequence: Synthetic probe
cggggtggaagaaactgagaaagcgttggttccagggattccagacggctggccggatac

SEQ ID NO: 11233 - DNA, 60 bp, Artificial Sequence
  Description of Artificial Sequence: Synthetic probe
acaggatggtccaccccttactatgtgccaattgaaatcccaattaagaggtcccaccat

SEQ ID NO: 11234 - DNA, 60 bp, Artificial Sequence
  Description of Artificial Sequence: Synthetic probe
gataccatccgacctcattcctcggaactcagcccactggatgggaaaccggtggtggag

SEQ ID NO: 11235 - DNA, 60 bp, Artificial Sequence
  Description of Artificial Sequence: Synthetic probe
ccctgacttcagctttgccctcctaaaaccccctggttcactaatcaaacatgggtcgat

SEQ ID NO: 11236 - DNA, 60 bp, Artificial Sequence
  Description of Artificial Sequence: Synthetic probe
agtggtgaagcaaaaacaacatgttccattacagttgaaactagaccttcccctgacttc

SEQ ID NO: 11237 - DNA, 60 bp, Artificial Sequence
  Description of Artificial Sequence: Synthetic probe
caaaacttgtgatcatggtctacaacgagttgatcaacccatatgagaacagtggtgaag

SEQ ID NO: 11238 - DNA, 60 bp, Artificial Sequence
  Description of Artificial Sequence: Synthetic probe
tgtcaggttcaccgtctctgggtctggagtgtttggcggtaagcttgccgcactcctggt

SEQ ID NO: 11239 - DNA, 60 bp, Artificial Sequence
  Description of Artificial Sequence: Synthetic probe
ccttgatcacatcgggaaattgtactcaacatggtctggcggaatcgatgtcaggttcac

SEQ ID NO: 11240 - DNA, 60 bp, Artificial Sequence
  Description of Artificial Sequence: Synthetic probe
ggcaacccttgccacagcgtcgacaggaaaatcagtcgatcaagaatggatgaccttctt

SEQ ID NO: 11241 - DNA, 58 bp, Artificial Sequence
  Description of Artificial Sequence: Synthetic probe
gacggtccaggtggtgctgagattgtgacagaggaacagggtaccgtggtgcaacaac

SEQ ID NO: 11242 - DNA, 56 bp, Artificial Sequence
  Description of Artificial Sequence: Synthetic probe
gctcttcttgggatccatcccttcgggttccgcagtaaacgctgatacatctttca

SEQ ID NO: 11243 - DNA, 60 bp, Artificial Sequence
  Description of Artificial Sequence: Synthetic probe
tacggcacaaaaccaggcgaggtggtgagtgcaatcttgtccaaactcgggctcttcttg

SEQ ID NO: 11244 - DNA, 57 bp, Artificial Sequence
  Description of Artificial Sequence: Synthetic probe
ttgtgcaacaaacggaacctgggccgacggcacaccgtgcgagccaatcctcccccc

SEQ ID NO: 11245 - DNA, 60 bp, Artificial Sequence
  Description of Artificial Sequence: Synthetic probe
tacattgatcctcccaacctcatccatgaaggacattgtgcaacaaacggaacctgggcc

SEQ ID NO: 11246 - DNA, 60 bp, Artificial Sequence
  Description of Artificial Sequence: Synthetic probe
ggcgaggtagtaagcgggatcctgtcaaaactcggatctgcttgggatccagaccttcgg

SEQ ID NO: 11247 - DNA, 60 bp, Artificial Sequence
  Description of Artificial Sequence: Synthetic probe
cctggcgaggtagtaagcgggatcctgtcaaaactcggatctgcttgggatccagacctt

SEQ ID NO: 11248 - DNA, 60 bp, Artificial Sequence
  Description of Artificial Sequence: Synthetic probe
ccacaaaaccaggcaaggtggtgagtgggatcctgtcaaaactcggatctgcttgggatc

SEQ ID NO: 11249 - DNA, 60 bp, Artificial Sequence
  Description of Artificial Sequence: Synthetic probe
cccttggggtagttatgtccgacaaagacgtgactacaatgttctactacataaagggga

SEQ ID NO: 11250 - DNA, 60 bp, Artificial Sequence
  Description of Artificial Sequence: Synthetic probe
caacctgtacaagggagttgtcagaactgtacacgagaacagtgggtgtggggcccatgt

SEQ ID NO: 11251 - DNA, 60 bp, Artificial Sequence
  Description of Artificial Sequence: Synthetic probe
tatggtgcaaatttcaacctgtacaagggagttgtcagaactgtacacgagaacagtggg

SEQ ID NO: 11252 - DNA, 60 bp, Artificial Sequence
  Description of Artificial Sequence: Synthetic probe
gacactgtatacaacctcctggccgccgtgaaggctaggtatggtgcaaatttcaacctg

SEQ ID NO: 11253 - DNA, 60 bp, Artificial Sequence
  Description of Artificial Sequence: Synthetic probe
atgatgaaattgacactgtatacaacctcctggccgccgtgaaggctaggtatggtgcaa

SEQ ID NO: 11254 - DNA, 60 bp, Artificial Sequence
  Description of Artificial Sequence: Synthetic probe
cccaattgttgattcggcctgtgcaacactaaaatcaaacccaattggcatcttcaacgg

SEQ ID NO: 11255 - DNA, 55 bp, Artificial Sequence
  Description of Artificial Sequence: Synthetic probe
tgcttggatgagatttcatgatttgtcgctgtgggaaggtagtcgcgacgtcctc

SEQ ID NO: 11256 - DNA, 50 bp, Artificial Sequence
  Description of Artificial Sequence: Synthetic probe
gttacacttagggtacgttctcgtcgatgagaacccagttggcagcatct

SEQ ID NO: 11257 - DNA, 60 bp, Artificial Sequence
  Description of Artificial Sequence: Synthetic probe
aacctcacaactagggtaaagaaagaaggcaatgaaagtgaaactgaccagacatcaaga

SEQ ID NO: 11258 - DNA, 60 bp, Artificial Sequence
  Description of Artificial Sequence: Synthetic probe
cctcacaactagggtaaagaaagaaggcaatgaaagtgaaactgaccagacatcaagaac

SEQ ID NO: 11259 - DNA, 60 bp, Artificial Sequence
  Description of Artificial Sequence: Synthetic probe
agcctcacaactagggtaaagaaagaaggcaatgaaagtgaaactgaccagacatcaaga

SEQ ID NO: 11260 - DNA, 60 bp, Artificial Sequence
  Description of Artificial Sequence: Synthetic probe
ccacagtcaatgggaagtacgcttacgtcgttggaaagcgcgatggtaagcacgtgatcg

SEQ ID NO: 11261 - DNA, 60 bp, Artificial Sequence
  Description of Artificial Sequence: Synthetic probe
catgaccacagtcaatgggaagtacgcttacgtcgttggaaagcgcgatggtaagcacgt

SEQ ID NO: 11262 - DNA, 60 bp, Artificial Sequence
  Description of Artificial Sequence: Synthetic probe
agcttggagaaaatggtcagtactttaaagtggttgacaccgagagatcactagtgcctg

SEQ ID NO: 11263 - DNA, 60 bp, Artificial Sequence
  Description of Artificial Sequence: Synthetic probe
tcacactcaataagcttggagaaaatggtcagtactttaaagtggttgacaccgagagat

SEQ ID NO: 11264 - DNA, 60 bp, Artificial Sequence
  Description of Artificial Sequence: Synthetic probe
tcgcactcaataagcttggagaaaatggtcagtactttaaagtggttgacaccgagagat

SEQ ID NO: 11265 - DNA, 60 bp, Artificial Sequence
  Description of Artificial Sequence: Synthetic probe
caactggttggtcaactccctattttactccaattgagatcacactcaataagcttggag

SEQ ID NO: 11266 - DNA, 60 bp, Artificial Sequence
  Description of Artificial Sequence: Synthetic probe
gccaaggaaggggggatggagatctttgtgccatcgcaccgctccatgtttgcttggatg

SEQ ID NO: 11267 - DNA, 60 bp, Artificial Sequence
  Description of Artificial Sequence: Synthetic probe
gcacgtcaaacggaacctgtgatcttcacaatccctgacattcggaaaactctcttccac

SEQ ID NO: 11268 - DNA, 60 bp, Artificial Sequence
  Description of Artificial Sequence: Synthetic probe
tttgatgcccgtcaaacggaacctgtgatcttcacaatccccgacatccggaagactctc

SEQ ID NO: 11269 - DNA, 60 bp, Artificial Sequence
  Description of Artificial Sequence: Synthetic probe
gacactgtccacaacctacttgcagccgtcaaggccaggtatggtgcaaatttcaacttg

SEQ ID NO: 11270 - DNA, 60 bp, Artificial Sequence
  Description of Artificial Sequence: Synthetic probe
acaatgaaattgacactgtccacaacctacttgcagccgtcaaggccaggtatggtgcaa

SEQ ID NO: 11271 - DNA, 60 bp, Artificial Sequence
  Description of Artificial Sequence: Synthetic probe
ggtaagaacagtacacgagaacagtgggtgtggggcccatgttcacgtgatatctcgaga

SEQ ID NO: 11272 - DNA, 55 bp, Artificial Sequence
  Description of Artificial Sequence: Synthetic probe
tgcttggatgagatttcatgatttgtcgctgtgggaaggtagtcgcgacgtcctt

SEQ ID NO: 11273 - DNA, 60 bp, Artificial Sequence
  Description of Artificial Sequence: Synthetic probe
gctcagtggtgaggtgtttgagaattagccactatggctactactcacacgcttctgtcg

SEQ ID NO: 11274 - DNA, 60 bp, Artificial Sequence
  Description of Artificial Sequence: Synthetic probe
ggctggaaagaccaaagcacgataggtattgtgttgactactcaaagtgggactcaactc

SEQ ID NO: 11275 - DNA, 60 bp, Artificial Sequence
  Description of Artificial Sequence: Synthetic probe
cagattcttctaaagttgtaaggattgcaacactcccagaagcctttacacaaggaggga

SEQ ID NO: 11276 - DNA, 60 bp, Artificial Sequence
  Description of Artificial Sequence: Synthetic probe
gggcatggttcggactgtacacgagaacagtgggtgtggggcccatgttcacgtagtctc

SEQ ID NO: 11277 - DNA, 60 bp, Artificial Sequence
  Description of Artificial Sequence: Synthetic probe
ccatgtttgcctggatgagatttcatgatttgtcgctgtgggaaggtagtcgcgacgccc

SEQ ID NO: 11278 - DNA, 60 bp, Artificial Sequence
  Description of Artificial Sequence: Synthetic probe
cacattcagggctgaatcggatggtccgggaagctccgagattgtgacggaggaacaagg

SEQ ID NO: 11279 - DNA, 60 bp, Artificial Sequence
  Description of Artificial Sequence: Synthetic probe
tgtgagcaacaacttcacattcagggctgaatcggatggtccgggaagctccgagattgt

SEQ ID NO: 11280 - DNA, 60 bp, Artificial Sequence
  Description of Artificial Sequence: Synthetic probe
gcatcttgggatcctttccttcggtccaccgcggatgtgagcaacaacttcacattcagg

SEQ ID NO: 11281 - DNA, 60 bp, Artificial Sequence
  Description of Artificial Sequence: Synthetic probe
ttgtccaaacttggtgcatcttgggatcctttccttcggtccaccgcggatgtgagcaac

SEQ ID NO: 11282 - DNA, 59 bp, Artificial Sequence
  Description of Artificial Sequence: Synthetic probe
ggttcatggcctgacggcacgccgtgcacaccaatcctccccccgttcaacatcacggg

SEQ ID NO: 11283 - DNA, 60 bp, Artificial Sequence
  Description of Artificial Sequence: Synthetic probe
cctcaacttggtcatcaacccttatgatctttttcttccagatgaacttgatgatgattg

SEQ ID NO: 11284 - DNA, 60 bp, Artificial Sequence
  Description of Artificial Sequence: Synthetic probe
ggacctaactgatctctacggagaacggtgtggtaccctcaacttggtcatcaaccctta

SEQ ID NO: 11285 - DNA, 60 bp, Artificial Sequence
  Description of Artificial Sequence: Synthetic probe
ctcctacacaaaaaggacctaactgatctctacggagaacggtgtggtaccctcaacttg

SEQ ID NO: 11286 - DNA, 60 bp, Artificial Sequence
  Description of Artificial Sequence: Synthetic probe
cgatcgagagtcgatactccggcagctctactggactcgtggacctaaccacgatgaccc

SEQ ID NO: 11287 - DNA, 60 bp, Artificial Sequence
  Description of Artificial Sequence: Synthetic probe
tcgatcgagagtcgatactccggcagctctactggactcgtggacctaaccacgacgacc

SEQ ID NO: 11288 - DNA, 60 bp, Artificial Sequence
  Description of Artificial Sequence: Synthetic probe
tgcttggatgagatttcatgatttgtcgctgtgggaaggtagtcgcgacatcctccccga

SEQ ID NO: 11289 - DNA, 50 bp, Artificial Sequence
  Description of Artificial Sequence: Synthetic probe
ctcttgcacaagaaggacctaaccgatctctacggagagaggtgcggtac

SEQ ID NO: 11290 - DNA, 60 bp, Artificial Sequence
  Description of Artificial Sequence: Synthetic probe
ccatgtttgcttggatgagatttcatgatttgtctttgtgggaaggtagtcgcgacaccc

SEQ ID NO: 11291 - DNA, 60 bp, Artificial Sequence
  Description of Artificial Sequence: Synthetic probe
ctcaaaatgggactctacccaaccaccaaaagtcacatctcagtcaattgacatcctcag

SEQ ID NO: 11292 - DNA, 60 bp, Artificial Sequence
  Description of Artificial Sequence: Synthetic probe
caatcgaccaaagcacgatcgatattgtgttgactactcaaaatgggactctacccaacc

SEQ ID NO: 11293 - DNA, 60 bp, Artificial Sequence
  Description of Artificial Sequence: Synthetic probe
ctcttcagaagactcaatcgaccaaagcacgatcgatattgtgttgactactcaaaatgg

SEQ ID NO: 11294 - DNA, 60 bp, Artificial Sequence
  Description of Artificial Sequence: Synthetic probe
cccttggcgttgtcatgtccgataaggatgtaacgacgatgttctattacatcaagggga

SEQ ID NO: 11295 - DNA, 60 bp, Artificial Sequence
  Description of Artificial Sequence: Synthetic probe
gagatcccttggcgttgtcatgtccgataaggatgtaacgacgatgttctattacatcaa

SEQ ID NO: 11296 - DNA, 60 bp, Artificial Sequence
  Description of Artificial Sequence: Synthetic probe
agtatgaaattgatactgtctacaacctacttgccgccgttaaggccaggtacggtgcaa

SEQ ID NO: 11297 - DNA, 60 bp, Artificial Sequence
  Description of Artificial Sequence: Synthetic probe
cccttggcgtcgtcatgtctgacaaggacgtaacgacaatgttctattacatcaagggga

SEQ ID NO: 11298 - DNA, 60 bp, Artificial Sequence
  Description of Artificial Sequence: Synthetic probe
gagatcccttggcgtcgtcatgtctgacaaggacgtaacgacaatgttctattacatcaa

SEQ ID NO: 11299 - DNA, 60 bp, Artificial Sequence
  Description of Artificial Sequence: Synthetic probe
gccatcacaccgctctatgtttgcttggatgagatttcatgatttgtcgctgtgggaagg

SEQ ID NO: 11300 - DNA, 60 bp, Artificial Sequence
  Description of Artificial Sequence: Synthetic probe
atggctactactcatacgcttctgtcgtttgacgacctcgaatttctcctacacaagaaa

SEQ ID NO: 11301 - DNA, 60 bp, Artificial Sequence
  Description of Artificial Sequence: Synthetic probe
atggctaccactcacacgcttctgtcgtttgacgacctcgaatttctcctacacaagaaa

SEQ ID NO: 11302 - DNA, 60 bp, Artificial Sequence
  Description of Artificial Sequence: Synthetic probe
aaacctacgacagtttggcctgaaaccgacccggaccgacaaaacggatgctgagattac

SEQ ID NO: 11303 - DNA, 60 bp, Artificial Sequence
  Description of Artificial Sequence: Synthetic probe
gggatggagatctttgtgccgtcgcaccgctccatgtttgcttggatgagatttcatgac

SEQ ID NO: 11304 - DNA, 60 bp, Artificial Sequence
  Description of Artificial Sequence: Synthetic probe
gggatggagatctttgtgccatcacaccgctccatgtttgcttggatgagatttcatgat

SEQ ID NO: 11305 - DNA, 60 bp, Artificial Sequence
  Description of Artificial Sequence: Synthetic probe
ggggatggagatctttgtgccgtcacaccgctccatgtttgcttggatgagatttcatga

SEQ ID NO: 11306 - DNA, 60 bp, Artificial Sequence
  Description of Artificial Sequence: Synthetic probe
ggggatggagatcttcgtgccatcacatcgctccatgtttgcttggatgagatttcatga

SEQ ID NO: 11307 - DNA, 60 bp, Artificial Sequence
  Description of Artificial Sequence: Synthetic probe
cttggataatcaataattttgtgcaggctccccaaggtgaatttactatttccccaaata

SEQ ID NO: 11308 - DNA, 60 bp, Artificial Sequence
  Description of Artificial Sequence: Synthetic probe
ttatgtctgacaaagacgtgacaacgatgttctattacatcaaggggaaagtggtcaacg

SEQ ID NO: 11309 - DNA, 60 bp, Artificial Sequence
  Description of Artificial Sequence: Synthetic probe
gttgttatgtctgacaaagacgtgacaacgatgttctattacatcaaggggaaagtggtc

SEQ ID NO: 11310 - DNA, 57 bp, Artificial Sequence
  Description of Artificial Sequence: Synthetic probe
gtcccagtattcggatttgtctgcccaaacaatgaaattgacactgtctataaccta

SEQ ID NO: 11311 - DNA, 60 bp, Artificial Sequence
  Description of Artificial Sequence: Synthetic probe
ccaaccaccaaaagtgacatcccaatcaattgacattctcagacatttcactgataaatc

SEQ ID NO: 11312 - DNA, 60 bp, Artificial Sequence
  Description of Artificial Sequence: Synthetic probe
gactcaggtgtgcaagtgacgtggaacatcttcgattcgatggacctgttcacttacggt

SEQ ID NO: 11313 - DNA, 55 bp, Artificial Sequence
  Description of Artificial Sequence: Synthetic probe
agaattagccactatggctactactcacacgcttctgtcgtttgacgacctcgaa

SEQ ID NO: 11314 - DNA, 57 bp, Artificial Sequence
  Description of Artificial Sequence: Synthetic probe
agaattagccactatggctactactcacacgcttctgtcgtttgacgacctcgaatt

SEQ ID NO: 11315 - DNA, 56 bp, Artificial Sequence
  Description of Artificial Sequence: Synthetic probe
agaattagccactatggctactactcacacgcttctgtcgtttgacgacctcgaat

SEQ ID NO: 11316 - DNA, 60 bp, Artificial Sequence
  Description of Artificial Sequence: Synthetic probe
ggctgaatcggacggtcctggtggagctgacatcgtgactgaggaacaaggcactgtcgt

SEQ ID NO: 11317 - DNA, 60 bp, Artificial Sequence
  Description of Artificial Sequence: Synthetic probe
cgctcgtccaacgagcgattgaatttgaaggtctacacattgaagtcccggaattccatc

SEQ ID NO: 11318 - DNA, 60 bp, Artificial Sequence
  Description of Artificial Sequence: Synthetic probe
ccgctcgtccaacgagcgattgaatttgaaggtctacacattgaagtcccggaattccac

SEQ ID NO: 11319 - DNA, 60 bp, Artificial Sequence
  Description of Artificial Sequence: Synthetic probe
gcctgtggaatcaccatccatgctacaatacccacacgtgctatttgatgctcgccaaac

SEQ ID NO: 11320 - DNA, 60 bp, Artificial Sequence
  Description of Artificial Sequence: Synthetic probe
gggattgagcctgtggaatcaccatccatgctacaatacccacacgtgctatttgatgct

SEQ ID NO: 11321 - DNA, 60 bp, Artificial Sequence
  Description of Artificial Sequence: Synthetic probe
cagctacattgatcctcctgaactcatccatgaagaacaccgtgcaacaaacggaacctg

SEQ ID NO: 11322 - DNA, 60 bp, Artificial Sequence
  Description of Artificial Sequence: Synthetic probe
gtatagctacattgatcctcctgaactcatccatgaagaacactgcgcaacgaacggtac

SEQ ID NO: 11323 - DNA, 60 bp, Artificial Sequence
  Description of Artificial Sequence: Synthetic probe
gggtccgctgcaaacgttgaaccaaacttcacgtttagggctgaatcggatggtccaggg

SEQ ID NO: 11324 - DNA, 60 bp, Artificial Sequence
  Description of Artificial Sequence: Synthetic probe
cggaccgctgcaaacgttgaaccaaacctcacgtttagggctgaatcggatggtccaggg

SEQ ID NO: 11325 - DNA, 60 bp, Artificial Sequence
  Description of Artificial Sequence: Synthetic probe
ggtctgccgtcaggcatgccactcacctccatcatcaactcactgaatcactgtctcatg

SEQ ID NO: 11326 - DNA, 60 bp, Artificial Sequence
  Description of Artificial Sequence: Synthetic probe
gacaaatctccaattgttgattcggcctgtgcaccactcaaatcaaacccaatcggcatc

SEQ ID NO: 11327 - DNA, 60 bp, Artificial Sequence
  Description of Artificial Sequence: Synthetic probe
aattgacatccacaggcacttcactgacaaatctccaattgttgattcggcctgtgcacg

SEQ ID NO: 11328 - DNA, 60 bp, Artificial Sequence
  Description of Artificial Sequence: Synthetic probe
ctgctgtttccctgatgtctatgcttctataggaactgaatatagctacatggatcctcc

SEQ ID NO: 11329 - DNA, 60 bp, Artificial Sequence
  Description of Artificial Sequence: Synthetic probe
gtttagggctgaatcggacggtcctggtggagctgacatcgtgactgaggaacaaggcac

SEQ ID NO: 11330 - DNA, 60 bp, Artificial Sequence
  Description of Artificial Sequence: Synthetic probe
agccggacttcgtgtttagggctgaatcggacggtcctggtggagctgacatcgtgactg

SEQ ID NO: 11331 - DNA, 60 bp, Artificial Sequence
  Description of Artificial Sequence: Synthetic probe
agtgaacacgaagccggacttcgtgtttagggctgaatcggacggtcctggtggagctga

SEQ ID NO: 11332 - DNA, 50 bp, Artificial Sequence
  Description of Artificial Sequence: Synthetic probe
gcctgggatcctgaccttcagtccaaagtgaacacgaagccggacttcgt

SEQ ID NO: 11333 - DNA, 60 bp, Artificial Sequence
  Description of Artificial Sequence: Synthetic probe
gcctgggatcctgaccttcagtccaaagtgaacacgaagccggacttcgtgtttagggct

SEQ ID NO: 11334 - DNA, 60 bp, Artificial Sequence
  Description of Artificial Sequence: Synthetic probe
ggaatactctccaaactcggatctgcctgggatcctgaccttcagtccaaagtgaacacg

SEQ ID NO: 11335 - DNA, 60 bp, Artificial Sequence
  Description of Artificial Sequence: Synthetic probe
ggcgaagtggtgagtggaatactctccaaactcggatctgcctgggatcctgaccttcag

SEQ ID NO: 11336 - DNA, 60 bp, Artificial Sequence
  Description of Artificial Sequence: Synthetic probe
ccacaaaacctggcgaagtggtgagtggaatactctccaaactcggatctgcctgggatc

SEQ ID NO: 11337 - DNA, 60 bp, Artificial Sequence
  Description of Artificial Sequence: Synthetic probe
gctgtgatgatcccttcaactgctgtttccctgatgtctatgcttccataggtactgaat

SEQ ID NO: 11338 - DNA, 60 bp, Artificial Sequence
  Description of Artificial Sequence: Synthetic probe
ccgatctctacggagaacggtgcggcacactcaatttggtcatcaacccttatgaactct

SEQ ID NO: 11339 - DNA, 60 bp, Artificial Sequence
  Description of Artificial Sequence: Synthetic probe
ccgatctctacggagaacggtgcggcacactcaatttggtcatcaatccttatgaactct

SEQ ID NO: 11340 - DNA, 60 bp, Artificial Sequence
  Description of Artificial Sequence: Synthetic probe
acctaaccgatctctacggagaacggtgcggcacactcaatttggtcatcaatccttatg

SEQ ID NO: 11341 - DNA, 60 bp, Artificial Sequence
  Description of Artificial Sequence: Synthetic probe
acctaaccgatctctacggagaacggtgcggcacactcaatttggtcatcaacccttatg

SEQ ID NO: 11342 - DNA, 60 bp, Artificial Sequence
  Description of Artificial Sequence: Synthetic probe
ccgcgaccttcatgggagtgcagctagcacgtgtcaagctagcatctaaggtcaacactc

SEQ ID NO: 11343 - DNA, 60 bp, Artificial Sequence
  Description of Artificial Sequence: Synthetic probe
cccagggcaaggtgctctactcacaggcactcaacccatcgatcaacccttacctcgatc

SEQ ID NO: 11344 - DNA, 60 bp, Artificial Sequence
  Description of Artificial Sequence: Synthetic probe
aaccccagggcaaggtgctctactcacaggcactcaacccatcgatcaacccttacctcg

SEQ ID NO: 11345 - DNA, 60 bp, Artificial Sequence
  Description of Artificial Sequence: Synthetic probe
ggaaccccagggcaaggtgctctactcacaggcactcaacccaccgatcaacccttacct

SEQ ID NO: 11346 - DNA, 60 bp, Artificial Sequence
  Description of Artificial Sequence: Synthetic probe
gcgacactcaaatcaaacccaattggcatcttcaacggtgtcgcgttcaaggttgctggt

SEQ ID NO: 11347 - DNA, 60 bp, Artificial Sequence
  Description of Artificial Sequence: Synthetic probe
tgggataattgttcttaatttagtagactgtagaattacttaattggtaggttgcattag

SEQ ID NO: 11348 - DNA, 60 bp, Artificial Sequence
  Description of Artificial Sequence: Synthetic probe
gttacgcgccaacttcgggctgcgggcctacgcatcaatccgtactcaaatggtcgccaa

SEQ ID NO: 11349 - DNA, 60 bp, Artificial Sequence
  Description of Artificial Sequence: Synthetic probe
tggcgttgcaaatgcagctattgaaggcaaaaagcttgatttggcatcaaaaggtctgca

SEQ ID NO: 11350 - DNA, 60 bp, Artificial Sequence
  Description of Artificial Sequence: Synthetic probe
atgttggactgtctgaccttcctcaagaccttcaattccctctatcctcgaccttcatgg

SEQ ID NO: 11351 - DNA, 60 bp, Artificial Sequence
  Description of Artificial Sequence: Synthetic probe
ggctccaactcaaccaaagttgcaaggattgccacactcccagaggcctacactcaaggt

SEQ ID NO: 11352 - DNA, 60 bp, Artificial Sequence
  Description of Artificial Sequence: Synthetic probe
actgttgctgacatgggtgccaacaaggtcaaaccacaacacaagatctcatcaaacaag

SEQ ID NO: 11353 - DNA, 60 bp, Artificial Sequence
  Description of Artificial Sequence: Synthetic probe
tgatacacacttcaaggggacatacatatgtggcacacgctcaaccgtcgccaaagacaa

SEQ ID NO: 11354 - DNA, 60 bp, Artificial Sequence
  Description of Artificial Sequence: Synthetic probe
cccatctgatgtcgttgcctcaaatggtaacttcgactacaggagtgggttctacgaccc

SEQ ID NO: 11355 - DNA, 56 bp, Artificial Sequence
  Description of Artificial Sequence: Synthetic probe
tactatgtgcccattgaaatcagaattgaccatgaacaaggtgaaaacaaccactg

SEQ ID NO: 11356 - DNA, 60 bp, Artificial Sequence
  Description of Artificial Sequence: Synthetic probe
cccatctgacctcatcccccggaactccgctcactggatgggaaatcgctggtggagtac

SEQ ID NO: 11357 - DNA, 60 bp, Artificial Sequence
  Description of Artificial Sequence: Synthetic probe
acctttgctctcttgaagcctcctggctcgctgatcaaacatggctctatcccatctgac

SEQ ID NO: 11358 - DNA, 60 bp, Artificial Sequence
  Description of Artificial Sequence: Synthetic probe
caaaaaccacctgttccataactgttgaaactaggccatcttctgactttacctttgctc

SEQ ID NO: 11359 - DNA, 60 bp, Artificial Sequence
  Description of Artificial Sequence: Synthetic probe
agtggaaccccaaggcaaggtgctttactcacaagcactcaacccatctatcaatcccta

SEQ ID NO: 11360 - DNA, 57 bp, Artificial Sequence
  Description of Artificial Sequence: Synthetic probe
atggtccaggtagcgccgagattgtgacggaggaacagggtaccatcgtgcagcaac

SEQ ID NO: 11361 - DNA, 60 bp, Artificial Sequence
  Description of Artificial Sequence: Synthetic probe
gcgaacgtcgactcaaacttcacgttcagggctgaatcggatggtccaggtagcgccgag

SEQ ID NO: 11362 - DNA, 60 bp, Artificial Sequence
  Description of Artificial Sequence: Synthetic probe
tggaacttggccgacggcacaccgtgcgagcctatcctccccccattcgtcatcgagggg

SEQ ID NO: 11363 - DNA, 60 bp, Artificial Sequence
  Description of Artificial Sequence: Synthetic probe
atgttgtgatgatccttttaattgctgcttccctattgtctatacttctataggaactga

SEQ ID NO: 11364 - DNA, 60 bp, Artificial Sequence
  Description of Artificial Sequence: Synthetic probe
cacaagaaggacctaaccgatctctacggagaaaggtgtggaactctcaacctggtcatc

SEQ ID NO: 11365 - DNA, 60 bp, Artificial Sequence
  Description of Artificial Sequence: Synthetic probe
gatttcctggtagcagtgcacgagggccttccatcaggttttccgtgcacctcccaggtg

SEQ ID NO: 11366 - DNA, 52 bp, Artificial Sequence
  Description of Artificial Sequence: Synthetic probe
gataaggatgtaacaaccatgttctactacatcaaggggaaagtgatcaatg

SEQ ID NO: 11367 - DNA, 53 bp, Artificial Sequence
  Description of Artificial Sequence: Synthetic probe
tacgcaacaaaacccggggaagtggttagtgggttggatccaaacttggatcc

SEQ ID NO: 11368 - DNA, 52 bp, Artificial Sequence
  Description of Artificial Sequence: Synthetic probe
tacgcaacaaaacccggggaagtggttagtgggttggatccaaacttggatc

SEQ ID NO: 11369 - DNA, 60 bp, Artificial Sequence
  Description of Artificial Sequence: Synthetic probe
tccctcccttcaacatcgtggggacccaccactactacgcaacaaaacccggggaagtgg

SEQ ID NO: 11370 - DNA, 60 bp, Artificial Sequence
  Description of Artificial Sequence: Synthetic probe
gatgatccttttaactgctgtttccctgatgtctatgcttctataggaactgaatatagc

SEQ ID NO: 11371 - DNA, 60 bp, Artificial Sequence
  Description of Artificial Sequence: Synthetic probe
cggcctgaaaccgacccggaccgacaaaacggatgctgagataacgcctgtccccaatga

SEQ ID NO: 11372 - DNA, 60 bp, Artificial Sequence
  Description of Artificial Sequence: Synthetic probe
cgaccgatattgtgttgactactccaagtgggactccacccaaccaccaaaggtaacatc

SEQ ID NO: 11373 - DNA, 60 bp, Artificial Sequence
  Description of Artificial Sequence: Synthetic probe
cgatcgatattgtgttgactactccaagtgggactccacccaaccaccaaaggtaacatc

SEQ ID NO: 11374 - DNA, 60 bp, Artificial Sequence
  Description of Artificial Sequence: Synthetic probe
catcagtcatgccgaaagtcctcgccaacctgaaacagtttggcctaaagccgacccgga

SEQ ID NO: 11375 - DNA, 60 bp, Artificial Sequence
  Description of Artificial Sequence: Synthetic probe
tcccaccactcatctcatcagtcatgccgaaagtcctcgccaacctgaaacagtttggcc

SEQ ID NO: 11376 - DNA, 60 bp, Artificial Sequence
  Description of Artificial Sequence: Synthetic probe
ctcatggtaggcgctgctgttgtcaaggctctcgaggactctggcattcaggtgacttgg

SEQ ID NO: 11377 - DNA, 60 bp, Artificial Sequence
  Description of Artificial Sequence: Synthetic probe
ctgtctcatggtaggcgctgctgttgtcaaggctctcgaggactctggcattcaggtgac

SEQ ID NO: 11378 - DNA, 60 bp, Artificial Sequence
  Description of Artificial Sequence: Synthetic probe
ggtcgccaaatttaccaagatgaagctgaccttgcaaatctgcactcttactatagcttc

SEQ ID NO: 11379 - DNA, 55 bp, Artificial Sequence
  Description of Artificial Sequence: Synthetic probe
ggctcggtggtcaggtgtttgagaattagccactatggctactactcacacgctt

SEQ ID NO: 11380 - DNA, 60 bp, Artificial Sequence
  Description of Artificial Sequence: Synthetic probe
gtgatgcgatgcgtattcaggcactccgcgctgctggcctccgtatcaacccgtactcaa

SEQ ID NO: 11381 - DNA, 60 bp, Artificial Sequence
  Description of Artificial Sequence: Synthetic probe
cccaccaggcgttgagcccatcgaatccgtatccatgttgcagtacccacacgttctatt

SEQ ID NO: 11382 - DNA, 60 bp, Artificial Sequence
  Description of Artificial Sequence: Synthetic probe
gcctgtacgccagtcaacacggagaggaattctataccagcaagatcgtaccgctcatcg

SEQ ID NO: 11383 - DNA, 60 bp, Artificial Sequence
  Description of Artificial Sequence: Synthetic probe
tcttcaacggtgttgcattcaaggtggccggcggcttgccctcgggtatgccactaacgt

SEQ ID NO: 11384 - DNA, 60 bp, Artificial Sequence
  Description of Artificial Sequence: Synthetic probe
tgctctcccacacgagtacgccctcggcctcaaagacgaactccggccaaaagacaaggt

SEQ ID NO: 11385 - DNA, 60 bp, Artificial Sequence
  Description of Artificial Sequence: Synthetic probe
gacgatcacggtgttgtcgttggactccatgctgggtctggtggtgacaaatgcccgtcc

SEQ ID NO: 11386 - DNA, 60 bp, Artificial Sequence
  Description of Artificial Sequence: Synthetic probe
gtcacccagttcattgctcctggagggaccatcattcttgagtcctgctatggcgcacgc

SEQ ID NO: 11387 - DNA, 60 bp, Artificial Sequence
  Description of Artificial Sequence: Synthetic probe
gtgaattcgtcacgcaagctggtgatgtccctgtgtttggattcgtctgccaaaacaatg

SEQ ID NO: 11388 - DNA, 60 bp, Artificial Sequence
  Description of Artificial Sequence: Synthetic probe
ccacaccctcaatccactcatgcagccatacaacccaatcttgagaaatttgatgtccgc

SEQ ID NO: 11389 - DNA, 60 bp, Artificial Sequence
  Description of Artificial Sequence: Synthetic probe
gcgaagccaaggacggaggtgtagttaggagttgcaaaacctacaatctcaaacctgcac

SEQ ID NO: 11390 - DNA, 56 bp, Artificial Sequence
  Description of Artificial Sequence: Synthetic probe
aactacccaatcttctatgtgaacaaagtcaaggttggatactttgacaggcaaac

SEQ ID NO: 11391 - DNA, 60 bp, Artificial Sequence
  Description of Artificial Sequence: Synthetic probe
gttgtcaggattactacactcccagaagccattacacaaggagggaactacccaatcttc

SEQ ID NO: 11392 - DNA, 60 bp, Artificial Sequence
  Description of Artificial Sequence: Synthetic probe
gcaaagttgtcaggattactacactcccagaagccattacacaaggagggaactacccaa

SEQ ID NO: 11393 - DNA, 60 bp, Artificial Sequence
  Description of Artificial Sequence: Synthetic probe
ccgcttgggttcacacttgtggacggtcaaccaattggctccagttccagcaaagttgtc

SEQ ID NO: 11394 - DNA, 60 bp, Artificial Sequence
  Description of Artificial Sequence: Synthetic probe
tccgcttgggttcacacttgtggacggtcaaccaattggctccagttccagcaaagttgt

SEQ ID NO: 11395 - DNA, 60 bp, Artificial Sequence
  Description of Artificial Sequence: Synthetic probe
ggaatggcaatgccagtccacaacgcaaaatttcacctcaaaaattgattgtcttcttcg

SEQ ID NO: 11396 - DNA, 60 bp, Artificial Sequence
  Description of Artificial Sequence: Synthetic probe
cttcaaaggtacatacatctgtggcactttatcaacggccaccatacccgaggttgacaa

SEQ ID NO: 11397 - DNA, 60 bp, Artificial Sequence
  Description of Artificial Sequence: Synthetic probe
ccggcaaccaagactgttgaccctaccaagaacaccacgcccttcaaaggtacatacatc

SEQ ID NO: 11398 - DNA, 60 bp, Artificial Sequence
  Description of Artificial Sequence: Synthetic probe
ttctacaatccggcaaccaagactgttgaccctaccaagaacaccacgcccttcaaaggt

SEQ ID NO: 11399 - DNA, 60 bp, Artificial Sequence
  Description of Artificial Sequence: Synthetic probe
aaccgttggttccatgtgatcgacacagacaaagccctggtgccaggcttgcctgatggt

SEQ ID NO: 11400 - DNA, 60 bp, Artificial Sequence
  Description of Artificial Sequence: Synthetic probe
attccacaacaactggttggtcaacaccatactacgtccccattgagatcaagcttcatg

SEQ ID NO: 11401 - DNA, 60 bp, Artificial Sequence
  Description of Artificial Sequence: Synthetic probe
tgattccacaacaactggttggtcaacaccatactacgtccccattgagatcaagcttca

SEQ ID NO: 11402 - DNA, 60 bp, Artificial Sequence
  Description of Artificial Sequence: Synthetic probe
ggggatggagatctttgtgccatcgcaccgctccatgtttgcttggatgagatttcatga

SEQ ID NO: 11403 - DNA, 60 bp, Artificial Sequence
  Description of Artificial Sequence: Synthetic probe
gcgccacagccttgacatcatgaccaaacttactgcagagcctgaactcgcccgcgtcgt

SEQ ID NO: 11404 - DNA, 60 bp, Artificial Sequence
  Description of Artificial Sequence: Synthetic probe
agggagatcatgcgccacagccttgacatcatgaccaaacttactgcagagcctgaactc

SEQ ID NO: 11405 - DNA, 60 bp, Artificial Sequence
  Description of Artificial Sequence: Synthetic probe
caagggaaagtgctttactcacaagcactcaatccatcaatcaacccctaccttgatcac

SEQ ID NO: 11406 - DNA, 60 bp, Artificial Sequence
  Description of Artificial Sequence: Synthetic probe
gaacctcaagggaaagtgctttactcacaagcactcaatccatcaatcaacccctacctt

SEQ ID NO: 11407 - DNA, 60 bp, Artificial Sequence
  Description of Artificial Sequence: Synthetic probe
tgggtccgctgcaaacgttgaaccaaacttcacgtttagggctgaatcggatggtccagg

SEQ ID NO: 11408 - DNA, 60 bp, Artificial Sequence
  Description of Artificial Sequence: Synthetic probe
atcccaatcaattgacattctcaggcatttcacagacaaatctccaattgttgattcggc

SEQ ID NO: 11409 - DNA, 60 bp, Artificial Sequence
  Description of Artificial Sequence: Synthetic probe
gctcggctgttgtcaaggctctcgaggactctggcgtgcaagtgacttggaacatcttcg

SEQ ID NO: 11410 - DNA, 60 bp, Artificial Sequence
  Description of Artificial Sequence: Synthetic probe
ctactactcacacgcttccgtcgtctaacgacctcgaatttctcttacacaaaaaggacc

SEQ ID NO: 11411 - DNA, 60 bp, Artificial Sequence
  Description of Artificial Sequence: Synthetic probe
cagctacattgatcctcccaacctcatccatgaagaacattgtgcaacaaacggaacctg

SEQ ID NO: 11412 - DNA, 60 bp, Artificial Sequence
  Description of Artificial Sequence: Synthetic probe
tggaccaccgtctggtatgccactcacttccatcatcaactcactgaatcactgtctcat

SEQ ID NO: 11413 - DNA, 60 bp, Artificial Sequence
  Description of Artificial Sequence: Synthetic probe
acacttcacagacaaatctccaattgttgattcggcctgtgcaccactcaaatcaaaccc

SEQ ID NO: 11414 - DNA, 60 bp, Artificial Sequence
  Description of Artificial Sequence: Synthetic probe
ggacaacgttcttttcgtaccacaccgctgtgaactggtcaacaactgaggctcaaggga

SEQ ID NO: 11415 - DNA, 60 bp, Artificial Sequence
  Description of Artificial Sequence: Synthetic probe
gatttcctggtggcagtgcacgagggccttccatcaggttttccgtgcacttcccaggtg

SEQ ID NO: 11416 - DNA, 60 bp, Artificial Sequence
  Description of Artificial Sequence: Synthetic probe
gtcaacaactgaggctcaagggaagattctcttttctcaagctcttagccctgaactaaa

SEQ ID NO: 11417 - DNA, 60 bp, Artificial Sequence
  Description of Artificial Sequence: Synthetic probe
gtcaacaactgaggctcaagggaagattctcttttctcaagctcttagccctgagctgaa

SEQ ID NO: 11418 - DNA, 60 bp, Artificial Sequence
  Description of Artificial Sequence: Synthetic probe
gtcaacaactgaggctcaagggaagattctcttctcccgagctctgagccctgagctgaa

SEQ ID NO: 11419 - DNA, 60 bp, Artificial Sequence
  Description of Artificial Sequence: Synthetic probe
gctgtgatgatcctttcaattgctgtttctctgatgtctatacttctatagggactgaat

SEQ ID NO: 11420 - DNA, 60 bp, Artificial Sequence
  Description of Artificial Sequence: Synthetic probe
ggctctcgaggactcaggcgtgcaggtgacttggaacatcttcgattcgatggacctgtt

SEQ ID NO: 11421 - DNA, 60 bp, Artificial Sequence
  Description of Artificial Sequence: Synthetic probe
cgagaacagtgggtgtggggcccatgttcacgtgatatctcgagaagagaacttcagagg

SEQ ID NO: 11422 - DNA, 60 bp, Artificial Sequence
  Description of Artificial Sequence: Synthetic probe
aacagatctaggcttgcatcagttccccacctcgagggagactccttcaggagatccctt

SEQ ID NO: 11423 - DNA, 60 bp, Artificial Sequence
  Description of Artificial Sequence: Synthetic probe
gtatgaaattgatactgtctacaacctacttgccgccgttaaggccaggtacggtgcaaa

SEQ ID NO: 11424 - DNA, 60 bp, Artificial Sequence
  Description of Artificial Sequence: Synthetic probe
cggcctgcgcaacactaaaatcaaacccaattggcatcttcaacggtgttgcattcaagg

SEQ ID NO: 11425 - DNA, 60 bp, Artificial Sequence
  Description of Artificial Sequence: Synthetic probe
tgacatcctcagacatttcactgacaaatccccaattgttgattcggcctgcgcaacact

SEQ ID NO: 11426 - DNA, 60 bp, Artificial Sequence
  Description of Artificial Sequence: Synthetic probe
tcacacgcttctgtcgtttgacgacctcgaatttctcttacacagaaaggacctaaccga

SEQ ID NO: 11427 - DNA, 60 bp, Artificial Sequence
  Description of Artificial Sequence: Synthetic probe
ggtcaggcggaattgatgtcaggttcaccgtctctggatctggtgtgttcggcggcaagc

SEQ ID NO: 11428 - DNA, 60 bp, Artificial Sequence
  Description of Artificial Sequence: Synthetic probe
tcttcaacggtgttgcattcaaggtggccggtggcgtccccactggcatgcccattacgt

SEQ ID NO: 11429 - DNA, 60 bp, Artificial Sequence
  Description of Artificial Sequence: Synthetic probe
ctgacaaatccccaattgttgattcggcctgtgcaacactaaaatcaaacccaattggca

SEQ ID NO: 11430 - DNA, 60 bp, Artificial Sequence
  Description of Artificial Sequence: Synthetic probe
ggatggacctgcagtcgaagatctcttcaaaaggctcgaccgaccaaagcacgatcgata

SEQ ID NO: 11431 - DNA, 60 bp, Artificial Sequence
  Description of Artificial Sequence: Synthetic probe
tggatggacctgcagtcgaagatctcttcaaaaggctcgaccgaccaaagcacgatcgat

SEQ ID NO: 11432 - DNA, 60 bp, Artificial Sequence
  Description of Artificial Sequence: Synthetic probe
cgctccatgtttgcttggatgagatttcatgatttgtcgctgtgggaaggtagtcgcgac

SEQ ID NO: 11433 - DNA, 55 bp, Artificial Sequence
  Description of Artificial Sequence: Synthetic probe
actcgaggactctggcgtgcaagtgacatggaacatcttcgactcgatggaccta

SEQ ID NO: 11434 - DNA, 50 bp, Artificial Sequence
  Description of Artificial Sequence: Synthetic probe
gccactatggctactactcacacgctcctgtcgtttgacgacctcgaatt

SEQ ID NO: 11435 - DNA, 60 bp, Artificial Sequence
  Description of Artificial Sequence: Synthetic probe
ccgctccatgtttgcttggatgagatttcatgatttgtcgctgtgggaaggtagtcgcga

SEQ ID NO: 11436 - DNA, 60 bp, Artificial Sequence
  Description of Artificial Sequence: Synthetic probe
gctcggatctgcctgggatcctgaccttcagtccacagtagacacgaagccggacttcgt

SEQ ID NO: 11437 - DNA, 60 bp, Artificial Sequence
  Description of Artificial Sequence: Synthetic probe
actcggatctgcctgggatcctgaccttcagtccaaagtgaacacgaagccggacttcgt

SEQ ID NO: 11438 - DNA, 57 bp, Artificial Sequence
  Description of Artificial Sequence: Synthetic probe
aaaagacctaaccgatctctacggagagaggtgtggtacactcaatctggtcatcaa

SEQ ID NO: 11439 - DNA, 57 bp, Artificial Sequence
  Description of Artificial Sequence: Synthetic probe
aaaagacctaaccgatctctacggagagaggtgtggtacactcaatctggtaatcaa

SEQ ID NO: 11440 - DNA, 60 bp, Artificial Sequence
  Description of Artificial Sequence: Synthetic probe
cgaatttctcttacatcaaaaagacctaaccgatctctacggagagaggtgtggtacact

SEQ ID NO: 11441 - DNA, 60 bp, Artificial Sequence
  Description of Artificial Sequence: Synthetic probe
gtcccagtattcggatttgtctgccaaaacaatgaaattgacactgtctataacctgctt

SEQ ID NO: 11442 - DNA, 57 bp, Artificial Sequence
  Description of Artificial Sequence: Synthetic probe
gtcccagtattcggatttgtctgccaaaacaatgaaattgacactgtgtacaaccta

SEQ ID NO: 11443 - DNA, 60 bp, Artificial Sequence
  Description of Artificial Sequence: Synthetic probe
gtttggcctgaaaccgacccggaccgacaaaacggatgctgagataacgcctatccctgc

SEQ ID NO: 11444 - DNA, 60 bp, Artificial Sequence
  Description of Artificial Sequence: Synthetic probe
ggctcaaaagatggttgtgcaacacacaaccaacaccagcgaattcgtcacacaagctgg

SEQ ID NO: 11445 - DNA, 60 bp, Artificial Sequence
  Description of Artificial Sequence: Synthetic probe
ttgttgaagccctcgcaccttgacgtgggagatttcctggtggcagtgcacgagggcctt

SEQ ID NO: 11446 - DNA, 60 bp, Artificial Sequence
  Description of Artificial Sequence: Synthetic probe
aggacttgttgaagccctcgcaccttgacgtgggagatttcctggtggcagtgcacgagg

SEQ ID NO: 11447 - DNA, 60 bp, Artificial Sequence
  Description of Artificial Sequence: Synthetic probe
tcttgaggactcaggcgtgcaagtgacttggaacatcttcgactcgatggaccttttcta

SEQ ID NO: 11448 - DNA, 60 bp, Artificial Sequence
  Description of Artificial Sequence: Synthetic probe
caacgtcacgttgagtccgcttgggttcacacttgtggacggtcaaccaattggctccag

SEQ ID NO: 11449 - DNA, 60 bp, Artificial Sequence
  Description of Artificial Sequence: Synthetic probe
gcacgatggacatcaacgtcacgttgagtccgcttgggttcacacttgtggacggtcaac

SEQ ID NO: 11450 - DNA, 60 bp, Artificial Sequence
  Description of Artificial Sequence: Synthetic probe
gtcttcttcgacggtccggagagcacgatggacatcaacgtcacgttgagtccgcttggg

SEQ ID NO: 11451 - DNA, 60 bp, Artificial Sequence
  Description of Artificial Sequence: Synthetic probe
cctcagagattgattgtcttcttcgacggtccggagagcacgatggacatcaacgtcacg

SEQ ID NO: 11452 - DNA, 60 bp, Artificial Sequence
  Description of Artificial Sequence: Synthetic probe
acacaaaatttcacctcagagattgattgtcttcttcgacggtccggagagcacgatgga

SEQ ID NO: 11453 - DNA, 60 bp, Artificial Sequence
  Description of Artificial Sequence: Synthetic probe
ggttgacaatcagaactacgcaaagaaagaagcacaaccgaaatcccaaacaatgtacat

SEQ ID NO: 11454 - DNA, 60 bp, Artificial Sequence
  Description of Artificial Sequence: Synthetic probe
aggttgacaatcagaactacgcaaagaaagaagcacaaaagaaatcccaaacaatgtaca

SEQ ID NO: 11455 - DNA, 60 bp, Artificial Sequence
  Description of Artificial Sequence: Synthetic probe
aggttgacaatcagaactacgcaaagaaagaagcacaaccgaaatcccaaacaatgtaca

SEQ ID NO: 11456 - DNA, 60 bp, Artificial Sequence
  Description of Artificial Sequence: Synthetic probe
catctgtggcactttatcaacggccaccatacccgaggttgacaatcagaactacgcaaa

SEQ ID NO: 11457 - DNA, 59 bp, Artificial Sequence
  Description of Artificial Sequence: Synthetic probe
gcctgatggttggcctgacactacaatcccagaaagtgtgacagcaaccaatggtgact

SEQ ID NO: 11458 - DNA, 60 bp, Artificial Sequence
  Description of Artificial Sequence: Synthetic probe
cgacacagacaaagccctggtgccaggcttgcctgatggttggcctgacactacaatccc

SEQ ID NO: 11459 - DNA, 60 bp, Artificial Sequence
  Description of Artificial Sequence: Synthetic probe
tgatcgacacagacaaagccctggtgccaggcttgcctgatggttggcctgacactacaa

SEQ ID NO: 11460 - DNA, 60 bp, Artificial Sequence
  Description of Artificial Sequence: Synthetic probe
ccatgtgatcgacacagacaaagccctggtgccaggcttgcctgatggttggcctgacac

SEQ ID NO: 11461 - DNA, 60 bp, Artificial Sequence
  Description of Artificial Sequence: Synthetic probe
gtgttgactactcaaaatgggactctacccaaccaccaaaagtaacatcccaatcaattg

SEQ ID NO: 11462 - DNA, 60 bp, Artificial Sequence
  Description of Artificial Sequence: Synthetic probe
cagtgggtgtggggcccatgttcacgtgatctctagggaagataacttcagaggaaaggc

SEQ ID NO: 11463 - DNA, 60 bp, Artificial Sequence
  Description of Artificial Sequence: Synthetic probe
cagtgggtgtggggcccatgttcacgtgatctctagggaagataacttcagaggaaaagc

SEQ ID NO: 11464 - DNA, 60 bp, Artificial Sequence
  Description of Artificial Sequence: Synthetic probe
gcgattgaatttgaaggtctacacattgaagtcccggaattccaccacgctgttgcagcg

SEQ ID NO: 11465 - DNA, 60 bp, Artificial Sequence
  Description of Artificial Sequence: Synthetic probe
gtttggcctgaaaccgacccggaccgacaaatcggatgctgagataacgcccatccctgc

SEQ ID NO: 11466 - DNA, 60 bp, Artificial Sequence
  Description of Artificial Sequence: Synthetic probe
gacctgctgtggaagatctcttcaaaaggctcgaaagaccaaagcacgatcggtattgtg

SEQ ID NO: 11467 - DNA, 60 bp, Artificial Sequence
  Description of Artificial Sequence: Synthetic probe
cgtgcaggtgacttggaacatcttcgattcaatggaccttttcacctatggcgatgacgg

SEQ ID NO: 11468 - DNA, 60 bp, Artificial Sequence
  Description of Artificial Sequence: Synthetic probe
gcgtgcaggtgacttggaacatcttcgattcaatggaccttttcacctatggcgatgacg

SEQ ID NO: 11469 - DNA, 60 bp, Artificial Sequence
  Description of Artificial Sequence: Synthetic probe
taccctctggcatgccactgacatccatcatcaactcactgaaccactgtctcatggtgg

SEQ ID NO: 11470 - DNA, 60 bp, Artificial Sequence
  Description of Artificial Sequence: Synthetic probe
gtggcttaccctctggcatgccactgacatccatcatcaactcactgaaccactgtctca

SEQ ID NO: 11471 - DNA, 60 bp, Artificial Sequence
  Description of Artificial Sequence: Synthetic probe
cgctccatgtttgcgtggatgcggtttcatgatttgtcgctgtgggaaggtagtcgcgac

SEQ ID NO: 11472 - DNA, 60 bp, Artificial Sequence
  Description of Artificial Sequence: Synthetic probe
cgctccatgttcgcgtggatgcgttttcatgatttgtcgctgtgggaaggtagtcgcgac

SEQ ID NO: 11473 - DNA, 60 bp, Artificial Sequence
  Description of Artificial Sequence: Synthetic probe
cgctccatgtttgcctggatgcgttttcatgatttgtcgctgtgggaaggtagtcgcgac

SEQ ID NO: 11474 - DNA, 60 bp, Artificial Sequence
  Description of Artificial Sequence: Synthetic probe
cgctccatgtttgcctggatgagatttcatgatttgtcgctgtgggaaggtagtcgcgac

SEQ ID NO: 11475 - DNA, 60 bp, Artificial Sequence
  Description of Artificial Sequence: Synthetic probe
ctcggtggtgaggtgtttgagaattagccactatggctactactcacacgcttctgtcgt

SEQ ID NO: 11476 - DNA, 60 bp, Artificial Sequence
  Description of Artificial Sequence: Synthetic probe
cgacctcgaatttctcttgcacaagaaggacctaaccgatctctacggagagaggtgcgg

SEQ ID NO: 11477 - DNA, 55 bp, Artificial Sequence
  Description of Artificial Sequence: Synthetic probe
tgcttggatgagatttcatgatttgtcgctgtgggaaggtagtcgcgacaccctt

SEQ ID NO: 11478 - DNA, 59 bp, Artificial Sequence
  Description of Artificial Sequence: Synthetic probe
gtgcaggtgacttggaacatcttcgactcgatggacctgtttacctatggtgacgacgg

SEQ ID NO: 11479 - DNA, 60 bp, Artificial Sequence
  Description of Artificial Sequence: Synthetic probe
ctcggatttgtctgccaaaacaatgaaattgacacggtctataacctacttgctgccgtc

SEQ ID NO: 11480 - DNA, 60 bp, Artificial Sequence
  Description of Artificial Sequence: Synthetic probe
gccttctggtatgccactaacatccatcatcaattcactaaaccactgcctcatggtggg

SEQ ID NO: 11481 - DNA, 60 bp, Artificial Sequence
  Description of Artificial Sequence: Synthetic probe
cgaatttctcttacacaagaaggacctaaccgatctctacggagaaaggtgtggaactct

SEQ ID NO: 11482 - DNA, 60 bp, Artificial Sequence
  Description of Artificial Sequence: Synthetic probe
ggtggacttggactcggtggtgaggtgtttgagaattagccactatgactactactcaca

SEQ ID NO: 11483 - DNA, 60 bp, Artificial Sequence
  Description of Artificial Sequence: Synthetic probe
gtggtggacttggactcggtggtgaggtgtttgagaattagccactatgactactactca

SEQ ID NO: 11484 - DNA, 60 bp, Artificial Sequence
  Description of Artificial Sequence: Synthetic probe
gcatcagttccccacctcgagggagactccttcaggagatcccttggcgttgtcatgtcc

SEQ ID NO: 11485 - DNA, 60 bp, Artificial Sequence
  Description of Artificial Sequence: Synthetic probe
tggcctgaaaccgacccggaccgacaaaacggatgctgagataacgccaatccctgctga

SEQ ID NO: 11486 - DNA, 60 bp, Artificial Sequence
  Description of Artificial Sequence: Synthetic probe
tggcctgaaaccgacccggaccgacaaaacggatgctgagataacgcctatccctgctga

SEQ ID NO: 11487 - DNA, 60 bp, Artificial Sequence
  Description of Artificial Sequence: Synthetic probe
tggcctgaaaccgacccggaccgacaaaacggatgctgagattacgcctatccctgctga

SEQ ID NO: 11488 - DNA, 60 bp, Artificial Sequence
  Description of Artificial Sequence: Synthetic probe
tggtctgaaaccgacccggaccgacaaaacggatgctgagataacgcctatccctgctga

SEQ ID NO: 11489 - DNA, 60 bp, Artificial Sequence
  Description of Artificial Sequence: Synthetic probe
cctgcttgccgccgttaaggccaggtatggtgcaaattttaatctgtataagggcatgac

SEQ ID NO: 11490 - DNA, 60 bp, Artificial Sequence
  Description of Artificial Sequence: Synthetic probe
taacctgcttgccgccgttaaggccaggtatggtgcaaattttaatctgtataagggcat

SEQ ID NO: 11491 - DNA, 60 bp, Artificial Sequence
  Description of Artificial Sequence: Synthetic probe
tttgtctgccaaaacaatgaaattgacactgtctataacctgcttgccgccgttaaggcc

SEQ ID NO: 11492 - DNA, 60 bp, Artificial Sequence
  Description of Artificial Sequence: Synthetic probe
cctcggcgttgtcatgtctgacaaggacgtaacaaccatgttctactacatcaaggggaa

SEQ ID NO: 11493 - DNA, 60 bp, Artificial Sequence
  Description of Artificial Sequence: Synthetic probe
tatggtgcaaatttcaacttgtataagggcatgacaagaactgcacacgagaacagtggg

SEQ ID NO: 11494 - DNA, 60 bp, Artificial Sequence
  Description of Artificial Sequence: Synthetic probe
tcaaattcttcaaaagttgtgaggattgcaacactcccagaagcctttacacaaggaggg

SEQ ID NO: 11495 - DNA, 60 bp, Artificial Sequence
  Description of Artificial Sequence: Synthetic probe
agatttcctggtggcagtgcacgagggcctcccatcaggttttccatgcacctcccaggt

SEQ ID NO: 11496 - DNA, 60 bp, Artificial Sequence
  Description of Artificial Sequence: Synthetic probe
ccatgtttgcttggatgagatttcatgatttgtcgctgtgggaaggtagtcgcgacaccc

SEQ ID NO: 11497 - DNA, 60 bp, Artificial Sequence
  Description of Artificial Sequence: Synthetic probe
tcagcctgggacagcactcagcagagggagattatgcgccagagccttgacatcatgacc

SEQ ID NO: 11498 - DNA, 60 bp, Artificial Sequence
  Description of Artificial Sequence: Synthetic probe
cgatcggtattgtgttgactactcaaaatgggactccacccaaccaccaaaggtaacatc

SEQ ID NO: 11499 - DNA, 60 bp, Artificial Sequence
  Description of Artificial Sequence: Synthetic probe
caaaagttgtgaggattgcaacactcccagaagcctttacacaaggagggaactacccca

SEQ ID NO: 11500 - DNA, 60 bp, Artificial Sequence
  Description of Artificial Sequence: Synthetic probe
gtttggcctgaagccgacccggaccgacaaaacggatgctgagataacgcctatccctgc

SEQ ID NO: 11501 - DNA, 60 bp, Artificial Sequence
  Description of Artificial Sequence: Synthetic probe
aattgccattcgatcggaatacacagattgcttcaaccgcccgattctgctgccatctcc

SEQ ID NO: 11502 - DNA, 60 bp, Artificial Sequence
  Description of Artificial Sequence: Synthetic probe
catgaataagattcaaattgccattcgatcggaatacacagattgcttcaaccgcccgat

SEQ ID NO: 11503 - DNA, 54 bp, Artificial Sequence
  Description of Artificial Sequence: Synthetic probe
aaaactgacacgtggcattcaaccatgtcacacttagggtacgttctcgtcgat

SEQ ID NO: 11504 - DNA, 60 bp, Artificial Sequence
  Description of Artificial Sequence: Synthetic probe
gacaacactagccaaacatcaaaaactgacacgtggcattcaaccatgtcacacttaggg

SEQ ID NO: 11505 - DNA, 60 bp, Artificial Sequence
  Description of Artificial Sequence: Synthetic probe
gcccaacacacaagattacatcaaattcactgatcgtttatgatgccgacaacactagcc

SEQ ID NO: 11506 - DNA, 60 bp, Artificial Sequence
  Description of Artificial Sequence: Synthetic probe
tatgcccaacacacaagattacatcaaattcactgatcgtttatgatgccgacaacacta

SEQ ID NO: 11507 - DNA, 60 bp, Artificial Sequence
  Description of Artificial Sequence: Synthetic probe
gaactctatttgccaccactgggacttgtaaaggggatactctatgcccaacacacaaga

SEQ ID NO: 11508 - DNA, 60 bp, Artificial Sequence
  Description of Artificial Sequence: Synthetic probe
gacatcaagaactctatttgccaccactgggacttgtaaaggggatactctatgcccaac

SEQ ID NO: 11509 - DNA, 57 bp, Artificial Sequence
  Description of Artificial Sequence: Synthetic probe
ggggtcaactccctattttactccaattgagatcgcactcaataagcttggagaaaa

SEQ ID NO: 11510 - DNA, 60 bp, Artificial Sequence
  Description of Artificial Sequence: Synthetic probe
tgaggccacaacaactggggggtcaactccctattttactccaattgagatcgcactcaa

SEQ ID NO: 11511 - DNA, 60 bp, Artificial Sequence
  Description of Artificial Sequence: Synthetic probe
ctgtcactaaggctctcgaggactcaggcgtgcaggtgacttggaacatcttcgattcga

SEQ ID NO: 11512 - DNA, 60 bp, Artificial Sequence
  Description of Artificial Sequence: Synthetic probe
gctgtcactaaggctctcgaggactcaggcgtgcaggtgacttggaacatcttcgactcg

SEQ ID NO: 11513 - DNA, 60 bp, Artificial Sequence
  Description of Artificial Sequence: Synthetic probe
tcatggtaggctgtgctgtcactaaggctctcgaggactcaggcgtgcaggtgacttgga

SEQ ID NO: 11514 - DNA, 60 bp, Artificial Sequence
  Description of Artificial Sequence: Synthetic probe
ctcatggtaggctgtgctgtcactaaggctctcgaggactcaggcgtgcaggtgacttgg

SEQ ID NO: 11515 - DNA, 60 bp, Artificial Sequence
  Description of Artificial Sequence: Synthetic probe
actgtctcatggtaggctgtgctgtcactaaggctctcgaggactcaggcgtgcaggtga

SEQ ID NO: 11516 - DNA, 60 bp, Artificial Sequence
  Description of Artificial Sequence: Synthetic probe
caactcactgaatcactgtctcatggtaggctgtgctgtcactaaggctctcgaggactc

SEQ ID NO: 11517 - DNA, 60 bp, Artificial Sequence
  Description of Artificial Sequence: Synthetic probe
actcacttccatcatcaactcactgaatcactgtctcatggtaggctgtgctgtcactaa

SEQ ID NO: 11518 - DNA, 60 bp, Artificial Sequence
  Description of Artificial Sequence: Synthetic probe
gccactaacatccatcatcaactcactgaatcactgtctcatggtaggctgtgctgtcac

SEQ ID NO: 11519 - DNA, 60 bp, Artificial Sequence
  Description of Artificial Sequence: Synthetic probe
gggttaatcattggactattcttggttctccgagttggtatttatctttgcattaaatta

SEQ ID NO: 11520 - DNA, 57 bp, Artificial Sequence
  Description of Artificial Sequence: Synthetic probe
ccaagcaagggtataagttcccactacacatcattggaactggagaagtagacaatg

SEQ ID NO: 11521 - DNA, 60 bp, Artificial Sequence
  Description of Artificial Sequence: Synthetic probe
cagacatcaatatgttgtcttatctaatctttgcacttgccgtttcgcccattttgggca

SEQ ID NO: 11522 - DNA, 60 bp, Artificial Sequence
  Description of Artificial Sequence: Synthetic probe
cagacatcaatatgttgtcttatctaatctttgcacttgtcgtttcgcccattctgggta

SEQ ID NO: 11523 - DNA, 60 bp, Artificial Sequence
  Description of Artificial Sequence: Synthetic probe
aacagacatcaatatgttgtcttatctaatctttgcacttgtcgtttcgcccattctggg

SEQ ID NO: 11524 - DNA, 60 bp, Artificial Sequence
  Description of Artificial Sequence: Synthetic probe
aacagacatcaatatgttgtcttatctaatctttgcacttgccgtttcgcccattttggg

SEQ ID NO: 11525 - DNA, 60 bp, Artificial Sequence
  Description of Artificial Sequence: Synthetic probe
gctcaggagaaactttaacagcgatcaagatggctgctactgtgaaacgcgtgattgatg

SEQ ID NO: 11526 - DNA, 56 bp, Artificial Sequence
  Description of Artificial Sequence: Synthetic probe
ccgtaccaatcagaagccgtatcagatgtttggtctctctcaaagacatccatgac

SEQ ID NO: 11527 - DNA, 60 bp, Artificial Sequence
  Description of Artificial Sequence: Synthetic probe
cctcaataggattaccagaaaccggaatcaggagcaattacttcccctatgtgtctacag

SEQ ID NO: 11528 - DNA, 60 bp, Artificial Sequence
  Description of Artificial Sequence: Synthetic probe
ggatgaccacttgtgactttagatggtatggaccaaaatatataactcattccatccata

SEQ ID NO: 11529 - DNA, 60 bp, Artificial Sequence
  Description of Artificial Sequence: Synthetic probe
agctatctctccgtctgatccaccttataagaacactctgagaaacctcttcgggtccgg

SEQ ID NO: 11530 - DNA, 60 bp, Artificial Sequence
  Description of Artificial Sequence: Synthetic probe
ctaccagacaaaccgaatcacctggctccaaatccaacacgagtcttgggataccagaag

SEQ ID NO: 11531 - DNA, 60 bp, Artificial Sequence
  Description of Artificial Sequence: Synthetic probe
ttgcttccaatgtctctaccagacaaaccgaatcacctggctccaaatccaacacgagtc

SEQ ID NO: 11532 - DNA, 60 bp, Artificial Sequence
  Description of Artificial Sequence: Synthetic probe
cggcttaccaggtacactttgaggccaaacagacttggaaaccggtgatagagacagggg

SEQ ID NO: 11533 - DNA, 60 bp, Artificial Sequence
  Description of Artificial Sequence: Synthetic probe
gatgatacggcttaccaggtacactttgaggccaaacagacttggaaaccggtgatagag

SEQ ID NO: 11534 - DNA, 60 bp, Artificial Sequence
  Description of Artificial Sequence: Synthetic probe
agcagtggaaagggtaggagatattcgagtgaactcagttgcagagtacgccaggaaact

SEQ ID NO: 11535 - DNA, 60 bp, Artificial Sequence
  Description of Artificial Sequence: Synthetic probe
ccggacatgaaggcctttgccaagagagcagtggaaagggtaggagatattcgagtgaac

SEQ ID NO: 11536 - DNA, 60 bp, Artificial Sequence
  Description of Artificial Sequence: Synthetic probe
actccggacatgaaggcctttgccaagagagcagtggaaagggtaggagatattcgagtg

SEQ ID NO: 11537 - DNA, 60 bp, Artificial Sequence
  Description of Artificial Sequence: Synthetic probe
gcatgaaattactccagacatgaaggcctttgccaagagagcagtggaaagggtaggaga

SEQ ID NO: 11538 - DNA, 60 bp, Artificial Sequence
  Description of Artificial Sequence: Synthetic probe
attaagcatgaaattactccggacatgaaggcctttgccaagagagcagtggaaagggta

SEQ ID NO: 11539 - DNA, 60 bp, Artificial Sequence
  Description of Artificial Sequence: Synthetic probe
gaggacattaagcatgaaattactccagacatgaaggcctttgccaagagagcagtggaa

SEQ ID NO: 11540 - DNA, 60 bp, Artificial Sequence
  Description of Artificial Sequence: Synthetic probe
gatcgtctgagctggagcagagattcgtgcttaacgggaagaagttcactaaggagaagg

SEQ ID NO: 11541 - DNA, 60 bp, Artificial Sequence
  Description of Artificial Sequence: Synthetic probe
gcaattggcagatcatctgagctggagcagagattcgtgcttaacgggaagaagttcacc

SEQ ID NO: 11542 - DNA, 60 bp, Artificial Sequence
  Description of Artificial Sequence: Synthetic probe
gcctatgcaattggcagatcgtctgagctggagcagagattcgtgcttaacgggaagaag

SEQ ID NO: 11543 - DNA, 60 bp, Artificial Sequence
  Description of Artificial Sequence: Synthetic probe
ctttttgcctatgcaattggcagatcgtctgagctggagcagagattcgtgcttaacggg

SEQ ID NO: 11544 - DNA, 54 bp, Artificial Sequence
  Description of Artificial Sequence: Synthetic probe
ttactcttccacaaaaaatcccagtttccatttctgggggcaactgaccgcatt

SEQ ID NO: 11545 - DNA, 60 bp, Artificial Sequence
  Description of Artificial Sequence: Synthetic probe
gtccacgaagtctccttactcttcaacaaaaaatcccagtttccatttctgggggcaact

SEQ ID NO: 11546 - DNA, 60 bp, Artificial Sequence
  Description of Artificial Sequence: Synthetic probe
gaaattgaccaagctgattcctacatgccctatctgatcgacatgggcttgtccacgaag

SEQ ID NO: 11547 - DNA, 60 bp, Artificial Sequence
  Description of Artificial Sequence: Synthetic probe
actcctggccaggaaattgaccaagctgattcctacatgccctatctgatcgacatgggc

SEQ ID NO: 11548 - DNA, 60 bp, Artificial Sequence
  Description of Artificial Sequence: Synthetic probe
ggagattgtggatgaaacagcagaattcttcaatgcttgggcaaatgactccaacttcac

SEQ ID NO: 11549 - DNA, 60 bp, Artificial Sequence
  Description of Artificial Sequence: Synthetic probe
aaagggcaagacacccgactgcccggagatgatctgtggcttccaacgctgatcttcggt

SEQ ID NO: 11550 - DNA, 60 bp, Artificial Sequence
  Description of Artificial Sequence: Synthetic probe
cggtgtacataaagaaggagacagatctgagtcttttgaggagtcatgtttatgacggga

SEQ ID NO: 11551 - DNA, 60 bp, Artificial Sequence
  Description of Artificial Sequence: Synthetic probe
accgacggtgtacataaagaaggagacagatctgagtcttttgaggagtcatgtttatga

SEQ ID NO: 11552 - DNA, 60 bp, Artificial Sequence
  Description of Artificial Sequence: Synthetic probe
ggctgtttcagtaaaaggaggatacaagcagaagtggagtactagaggtgatgggctccc

SEQ ID NO: 11553 - DNA, 60 bp, Artificial Sequence
  Description of Artificial Sequence: Synthetic probe
ggtgggaggctgtttcagtaaaaggaggatacaagcagaagtggagtactagaggtgatg

SEQ ID NO: 11554 - DNA, 51 bp, Artificial Sequence
  Description of Artificial Sequence: Synthetic probe
gctgccttaaaatcatctgatagacctgcagatttattgaccattagcctt

SEQ ID NO: 11555 - DNA, 60 bp, Artificial Sequence
  Description of Artificial Sequence: Synthetic probe
ttgagactatgctacaaatattcggagtacccacgggtgtgtctcatgcggctgccttaa

SEQ ID NO: 11556 - DNA, 60 bp, Artificial Sequence
  Description of Artificial Sequence: Synthetic probe
tgtaaaccttgagactatgctacaaatattcggagtacccacaggtgtgtctcatgcggc

SEQ ID NO: 11557 - DNA, 60 bp, Artificial Sequence
  Description of Artificial Sequence: Synthetic probe
gacgggtattccctcccaattcattcctgatccttttgtaaaccttgagactatgctaca

SEQ ID NO: 11558 - DNA, 60 bp, Artificial Sequence
  Description of Artificial Sequence: Synthetic probe
ccttgacaggtattccctcccaattcattcctgatccttttgtaaaccttgagactatgc

SEQ ID NO: 11559 - DNA, 60 bp, Artificial Sequence
  Description of Artificial Sequence: Synthetic probe
ttacatggaatgggaatccattacagggacttcttaagttgtggagacggttccggcggg

SEQ ID NO: 11560 - DNA, 60 bp, Artificial Sequence
  Description of Artificial Sequence: Synthetic probe
attcggagtatattacatggaatgggaatccattacagggacttcttaagttgtggagac

SEQ ID NO: 11561 - DNA, 60 bp, Artificial Sequence
  Description of Artificial Sequence: Synthetic probe
actggcgctcattataaaattcggagtatattacatggaatgggaatccattacagggac

SEQ ID NO: 11562 - DNA, 60 bp, Artificial Sequence
  Description of Artificial Sequence: Synthetic probe
gccagttacctactggcgctcattataaaattcggagtatattacatggaatgggaatcc

SEQ ID NO: 11563 - DNA, 60 bp, Artificial Sequence
  Description of Artificial Sequence: Synthetic probe
ttgggccaattaccaactggcgctcattataaaattcggagtatattacatggaatggga

SEQ ID NO: 11564 - DNA, 60 bp, Artificial Sequence
  Description of Artificial Sequence: Synthetic probe
ggggaagggaatccagagggacaattacaacaatccctgtttattatacgaccacccctt

SEQ ID NO: 11565 - DNA, 57 bp, Artificial Sequence
  Description of Artificial Sequence: Synthetic probe
caagcaaccgtgatatgggggtgattgtcagaaattacttcaaataccaatgccgtc

SEQ ID NO: 11566 - DNA, 60 bp, Artificial Sequence
  Description of Artificial Sequence: Synthetic probe
acctgctgagcaatcctatcaagtcggcagatgtataggttttctatatggagacttggc

SEQ ID NO: 11567 - DNA, 60 bp, Artificial Sequence
  Description of Artificial Sequence: Synthetic probe
gggaattggaagaatttagcacctgcagagcaatcctatcaagtcggcagatgtataggt

SEQ ID NO: 11568 - DNA, 60 bp, Artificial Sequence
  Description of Artificial Sequence: Synthetic probe
gatctaccctttagaagggaattggaagaatttagcacctgctgagcaatcctatcaagt

SEQ ID NO: 11569 - DNA, 60 bp, Artificial Sequence
  Description of Artificial Sequence: Synthetic probe
gagaccagatacatcagagtcgatattgctgctccaattctcccaagaatggtcggaaca

SEQ ID NO: 11570 - DNA, 60 bp, Artificial Sequence
  Description of Artificial Sequence: Synthetic probe
tgagaccagatacatcagagtcgatattgctgctccaattctcccaagaatggtcggaac

SEQ ID NO: 11571 - DNA, 60 bp, Artificial Sequence
  Description of Artificial Sequence: Synthetic probe
ttaaagggctgtgtgattctaacctcatttccatggacatcaccttcttctcagaagacg

SEQ ID NO: 11572 - DNA, 60 bp, Artificial Sequence
  Description of Artificial Sequence: Synthetic probe
tacaaagttaaagggctgtgtgattctaacctcatttccatggacatcaccttcttctca

SEQ ID NO: 11573 - DNA, 60 bp, Artificial Sequence
  Description of Artificial Sequence: Synthetic probe
cagaaaacaggggtacaagcttaaaaatgacctctggttccagatcatggacccagacct

SEQ ID NO: 11574 - DNA, 60 bp, Artificial Sequence
  Description of Artificial Sequence: Synthetic probe
aagtgtctgcagtcaattgtttactttggttggaggaatttttttctctgattcagaaga

SEQ ID NO: 11575 - DNA, 60 bp, Artificial Sequence
  Description of Artificial Sequence: Synthetic probe
cataattccacaaaatggtttacgtcctctgatggagaaagtgtctgcagtcaattgttt

SEQ ID NO: 11576 - DNA, 60 bp, Artificial Sequence
  Description of Artificial Sequence: Synthetic probe
ttatgtgtcactcagccttgtggatgaccacttgtgacttcagatggtatgggccaaaat

SEQ ID NO: 11577 - DNA, 60 bp, Artificial Sequence
  Description of Artificial Sequence: Synthetic probe
ggaatctggcagagtgcacatttgaagcatcgggagaaggggtcattatgaaggagcgcc

SEQ ID NO: 11578 - DNA, 60 bp, Artificial Sequence
  Description of Artificial Sequence: Synthetic probe
aatactggaatctggcagagtgcacatttgaagcatcgggagaaggggtcattatgaagg

SEQ ID NO: 11579 - DNA, 60 bp, Artificial Sequence
  Description of Artificial Sequence: Synthetic probe
aaatactggaatctggcagagtgcacatttgaagcatcgggagaaggggtcattgtgaaa

SEQ ID NO: 11580 - DNA, 60 bp, Artificial Sequence
  Description of Artificial Sequence: Synthetic probe
gttgttcaaagtgccaaatactggaatctggcagagtgcacatttgaagcatcgggagaa

SEQ ID NO: 11581 - DNA, 60 bp, Artificial Sequence
  Description of Artificial Sequence: Synthetic probe
aaagcagtcgttcaaagtgccaaacactggaatctggcagagtgcacatttgaagcatcg

SEQ ID NO: 11582 - DNA, 60 bp, Artificial Sequence
  Description of Artificial Sequence: Synthetic probe
ggaagtgaggaagagtattattcagtatgcccagaaggagcatcagatttgatgggagca

SEQ ID NO: 11583 - DNA, 60 bp, Artificial Sequence
  Description of Artificial Sequence: Synthetic probe
gggtaagttggataaagattggtcaagtttcggaataaacatcgggaaggcaggggatac

SEQ ID NO: 11584 - DNA, 60 bp, Artificial Sequence
  Description of Artificial Sequence: Synthetic probe
tccggggtaagttggataaagattggtcaagtttcggaataaacatcgggaaggcagggg

SEQ ID NO: 11585 - DNA, 60 bp, Artificial Sequence
  Description of Artificial Sequence: Synthetic probe
tccggggtaagttggataaagattggtcaagtttcggaataaacatcgggaaagcagggg

SEQ ID NO: 11586 - DNA, 60 bp, Artificial Sequence
  Description of Artificial Sequence: Synthetic probe
gttggataaagattggtcaagtttcggaataaacatcgggaaggcaggggatacaatcgg

SEQ ID NO: 11587 - DNA, 60 bp, Artificial Sequence
  Description of Artificial Sequence: Synthetic probe
tccgaggcaagttggataaagattggtcaagtttcggaataaacatcgggaaagcagggg

SEQ ID NO: 11588 - DNA, 60 bp, Artificial Sequence
  Description of Artificial Sequence: Synthetic probe
ataccggtcaccttccctaattggactcaacctgtaatgaaggagaatggtggggagaag

SEQ ID NO: 11589 - DNA, 60 bp, Artificial Sequence
  Description of Artificial Sequence: Synthetic probe
atataccggtcaccttccctaattggactcaacctgtaatgaaggagaatggtggggaga

SEQ ID NO: 11590 - DNA, 60 bp, Artificial Sequence
  Description of Artificial Sequence: Synthetic probe
gatataccggtcaccttccctaattggactcaacctgtaatgaaggagaatggtggggag

SEQ ID NO: 11591 - DNA, 60 bp, Artificial Sequence
  Description of Artificial Sequence: Synthetic probe
atataccggtcaccttccctaattggactcaacctgtaatgaaggagaatgatggagaga

SEQ ID NO: 11592 - DNA, 60 bp, Artificial Sequence
  Description of Artificial Sequence: Synthetic probe
ggtgatgggctcccaaaagatacccgaacttcagactccttggccccaatcgggaactgg

SEQ ID NO: 11593 - DNA, 60 bp, Artificial Sequence
  Description of Artificial Sequence: Synthetic probe
ctcactctgttaaagtagatgagtacactggagaatggattgacccacatttcatcgggg

SEQ ID NO: 11594 - DNA, 60 bp, Artificial Sequence
  Description of Artificial Sequence: Synthetic probe
gggtttatgtgtcactctgctttatggatgaccacttgtgatttcagatggtatggacct

SEQ ID NO: 11595 - DNA, 60 bp, Artificial Sequence
  Description of Artificial Sequence: Synthetic probe
tgggtttatgtgtcactctgctttatggatgaccacttgtgatttcaggtggtatggacc

SEQ ID NO: 11596 - DNA, 60 bp, Artificial Sequence
  Description of Artificial Sequence: Synthetic probe
tgggtttatgtgccactctgctttatggatgaccacttgtgatttcagatggtatggacc

SEQ ID NO: 11597 - DNA, 60 bp, Artificial Sequence
  Description of Artificial Sequence: Synthetic probe
tgggtttatgtgtcactctgctttatggatgaccacttgtgatttcagatggtatggacc

SEQ ID NO: 11598 - DNA, 60 bp, Artificial Sequence
  Description of Artificial Sequence: Synthetic probe
gatgggtttatgtgtcactctgctttatggatgaccacttgtgatttcaggtggtatgga

SEQ ID NO: 11599 - DNA, 60 bp, Artificial Sequence
  Description of Artificial Sequence: Synthetic probe
acacatcaggttgatgggtttatgtgccactctgctttatggatgaccacttgtgatttc

SEQ ID NO: 11600 - DNA, 60 bp, Artificial Sequence
  Description of Artificial Sequence: Synthetic probe
acacatcaggttgatgggtttatgtgtcactctgctttatggatgaccacttgtgatttc

SEQ ID NO: 11601 - DNA, 60 bp, Artificial Sequence
  Description of Artificial Sequence: Synthetic probe
gctaacaatgcccaagggactaacaacacatcaggttgatgggtttatgtgtcactctgc

SEQ ID NO: 11602 - DNA, 60 bp, Artificial Sequence
  Description of Artificial Sequence: Synthetic probe
gaattcatgttgagctaacaatgcccaagggactaacaacacatcaggttgatgggttta

SEQ ID NO: 11603 - DNA, 60 bp, Artificial Sequence
  Description of Artificial Sequence: Synthetic probe
cagggattcctattgagctaacaatgcccaagggactaacaacacatcaggttgatgggt

SEQ ID NO: 11604 - DNA, 60 bp, Artificial Sequence
  Description of Artificial Sequence: Synthetic probe
cagggattcctgttgagctaacaatgcccaagggactaacaacacatcaggttgatgggt

SEQ ID NO: 11605 - DNA, 60 bp, Artificial Sequence
  Description of Artificial Sequence: Synthetic probe
caggaattcctgttgagctaacaatgcccaagggactaacaacacatcaggttgatgggt

SEQ ID NO: 11606 - DNA, 60 bp, Artificial Sequence
  Description of Artificial Sequence: Synthetic probe
ggactcagacaggaattcctgttgagctaacaatgcccaagggactaacaacacatcagg

SEQ ID NO: 11607 - DNA, 60 bp, Artificial Sequence
  Description of Artificial Sequence: Synthetic probe
ggactcagacagggattcctattgagctaacaatgcccaagggactaacaacacatcagg

SEQ ID NO: 11608 - DNA, 60 bp, Artificial Sequence
  Description of Artificial Sequence: Synthetic probe
ggactcaaacagggattcctattgagctaacaatgcccaagggactaacaacacatcagg

SEQ ID NO: 11609 - DNA, 60 bp, Artificial Sequence
  Description of Artificial Sequence: Synthetic probe
ggactcagacagggattcctgttgagctaacaatgcccaagggactaacaacacatcagg

SEQ ID NO: 11610 - DNA, 60 bp, Artificial Sequence
  Description of Artificial Sequence: Synthetic probe
tcctcatgaatacaattactgtcccactagtgcagataaaaactcgcacgggactcagac

SEQ ID NO: 11611 - DNA, 60 bp, Artificial Sequence
  Description of Artificial Sequence: Synthetic probe
tcctcatgaatacaattactgtcccactagtgcagataaaaactcacatgggactcaaac

SEQ ID NO: 11612 - DNA, 60 bp, Artificial Sequence
  Description of Artificial Sequence: Synthetic probe
tcctcatgaatacaattactgtcccactagtgcagataagaactcacatgggactcagac

SEQ ID NO: 11613 - DNA, 60 bp, Artificial Sequence
  Description of Artificial Sequence: Synthetic probe
tcctcatgaatacaattactgtcccactagtgcagataaaaactcacatgggactcagac

SEQ ID NO: 11614 - DNA, 60 bp, Artificial Sequence
  Description of Artificial Sequence: Synthetic probe
tcctcatgaatacaattactgtcccactagtgcagacaaaaactcacacgggactcagac

SEQ ID NO: 11615 - DNA, 56 bp, Artificial Sequence
  Description of Artificial Sequence: Synthetic probe
tagacaaatgggaagaggatttgcccgaattggaaaagattgatgatgatatacca

SEQ ID NO: 11616 - DNA, 60 bp, Artificial Sequence
  Description of Artificial Sequence: Synthetic probe
tagacaaatgggaagaggatttgcccgaattggaaaagattgatgatgatataccagtca

SEQ ID NO: 11617 - DNA, 56 bp, Artificial Sequence
  Description of Artificial Sequence: Synthetic probe
tagacaaatgggaagaggatttgcccgaattggaaaagatcgatgatgatatacca

SEQ ID NO: 11618 - DNA, 60 bp, Artificial Sequence
  Description of Artificial Sequence: Synthetic probe
aacatcttacgatgttatcgccggatgaaagaatagacaaatgggaagaggatttgcccg

SEQ ID NO: 11619 - DNA, 60 bp, Artificial Sequence
  Description of Artificial Sequence: Synthetic probe
gagtccatcaatctatgggatttaaagtccacagaagtacaattgatctctaagagagcc

SEQ ID NO: 11620 - DNA, 55 bp, Artificial Sequence
  Description of Artificial Sequence: Synthetic probe
aaaagcatgagcgtgctccaatcagatacggaaccatagtctcacgattcaagga

SEQ ID NO: 11621 - DNA, 60 bp, Artificial Sequence
  Description of Artificial Sequence: Synthetic probe
tgtttaaaaagcatgaacgtgctccaatcagatacggaaccatagtctcaagattcaagg

SEQ ID NO: 11622 - DNA, 58 bp, Artificial Sequence
  Description of Artificial Sequence: Synthetic probe
aaaagcatgaacgtgctccaatcagatacggaaccatagtctcaagattcaaggactg

SEQ ID NO: 11623 - DNA, 60 bp, Artificial Sequence
  Description of Artificial Sequence: Synthetic probe
gcttatctctacgctgcattaaagggagtggaaggaactttagacagagactgggttagc

SEQ ID NO: 11624 - DNA, 60 bp, Artificial Sequence
  Description of Artificial Sequence: Synthetic probe
gacttggtctccacttttctgaaggggtgggtggggaaagattacccattcaagtcaaag

SEQ ID NO: 11625 - DNA, 60 bp, Artificial Sequence
  Description of Artificial Sequence: Synthetic probe
tgacctatgacttggtctccacttttctgaaggggtgggtggggaaagattacccattca

SEQ ID NO: 11626 - DNA, 60 bp, Artificial Sequence
  Description of Artificial Sequence: Synthetic probe
ccgcccaacccttcacattcttaaaagaggtggacaaagagtcagaaatgacctatgact

SEQ ID NO: 11627 - DNA, 60 bp, Artificial Sequence
  Description of Artificial Sequence: Synthetic probe
ttccgcccaacccttcacattcttaaaagaggtggacaaagagtcagaaatgacctatga

SEQ ID NO: 11628 - DNA, 60 bp, Artificial Sequence
  Description of Artificial Sequence: Synthetic probe
gatctaaggagtgggattctcctcttgatatgcttagaggttgtcaagctcaacccatgt

SEQ ID NO: 11629 - DNA, 60 bp, Artificial Sequence
  Description of Artificial Sequence: Synthetic probe
gagatctaaggagtgggattctcctcttgatatgcttagaggttgtcaagctcaacccat

SEQ ID NO: 11630 - DNA, 60 bp, Artificial Sequence
  Description of Artificial Sequence: Synthetic probe
atggtttatataattaaaagaatgaatcacgaggaggttccccccatttggagatctaag

SEQ ID NO: 11631 - DNA, 60 bp, Artificial Sequence
  Description of Artificial Sequence: Synthetic probe
cttaaacaccgcagactataatttgaattctccactcatttccgatgacatggtttatat

SEQ ID NO: 11632 - DNA, 60 bp, Artificial Sequence
  Description of Artificial Sequence: Synthetic probe
acttaaacaccgcagactataatttgaattctccactcatttccgatgacatggtttata

SEQ ID NO: 11633 - DNA, 52 bp, Artificial Sequence
  Description of Artificial Sequence: Synthetic probe
aacaggaatcaaaatggatttcgatctaatagaagattctgctaactgggaa

SEQ ID NO: 11634 - DNA, 60 bp, Artificial Sequence
  Description of Artificial Sequence: Synthetic probe
cggaggaagatgcaagggacaaatttgtgaaacagtccataattccacaaaatggttcac

SEQ ID NO: 11635 - DNA, 60 bp, Artificial Sequence
  Description of Artificial Sequence: Synthetic probe
ccacacttcatcggaggaaggtgcaagggacaaatttgtgaaacagtccataattccaca

SEQ ID NO: 11636 - DNA, 60 bp, Artificial Sequence
  Description of Artificial Sequence: Synthetic probe
ccacatttcatcggaggaaggtgcaaaggacaaatttgtgaaacagtccataattccaca

SEQ ID NO: 11637 - DNA, 60 bp, Artificial Sequence
  Description of Artificial Sequence: Synthetic probe
tccacatttcatcggaggaagatgcaagggacaaatttgtgaaacagtccataattccac

SEQ ID NO: 11638 - DNA, 54 bp, Artificial Sequence
  Description of Artificial Sequence: Synthetic probe
cctcgcattcacccggtccagcaccaaaagtcacggagtcaactagtctatggg

SEQ ID NO: 11639 - DNA, 55 bp, Artificial Sequence
  Description of Artificial Sequence: Synthetic probe
tcctcgcattcacccggtccagcaccaaaagtcacggagtcaaccagtctatggg

SEQ ID NO: 11640 - DNA, 60 bp, Artificial Sequence
  Description of Artificial Sequence: Synthetic probe
tctcctcctcgcattcacccggtccagcaccaaaagtcacggagtcaactagtctatggg

SEQ ID NO: 11641 - DNA, 60 bp, Artificial Sequence
  Description of Artificial Sequence: Synthetic probe
ttccggatctttctcctcctcgcattcacccggtccagcaccaaaagtcacggagtcaac

SEQ ID NO: 11642 - DNA, 60 bp, Artificial Sequence
  Description of Artificial Sequence: Synthetic probe
ttccgaatctttctcctcctcgcattcacccggtccagcaccaaaagtcacggagtcaac

SEQ ID NO: 11643 - DNA, 60 bp, Artificial Sequence
  Description of Artificial Sequence: Synthetic probe
ttgtgtccagtctttgcaagcccaagaagagaccaatctacaaatccgacgtagaaatgg

SEQ ID NO: 11644 - DNA, 60 bp, Artificial Sequence
  Description of Artificial Sequence: Synthetic probe
tcagattgattggatttgtgtccagtctttgcaagcccaagaagagaccaatctacaaat

SEQ ID NO: 11645 - DNA, 60 bp, Artificial Sequence
  Description of Artificial Sequence: Synthetic probe
ttacggagacactggagtatcaaagaatccagttgaattggtagagggatggtttagcag

SEQ ID NO: 11646 - DNA, 60 bp, Artificial Sequence
  Description of Artificial Sequence: Synthetic probe
ctttacgtccaagtacctaagggtcgaattagaaagtccagtcatacccagaatggaagg

SEQ ID NO: 11647 - DNA, 60 bp, Artificial Sequence
  Description of Artificial Sequence: Synthetic probe
tggctcactacattactttacgtccaagtacctaagggtcgaattagaaagtccagtcat

SEQ ID NO: 11648 - DNA, 60 bp, Artificial Sequence
  Description of Artificial Sequence: Synthetic probe
tatttaggaccaaaaaacccaggtgtagggccagtttttacaatcatcaatggctcacta

SEQ ID NO: 11649 - DNA, 60 bp, Artificial Sequence
  Description of Artificial Sequence: Synthetic probe
ggagcaagattgcagcaggagaaccaataactcccgttgatatcagctatttaggaccaa

SEQ ID NO: 11650 - DNA, 60 bp, Artificial Sequence
  Description of Artificial Sequence: Synthetic probe
ccatcatcgccccaggagaacatgcgacagatatatctctaatatcagatgtagaacgga

SEQ ID NO: 11651 - DNA, 60 bp, Artificial Sequence
  Description of Artificial Sequence: Synthetic probe
gacctttcttcttccatcatcgccccaggagaacatgcgacagatatatctctaatatca

SEQ ID NO: 11652 - DNA, 60 bp, Artificial Sequence
  Description of Artificial Sequence: Synthetic probe
aaactgtgagggatctaccacacattaaagactgtgacctttcttcttccatcatcgccc

SEQ ID NO: 11653 - DNA, 60 bp, Artificial Sequence
  Description of Artificial Sequence: Synthetic probe
acccagacttggatcaaactgtgagggatctaccacacattaaagactgtgacctttctt

SEQ ID NO: 11654 - DNA, 60 bp, Artificial Sequence
  Description of Artificial Sequence: Synthetic probe
cagaaaaccagggtacaagcttaagaacgacctttggttccaaatcacagacccagactt

SEQ ID NO: 11655 - DNA, 60 bp, Artificial Sequence
  Description of Artificial Sequence: Synthetic probe
acttcaatgggattacctgaaaccggaatcagaagcaactacttcccctatgtgtccaca

SEQ ID NO: 11656 - DNA, 57 bp, Artificial Sequence
  Description of Artificial Sequence: Synthetic probe
cagatggggagagtgtatgcagtcaattatttacactagtaggaggaacctttttct

SEQ ID NO: 11657 - DNA, 60 bp, Artificial Sequence
  Description of Artificial Sequence: Synthetic probe
gagagtggattgatcctcattttattggaggaaggtgcaaggggaatatttgtgaaaccg

SEQ ID NO: 11658 - DNA, 60 bp, Artificial Sequence
  Description of Artificial Sequence: Synthetic probe
acaaataataacagttaccccccactctgttaaagttgatgagtataccggagagtggat

SEQ ID NO: 11659 - DNA, 56 bp, Artificial Sequence
  Description of Artificial Sequence: Synthetic probe
tgcttggaggccatcaaagcatataaggacggaatcagtcttaatcctggatttcc

SEQ ID NO: 11660 - DNA, 60 bp, Artificial Sequence
  Description of Artificial Sequence: Synthetic probe
gatggtacggaccaaaatacataactcactccatccataatgaggaacctaatgactatc

SEQ ID NO: 11661 - DNA, 60 bp, Artificial Sequence
  Description of Artificial Sequence: Synthetic probe
tggaaaatagtgccacatggatacaattattgccctaccagcgcagataaaaattcccat

SEQ ID NO: 11662 - DNA, 60 bp, Artificial Sequence
  Description of Artificial Sequence: Synthetic probe
cctgggtaaaatcgaaattgtctttccccaacatactgcaggggactggaaaatagtgcc

SEQ ID NO: 11663 - DNA, 60 bp, Artificial Sequence
  Description of Artificial Sequence: Synthetic probe
aacagacatcaatatgttgtcctacctcatcctagcacttgccatctcacccatcctggg

SEQ ID NO: 11664 - DNA, 52 bp, Artificial Sequence
  Description of Artificial Sequence: Synthetic probe
tgaagcgggagaaccaattaccccagtagatctcagctaccttggaccaaaa

SEQ ID NO: 11665 - DNA, 60 bp, Artificial Sequence
  Description of Artificial Sequence: Synthetic probe
tgaagcgggagaaccaattaccccagtagatctcagctaccttggaccaaaaaacccagg

SEQ ID NO: 11666 - DNA, 52 bp, Artificial Sequence
  Description of Artificial Sequence: Synthetic probe
tgaagcgggagaaccaattaccccagtagatctcagctatcttggaccaaaa

SEQ ID NO: 11667 - DNA, 52 bp, Artificial Sequence
  Description of Artificial Sequence: Synthetic probe
cagaaaaccggggtacaagcttaaaaatgacctctggtttcagattacagac

SEQ ID NO: 11668 - DNA, 60 bp, Artificial Sequence
  Description of Artificial Sequence: Synthetic probe
cagacatcaatatgttgtcttatctaattcttgcacttgtcgtttcgcccattttgggca

SEQ ID NO: 11669 - DNA, 60 bp, Artificial Sequence
  Description of Artificial Sequence: Synthetic probe
aacagacatcaatatgttgtcttatctaattcttgcacttgtcgtttcgcccattttggg

SEQ ID NO: 11670 - DNA, 60 bp, Artificial Sequence
  Description of Artificial Sequence: Synthetic probe
aacagacatcaatatgttgtcttatctaattcttgcaattgttgtttcgcctattttagg

SEQ ID NO: 11671 - DNA, 60 bp, Artificial Sequence
  Description of Artificial Sequence: Synthetic probe
aacagacatcaatatgttgtcttatctaattcttgcaattattgtttcgcctatcttagg

SEQ ID NO: 11672 - DNA, 60 bp, Artificial Sequence
  Description of Artificial Sequence: Synthetic probe
ggattgactaaggttcagacagaacagtggaggaagaccattgaggcagtctgtgagagc

SEQ ID NO: 11673 - DNA, 60 bp, Artificial Sequence
  Description of Artificial Sequence: Synthetic probe
ggactattcttggttctccgagttggtatttatctctgcattaaattaaagcacaccagg

SEQ ID NO: 11674 - DNA, 60 bp, Artificial Sequence
  Description of Artificial Sequence: Synthetic probe
ggactattcttggttctccgagttggtatttatctttgcattaaattaaagcacaccaag

SEQ ID NO: 11675 - DNA, 60 bp, Artificial Sequence
  Description of Artificial Sequence: Synthetic probe
ccattcaatgagatcttgttcaatcagctatgtcgtacagtggataatcatttgaaatgg

SEQ ID NO: 11676 - DNA, 60 bp, Artificial Sequence
  Description of Artificial Sequence: Synthetic probe
taaatccattcaatgagatcttgttcaatcagctatgtcgtacagtggataatcatttga

SEQ ID NO: 11677 - DNA, 60 bp, Artificial Sequence
  Description of Artificial Sequence: Synthetic probe
cgtctaaatccattcaatgagatcttgttcaatcagctatgtcgtacagtggataatcat

SEQ ID NO: 11678 - DNA, 60 bp, Artificial Sequence
  Description of Artificial Sequence: Synthetic probe
tcgtctaaatccattcaatgagatcttgttcaatcagctatgtcgtacagtggataatca

SEQ ID NO: 11679 - DNA, 60 bp, Artificial Sequence
  Description of Artificial Sequence: Synthetic probe
aagttcgtctaaatccattcaatgagatcttgttcaatcagctatgtcgtacagtggata

SEQ ID NO: 11680 - DNA, 60 bp, Artificial Sequence
  Description of Artificial Sequence: Synthetic probe
ctccggatgtatataaggtcactccagtgatgaacacacatccgtcccaatcagaagccg

SEQ ID NO: 11681 - DNA, 60 bp, Artificial Sequence
  Description of Artificial Sequence: Synthetic probe
agagttcaaaatattggaatttatcagaatgccaaattctgaacttagaagactgcctca

SEQ ID NO: 11682 - DNA, 60 bp, Artificial Sequence
  Description of Artificial Sequence: Synthetic probe
cagataattgtcttatcctcaaaggccgagttatgactcctgactgcagttcatcaatca

SEQ ID NO: 11683 - DNA, 60 bp, Artificial Sequence
  Description of Artificial Sequence: Synthetic probe
ccgaagtacaactgatctcgaagagggccggagtgaaagacatgatggtgaaattgacag

SEQ ID NO: 11684 - DNA, 60 bp, Artificial Sequence
  Description of Artificial Sequence: Synthetic probe
aattgtcttgtcctcaaaggccgagttatgactcctgactgcagttcatcaatcaaatct

SEQ ID NO: 11685 - DNA, 60 bp, Artificial Sequence
  Description of Artificial Sequence: Synthetic probe
gggttaatcattggactattcttggttctccgagttggtatccatctttgcattaaatta

SEQ ID NO: 11686 - DNA, 60 bp, Artificial Sequence
  Description of Artificial Sequence: Synthetic probe
tggtttacatcttcagatggagaaagtgtctgtagtcaattattcactctagttggagga

SEQ ID NO: 11687 - DNA, 60 bp, Artificial Sequence
  Description of Artificial Sequence: Synthetic probe
tcgaagagggccggagtgaaggacatgatggtgaaattgacagacttttttggaagtgaa

SEQ ID NO: 11688 - DNA, 60 bp, Artificial Sequence
  Description of Artificial Sequence: Synthetic probe
gtctgtgagagctctaaatattggaatttgtcagaatgccagattatgacctcagatgat

SEQ ID NO: 11689 - DNA, 60 bp, Artificial Sequence
  Description of Artificial Sequence: Synthetic probe
ttccgaatctctctcctcctcgcattcacccggtccagcaccaaagtcacggaatcaact

SEQ ID NO: 11690 - DNA, 60 bp, Artificial Sequence
  Description of Artificial Sequence: Synthetic probe
cggagtcaactagtctatgggacttaagatcaacagaagtacaactgatctcgaagaggg

SEQ ID NO: 11691 - DNA, 60 bp, Artificial Sequence
  Description of Artificial Sequence: Synthetic probe
ccatagggttaatcattggactattcttggttctccgagttggtatttatctttgcatta

SEQ ID NO: 11692 - DNA, 60 bp, Artificial Sequence
  Description of Artificial Sequence: Synthetic probe
tttgaaagcgaagaagagtattattcagtatgcccggacggagcatctgatttgatgggg

SEQ ID NO: 11693 - DNA, 60 bp, Artificial Sequence
  Description of Artificial Sequence: Synthetic probe
gacttctttgaaagcgaagaagagtattattcagtatgcccggacggagcatctgatttg

SEQ ID NO: 11694 - DNA, 60 bp, Artificial Sequence
  Description of Artificial Sequence: Synthetic probe
aacagatatcaaaatggctcctacagttaagagaatcattaacgactcaattattcagcc

SEQ ID NO: 11695 - DNA, 60 bp, Artificial Sequence
  Description of Artificial Sequence: Synthetic probe
gtacaactgatctctaagagggccggagtgaaagacatgatggtgaaattgacagacttt

SEQ ID NO: 11696 - DNA, 60 bp, Artificial Sequence
  Description of Artificial Sequence: Synthetic probe
atgccattctgcagaaagccagggtacaaacttaagaatgacctctggtttcagatcaca

SEQ ID NO: 11697 - DNA, 60 bp, Artificial Sequence
  Description of Artificial Sequence: Synthetic probe
aatccagggttccctcctcagagctgtgggtatggtacggtcacggatgctgaagcccat

SEQ ID NO: 11698 - DNA, 60 bp, Artificial Sequence
  Description of Artificial Sequence: Synthetic probe
gttagttttaatccagggttccctcctcagagctgtgggtatggtacggtcacagatgct

SEQ ID NO: 11699 - DNA, 60 bp, Artificial Sequence
  Description of Artificial Sequence: Synthetic probe
gttagctttaatccagggttccctcctcagagctgtgggtatggtacggtcacggacgct

SEQ ID NO: 11700 - DNA, 60 bp, Artificial Sequence
  Description of Artificial Sequence: Synthetic probe
gatggtgttagttttaatccagggttccctcctcagagctgtgggtatggtacggtcacg

SEQ ID NO: 11701 - DNA, 60 bp, Artificial Sequence
  Description of Artificial Sequence: Synthetic probe
gcatataaagatggtgttagctttaatccagggttccctcctcagagctgtgggtatggt

SEQ ID NO: 11702 - DNA, 60 bp, Artificial Sequence
  Description of Artificial Sequence: Synthetic probe
gcatataaagatggtgttagttttaatccagggttccctcctcagagctgtgggtatggt

SEQ ID NO: 11703 - DNA, 60 bp, Artificial Sequence
  Description of Artificial Sequence: Synthetic probe
ctatacataatgaggagcctacagattaccaatgtttggaagcaatcaaagcatataaag

SEQ ID NO: 11704 - DNA, 60 bp, Artificial Sequence
  Description of Artificial Sequence: Synthetic probe
tcattgtctctgttccctccagttggactaacaaagattcaaacagaacaatggagaaaa

SEQ ID NO: 11705 - DNA, 60 bp, Artificial Sequence
  Description of Artificial Sequence: Synthetic probe
acctttacgcagcattgaagggagtagaagggaccttggacagagactgggtcagcttcg

SEQ ID NO: 11706 - DNA, 60 bp, Artificial Sequence
  Description of Artificial Sequence: Synthetic probe
acctttacgcagcattgaagggagtagaagggactttggacagagactgggtcagctttg

SEQ ID NO: 11707 - DNA, 60 bp, Artificial Sequence
  Description of Artificial Sequence: Synthetic probe
gtctggcaatccatctatactccacataaatgcttacctttacgcagcattaaagggagt

SEQ ID NO: 11708 - DNA, 60 bp, Artificial Sequence
  Description of Artificial Sequence: Synthetic probe
tctggcaatccatctatactccacataaatgcttacctttacgcagcattgaagggagta

SEQ ID NO: 11709 - DNA, 60 bp, Artificial Sequence
  Description of Artificial Sequence: Synthetic probe
caatccatctatactccacataaatgcttacctttacgcagcattaaagggagtagaagg

SEQ ID NO: 11710 - DNA, 60 bp, Artificial Sequence
  Description of Artificial Sequence: Synthetic probe
tactgactataatgctgagcatcttacgatgttgtcgccagatgaaagaatagacaagtg

SEQ ID NO: 11711 - DNA, 60 bp, Artificial Sequence
  Description of Artificial Sequence: Synthetic probe
caccccttacccaaagatgctagagatgcctccaagaatccaaaatcccctgctgtccgg

SEQ ID NO: 11712 - DNA, 60 bp, Artificial Sequence
  Description of Artificial Sequence: Synthetic probe
ttagaaacgattccccacaagatcccgacatcctatccgacaagcaaccgtgatatgggg

SEQ ID NO: 11713 - DNA, 61 bp, Artificial Sequence
  Description of Artificial Sequence: Synthetic probe
cttccactgattaaatgttttgaaataccagacttactagacccatcgataatatactctg

SEQ ID NO: 11714 - DNA, 50 bp, Artificial Sequence
  Description of Artificial Sequence: Synthetic probe
cacattccatccgatccttcactccatctgtagaacaatgcagggaaagc

SEQ ID NO: 11715 - DNA, 60 bp, Artificial Sequence
  Description of Artificial Sequence: Synthetic probe
aaattctgaacttagaagactgcctcaccctcaaaggccgagtgatgactcctgattgca

SEQ ID NO: 11716 - DNA, 60 bp, Artificial Sequence
  Description of Artificial Sequence: Synthetic probe
gggccaaaataccataattccacaaaatggtttacgtcctctgatggagaaagtgtctgc

SEQ ID NO: 11717 - DNA, 60 bp, Artificial Sequence
  Description of Artificial Sequence: Synthetic probe
gtgtcactcagccttgtggatgaccacttgtgacttcagatggtatgggccaaaatacca

SEQ ID NO: 11718 - DNA, 57 bp, Artificial Sequence
  Description of Artificial Sequence: Synthetic probe
tcttacgatgctgtcaccggatgaaagaatagacaagtgggaagaagatttgcctga

SEQ ID NO: 11719 - DNA, 60 bp, Artificial Sequence
  Description of Artificial Sequence: Synthetic probe
tggtttacgtcctctgatggagaaagtgtctgcagtcaattgtttactttggttggagga

SEQ ID NO: 11720 - DNA, 60 bp, Artificial Sequence
  Description of Artificial Sequence: Synthetic probe
gaatccactaatctatgggatttaaagtccacagaagtacaattgatctctaagagagcc

SEQ ID NO: 11721 - DNA, 60 bp, Artificial Sequence
  Description of Artificial Sequence: Synthetic probe
ggctcctacagttaagagaatcattaacgactccattattcagcctaagttaccggccaa

SEQ ID NO: 11722 - DNA, 51 bp, Artificial Sequence
  Description of Artificial Sequence: Synthetic probe
aattgtcttatcctcaaaggccgagttatgactcctgactgcagttcatct

SEQ ID NO: 11723 - DNA, 60 bp, Artificial Sequence
  Description of Artificial Sequence: Synthetic probe
atggataatctcacaaaagttcgtgagtatctcaagtcctattctcgtctggatcaggcg

SEQ ID NO: 11724 - DNA, 60 bp, Artificial Sequence
  Description of Artificial Sequence: Synthetic probe
aacagacatcaaaatggctcctacagttaagagaatcattaacgactcaattattcagcc

SEQ ID NO: 11725 - DNA, 60 bp, Artificial Sequence
  Description of Artificial Sequence: Synthetic probe
ggattgactaaggttcagacagaacagtggaagaagaccatcgaggcagtctgtgagagc

SEQ ID NO: 11726 - DNA, 60 bp, Artificial Sequence
  Description of Artificial Sequence: Synthetic probe
gcagaaatcccagtggctttcgacgattaaagcagtcgtgcaaagtgccaaatactggaa

SEQ ID NO: 11727 - DNA, 60 bp, Artificial Sequence
  Description of Artificial Sequence: Synthetic probe
gagcagaaatcccagtggctttcgacgattaaagcagttgttcaaagtgccaaatactgg

SEQ ID NO: 11728 - DNA, 60 bp, Artificial Sequence
  Description of Artificial Sequence: Synthetic probe
cttcggactggaaaccacctgagcttgaatctgacgagcatggaaagaccttacggttga

SEQ ID NO: 11729 - DNA, 60 bp, Artificial Sequence
  Description of Artificial Sequence: Synthetic probe
agtcaactctctgcagtcacttcgtgagaagacaatcggcaaatatgccaaggcagagtt

SEQ ID NO: 11730 - DNA, 55 bp, Artificial Sequence
  Description of Artificial Sequence: Synthetic probe
cttcaatcaggcaagaatgaaatatcgtctttaattccttttcatgatcaatatg

SEQ ID NO: 11731 - DNA, 60 bp, Artificial Sequence
  Description of Artificial Sequence: Synthetic probe
gccagacttgatgggagctatcatcatgggactgaagtacaagaaactcttcaatcaggc

SEQ ID NO: 11732 - DNA, 60 bp, Artificial Sequence
  Description of Artificial Sequence: Synthetic probe
gcgccagacttgatgggagctatcatcatgggactgaagtacaagaaactcttcaatcag

SEQ ID NO: 11733 - DNA, 60 bp, Artificial Sequence
  Description of Artificial Sequence: Synthetic probe
ccatcaatttatgggatttaaagtccactgaagtacaattgatctccaagagagccggag

SEQ ID NO: 11734 - DNA, 60 bp, Artificial Sequence
  Description of Artificial Sequence: Synthetic probe
acctctctactcctctcattctccaggtcccccactcaaggtatcagagtccatcaattt

SEQ ID NO: 11735 - DNA, 60 bp, Artificial Sequence
  Description of Artificial Sequence: Synthetic probe
tcagtaaaatctcaaaattctgtccggaggtcagaacctctctactcctctcattctcca

SEQ ID NO: 11736 - DNA, 60 bp, Artificial Sequence
  Description of Artificial Sequence: Synthetic probe
cctgattgtagttcttcagtaaaatctcaaaattctgtccggaggtcagaacctctctac

SEQ ID NO: 11737 - DNA, 60 bp, Artificial Sequence
  Description of Artificial Sequence: Synthetic probe
cttggaagacagcctcactatcaaaggccgattgatgactcctgattgtagttcttcagt

SEQ ID NO: 11738 - DNA, 60 bp, Artificial Sequence
  Description of Artificial Sequence: Synthetic probe
aaattcttaacttggaagacagcctcactatcaaaggccgattgatgactcctgattgta

SEQ ID NO: 11739 - DNA, 50 bp, Artificial Sequence
  Description of Artificial Sequence: Synthetic probe
aacagatatcatggacagtgttgataggctcaagacttacttagccactt

SEQ ID NO: 11740 - DNA, 60 bp, Artificial Sequence
  Description of Artificial Sequence: Synthetic probe
ggaagtgaagaggaatattattcagtatgcccaaaaggggcaccagacttgatgggagca

SEQ ID NO: 11741 - DNA, 60 bp, Artificial Sequence
  Description of Artificial Sequence: Synthetic probe
tggaagtgaagaggaatattattcagtatgcccagaaggggccccagatttgatgggagc

SEQ ID NO: 11742 - DNA, 60 bp, Artificial Sequence
  Description of Artificial Sequence: Synthetic probe
acttttttggaagtgaagaggaatattattcagtatgcccaaaaggggcaccagacttga

SEQ ID NO: 11743 - DNA, 60 bp, Artificial Sequence
  Description of Artificial Sequence: Synthetic probe
catgggtccttaatagagaagttgcagacgagctatgccagatgatgtatccggggcaag

SEQ ID NO: 11744 - DNA, 60 bp, Artificial Sequence
  Description of Artificial Sequence: Synthetic probe
aacatgggtccttaatagagaagttgcagacgagctatgccagatgatgtatccggggca

SEQ ID NO: 11745 - DNA, 60 bp, Artificial Sequence
  Description of Artificial Sequence: Synthetic probe
cctcctcagagttgtggatatgcaactgtgacggatgctgaagcagtgattgtccaggtg

SEQ ID NO: 11746 - DNA, 54 bp, Artificial Sequence
  Description of Artificial Sequence: Synthetic probe
cttaaaatcaacagacgtacaactgatctcgaagagggccggagtgaaagacat

SEQ ID NO: 11747 - DNA, 60 bp, Artificial Sequence
  Description of Artificial Sequence: Synthetic probe
caggaaattgtcttattttgaggggacaagttatgacctctgattgcagcccatcagcta

SEQ ID NO: 11748 - DNA, 60 bp, Artificial Sequence
  Description of Artificial Sequence: Synthetic probe
tgtaacttcaggaaattgtcttattttgaggggacaagttatgacctctgattgcagccc

SEQ ID NO: 11749 - DNA, 60 bp, Artificial Sequence
  Description of Artificial Sequence: Synthetic probe
ggattgactcaggttcagacagaacagtggaagaagaccattgagacagtctgtgagagc

SEQ ID NO: 11750 - DNA, 60 bp, Artificial Sequence
  Description of Artificial Sequence: Synthetic probe
ctccagtcggattgactcaggttcagacagaacagtggaagaagaccattgagacagtct

SEQ ID NO: 11751 - DNA, 60 bp, Artificial Sequence
  Description of Artificial Sequence: Synthetic probe
ttcaaacagaacaatggagaaaaaccattgaggcggtttgtgagagttcaaaatattgga

SEQ ID NO: 11752 - DNA, 60 bp, Artificial Sequence
  Description of Artificial Sequence: Synthetic probe
ccaagggatcaaatctggcaatccgtctatactccacataaatgcttacctttacgcagc

SEQ ID NO: 11753 - DNA, 60 bp, Artificial Sequence
  Description of Artificial Sequence: Synthetic probe
ctcagataattgtcttatcctcaaaggtagagttatgactcctgactgcagttcatcaat

SEQ ID NO: 11754 - DNA, 60 bp, Artificial Sequence
  Description of Artificial Sequence: Synthetic probe
gtacaactgatctcgaagagggccggagtgaaagacataatggtgaaattgacagacttt

SEQ ID NO: 11755 - DNA, 60 bp, Artificial Sequence
  Description of Artificial Sequence: Synthetic probe
cctcatttccatggacatcaccttcttctcagaggacggagagctatcatccctaggaaa

SEQ ID NO: 11756 - DNA, 60 bp, Artificial Sequence
  Description of Artificial Sequence: Synthetic probe
cctcatttccatggacatcaccttcttctcagaggacggagagctatcatccctgggaaa

SEQ ID NO: 11757 - DNA, 60 bp, Artificial Sequence
  Description of Artificial Sequence: Synthetic probe
ggctatgtgattctaacctcatttccatggacatcaccttcttctcagaggacggagagc

SEQ ID NO: 11758 - DNA, 60 bp, Artificial Sequence
  Description of Artificial Sequence: Synthetic probe
ttacaattatttggcatagagggtactttaacagatatcaaaatggctcctacagttaag

SEQ ID NO: 11759 - DNA, 60 bp, Artificial Sequence
  Description of Artificial Sequence: Synthetic probe
gcttatctttacgctgcattaaagggagtggaaggaactttggacagagactgggttagc

SEQ ID NO: 11760 - DNA, 60 bp, Artificial Sequence
  Description of Artificial Sequence: Synthetic probe
cggagtcgactagtctatgggacttaagatcaacagaagtacaactaatctcgaagaggg

SEQ ID NO: 11761 - DNA, 60 bp, Artificial Sequence
  Description of Artificial Sequence: Synthetic probe
gtggcactgaatgatttaagggcttatgtctaccaggggatcaagtctggcaatccatct

SEQ ID NO: 11762 - DNA, 60 bp, Artificial Sequence
  Description of Artificial Sequence: Synthetic probe
ctaaagtggcactgaatgatttaagggcttatgtctaccaggggatcaagtctggcaatc

SEQ ID NO: 11763 - DNA, 60 bp, Artificial Sequence
  Description of Artificial Sequence: Synthetic probe
actctctgcagtcacttcgtgaaaagacaattggcaaatatgccaaggcagagtttgaca

SEQ ID NO: 11764 - DNA, 60 bp, Artificial Sequence
  Description of Artificial Sequence: Synthetic probe
ccatcaatctatgggatttaaagtccacagaagtacaattgatctctaagagagccggag

SEQ ID NO: 11765 - DNA, 60 bp, Artificial Sequence
  Description of Artificial Sequence: Synthetic probe
agggtttaagtggagagcagaaatcccagtggctttcgacgattaaagcagttgttcaaa

SEQ ID NO: 11766 - DNA, 60 bp, Artificial Sequence
  Description of Artificial Sequence: Synthetic probe
tgagcttgaatctgacgagcatggaaagaccttacggttgacattgccagagggtttaag

SEQ ID NO: 11767 - DNA, 60 bp, Artificial Sequence
  Description of Artificial Sequence: Synthetic probe
tttggaagtgaggaagagtattattcagtatgcccagaaggagcatcagatttgatggga

SEQ ID NO: 11768 - DNA, 60 bp, Artificial Sequence
  Description of Artificial Sequence: Synthetic probe
ggattacagaaagaaactactggacgggcttgaaaatcagtgcagagtggcgtcaaccag

SEQ ID NO: 11769 - DNA, 60 bp, Artificial Sequence
  Description of Artificial Sequence: Synthetic probe
ctacaccggacatgctgaacttcgcaagacgagcagtcagctccctacaggcacttcgtg

SEQ ID NO: 11770 - DNA, 60 bp, Artificial Sequence
  Description of Artificial Sequence: Synthetic probe
tccataattcagcctaaactaccggccaacgaggatccggttgaatacccggccgattac

SEQ ID NO: 11771 - DNA, 60 bp, Artificial Sequence
  Description of Artificial Sequence: Synthetic probe
tacgcagcattgaagggagtagaagggaccttggacagagactgggtcagcttcggacgc

SEQ ID NO: 11772 - DNA, 60 bp, Artificial Sequence
  Description of Artificial Sequence: Synthetic probe
gcttggttggtacgatgacaacggaggaaaacccacacctgatatgctcaacttcgcacg

SEQ ID NO: 11773 - DNA, 60 bp, Artificial Sequence
  Description of Artificial Sequence: Synthetic probe
gcagcattgaagggagtagaagggactttggacagagactgggtcagctttggacgcacg

SEQ ID NO: 11774 - DNA, 60 bp, Artificial Sequence
  Description of Artificial Sequence: Synthetic probe
gaagaaatcagatgtcccaccaaaaggaagaaatgtcgtggactggcttggctggtatga

SEQ ID NO: 11775 - DNA, 60 bp, Artificial Sequence
  Description of Artificial Sequence: Synthetic probe
gcagcattgaaaggagtagaagggaccttggatcgagactgggtcagcttcggacgcacc

SEQ ID NO: 11776 - DNA, 60 bp, Artificial Sequence
  Description of Artificial Sequence: Synthetic probe
ccagggtatcaagtccggtaatccatccatcctccacataaatgcttatctctacgctgc

SEQ ID NO: 11777 - DNA, 60 bp, Artificial Sequence
  Description of Artificial Sequence: Synthetic probe
gtctgtgagagctcaaaatattggaatttgtcagaatgccaaattatgaactcagataat

SEQ ID NO: 11778 - DNA, 60 bp, Artificial Sequence
  Description of Artificial Sequence: Synthetic probe
ggaatcaactaggtctatgggattcaaaatcaacagaagtacaactgatctcgaagaggg

SEQ ID NO: 11779 - DNA, 60 bp, Artificial Sequence
  Description of Artificial Sequence: Synthetic probe
acataatgaggaacctacggattatcagtgcttggaggccatcaaagcatataaggatgg

SEQ ID NO: 11780 - DNA, 60 bp, Artificial Sequence
  Description of Artificial Sequence: Synthetic probe
aagtgaggaagagtattattcagtatgcccagaaggggcaccagacttgatgggagccat

SEQ ID NO: 11781 - DNA, 60 bp, Artificial Sequence
  Description of Artificial Sequence: Synthetic probe
aagtgaggaagagtattattcagtatgcccagaaggggcaccagacttgatgggagctat

SEQ ID NO: 11782 - DNA, 60 bp, Artificial Sequence
  Description of Artificial Sequence: Synthetic probe
gaatcagaatcagatgtcatcttgagccccagttcaattgaaatgatgcacaatatgaaa

SEQ ID NO: 11783 - DNA, 51 bp, Artificial Sequence
  Description of Artificial Sequence: Synthetic probe
gaatcagaatcagatgtcatcttgagccccagttcaattgaaatgatgcac

SEQ ID NO: 11784 - DNA, 60 bp, Artificial Sequence
  Description of Artificial Sequence: Synthetic probe
taagtttcctttatatatgattggacatggtatgttggactccgatcttcatcttagctc

SEQ ID NO: 11785 - DNA, 60 bp, Artificial Sequence
  Description of Artificial Sequence: Synthetic probe
tattcagtatgcccagaaggggcaccagacttgatgggagcaatcatcatgggactaaaa

SEQ ID NO: 11786 - DNA, 60 bp, Artificial Sequence
  Description of Artificial Sequence: Synthetic probe
atattattcagtatgcccagaaggggcaccagacttgatgggagcaatcatcatgggact

SEQ ID NO: 11787 - DNA, 60 bp, Artificial Sequence
  Description of Artificial Sequence: Synthetic probe
ctcagataattgtcttatcctcaaaggccgagttatgactcctgactgcagttcatcaat

SEQ ID NO: 11788 - DNA, 60 bp, Artificial Sequence
  Description of Artificial Sequence: Synthetic probe
ggcacagccatacaagtcaaaatgcccaagagtcacaaggctattcaagcagacggttgg

SEQ ID NO: 11789 - DNA, 60 bp, Artificial Sequence
  Description of Artificial Sequence: Synthetic probe
ggcacagccttacaggtcaaaatgcccaagagtcacaaggctattcaagcagacggttgg

SEQ ID NO: 11790 - DNA, 58 bp, Artificial Sequence
  Description of Artificial Sequence: Synthetic probe
actccataattcagcctaaactaccggccaatgaggatccggtagagtatccagctga

SEQ ID NO: 11791 - DNA, 60 bp, Artificial Sequence
  Description of Artificial Sequence: Synthetic probe
actccataattcagcctaaactaccggccaatgaggatccggtagagtatccggctgatt

SEQ ID NO: 11792 - DNA, 60 bp, Artificial Sequence
  Description of Artificial Sequence: Synthetic probe
ggaagtggatgttgtattcacttcggactggaaacagcctgagcttgaatctaatgagca

SEQ ID NO: 11793 - DNA, 60 bp, Artificial Sequence
  Description of Artificial Sequence: Synthetic probe
gaggaagtggatgttgtattcacttcggactggaaacagcctgagcttgaatctaatgag

SEQ ID NO: 11794 - DNA, 60 bp, Artificial Sequence
  Description of Artificial Sequence: Synthetic probe
aacagatatcaaaatggcccctacagttaagagaatcattaacgactcaattattcagcc

SEQ ID NO: 11795 - DNA, 60 bp, Artificial Sequence
  Description of Artificial Sequence: Synthetic probe
tgaggaagagtattattcagtatgcccagaaggagcatcagatttgatgggagcaatcat

SEQ ID NO: 11796 - DNA, 60 bp, Artificial Sequence
  Description of Artificial Sequence: Synthetic probe
gaattggagaagatcgatgatgatatactggtcacattccctagttggactcaacctgta

SEQ ID NO: 11797 - DNA, 60 bp, Artificial Sequence
  Description of Artificial Sequence: Synthetic probe
acatccgtcccaatcagaagcagtatcagatgtttggtctctctcaaagacatccatgac

SEQ ID NO: 11798 - DNA, 60 bp, Artificial Sequence
  Description of Artificial Sequence: Synthetic probe
gaatggatcaatagacgaatttcaaaagaagaccggtctatactgatattgaaaagcgac

SEQ ID NO: 11799 - DNA, 60 bp, Artificial Sequence
  Description of Artificial Sequence: Synthetic probe
aacacaggaatgattgaatggatcaatagacgaatttcaaaagaagaccggtctatactg

SEQ ID NO: 11800 - DNA, 60 bp, Artificial Sequence
  Description of Artificial Sequence: Synthetic probe
agaagaggtaatctattacggggacactggagtatccaaaaatccagttgagttagtgga

SEQ ID NO: 11801 - DNA, 51 bp, Artificial Sequence
  Description of Artificial Sequence: Synthetic probe
tgaaaaccaagcaaggatataaattcccattgcacatcattggtactgggg

SEQ ID NO: 11802 - DNA, 60 bp, Artificial Sequence
  Description of Artificial Sequence: Synthetic probe
agaaccaatcactcctgtggatatcagctatctaggacctaaaaaccctggcgttgggcc

SEQ ID NO: 11803 - DNA, 60 bp, Artificial Sequence
  Description of Artificial Sequence: Synthetic probe
attcacattggttggaggaacttttttctctgattcagaggagattacctcaatgggatt

SEQ ID NO: 11804 - DNA, 60 bp, Artificial Sequence
  Description of Artificial Sequence: Synthetic probe
agttgtggatacggttcagtgacggatgcagaggcacatataataacagttactccccac

SEQ ID NO: 11805 - DNA, 60 bp, Artificial Sequence
  Description of Artificial Sequence: Synthetic probe
tcaaagcatataaggatggagttagtttcaatcctgggttccctcctcaaagctgtggat

SEQ ID NO: 11806 - DNA, 60 bp, Artificial Sequence
  Description of Artificial Sequence: Synthetic probe
tcattccatccataatgaagaaccgacagactatcagtgcttggaggccatcaaagcata

SEQ ID NO: 11807 - DNA, 60 bp, Artificial Sequence
  Description of Artificial Sequence: Synthetic probe
aggagagaaatccttgtctctgttccctccagttggactaacaaagattcaaacagaaca

SEQ ID NO: 11808 - DNA, 60 bp, Artificial Sequence
  Description of Artificial Sequence: Synthetic probe
aagaccattgaggcagtttgtgagagttcaaaatattggaatttatcagagtgccaactt

SEQ ID NO: 11809 - DNA, 56 bp, Artificial Sequence
  Description of Artificial Sequence: Synthetic probe
aacatgcatctagagcatcagcttcaccgaatctatgggactttaagtttacagag

SEQ ID NO: 11810 - DNA, 60 bp, Artificial Sequence
  Description of Artificial Sequence: Synthetic probe
tagacaagtgggaagaagacttgcctgaattggagaagatcgatgacgatatactggtca

SEQ ID NO: 11811 - DNA, 50 bp, Artificial Sequence
  Description of Artificial Sequence: Synthetic probe
aacagatatcatggacagtgtcgatcggctcaagacgtatttggctactt

SEQ ID NO: 11812 - DNA, 60 bp, Artificial Sequence
  Description of Artificial Sequence: Synthetic probe
ggcagtctgtgagagctcaaaatattggaatttatcagagtgccggattgtaacttcaga

SEQ ID NO: 11813 - DNA, 60 bp, Artificial Sequence
  Description of Artificial Sequence: Synthetic probe
tgaggcagtctgtgagagctcaaaatattggaatttatcagagtgccggattgtaacttc

SEQ ID NO: 11814 - DNA, 50 bp, Artificial Sequence
  Description of Artificial Sequence: Synthetic probe
aatcagatgtaccacccaaagggaggaatgttgtagactggctcggctgg

SEQ ID NO: 11815 - DNA, 60 bp, Artificial Sequence
  Description of Artificial Sequence: Synthetic probe
cctagagggaacttttaacagatatcaaaatggctcctacagttaagagaatcattaacg

SEQ ID NO: 11816 - DNA, 60 bp, Artificial Sequence
  Description of Artificial Sequence: Synthetic probe
gcatagagggtactttaacagatatcaaaatggctcctacagttaagagaatcattaacg

SEQ ID NO: 11817 - DNA, 52 bp, Artificial Sequence
  Description of Artificial Sequence: Synthetic probe
gtctgtgagagctctaaatattggaatttgtcagaatgtcagattatgaact

SEQ ID NO: 11818 - DNA, 60 bp, Artificial Sequence
  Description of Artificial Sequence: Synthetic probe
ccctaccagcgcagacaagaactcacatgggactgaaacaggaatccctgttgagttaac

SEQ ID NO: 11819 - DNA, 60 bp, Artificial Sequence
  Description of Artificial Sequence: Synthetic probe
tgccctaccagcgcagacaagaactcacatgggactcaaacaggaatccctgttgagtta

SEQ ID NO: 11820 - DNA, 56 bp, Artificial Sequence
  Description of Artificial Sequence: Synthetic probe
tgccctaccagcgcagacaagaactcacatgggactcaaacaggaatccctgttga

SEQ ID NO: 11821 - DNA, 60 bp, Artificial Sequence
  Description of Artificial Sequence: Synthetic probe
gagttccccatgaatataactattgccctaccagcgcagacaagaactcacatgggactc

SEQ ID NO: 11822 - DNA, 60 bp, Artificial Sequence
  Description of Artificial Sequence: Synthetic probe
gagttccccatgaatataattattgccctaccagcgcagacaagaactcacatgggactc

SEQ ID NO: 11823 - DNA, 60 bp, Artificial Sequence
  Description of Artificial Sequence: Synthetic probe
ctatgggacttaagatcaacagaagtacaactgatctcgaagagggccggagtgaaagac

SEQ ID NO: 11824 - DNA, 60 bp, Artificial Sequence
  Description of Artificial Sequence: Synthetic probe
gacttggtctcaaccttcctaaaagggtgggtggggaaagaatacccttttaagccaaag

SEQ ID NO: 11825 - DNA, 60 bp, Artificial Sequence
  Description of Artificial Sequence: Synthetic probe
tactgactataatgctgaacatcttacgatgttgtcgccagatgagagagtagacaagtg

SEQ ID NO: 11826 - DNA, 60 bp, Artificial Sequence
  Description of Artificial Sequence: Synthetic probe
gtggatgttgtatttacctcggactggaaacagcctgagcttgaatctgacgagcatgga

SEQ ID NO: 11827 - DNA, 51 bp, Artificial Sequence
  Description of Artificial Sequence: Synthetic probe
ccattgaagcggtttgtgagagttcaaaatattggaatttgtcagaatgcc

SEQ ID NO: 11828 - DNA, 60 bp, Artificial Sequence
  Description of Artificial Sequence: Synthetic probe
ggaatctatcagaatgccaaattctgaacttagaagactgcctaaccctcaaaggccgag

SEQ ID NO: 11829 - DNA, 60 bp, Artificial Sequence
  Description of Artificial Sequence: Synthetic probe
ggaatttatcagaatgccaaattctgaacttagaagactgcctcaccctcaaaggcagag

SEQ ID NO: 11830 - DNA, 60 bp, Artificial Sequence
  Description of Artificial Sequence: Synthetic probe
aaatattggaatctatcagaatgccaaattctgaacttagaagactgcctaaccctcaaa

SEQ ID NO: 11831 - DNA, 60 bp, Artificial Sequence
  Description of Artificial Sequence: Synthetic probe
aaatattggaatttatcagaatgccaaattctgaacttagaagactgcctcaccctcaaa

SEQ ID NO: 11832 - DNA, 56 bp, Artificial Sequence
  Description of Artificial Sequence: Synthetic probe
gccttgcaggatgcaaatgaatctgaagagagaagagaggataaatatctccaaga

SEQ ID NO: 11833 - DNA, 60 bp, Artificial Sequence
  Description of Artificial Sequence: Synthetic probe
tgagcatcttacgatgttgtcgcccgaggaaagaatagacaagtgggaagaagacttgcc

SEQ ID NO: 11834 - DNA, 60 bp, Artificial Sequence
  Description of Artificial Sequence: Synthetic probe
ggatcaggcggtaggagagatagatgagatcgaagcacaacgagctgaaaagtccaatta

SEQ ID NO: 11835 - DNA, 51 bp, Artificial Sequence
  Description of Artificial Sequence: Synthetic probe
tttgaagtccacagaagtacaattgatctctaagagagctggagttaagga

SEQ ID NO: 11836 - DNA, 58 bp, Artificial Sequence
  Description of Artificial Sequence: Synthetic probe
tatgggatttgaagtccacagaagtacaattgatctctaagagagctggggttaagga

SEQ ID NO: 11837 - DNA, 60 bp, Artificial Sequence
  Description of Artificial Sequence: Synthetic probe
ggcccctacagttaagagaatcattaacgactcaattattcagcccaaattaccggccaa

SEQ ID NO: 11838 - DNA, 60 bp, Artificial Sequence
  Description of Artificial Sequence: Synthetic probe
acgataatcaacggtactctgaaatactttgagaccagatacatcagagtcgatattgct

SEQ ID NO: 11839 - DNA, 60 bp, Artificial Sequence
  Description of Artificial Sequence: Synthetic probe
ttgtatgtgagcaccaaagtggcactaaatgatttgagagcatacgtataccaggggatc

SEQ ID NO: 11840 - DNA, 60 bp, Artificial Sequence
  Description of Artificial Sequence: Synthetic probe
aggaaattcaattctcttccaattccctcgatgtgggatagtaagaactgggatggagtt

SEQ ID NO: 11841 - DNA, 60 bp, Artificial Sequence
  Description of Artificial Sequence: Synthetic probe
ctgcagtcacttcgtgagaagacaattggcaaatatgccaaggccgagtttgacaagtga

SEQ ID NO: 11842 - DNA, 60 bp, Artificial Sequence
  Description of Artificial Sequence: Synthetic probe
tctgcagtcacttcgtgagaagacaattggcaaatatgccaaggccgagtttgacaagtg

SEQ ID NO: 11843 - DNA, 54 bp, Artificial Sequence
  Description of Artificial Sequence: Synthetic probe
tacagagttcagaatctctctactcctcccattcaccaggacctgcacctagag

SEQ ID NO: 11844 - DNA, 60 bp, Artificial Sequence
  Description of Artificial Sequence: Synthetic probe
taaatctcagaattctgtacagagttcagaatctctctactcctcccattcaccaggacc

SEQ ID NO: 11845 - DNA, 56 bp, Artificial Sequence
  Description of Artificial Sequence: Synthetic probe
gccttgcaggatgcaaatgaatctgaggagagaagagaggataaatatctccagga

SEQ ID NO: 11846 - DNA, 60 bp, Artificial Sequence
  Description of Artificial Sequence: Synthetic probe
gtgggtcactacttgtgatttccgctggtatggaccgaaatatataacacattccatcag

SEQ ID NO: 11847 - DNA, 60 bp, Artificial Sequence
  Description of Artificial Sequence: Synthetic probe
aagcacaccaagaaaagacagatttatacagacatagagatgaaccgacttgggaagtaa

SEQ ID NO: 11848 - DNA, 60 bp, Artificial Sequence
  Description of Artificial Sequence: Synthetic probe
aaagcacaccaagaaaagacagatttatacagacatagagatgaaccgacttggaaagta

SEQ ID NO: 11849 - DNA, 60 bp, Artificial Sequence
  Description of Artificial Sequence: Synthetic probe
taaagcacaccaagaaaagacagatttatacagacatagagatgaaccgacttgggaagt

SEQ ID NO: 11850 - DNA, 60 bp, Artificial Sequence
  Description of Artificial Sequence: Synthetic probe
taaagcacaccaagaaaagacagatttatacagacatagagatgaaccgacttggaaagt

SEQ ID NO: 11851 - DNA, 60 bp, Artificial Sequence
  Description of Artificial Sequence: Synthetic probe
taaagcacaccaataaaagacagatttatacagacatagagatgaaccgacttggaaagt

SEQ ID NO: 11852 - DNA, 60 bp, Artificial Sequence
  Description of Artificial Sequence: Synthetic probe
ttaaagcacaccaagaaaagacagatttatacagacatagagatgaaccgacttggaaag

SEQ ID NO: 11853 - DNA, 60 bp, Artificial Sequence
  Description of Artificial Sequence: Synthetic probe
taaattaaagcacaccaataaaagacagatttatacagacatagagatgaaccgacttgg

SEQ ID NO: 11854 - DNA, 60 bp, Artificial Sequence
  Description of Artificial Sequence: Synthetic probe
ttaaattaaaacacactaagaaaagacagatttatacagacatagagatgaaccgacttg

SEQ ID NO: 11855 - DNA, 60 bp, Artificial Sequence
  Description of Artificial Sequence: Synthetic probe
cattaaattaaagcacaccaagaaaagacagatttatacagacatagagatgaaccgact

SEQ ID NO: 11856 - DNA, 58 bp, Artificial Sequence
  Description of Artificial Sequence: Synthetic probe
aaagagagcaggtgtcaaagacatgacggtcaaattaacagatttcttcggaagcgag

SEQ ID NO: 11857 - DNA, 51 bp, Artificial Sequence
  Description of Artificial Sequence: Synthetic probe
aagtcaacagaagtgcaattgacttcaaagagagcaggtgtcaaagacatg

SEQ ID NO: 11858 - DNA, 60 bp, Artificial Sequence
  Description of Artificial Sequence: Synthetic probe
cctcccattcaccaggccccgcacctagggtatcagagtctatgaatctatgggatctga

SEQ ID NO: 11859 - DNA, 60 bp, Artificial Sequence
  Description of Artificial Sequence: Synthetic probe
ccgaatctctctattcctcccattcaccaggccccgcacctagggtatcagagtctatga

SEQ ID NO: 11860 - DNA, 60 bp, Artificial Sequence
  Description of Artificial Sequence: Synthetic probe
gtgccaacttgttacttcagagaactgtatcatactcaagggacgagttatgacccctga

SEQ ID NO: 11861 - DNA, 60 bp, Artificial Sequence
  Description of Artificial Sequence: Synthetic probe
ttggaatttatcagagtgccaacttgttacttcagagaactgtatcatactcaagggacg

SEQ ID NO: 11862 - DNA, 60 bp, Artificial Sequence
  Description of Artificial Sequence: Synthetic probe
gcagaacaatggaaaaagaccattgaggcagtttgtgagagttcaaaatattggaattta

SEQ ID NO: 11863 - DNA, 60 bp, Artificial Sequence
  Description of Artificial Sequence: Synthetic probe
gagaaatcattatctttgttccctccagttggcctgaccaaagttcaagcagaacaatgg

SEQ ID NO: 11864 - DNA, 60 bp, Artificial Sequence
  Description of Artificial Sequence: Synthetic probe
gtgagaaatcattatctttgttccctccagttggcctgaccaaagttcaagcagaacaat

SEQ ID NO: 11865 - DNA, 60 bp, Artificial Sequence
  Description of Artificial Sequence: Synthetic probe
ccggttactttccctaattggactcaacctgtaatgaaggagaacggtggtgagaaatca

SEQ ID NO: 11866 - DNA, 60 bp, Artificial Sequence
  Description of Artificial Sequence: Synthetic probe
accggttactttccctaattggactcaacctgtaatgaaggagaacggtggtgagaaatc

SEQ ID NO: 11867 - DNA, 60 bp, Artificial Sequence
  Description of Artificial Sequence: Synthetic probe
ctcagataattgtcttatcctcaaagtccgagttatgactcctgactgcagttcatcaat

SEQ ID NO: 11868 - DNA, 60 bp, Artificial Sequence
  Description of Artificial Sequence: Synthetic probe
tagacgaatttcaaaagaagaccggtctatactgatgttgaagagtgacctacacgagga

SEQ ID NO: 11869 - DNA, 60 bp, Artificial Sequence
  Description of Artificial Sequence: Synthetic probe
gaatggatcaatagacgaatttcaaaagaagaccggtctatactgatgttgaagagtgac

SEQ ID NO: 11870 - DNA, 60 bp, Artificial Sequence
  Description of Artificial Sequence: Synthetic probe
gattgaatggatcaatagacgaatttcaaaagaagaccggtctatactgatgttgaagag

SEQ ID NO: 11871 - DNA, 60 bp, Artificial Sequence
  Description of Artificial Sequence: Synthetic probe
ggtctcaaccttcctaaaagggtgggtggggaaagaatacccttttaagccaaagggcag

SEQ ID NO: 11872 - DNA, 60 bp, Artificial Sequence
  Description of Artificial Sequence: Synthetic probe
tgagcatcttacgatgttgtcgccagatgaaagaatagacaagtgggaagaggacttgcc

SEQ ID NO: 11873 - DNA, 60 bp, Artificial Sequence
  Description of Artificial Sequence: Synthetic probe
gccaaagggcagagagattgatagtatagcattagtcggtcctctgtgtcagaaatttct

SEQ ID NO: 11874 - DNA, 60 bp, Artificial Sequence
  Description of Artificial Sequence: Synthetic probe
taagccaaagggcagagagattgatagtatagcattagtcggtcctctgtgtcagaaatt

SEQ ID NO: 11875 - DNA, 50 bp, Artificial Sequence
  Description of Artificial Sequence: Synthetic probe
aacagagatcatggacagtattgatcggctcaaaacttacttggctactt

SEQ ID NO: 11876 - DNA, 50 bp, Artificial Sequence
  Description of Artificial Sequence: Synthetic probe
aacagagatcatggacagtattgatcggctcaaaacttatttggctactt

SEQ ID NO: 11877 - DNA, 60 bp, Artificial Sequence
  Description of Artificial Sequence: Synthetic probe
tgaacatcttacgatgctgtcgccggatgaaagaatagacaagtgggaagaagacttgcc

SEQ ID NO: 11878 - DNA, 60 bp, Artificial Sequence
  Description of Artificial Sequence: Synthetic probe
agatgaatattattcagtatgcccagaaggggcaccagacttgatgggagcaatcatcat

SEQ ID NO: 11879 - DNA, 60 bp, Artificial Sequence
  Description of Artificial Sequence: Synthetic probe
tactgactataatgctgagcatcttacgatgttgtcgcccgaggaaagaatagacaagtg

SEQ ID NO: 11880 - DNA, 60 bp, Artificial Sequence
  Description of Artificial Sequence: Synthetic probe
gagaaatcattgtctctgttccctccagttggactaacaaagattcaaacagaacaatgg

SEQ ID NO: 11881 - DNA, 60 bp, Artificial Sequence
  Description of Artificial Sequence: Synthetic probe
ccggtgacctttcctaattggacacagcctgtaatgaaggaagatggaggagagaaatca

SEQ ID NO: 11882 - DNA, 60 bp, Artificial Sequence
  Description of Artificial Sequence: Synthetic probe
gatataccggtgacctttcctaattggacacagcctgtaatgaaggaagatggaggagag

SEQ ID NO: 11883 - DNA, 60 bp, Artificial Sequence
  Description of Artificial Sequence: Synthetic probe
ggaatagaagcataactccaacaggaatcaaaatggatttcgatctaatagaagattctg

SEQ ID NO: 11884 - DNA, 60 bp, Artificial Sequence
  Description of Artificial Sequence: Synthetic probe
tatatgaaaaaaactggaatagaagcataactccaacaggaatcaaaatggatttcgatc

SEQ ID NO: 11885 - DNA, 59 bp, Artificial Sequence
  Description of Artificial Sequence: Synthetic probe
gagtgccggattgtgacttcagatgattgtctcattctgaggggacgagttatgactcc

SEQ ID NO: 11886 - DNA, 60 bp, Artificial Sequence
  Description of Artificial Sequence: Synthetic probe
atggtcggaatgatcagtggaactaccacagaaagggaactgtgggatgactgggcacca

SEQ ID NO: 11887 - DNA, 60 bp, Artificial Sequence
  Description of Artificial Sequence: Synthetic probe
aagaatggtcggaatgatcagtggaactaccacagaaagggaactgtgggatgactgggc

SEQ ID NO: 11888 - DNA, 60 bp, Artificial Sequence
  Description of Artificial Sequence: Synthetic probe
gtgagagctccaaatattggaatttgtccgaatgccagattatgaactcagatgattgtc

SEQ ID NO: 11889 - DNA, 60 bp, Artificial Sequence
  Description of Artificial Sequence: Synthetic probe
gtctgtgagagctccaaatattggaatttgtccgaatgccagattatgaactcagatgat

SEQ ID NO: 11890 - DNA, 60 bp, Artificial Sequence
  Description of Artificial Sequence: Synthetic probe
aacagatatcaaaatggctcctacagttaagagaatcattaacgactccattattcagcc

SEQ ID NO: 11891 - DNA, 60 bp, Artificial Sequence
  Description of Artificial Sequence: Synthetic probe
aacagatatcaaaatggctcctacagttaagagaatcattaacgactcaataattcagcc

SEQ ID NO: 11892 - DNA, 60 bp, Artificial Sequence
  Description of Artificial Sequence: Synthetic probe
ccagctcaggatataaatttcctttatatatgattggacatggtatgttggactccgatc

SEQ ID NO: 11893 - DNA, 60 bp, Artificial Sequence
  Description of Artificial Sequence: Synthetic probe
aggcagtttgtgagagttcaaaatattggaatttatcagaatgccaacttgttacctcag

SEQ ID NO: 11894 - DNA, 60 bp, Artificial Sequence
  Description of Artificial Sequence: Synthetic probe
gtcccaccgaaaggaagaaatgttgtagactggctcggttggtatgatgacaatggaggg

SEQ ID NO: 11895 - DNA, 60 bp, Artificial Sequence
  Description of Artificial Sequence: Synthetic probe
ggtctcaagaaatccgaagtcccaccgaaaggaagaaatgttgtagactggcttggttgg

SEQ ID NO: 11896 - DNA, 60 bp, Artificial Sequence
  Description of Artificial Sequence: Synthetic probe
aggatgacggtctcaagaaatccgaagtcccaccgaaaggaagaaatgttgtagactggc

SEQ ID NO: 11897 - DNA, 60 bp, Artificial Sequence
  Description of Artificial Sequence: Synthetic probe
gagaagtcgcagatgaactatgccaaatgatgtacccaggccaagaaattgataaggcgg

SEQ ID NO: 11898 - DNA, 60 bp, Artificial Sequence
  Description of Artificial Sequence: Synthetic probe
ctgaatagagaagtcgcagatgaactatgccaaatgatgtacccaggccaagaaattgat

SEQ ID NO: 11899 - DNA, 60 bp, Artificial Sequence
  Description of Artificial Sequence: Synthetic probe
tgccgcgttaaagggagtagaaggaacattagacagagactgggttagctttggaagaac

SEQ ID NO: 11900 - DNA, 60 bp, Artificial Sequence
  Description of Artificial Sequence: Synthetic probe
tctttatgccgcactaaagggagtagagggaacattagacagagactgggttagctttgg

SEQ ID NO: 11901 - DNA, 60 bp, Artificial Sequence
  Description of Artificial Sequence: Synthetic probe
tgaacatcttacgatgttgtcgccggatgaaagaatagacaaatgggaagaagatttgcc

SEQ ID NO: 11902 - DNA, 60 bp, Artificial Sequence
  Description of Artificial Sequence: Synthetic probe
tactgactataagtctgaacatcttacgatgttgtcgccggatgaaagaatagacaaatg

SEQ ID NO: 11903 - DNA, 60 bp, Artificial Sequence
  Description of Artificial Sequence: Synthetic probe
tactgactataattctgaacatcttacgatgttgtcgccggatgaaagaatagacaaatg

SEQ ID NO: 11904 - DNA, 56 bp, Artificial Sequence
  Description of Artificial Sequence: Synthetic probe
gccttgcaggatgccaatgaatctgaagagagaagagaggataaatatctccagga

SEQ ID NO: 11905 - DNA, 56 bp, Artificial Sequence
  Description of Artificial Sequence: Synthetic probe
gccttgcaggatgcaaatgaatctgaagagagaagagaggataaatatctccagga

SEQ ID NO: 11906 - DNA, 60 bp, Artificial Sequence
  Description of Artificial Sequence: Synthetic probe
aacatgggttctaaatagagaagttgcagacgagctatgccagatgatgtatccagggca

SEQ ID NO: 11907 - DNA, 60 bp, Artificial Sequence
  Description of Artificial Sequence: Synthetic probe
gagaatcagtgcaaagtagcatcgaccagattcgaaagcctagttgaagacggattggat

SEQ ID NO: 11908 - DNA, 60 bp, Artificial Sequence
  Description of Artificial Sequence: Synthetic probe
gcactaaagtggcactaaatgatttgagggcttatgtctaccaagggatcaagtctggca

SEQ ID NO: 11909 - DNA, 60 bp, Artificial Sequence
  Description of Artificial Sequence: Synthetic probe
gcattggcgacatttgggcatctcagcaaggtcagtggactctctattgaagatctcaca

SEQ ID NO: 11910 - DNA, 60 bp, Artificial Sequence
  Description of Artificial Sequence: Synthetic probe
gcactaaagtggcactaaatgatttgagggcttacgtctaccaagggatcaagtctggca

SEQ ID NO: 11911 - DNA, 60 bp, Artificial Sequence
  Description of Artificial Sequence: Synthetic probe
acatttgggcatctaagcaaggtcagtggactctctattgaagatctcacaacatgggtc

SEQ ID NO: 11912 - DNA, 60 bp, Artificial Sequence
  Description of Artificial Sequence: Synthetic probe
gagaatcagtgcaaagtagcatcgaccagattcgaaagcctcgttgaagatggattggat

SEQ ID NO: 11913 - DNA, 58 bp, Artificial Sequence
  Description of Artificial Sequence: Synthetic probe
ttattgcccatcaagctcagatttgaattggcataatgacttaataggcacagcctta

SEQ ID NO: 11914 - DNA, 60 bp, Artificial Sequence
  Description of Artificial Sequence: Synthetic probe
ggaagtgaggaagagtattattcagtatgcccagaaggggcgccagacttgatgggagct

SEQ ID NO: 11915 - DNA, 60 bp, Artificial Sequence
  Description of Artificial Sequence: Synthetic probe
tgaagcgggagaaccaattaccccagtagatctcagctatcttggaccaaaaaacccagg

SEQ ID NO: 11916 - DNA, 60 bp, Artificial Sequence
  Description of Artificial Sequence: Synthetic probe
tccccaggtcccacactcaaggtatcagagtccatcaatctatgggatttaaagtccaca

SEQ ID NO: 11917 - DNA, 56 bp, Artificial Sequence
  Description of Artificial Sequence: Synthetic probe
gaagacaattaaggcagtctgtgagagctctaagtattggaagttgtcagaatgcc

SEQ ID NO: 11918 - DNA, 60 bp, Artificial Sequence
  Description of Artificial Sequence: Synthetic probe
cctccggttggattaacaaaagttcagacggaccaatggaggaagacaattgatgcggtc

SEQ ID NO: 11919 - DNA, 60 bp, Artificial Sequence
  Description of Artificial Sequence: Synthetic probe
cctccggttggattaacaaaagttcagacggaccaatggaggaagacaattaaggcagtc

SEQ ID NO: 11920 - DNA, 60 bp, Artificial Sequence
  Description of Artificial Sequence: Synthetic probe
ctctgtttcctccggttggattaacaaaagttcagacggaccaatggatgaagacaattg

SEQ ID NO: 11921 - DNA, 60 bp, Artificial Sequence
  Description of Artificial Sequence: Synthetic probe
tctctgtttcctccggttggattaacaaaagttcagacggaccaatggaggaagacaatt

SEQ ID NO: 11922 - DNA, 60 bp, Artificial Sequence
  Description of Artificial Sequence: Synthetic probe
ctatctgtttcctccggttggattaacaaaagttcagacggaccaatggaggaagacaat

SEQ ID NO: 11923 - DNA, 58 bp, Artificial Sequence
  Description of Artificial Sequence: Synthetic probe
tctatgctgcattaaagggagtggaaggaactttagacagagactgggttagctttgg

SEQ ID NO: 11924 - DNA, 58 bp, Artificial Sequence
  Description of Artificial Sequence: Synthetic probe
tctacgctgcattaaagggagtggaaggaactttagacagagactgggttagctttgg

SEQ ID NO: 11925 - DNA, 60 bp, Artificial Sequence
  Description of Artificial Sequence: Synthetic probe
ctccacataaatgcttatctctacgctgcattaaagggagtggaaggaactttagacaga

SEQ ID NO: 11926 - DNA, 60 bp, Artificial Sequence
  Description of Artificial Sequence: Synthetic probe
tttgaaagcgaagaagagtattattcagtatgcccagaaggagcatccgacttgatgggg

SEQ ID NO: 11927 - DNA, 60 bp, Artificial Sequence
  Description of Artificial Sequence: Synthetic probe
acttctttgaaagcgaagaagagtattattcagtatgcccagaaggagcatccgacttga

SEQ ID NO: 11928 - DNA, 60 bp, Artificial Sequence
  Description of Artificial Sequence: Synthetic probe
gagtctatgaatctatgggatctgaagtcaacagaagtgcaattgacttcaaagagagca

SEQ ID NO: 11929 - DNA, 60 bp, Artificial Sequence
  Description of Artificial Sequence: Synthetic probe
cagagtcaatgaatctatgggatctgaagtcaacagaagtacaattgacttcaaagagag

SEQ ID NO: 11930 - DNA, 60 bp, Artificial Sequence
  Description of Artificial Sequence: Synthetic probe
acttttcctaattggactcaacctgtaatgaaggagaatggtggtgagaagtccctatcg

SEQ ID NO: 11931 - DNA, 60 bp, Artificial Sequence
  Description of Artificial Sequence: Synthetic probe
aaccgaagtacaactgatctcgaagagggccggagtgaaagacatgatggtgaaattgac

SEQ ID NO: 11932 - DNA, 60 bp, Artificial Sequence
  Description of Artificial Sequence: Synthetic probe
gccacaagagaattcctgaatcctgatgagcgcatgacgtacttgaatcatgctgattac

SEQ ID NO: 11933 - DNA, 60 bp, Artificial Sequence
  Description of Artificial Sequence: Synthetic probe
ctatgccacaagagaattcctgaatcccgatgagcgcatgacgtacttgaatcatgctga

SEQ ID NO: 11934 - DNA, 60 bp, Artificial Sequence
  Description of Artificial Sequence: Synthetic probe
cagatgattgtcttatcctcaaaggccgagttatgactcctgactgcagttcatcaatca

SEQ ID NO: 11935 - DNA, 60 bp, Artificial Sequence
  Description of Artificial Sequence: Synthetic probe
gctctaaatattggaatttgtcagaatgccagattatgaactcagaagattgtcttatcc

SEQ ID NO: 11936 - DNA, 60 bp, Artificial Sequence
  Description of Artificial Sequence: Synthetic probe
ttatcagacacgatgttaagaggatcttccccggaacctcccagcgcccttgagacccta

SEQ ID NO: 11937 - DNA, 60 bp, Artificial Sequence
  Description of Artificial Sequence: Synthetic probe
ggaatattattcagtatgcccagaaggggccccagatttgatgggagcaatcatcatggg

SEQ ID NO: 11938 - DNA, 60 bp, Artificial Sequence
  Description of Artificial Sequence: Synthetic probe
ctcctcctcgcattcacccggtccagcaccaaagtcacggaatcaactaggtctatggga

SEQ ID NO: 11939 - DNA, 60 bp, Artificial Sequence
  Description of Artificial Sequence: Synthetic probe
agaacggatcttggattatgctctttgtcaaaacacttggagcaagattgcagcaggaga

SEQ ID NO: 11940 - DNA, 59 bp, Artificial Sequence
  Description of Artificial Sequence: Synthetic probe
ataaggatggagtcagtttcaatcctggatttcctccccagagctgcgggtatggttca

SEQ ID NO: 11941 - DNA, 60 bp, Artificial Sequence
  Description of Artificial Sequence: Synthetic probe
tgaacatcttacgatgctgtcgccagatgaaagaatagacaagtgggaagaagatttgcc

SEQ ID NO: 11942 - DNA, 51 bp, Artificial Sequence
  Description of Artificial Sequence: Synthetic probe
gagcaggagttaaggacatgacagtgaaattaacagacttctttgaaagtg

SEQ ID NO: 11943 - DNA, 60 bp, Artificial Sequence
  Description of Artificial Sequence: Synthetic probe
aggtgcaactaatgtcaaaaagagcaggagttaaggacatgacagtgaaattaacagact

SEQ ID NO: 11944 - DNA, 55 bp, Artificial Sequence
  Description of Artificial Sequence: Synthetic probe
attgcagcccatcagctaaatctcagaattctggacagagttccgagtctccttc

SEQ ID NO: 11945 - DNA, 59 bp, Artificial Sequence
  Description of Artificial Sequence: Synthetic probe
atgcccgacagccagatgacattgaatatacatcattaacttgtgcaagtctactgctg

SEQ ID NO: 11946 - DNA, 60 bp, Artificial Sequence
  Description of Artificial Sequence: Synthetic probe
atgcccgacagccagatgacattgaatatacatcattaacttgtgcaagtctactgctgt

SEQ ID NO: 11947 - DNA, 60 bp, Artificial Sequence
  Description of Artificial Sequence: Synthetic probe
gatgactatgcagatgaggaagtggatgttgtatttacttcagactggaaacagcctgag

SEQ ID NO: 11948 - DNA, 60 bp, Artificial Sequence
  Description of Artificial Sequence: Synthetic probe
caggggcctttagatgactatgcagatgaggaagtggatgttgtattcacttcagactgg

SEQ ID NO: 11949 - DNA, 60 bp, Artificial Sequence
  Description of Artificial Sequence: Synthetic probe
cagacttctttggaagtgaggaagagtattattcagtatgcccagaaggggcgccagact

SEQ ID NO: 11950 - DNA, 60 bp, Artificial Sequence
  Description of Artificial Sequence: Synthetic probe
gagtccatcaatctatgggatttaaagtccacagaagtacaactgatctctaagagagcc

SEQ ID NO: 11951 - DNA, 60 bp, Artificial Sequence
  Description of Artificial Sequence: Synthetic probe
gtgttatatgttagcactaaagtggcactaaatgatttgagggcttatgtctaccaaggg

SEQ ID NO: 11952 - DNA, 60 bp, Artificial Sequence
  Description of Artificial Sequence: Synthetic probe
tggtctaaagaaatcagatgtaccacccaaagggaggaatgtcgtagactggctcggctg

SEQ ID NO: 11953 - DNA, 60 bp, Artificial Sequence
  Description of Artificial Sequence: Synthetic probe
ggatgatggtctaaagaaatcagatgtaccacccaaagggaggaatgtcgtagactggct

SEQ ID NO: 11954 - DNA, 60 bp, Artificial Sequence
  Description of Artificial Sequence: Synthetic probe
gtgttatatgttagcactaaagtggcactaaatgatttgagggcttacgtctaccaaggg

SEQ ID NO: 11955 - DNA, 60 bp, Artificial Sequence
  Description of Artificial Sequence: Synthetic probe
gtgttatatgttagcactaaagtggcactaaatgatttgagggcttatgtctaccagggg

SEQ ID NO: 11956 - DNA, 60 bp, Artificial Sequence
  Description of Artificial Sequence: Synthetic probe
gtgttatatgttagcactaaagtggcactaaatgacttgagggcttatgtctaccagggg

SEQ ID NO: 11957 - DNA, 60 bp, Artificial Sequence
  Description of Artificial Sequence: Synthetic probe
caaatacactccagatgatagtaccggaggattgacgactaatgcaccgccacaaggcag

SEQ ID NO: 11958 - DNA, 60 bp, Artificial Sequence
  Description of Artificial Sequence: Synthetic probe
gagatagcaaatacactccagatgatagtaccggaggattgacgactaatgcaccgccac

SEQ ID NO: 11959 - DNA, 60 bp, Artificial Sequence
  Description of Artificial Sequence: Synthetic probe
gagataacaaatacactccagatgataataccggaggattgacgactaatgcaccgccac

SEQ ID NO: 11960 - DNA, 50 bp, Artificial Sequence
  Description of Artificial Sequence: Synthetic probe
agcccagattaccggccaacgaggacccggtagaatacccggctgattac

SEQ ID NO: 11961 - DNA, 60 bp, Artificial Sequence
  Description of Artificial Sequence: Synthetic probe
gagggaacttttaacagatatcaaaatggctcctacagttaagagaatcattaacgactc

SEQ ID NO: 11962 - DNA, 52 bp, Artificial Sequence
  Description of Artificial Sequence: Synthetic probe
caggaaaccggggtataagcttaaaaatgacctctggtttcagattacggac

SEQ ID NO: 11963 - DNA, 60 bp, Artificial Sequence
  Description of Artificial Sequence: Synthetic probe
tggttcacatcctccgatggagaaagtgtctgcagtcaattgttcaccttggttggagga

SEQ ID NO: 11964 - DNA, 60 bp, Artificial Sequence
  Description of Artificial Sequence: Synthetic probe
ataattccacaaaatggttcacatcctccgatggagaaagtgtctgcagtcaattgttca

SEQ ID NO: 11965 - DNA, 60 bp, Artificial Sequence
  Description of Artificial Sequence: Synthetic probe
cataattccacaaaatggtttacatcctccgatggagaaagtgtctgcagtcaattgttt

SEQ ID NO: 11966 - DNA, 60 bp, Artificial Sequence
  Description of Artificial Sequence: Synthetic probe
tgaggctggagaaccaattaccccagtggatctcagctatcttggaccaaaaaacccagg

SEQ ID NO: 11967 - DNA, 57 bp, Artificial Sequence
  Description of Artificial Sequence: Synthetic probe
ttaccagaaacaggaatcagaagtaattactttccctacatatccacagaggggatt

SEQ ID NO: 11968 - DNA, 60 bp, Artificial Sequence
  Description of Artificial Sequence: Synthetic probe
atccacacttcatcggaggaaggtgcaagggacaaatttgtgaaacagtccataattcca

SEQ ID NO: 11969 - DNA, 60 bp, Artificial Sequence
  Description of Artificial Sequence: Synthetic probe
gcgctctacaacttctgcagtgggagacagggattcatgcattggcggagagacttgggg

SEQ ID NO: 11970 - DNA, 60 bp, Artificial Sequence
  Description of Artificial Sequence: Synthetic probe
tcaaaatgagttctcaagtattctgcatttctacaggtcaaacagtctccgtgtgccttc

SEQ ID NO: 11971 - DNA, 60 bp, Artificial Sequence
  Description of Artificial Sequence: Synthetic probe
acagcctgagcttgaatccgacgagcatggaaagaccttacggttgacattgccagaggg

SEQ ID NO: 11972 - DNA, 60 bp, Artificial Sequence
  Description of Artificial Sequence: Synthetic probe
acagcctgagctcaaatctgacgagcatggaaagaccttacggttgacattgccagaggg

SEQ ID NO: 11973 - DNA, 60 bp, Artificial Sequence
  Description of Artificial Sequence: Synthetic probe
ctactcctctcattctcccggtcccacgctcaaggtatcagagtccatcaatctatggga

SEQ ID NO: 11974 - DNA, 60 bp, Artificial Sequence
  Description of Artificial Sequence: Synthetic probe
tcgaagagggccggagtgaaagacatgatggtgaaattgacagacttttttggaagtgaa

SEQ ID NO: 11975 - DNA, 60 bp, Artificial Sequence
  Description of Artificial Sequence: Synthetic probe
tcgaagagggccggagtgaaagacatgatggtgaaattgacagacttttttgaaagtgaa

SEQ ID NO: 11976 - DNA, 60 bp, Artificial Sequence
  Description of Artificial Sequence: Synthetic probe
ctcgaagagggccggagtgaaagacatgatggtgaaattgacagacttctttggaagtga

SEQ ID NO: 11977 - DNA, 52 bp, Artificial Sequence
  Description of Artificial Sequence: Synthetic probe
ttattcatcccaagctgccagcccatgaagatccggtagaatacccggctga

SEQ ID NO: 11978 - DNA, 60 bp, Artificial Sequence
  Description of Artificial Sequence: Synthetic probe
cgactctattatccatcctaagctgccagcccatgaagatccggtagaatacccggctga

SEQ ID NO: 11979 - DNA, 52 bp, Artificial Sequence
  Description of Artificial Sequence: Synthetic probe
aacatgcatctagagcatcagcatcaccgaatctatgggactttaagtttac

SEQ ID NO: 11980 - DNA, 60 bp, Artificial Sequence
  Description of Artificial Sequence: Synthetic probe
ctccagtcggattgactcagattcagacagaacagtggaaaaagaccattgagacagtct

SEQ ID NO: 11981 - DNA, 56 bp, Artificial Sequence
  Description of Artificial Sequence: Synthetic probe
ttattcagccgaaattaccggccaacgaggatccggtcgaatacccggctgattac

SEQ ID NO: 11982 - DNA, 60 bp, Artificial Sequence
  Description of Artificial Sequence: Synthetic probe
gactcaattattcagccgaaattaccggccaacgaggatccggtcgaatacccggctgat

SEQ ID NO: 11983 - DNA, 60 bp, Artificial Sequence
  Description of Artificial Sequence: Synthetic probe
cattaacgactcaattattcagccgaaattaccggccaacgaggatccggtagaataccc

SEQ ID NO: 11984 - DNA, 60 bp, Artificial Sequence
  Description of Artificial Sequence: Synthetic probe
ctcagatgattgtcttatcctcaaaggccgagttatgactcctgactgcagttcatcaat

SEQ ID NO: 11985 - DNA, 60 bp, Artificial Sequence
  Description of Artificial Sequence: Synthetic probe
gtctgtgagagctctaaatattggaatttgtcagaatgccaaattatgaactcagataat

SEQ ID NO: 11986 - DNA, 60 bp, Artificial Sequence
  Description of Artificial Sequence: Synthetic probe
cagtatgcccagaaggggcaccagacttgatgggagcaatcatcatgggactaaaacata

SEQ ID NO: 11987 - DNA, 60 bp, Artificial Sequence
  Description of Artificial Sequence: Synthetic probe
ttcagtatgcccagaaggggcaccagacttgatgggagcaatcatcatgggactaaaaca

SEQ ID NO: 11988 - DNA, 60 bp, Artificial Sequence
  Description of Artificial Sequence: Synthetic probe
ctcaaatgcaatcggaagcatgtgtgttatctctcattttgtcatgaacacaatacggac

SEQ ID NO: 11989 - DNA, 60 bp, Artificial Sequence
  Description of Artificial Sequence: Synthetic probe
taaccttgaaacactgtttcaaatagcgggggtccctactggagttgcacacggaatcac

SEQ ID NO: 11990 - DNA, 60 bp, Artificial Sequence
  Description of Artificial Sequence: Synthetic probe
ggaagtgaaggaccctaccatgtcatacaaaattgaattattggtcagacaatatgtccc

SEQ ID NO: 11991 - DNA, 60 bp, Artificial Sequence
  Description of Artificial Sequence: Synthetic probe
ttttcaacagtttgttggatttatcagacacgatgttaagaggatcttccccagaacccc

SEQ ID NO: 11992 - DNA, 60 bp, Artificial Sequence
  Description of Artificial Sequence: Synthetic probe
ggggaatgactgttgccttgcttcgacttaatagagcatctagaggaattttcaacagtt

SEQ ID NO: 11993 - DNA, 60 bp, Artificial Sequence
  Description of Artificial Sequence: Synthetic probe
ccgactaggacagttacccaccggagctcactacaagatgagaaccatcatatcccgtct

SEQ ID NO: 11994 - DNA, 60 bp, Artificial Sequence
  Description of Artificial Sequence: Synthetic probe
gaatgagggtatcgctttgtacccaaattggggaatagagtatattggaaatgtgactga

SEQ ID NO: 11995 - DNA, 60 bp, Artificial Sequence
  Description of Artificial Sequence: Synthetic probe
gataaactaagtgcatcaagtccattcctatcacttgtaagaaccggtcctattcgacaa

SEQ ID NO: 11996 - DNA, 60 bp, Artificial Sequence
  Description of Artificial Sequence: Synthetic probe
gttgctgtcaagtaatccatcgcagaagtgtttccactttaaagagacctgctaatgctg

SEQ ID NO: 11997 - DNA, 60 bp, Artificial Sequence
  Description of Artificial Sequence: Synthetic probe
ggggcttcctacaagggttattagatggtttgatgagatcaagttgctgtcaagtaatcc

SEQ ID NO: 11998 - DNA, 60 bp, Artificial Sequence
  Description of Artificial Sequence: Synthetic probe
ccggtcgaacagtcatatcaagttgcgagatgcattggatttctttatggggaattgaca

SEQ ID NO: 11999 - DNA, 60 bp, Artificial Sequence
  Description of Artificial Sequence: Synthetic probe
gcaatggagggttcgcttcacaaagccctgctactttaacacgtatgattgcgaccacag

SEQ ID NO: 12000 - DNA, 60 bp, Artificial Sequence
  Description of Artificial Sequence: Synthetic probe
ctcaacttcgagaatgagcaatggaggattcgcttcacaaagccctgctactttaacacg

SEQ ID NO: 12001 - DNA, 60 bp, Artificial Sequence
  Description of Artificial Sequence: Synthetic probe
gagaacaggatcagcattacacaggttctcaacttcgagaatgagcaatggagggttcgc

SEQ ID NO: 12002 - DNA, 60 bp, Artificial Sequence
  Description of Artificial Sequence: Synthetic probe
gagggcaaccagattgagggatgctatatcttggtttgtaccaccagaatctcctctatc

SEQ ID NO: 12003 - DNA, 60 bp, Artificial Sequence
  Description of Artificial Sequence: Synthetic probe
ctgtgcattgtccaaagggaatcacagatgtattcaataggagaggaccattgccggctt

SEQ ID NO: 12004 - DNA, 60 bp, Artificial Sequence
  Description of Artificial Sequence: Synthetic probe
gagctgatgtattaagatacaaatcttggacaagaaaggtagtggggactacagtgcctc

SEQ ID NO: 12005 - DNA, 61 bp, Artificial Sequence
  Description of Artificial Sequence: Synthetic probe
caaagatctcgatgaattgataatcaagagtgagatatcttctttaagtcatcttggatcc

SEQ ID NO: 12006 - DNA, 60 bp, Artificial Sequence
  Description of Artificial Sequence: Synthetic probe
atggtcaatcaacccactctttccccgtttcttaagcgagtttaaggctgggacattttt

SEQ ID NO: 12007 - DNA, 60 bp, Artificial Sequence
  Description of Artificial Sequence: Synthetic probe
tcggaggggaatgtggtatggcgttgtctcgattcttaatcagagcttttccagatccgg

SEQ ID NO: 12008 - DNA, 60 bp, Artificial Sequence
  Description of Artificial Sequence: Synthetic probe
gggacctttgctcgattattgctctttatgcatgaccctgcaataagacattctctgtat

SEQ ID NO: 12009 - DNA, 56 bp, Artificial Sequence
  Description of Artificial Sequence: Synthetic probe
tttcgcggggttatccgaggattggaaacaaaaagatggtcacgagtgacatgtgt

SEQ ID NO: 12010 - DNA, 60 bp, Artificial Sequence
  Description of Artificial Sequence: Synthetic probe
ggaacgggcagaaaggaggattagaaggactgagacagaagggatggagtatcgtgaatc

SEQ ID NO: 12011 - DNA, 60 bp, Artificial Sequence
  Description of Artificial Sequence: Synthetic probe
gatctaacatctgtgatcaagaagatgatggacagttcatcaggtcaggggcttgatgat

SEQ ID NO: 12012 - DNA, 60 bp, Artificial Sequence
  Description of Artificial Sequence: Synthetic probe
agatgtctcccaaacatcctttttatgaacatgtcgttaataagacatggcccaccgcag

SEQ ID NO: 12013 - DNA, 57 bp, Artificial Sequence
  Description of Artificial Sequence: Synthetic probe
cgaatcggagatcgaatcttggagcagtgtggcaatagggcatatgatttgataaaa

SEQ ID NO: 12014 - DNA, 60 bp, Artificial Sequence
  Description of Artificial Sequence: Synthetic probe
taatggatcgaaactttctcctcatgtgcaaggatgtcataatcggccgaatgcagacat

SEQ ID NO: 12015 - DNA, 60 bp, Artificial Sequence
  Description of Artificial Sequence: Synthetic probe
ccgcatgagttgtgaaaacattcctattgcccgcttaagacttcccagtttaggccccgt

SEQ ID NO: 12016 - DNA, 60 bp, Artificial Sequence
  Description of Artificial Sequence: Synthetic probe
cctctgcaaaataaccggaatgtctacagaagatgtgacgacctggatcttgaaccgaga

SEQ ID NO: 12017 - DNA, 60 bp, Artificial Sequence
  Description of Artificial Sequence: Synthetic probe
ggacacctctgcaaaataaccggaatgtctacagaagatgtgacgacctggatcctgaac

SEQ ID NO: 12018 - DNA, 60 bp, Artificial Sequence
  Description of Artificial Sequence: Synthetic probe
ctcagatgattgtcttatcctcaaaggccgagtgatgactcctgactgcagttcatcaat

SEQ ID NO: 12019 - DNA, 60 bp, Artificial Sequence
  Description of Artificial Sequence: Synthetic probe
gtgacctacacgaggaaaactcttggagagattaaaaaatcatgaggagactccaaactt

SEQ ID NO: 12020 - DNA, 60 bp, Artificial Sequence
  Description of Artificial Sequence: Synthetic probe
tgttgaagagtgacctacacgaggaaaactcttggagagattaaaaaatcatgaggagac

SEQ ID NO: 12021 - DNA, 60 bp, Artificial Sequence
  Description of Artificial Sequence: Synthetic probe
ctcaaaagaagaccggtctatactgatgttgaagagcgacctacatgaggaaaactcttg

SEQ ID NO: 12022 - DNA, 60 bp, Artificial Sequence
  Description of Artificial Sequence: Synthetic probe
ttcaaaagaagaccggtctatactgatgttgaagagtgacctacacgaggaaaactcttg

SEQ ID NO: 12023 - DNA, 60 bp, Artificial Sequence
  Description of Artificial Sequence: Synthetic probe
ggcagtctgtgagagctcaaaatactggaatttatcagagtgccggattgtaacttcaga

SEQ ID NO: 12024 - DNA, 60 bp, Artificial Sequence
  Description of Artificial Sequence: Synthetic probe
ctatgggatttgaggtctacagaggtgcaattgacttcaaagagagcaggagttaaggat

SEQ ID NO: 12025 - DNA, 60 bp, Artificial Sequence
  Description of Artificial Sequence: Synthetic probe
ctatgggatttgaggtctacagaggtgcaattgacttcaaagagagcaggagttaaggac

SEQ ID NO: 12026 - DNA, 60 bp, Artificial Sequence
  Description of Artificial Sequence: Synthetic probe
gtgggatagtaagaactgggatggagttcttgagatgttaacatcatggccccaatcggg

SEQ ID NO: 12027 - DNA, 60 bp, Artificial Sequence
  Description of Artificial Sequence: Synthetic probe
ctcgatgtgggatagtaagaactgggatggagttcttgagatgttaacatcatggcccca

SEQ ID NO: 12028 - DNA, 60 bp, Artificial Sequence
  Description of Artificial Sequence: Synthetic probe
gggattaccagaaaccggaatcaggagcaattacttcccctatgtgtctacagaaggaat

SEQ ID NO: 12029 - DNA, 60 bp, Artificial Sequence
  Description of Artificial Sequence: Synthetic probe
caatgggattaccagaaaccggaatcaggagcaattacttcccctatgtgtctacagaag

SEQ ID NO: 12030 - DNA, 60 bp, Artificial Sequence
  Description of Artificial Sequence: Synthetic probe
ttatggatgaccacttgtgactttagatggtatggaccaaaatatataactcattccatc

SEQ ID NO: 12031 - DNA, 60 bp, Artificial Sequence
  Description of Artificial Sequence: Synthetic probe
tggtttacatcctccgatggagaaagtgtctgcagtcaattgtttactttggttggagga

SEQ ID NO: 12032 - DNA, 60 bp, Artificial Sequence
  Description of Artificial Sequence: Synthetic probe
ggagacggttccggcgggatgactgctgcattactacgagaaaatgtgcatagcagagga

SEQ ID NO: 12033 - DNA, 60 bp, Artificial Sequence
  Description of Artificial Sequence: Synthetic probe
atgtttctgtgcattgtccagacgggatccatgacgtctttagttcacggggacccttgc

SEQ ID NO: 12034 - DNA, 60 bp, Artificial Sequence
  Description of Artificial Sequence: Synthetic probe
atatgattgggcatggtatgttggactccgatctccatctcagctcaaaggttcaggtgt

SEQ ID NO: 12035 - DNA, 60 bp, Artificial Sequence
  Description of Artificial Sequence: Synthetic probe
cacaggagagtgggttgattcacagttcatcaacggaaaatgcagcaatgacatatgcct

SEQ ID NO: 12036 - DNA, 60 bp, Artificial Sequence
  Description of Artificial Sequence: Synthetic probe
cagcctgaacttgaatctgacgagcacggaaagactttacggttgacattgccagagggt

SEQ ID NO: 12037 - DNA, 56 bp, Artificial Sequence
  Description of Artificial Sequence: Synthetic probe
attacaattatttggcctagagggaactttaacagatatcaaaatggctcctacag

SEQ ID NO: 12038 - DNA, 60 bp, Artificial Sequence
  Description of Artificial Sequence: Synthetic probe
cgtggaacggatacttgattatgctctttgtcaaaacacttggagcaagattgaagcagg

SEQ ID NO: 12039 - DNA, 60 bp, Artificial Sequence
  Description of Artificial Sequence: Synthetic probe
atatcagacgtggaacggatacttgattatgctctttgtcaaaacacttggagcaagatt

SEQ ID NO: 12040 - DNA, 60 bp, Artificial Sequence
  Description of Artificial Sequence: Synthetic probe
gctctaaatattggaatttgtcagaatgccagattatgaactcagatgattgtcttatcc

SEQ ID NO: 12041 - DNA, 60 bp, Artificial Sequence
  Description of Artificial Sequence: Synthetic probe
ggtccgaaaccaagtccgtctaaatccattcaatgagatcttgttcaatcagctatgtcg

SEQ ID NO: 12042 - DNA, 60 bp, Artificial Sequence
  Description of Artificial Sequence: Synthetic probe
cgatgttatcgccggatgaaagaatagacaaatgggaagaggatttgcccgaattggaaa

SEQ ID NO: 12043 - DNA, 60 bp, Artificial Sequence
  Description of Artificial Sequence: Synthetic probe
tgaacatcttacgatgttgtcgccggatgaaagaatagacaaatgggaagaggatttgcc

SEQ ID NO: 12044 - DNA, 60 bp, Artificial Sequence
  Description of Artificial Sequence: Synthetic probe
ccggtgacctttcctagttggacacagcctgtaatgaaggaaaatggaggagagaaatca

SEQ ID NO: 12045 - DNA, 60 bp, Artificial Sequence
  Description of Artificial Sequence: Synthetic probe
ataccggtgacctttcctagttggacacagcctgtaatgaaggaaaatggaggagagaaa

SEQ ID NO: 12046 - DNA, 59 bp, Artificial Sequence
  Description of Artificial Sequence: Synthetic probe
aattggataagagcttgggaattaattagaaatggaaataagtctgagccttttgattc

SEQ ID NO: 12047 - DNA, 60 bp, Artificial Sequence
  Description of Artificial Sequence: Synthetic probe
caaaagattccagattaggagacagccttgctaatatcggcaattggataagagcttggg

SEQ ID NO: 12048 - DNA, 60 bp, Artificial Sequence
  Description of Artificial Sequence: Synthetic probe
atgcaatcccaaaagattccagattaggagacagccttgctaatatcggcaattggataa

SEQ ID NO: 12049 - DNA, 50 bp, Artificial Sequence
  Description of Artificial Sequence: Synthetic probe
cccatcagatggggatgtcaacaaaatgtgttcagcattgattgggacat

SEQ ID NO: 12050 - DNA, 60 bp, Artificial Sequence
  Description of Artificial Sequence: Synthetic probe
ggaccacagatagtatgcctggacccccatcagatggggatgtcaacaaaatgtgttcag

SEQ ID NO: 12051 - DNA, 60 bp, Artificial Sequence
  Description of Artificial Sequence: Synthetic probe
gtgtgttatctctcatttcaccattaacacaatacggaccacagatagtatgcctggacc

SEQ ID NO: 12052 - DNA, 60 bp, Artificial Sequence
  Description of Artificial Sequence: Synthetic probe
tgccatcggaagcatgtgtgttatctctcatttcaccattaacacaatacggaccacaga

SEQ ID NO: 12053 - DNA, 50 bp, Artificial Sequence
  Description of Artificial Sequence: Synthetic probe
gttcccaccggagttgcgcatggaatcacacatcacatattgcagtctaa

SEQ ID NO: 12054 - DNA, 60 bp, Artificial Sequence
  Description of Artificial Sequence: Synthetic probe
ggagtcaatctagagaccctgtttcaaatagcaggggttcccaccggagttgcgcatgga

SEQ ID NO: 12055 - DNA, 60 bp, Artificial Sequence
  Description of Artificial Sequence: Synthetic probe
ttgtaccggatcctggagtcaatctagagaccctgtttcaaatagcaggggttcccaccg

SEQ ID NO: 12056 - DNA, 60 bp, Artificial Sequence
  Description of Artificial Sequence: Synthetic probe
ctttcagaagcttcaaagatgaatttcaaagagctcaatcacttaccccagagacaaccc

SEQ ID NO: 12057 - DNA, 60 bp, Artificial Sequence
  Description of Artificial Sequence: Synthetic probe
agaaacagtatgctttcagaagcttcaaagatgaatttcaaagagctcaatcacttaccc

SEQ ID NO: 12058 - DNA, 60 bp, Artificial Sequence
  Description of Artificial Sequence: Synthetic probe
catccgaattgtacttggtatgcaggagattgaaggattatgtagacactccctttgttg

SEQ ID NO: 12059 - DNA, 60 bp, Artificial Sequence
  Description of Artificial Sequence: Synthetic probe
gtccaaacggatttaagctctagtaatacatccgaattgtacttggtatgcaggggattg

SEQ ID NO: 12060 - DNA, 60 bp, Artificial Sequence
  Description of Artificial Sequence: Synthetic probe
tttcactctgtccaacttgtccaaacggatttaagctctagtaatacatccgaattgtac

SEQ ID NO: 12061 - DNA, 60 bp, Artificial Sequence
  Description of Artificial Sequence: Synthetic probe
aagacaattccctgactcttataggatcactttttcactctgtccaacttgtccaaacgg

SEQ ID NO: 12062 - DNA, 60 bp, Artificial Sequence
  Description of Artificial Sequence: Synthetic probe
catatggaacatatattgccacacaagaagacaattccctgactcttataggatcacttt

SEQ ID NO: 12063 - DNA, 60 bp, Artificial Sequence
  Description of Artificial Sequence: Synthetic probe
gccttatttataaaacatatggaacatatattgccacacaagaagacaattccctgactc

SEQ ID NO: 12064 - DNA, 60 bp, Artificial Sequence
  Description of Artificial Sequence: Synthetic probe
cgacggttgccttatttataaaacatatggaacatatattgccacacaagaagacaattc

SEQ ID NO: 12065 - DNA, 60 bp, Artificial Sequence
  Description of Artificial Sequence: Synthetic probe
cagacagtatgttccggttctattggaatccgacggttgccttatttataaaacatatgg

SEQ ID NO: 12066 - DNA, 60 bp, Artificial Sequence
  Description of Artificial Sequence: Synthetic probe
caaaatcgagtcattggtcagacagtatgttccggttctattggaatccgacggttgcct

SEQ ID NO: 12067 - DNA, 60 bp, Artificial Sequence
  Description of Artificial Sequence: Synthetic probe
tacaaaatcgagtcattggtcagacagtatgttccggttctattggaatccgacggttgc

SEQ ID NO: 12068 - DNA, 60 bp, Artificial Sequence
  Description of Artificial Sequence: Synthetic probe
agaggatcctcaccagaacctcccagtgcccttgagaccctggggggagagagagtgaga

SEQ ID NO: 12069 - DNA, 60 bp, Artificial Sequence
  Description of Artificial Sequence: Synthetic probe
ttaacagtttgttggatctgtcagacacaatgctaagaggatcctcaccagaacctccca

SEQ ID NO: 12070 - DNA, 60 bp, Artificial Sequence
  Description of Artificial Sequence: Synthetic probe
catccagaggaatctttaacagtttgttggatctgtcagacacaatgctaagaggatcct

SEQ ID NO: 12071 - DNA, 60 bp, Artificial Sequence
  Description of Artificial Sequence: Synthetic probe
cggagatgggtcaggaggaatgactgcagcattactccggtataatcggacatccagagg

SEQ ID NO: 12072 - DNA, 60 bp, Artificial Sequence
  Description of Artificial Sequence: Synthetic probe
agagccattgtatttcgtcttaaaattccgtatcatgactttctggcttgcggagatggg

SEQ ID NO: 12073 - DNA, 60 bp, Artificial Sequence
  Description of Artificial Sequence: Synthetic probe
gtcaggactcaggcttggacaactgccaactggggctcattacaaaatgagagccattgt

SEQ ID NO: 12074 - DNA, 54 bp, Artificial Sequence
  Description of Artificial Sequence: Synthetic probe
tctcaaacgatctcctcttttgctcacaagagataagacatgcttgcaaatttg

SEQ ID NO: 12075 - DNA, 50 bp, Artificial Sequence
  Description of Artificial Sequence: Synthetic probe
gcgtatatccagctctctccttagactcctttatcgaccttctctgacaa

SEQ ID NO: 12076 - DNA, 60 bp, Artificial Sequence
  Description of Artificial Sequence: Synthetic probe
aggagagaaatcattgtccctgttccccccagttggactaacaaagattcaaacagaaca

SEQ ID NO: 12077 - DNA, 60 bp, Artificial Sequence
  Description of Artificial Sequence: Synthetic probe
gctggagtgaaagacatgatggtgaaattgacagacttttttggaagtgaagatgaatat

SEQ ID NO: 12078 - DNA, 60 bp, Artificial Sequence
  Description of Artificial Sequence: Synthetic probe
agggctggagtgaaagacatgatggtgaaattgacagacttttttggaagtgaagatgaa

SEQ ID NO: 12079 - DNA, 51 bp, Artificial Sequence
  Description of Artificial Sequence: Synthetic probe
cagaagccgtattagatgtttggtctctctcaaagacatccatgaccttcc

SEQ ID NO: 12080 - DNA, 60 bp, Artificial Sequence
  Description of Artificial Sequence: Synthetic probe
ggtcactccagtgatgaacacacatccgtctcaatcagaagccgtattagatgtttggtc

SEQ ID NO: 12081 - DNA, 60 bp, Artificial Sequence
  Description of Artificial Sequence: Synthetic probe
ggagaaggggtcattatgaaggagcgccaggtgactccggatgtatataaggtcactcca

SEQ ID NO: 12082 - DNA, 60 bp, Artificial Sequence
  Description of Artificial Sequence: Synthetic probe
acatttgaagcatctggagaaggggtcattatgaaggagcgccaggtgactccggatgta

SEQ ID NO: 12083 - DNA, 60 bp, Artificial Sequence
  Description of Artificial Sequence: Synthetic probe
tccggatgtatataaggtcactccagtgatgaacacacatccgtctcaatcagaagccgt

SEQ ID NO: 12084 - DNA, 60 bp, Artificial Sequence
  Description of Artificial Sequence: Synthetic probe
ctccggatgtatataaggtcactccagtgatgaacacacatccgtaccaatcagaagccg

SEQ ID NO: 12085 - DNA, 60 bp, Artificial Sequence
  Description of Artificial Sequence: Synthetic probe
gcgccagataactccggatgtatataaggtcactccagtgatgaacacacatccgtccca

SEQ ID NO: 12086 - DNA, 60 bp, Artificial Sequence
  Description of Artificial Sequence: Synthetic probe
attatgaaggagcgccagataactccggatgtatataaggtcactccagtgatgaacaca

SEQ ID NO: 12087 - DNA, 58 bp, Artificial Sequence
  Description of Artificial Sequence: Synthetic probe
gagttggaaaagattgatgatgatataccagtcactttttccgattggacacaacctg

SEQ ID NO: 12088 - DNA, 58 bp, Artificial Sequence
  Description of Artificial Sequence: Synthetic probe
gaattggaaaagattgatgatgatataccagtcactttttctgactggacacaacctg

SEQ ID NO: 12089 - DNA, 58 bp, Artificial Sequence
  Description of Artificial Sequence: Synthetic probe
gaattggaaaagattgatgatgatataccagtcactttttctgattggacacaacctg

SEQ ID NO: 12090 - DNA, 60 bp, Artificial Sequence
  Description of Artificial Sequence: Synthetic probe
tactgactataatgctgaacatcttacgatgttgtcgccggatgaaagaatagacaaatg

SEQ ID NO: 12091 - DNA, 60 bp, Artificial Sequence
  Description of Artificial Sequence: Synthetic probe
cagaggaaatcacttcaatgggattaccagaaaccggaatcaggagcaattatttcccct

SEQ ID NO: 12092 - DNA, 60 bp, Artificial Sequence
  Description of Artificial Sequence: Synthetic probe
tttttctccgattcagaggaaatcacttcaatgggattaccagaaaccggaatcaggagc

SEQ ID NO: 12093 - DNA, 54 bp, Artificial Sequence
  Description of Artificial Sequence: Synthetic probe
caccctcaaaggccgagtgatgactcctgattgcagttcttcagtcaaatctca

SEQ ID NO: 12094 - DNA, 60 bp, Artificial Sequence
  Description of Artificial Sequence: Synthetic probe
caccctcaaaggccgagtgatgactcctgattgcagttcttcagtcaaatctcagaattc

SEQ ID NO: 12095 - DNA, 60 bp, Artificial Sequence
  Description of Artificial Sequence: Synthetic probe
gaagactgcctcaccctcaaaggccgagtgatgactcctgattgcagttcttcagtcaaa

SEQ ID NO: 12096 - DNA, 60 bp, Artificial Sequence
  Description of Artificial Sequence: Synthetic probe
gtacaactgatctcgaagagggccggagtgaaagacatgatggtgaaattgacagacttt

SEQ ID NO: 12097 - DNA, 60 bp, Artificial Sequence
  Description of Artificial Sequence: Synthetic probe
gtacacctgatctcgaagagggccggagtgaaagacatgatggtgaaattgacagacttt

SEQ ID NO: 12098 - DNA, 60 bp, Artificial Sequence
  Description of Artificial Sequence: Synthetic probe
gtacaactgatctcgaagagggccggagtgaaagacatgatggtgaaattgacagacttc

SEQ ID NO: 12099 - DNA, 60 bp, Artificial Sequence
  Description of Artificial Sequence: Synthetic probe
cggctgattacttcgaaaataacaccaacatagtattatatgtgaacaccaaagtggcac

SEQ ID NO: 12100 - DNA, 60 bp, Artificial Sequence
  Description of Artificial Sequence: Synthetic probe
cagtaaaatctcaaaattctattcagagttcggaatctctctactcctctcattccccag

SEQ ID NO: 12101 - DNA, 60 bp, Artificial Sequence
  Description of Artificial Sequence: Synthetic probe
cagtcaagtctcaaaattctattcagagttcggaatctctctactcctctcattccccag

SEQ ID NO: 12102 - DNA, 60 bp, Artificial Sequence
  Description of Artificial Sequence: Synthetic probe
aaacagagcaatggagaaaaaccattgaggcagtttgtgagagctcaaaatattggaatt

SEQ ID NO: 12103 - DNA, 60 bp, Artificial Sequence
  Description of Artificial Sequence: Synthetic probe
tgatgatgaaaccatgcaatcagcagactatttgaactatgggaaaattccaatattccg

SEQ ID NO: 12104 - DNA, 60 bp, Artificial Sequence
  Description of Artificial Sequence: Synthetic probe
tcatcaccccaggggaacatgcaacagacatatctctaatatcagatgtggaacggatac

SEQ ID NO: 12105 - DNA, 60 bp, Artificial Sequence
  Description of Artificial Sequence: Synthetic probe
tgtgactttaggtggtatggaccaaaatatataactcattccatacataatgaggaaccg

SEQ ID NO: 12106 - DNA, 60 bp, Artificial Sequence
  Description of Artificial Sequence: Synthetic probe
gcaaaattgaaattgtctttccccaacataccacaggggattggaaaagagtgccgcacg

SEQ ID NO: 12107 - DNA, 60 bp, Artificial Sequence
  Description of Artificial Sequence: Synthetic probe
ccatcaatctatgggatttaaagtccacagaggtccaattgatctccaagagagccggag

SEQ ID NO: 12108 - DNA, 60 bp, Artificial Sequence
  Description of Artificial Sequence: Synthetic probe
cagaatctctctactcctctcattctcccggtcccacgctcaaggtatcagagtccatca

SEQ ID NO: 12109 - DNA, 60 bp, Artificial Sequence
  Description of Artificial Sequence: Synthetic probe
aatggagaaaaaccattgaagcggtttgtgagagttcaaaatattggaatttgtcagaat

SEQ ID NO: 12110 - DNA, 60 bp, Artificial Sequence
  Description of Artificial Sequence: Synthetic probe
gaaatcattgtctctgttccctccagttggactaacaaagattcaaacagagcaatggag

SEQ ID NO: 12111 - DNA, 60 bp, Artificial Sequence
  Description of Artificial Sequence: Synthetic probe
ccagtctatgggacttaagatcaacagaagtacaattgatctcgaagagggctggagtga

SEQ ID NO: 12112 - DNA, 60 bp, Artificial Sequence
  Description of Artificial Sequence: Synthetic probe
cgactagtctatgggacttaagatcaacagaagtacaactaatctcgaagagggccggag

SEQ ID NO: 12113 - DNA, 60 bp, Artificial Sequence
  Description of Artificial Sequence: Synthetic probe
caaccagtctatgggacttaagatcaacagaagtacaattgatctcgaagagggctggag

SEQ ID NO: 12114 - DNA, 60 bp, Artificial Sequence
  Description of Artificial Sequence: Synthetic probe
ataaggtcactccagtgatgaacacacatccgtcccaatcagaatccgtatcagatgttt

SEQ ID NO: 12115 - DNA, 60 bp, Artificial Sequence
  Description of Artificial Sequence: Synthetic probe
cagataattgtcttatcctcaaaggtagagttatgactcctgactgcagttcatcaatca

SEQ ID NO: 12116 - DNA, 60 bp, Artificial Sequence
  Description of Artificial Sequence: Synthetic probe
cagataattgtcttatcctcaaaggcagagttatgactcctgactgcagttcatcaatca

SEQ ID NO: 12117 - DNA, 60 bp, Artificial Sequence
  Description of Artificial Sequence: Synthetic probe
cagataattgtcttatcctcaaagtccgagttatgactcctgactgcagttcatcaatca

SEQ ID NO: 12118 - DNA, 60 bp, Artificial Sequence
  Description of Artificial Sequence: Synthetic probe
tcagataattgtcttatcctcaaaggcagagttatgactcctgactgcagttcatcaatc

SEQ ID NO: 12119 - DNA, 60 bp, Artificial Sequence
  Description of Artificial Sequence: Synthetic probe
gtgatgatatcgacaatttgatcaggaaattcaattctcttccaattccctcgatgtggg

SEQ ID NO: 12120 - DNA, 58 bp, Artificial Sequence
  Description of Artificial Sequence: Synthetic probe
tcctctaattagtgatgatattgacaatttgatcaggaaattcaattctcttccgatt

SEQ ID NO: 12121 - DNA, 60 bp, Artificial Sequence
  Description of Artificial Sequence: Synthetic probe
tccatacataatgaagagcctacagattatcaatgtttggaggccattaagtcatacaaa

SEQ ID NO: 12122 - DNA, 53 bp, Artificial Sequence
  Description of Artificial Sequence: Synthetic probe
aagcagattcatacatgccgtatatgatcgactttgggttatctcagaaatcc

SEQ ID NO: 12123 - DNA, 60 bp, Artificial Sequence
  Description of Artificial Sequence: Synthetic probe
gggaagttgcagacgagctatgtcagatgatgtatccgggtcaagaaattgacaaagcag

SEQ ID NO: 12124 - DNA, 60 bp, Artificial Sequence
  Description of Artificial Sequence: Synthetic probe
atgtgagcaccaaagtagcactaaatgatttgagggcatacgtataccaggggatcaagt

SEQ ID NO: 12125 - DNA, 60 bp, Artificial Sequence
  Description of Artificial Sequence: Synthetic probe
atcattgtctctgttccctccagttggactaacaaagattcaaacagaacaatggagaaa

SEQ ID NO: 12126 - DNA, 60 bp, Artificial Sequence
  Description of Artificial Sequence: Synthetic probe
gaaatccttgtctctgttccctccagttggactaacaaagattcaaacagaacaatggag

SEQ ID NO: 12127 - DNA, 60 bp, Artificial Sequence
  Description of Artificial Sequence: Synthetic probe
gaaatcattgtctctgttccctccagttggactaacaaagattcaaacagaacaatggag

SEQ ID NO: 12128 - DNA, 57 bp, Artificial Sequence
  Description of Artificial Sequence: Synthetic probe
actggagacaaggcctgcaaaatgcagtactgcaagcattggggagtcagactccca

SEQ ID NO: 12129 - DNA, 60 bp, Artificial Sequence
  Description of Artificial Sequence: Synthetic probe
gaaactggagacaaggcctgcaaaatgcagtactgcaagcattggggagtcagactccca

SEQ ID NO: 12130 - DNA, 60 bp, Artificial Sequence
  Description of Artificial Sequence: Synthetic probe
caaagttgtggatatgcaactgtgacggatgctgaagcagtgattgtccaggtgactcct

SEQ ID NO: 12131 - DNA, 60 bp, Artificial Sequence
  Description of Artificial Sequence: Synthetic probe
atgatgatataccggtcaccttccctaattggactcaacctgtaatgaaggagaatggtg

SEQ ID NO: 12132 - DNA, 60 bp, Artificial Sequence
  Description of Artificial Sequence: Synthetic probe
tactgactacaatgctgagcatcttacgatgttgtcgccagatgaaagaatagacaagtg

SEQ ID NO: 12133 - DNA, 60 bp, Artificial Sequence
  Description of Artificial Sequence: Synthetic probe
gtctatactgatgttgaagagtgacctacatgaggaaaactcttggagagattaaaaaat

SEQ ID NO: 12134 - DNA, 55 bp, Artificial Sequence
  Description of Artificial Sequence: Synthetic probe
ctcgatgtgggatagtaagaactgggatggagttcttgagatgttaacatcatgg

SEQ ID NO: 12135 - DNA, 51 bp, Artificial Sequence
  Description of Artificial Sequence: Synthetic probe
ctcgatgtgggatagtaagaactgggatggagttcttgagatgttaacatc

SEQ ID NO: 12136 - DNA, 60 bp, Artificial Sequence
  Description of Artificial Sequence: Synthetic probe
aatttgatcaggaaattcaattctcttccgattccctcgatgtgggatagtaagaactgg

SEQ ID NO: 12137 - DNA, 60 bp, Artificial Sequence
  Description of Artificial Sequence: Synthetic probe
agtgatgatattgacaatttgatcaggaaattcaattctcttccgattccctcgatgtgg

SEQ ID NO: 12138 - DNA, 56 bp, Artificial Sequence
  Description of Artificial Sequence: Synthetic probe
ccgtcccaatcagaagccgtatcagatgtttggtctctctcgaagacatccatgac

SEQ ID NO: 12139 - DNA, 60 bp, Artificial Sequence
  Description of Artificial Sequence: Synthetic probe
aggagagaaatcattgtctctgttccctccagttggactaacaaagattcaaacagagca

SEQ ID NO: 12140 - DNA, 60 bp, Artificial Sequence
  Description of Artificial Sequence: Synthetic probe
cggaatctctctactcctctcattccccaggtcccacaatcaaggtatcagagtccatca

SEQ ID NO: 12141 - DNA, 60 bp, Artificial Sequence
  Description of Artificial Sequence: Synthetic probe
cggaatctctctactcctctcattccccaggtcccacactcaaggtatcagagtccatca

SEQ ID NO: 12142 - DNA, 60 bp, Artificial Sequence
  Description of Artificial Sequence: Synthetic probe
tgattgcagctcatcggttaaatctcagaattctgtacagagttccgaatctctctactc

SEQ ID NO: 12143 - DNA, 60 bp, Artificial Sequence
  Description of Artificial Sequence: Synthetic probe
cttcagatgattgtctcactctcagaggacgagtcatgactcctgattgcagctcatcgg

SEQ ID NO: 12144 - DNA, 60 bp, Artificial Sequence
  Description of Artificial Sequence: Synthetic probe
attgtaacttcagatgattgtctcactctcagaggacgagtcatgactcctgattgcagc

SEQ ID NO: 12145 - DNA, 60 bp, Artificial Sequence
  Description of Artificial Sequence: Synthetic probe
gcgccagatgactccggatgtatataaggtcactccggtgatgaacacacatccgtccca

SEQ ID NO: 12146 - DNA, 60 bp, Artificial Sequence
  Description of Artificial Sequence: Synthetic probe
ggagaaggagtcattatgaaggagcgccagatgactccggatgtatataaggtcactcca

SEQ ID NO: 12147 - DNA, 60 bp, Artificial Sequence
  Description of Artificial Sequence: Synthetic probe
gcactaaagtggcactaaatgacttgagggcttatgtctaccaggggatcaagtctggca

SEQ ID NO: 12148 - DNA, 53 bp, Artificial Sequence
  Description of Artificial Sequence: Synthetic probe
ggggtaattatgaaggagcgccagatgactccagatgtatataaggtcacccc

SEQ ID NO: 12149 - DNA, 60 bp, Artificial Sequence
  Description of Artificial Sequence: Synthetic probe
tcaaagctgttgtccaaagtgctaagtactggaacttggcagaatgcacttttgaggcat

SEQ ID NO: 12150 - DNA, 60 bp, Artificial Sequence
  Description of Artificial Sequence: Synthetic probe
ctgagggtttaagtggagagcaaaagtctcaatggctttctactatcaaagctgttgtcc

SEQ ID NO: 12151 - DNA, 60 bp, Artificial Sequence
  Description of Artificial Sequence: Synthetic probe
actgcctgagggtttaagtggagagcaaaagtctcaatggctttctactatcaaagctgt

SEQ ID NO: 12152 - DNA, 60 bp, Artificial Sequence
  Description of Artificial Sequence: Synthetic probe
ccacaccggacatgctaaatttcgcaagaagagcggtcaactccctacaagcactccgtg

SEQ ID NO: 12153 - DNA, 60 bp, Artificial Sequence
  Description of Artificial Sequence: Synthetic probe
gaaaacccacaccggacatgctaaatttcgcaagaagagcggtcaactccctacaagcac

SEQ ID NO: 12154 - DNA, 60 bp, Artificial Sequence
  Description of Artificial Sequence: Synthetic probe
ccacaccggacatgctaaatttcgcaagaagagcagtcaactccctacaagcactccgtg

SEQ ID NO: 12155 - DNA, 60 bp, Artificial Sequence
  Description of Artificial Sequence: Synthetic probe
aacccacaccggacatgctaaatttcgcaagaagagcagtcaactccctacaagcactcc

SEQ ID NO: 12156 - DNA, 60 bp, Artificial Sequence
  Description of Artificial Sequence: Synthetic probe
ccagccttccacttctggggtcaacttgcagcactcctattaagatctactcgcgcaaag

SEQ ID NO: 12157 - DNA, 60 bp, Artificial Sequence
  Description of Artificial Sequence: Synthetic probe
acccagccttccacttctggggtcaacttgcagcactcctattaagatctactcgcgcaa

SEQ ID NO: 12158 - DNA, 60 bp, Artificial Sequence
  Description of Artificial Sequence: Synthetic probe
acaggggcctttagatgactatgcagatgaggaagtggatgttgtatttacttcggactg

SEQ ID NO: 12159 - DNA, 60 bp, Artificial Sequence
  Description of Artificial Sequence: Synthetic probe
agttgaaggctttatacaggggcctttagatgactatgcagatgaggaagtggatgttgt

SEQ ID NO: 12160 - DNA, 60 bp, Artificial Sequence
  Description of Artificial Sequence: Synthetic probe
gaagggcacagggttcagaagtaactactttgcttatgaaactggagacaaggcctgcaa

SEQ ID NO: 12161 - DNA, 60 bp, Artificial Sequence
  Description of Artificial Sequence: Synthetic probe
gagggtacagggttcagaagtaactactttgcttatgaaactggagacaaggcctgcaaa

SEQ ID NO: 12162 - DNA, 60 bp, Artificial Sequence
  Description of Artificial Sequence: Synthetic probe
ggagggcacagggttcagaagtaactactttgcttatgaaactggagacaaggcctgcaa

SEQ ID NO: 12163 - DNA, 60 bp, Artificial Sequence
  Description of Artificial Sequence: Synthetic probe
ggagggtacagggttcagaagtaactactttgcttatgaaactggagacaaggcctgcaa

SEQ ID NO: 12164 - DNA, 60 bp, Artificial Sequence
  Description of Artificial Sequence: Synthetic probe
ccctaggaaaggagggtacagggttcagaagtaactactttgcttatgaaactggagaca

SEQ ID NO: 12165 - DNA, 60 bp, Artificial Sequence
  Description of Artificial Sequence: Synthetic probe
acttaataggcacagccttacaagtcaaaatgcccaagagtcacaaggctattcaagcag

SEQ ID NO: 12166 - DNA, 60 bp, Artificial Sequence
  Description of Artificial Sequence: Synthetic probe
gacttaataggcacagccttacaagtcaaaatgcccaagagtcacaaggctattcaagca

SEQ ID NO: 12167 - DNA, 60 bp, Artificial Sequence
  Description of Artificial Sequence: Synthetic probe
gacttaataggcacagccttacaggtcaaaatgcccaagagtcacaaggctattcaagca

SEQ ID NO: 12168 - DNA, 60 bp, Artificial Sequence
  Description of Artificial Sequence: Synthetic probe
gacttaataggcacagccttgcaagtcaaaatgcccaagagtcacaaggctattcaagca

SEQ ID NO: 12169 - DNA, 60 bp, Artificial Sequence
  Description of Artificial Sequence: Synthetic probe
gacttaataggcacagccatacaagtcaaaatgcccaagagtcacaaggctattcaagca

SEQ ID NO: 12170 - DNA, 60 bp, Artificial Sequence
  Description of Artificial Sequence: Synthetic probe
atgacttaataggcacagccttacaagtcaaaatgcccaagagtcacaaggctattcaag

SEQ ID NO: 12171 - DNA, 60 bp, Artificial Sequence
  Description of Artificial Sequence: Synthetic probe
taatgacttaataggcacagccttacaagtcaaaatgcccaagagtcacaaggctattca

SEQ ID NO: 12172 - DNA, 60 bp, Artificial Sequence
  Description of Artificial Sequence: Synthetic probe
gcccgacagccagatgacattgaatatacatcactgacttgtgcaagcctactactgtca

SEQ ID NO: 12173 - DNA, 60 bp, Artificial Sequence
  Description of Artificial Sequence: Synthetic probe
atgcccgacagccagatgacattgaatatacatcactgacttgtgcaagcctactactgt

SEQ ID NO: 12174 - DNA, 60 bp, Artificial Sequence
  Description of Artificial Sequence: Synthetic probe
gtcaacttgcagcactcctgttaagatctactcgtgcaaaaaatgcccgacagccagatg

SEQ ID NO: 12175 - DNA, 60 bp, Artificial Sequence
  Description of Artificial Sequence: Synthetic probe
cttctggggtcaacttgcagcactcctgttaagatctactcgtgcaaaaaatgcccgaca

SEQ ID NO: 12176 - DNA, 60 bp, Artificial Sequence
  Description of Artificial Sequence: Synthetic probe
ggaaccatagtatcacggttcaaggactgtgcagcgttagcaacatttggacatctcagt

SEQ ID NO: 12177 - DNA, 60 bp, Artificial Sequence
  Description of Artificial Sequence: Synthetic probe
taagatatggaaccatagtatcacggttcaaggactgtgcagcgttagcaacatttggac

SEQ ID NO: 12178 - DNA, 60 bp, Artificial Sequence
  Description of Artificial Sequence: Synthetic probe
gtcgaagatggattggatttttttgacatatgggaaaatgatccgaatttcaccaagata

SEQ ID NO: 12179 - DNA, 60 bp, Artificial Sequence
  Description of Artificial Sequence: Synthetic probe
gtcgaagatggattggatttttttgacatatgggaaaatgatccgaacttcaccaagata

SEQ ID NO: 12180 - DNA, 60 bp, Artificial Sequence
  Description of Artificial Sequence: Synthetic probe
cggtctagagaaccagtgcaaagtagcatcaaccagattcgaaagtctagtcgaagatgg

SEQ ID NO: 12181 - DNA, 60 bp, Artificial Sequence
  Description of Artificial Sequence: Synthetic probe
acggtctagagaaccagtgcaaagtagcatcaaccagattcgaaagtctagtcgaagatg

SEQ ID NO: 12182 - DNA, 60 bp, Artificial Sequence
  Description of Artificial Sequence: Synthetic probe
ggtctagagaaccagtgcaaagtagcatcaaccagatttgaaagtctagtcgaagatgga

SEQ ID NO: 12183 - DNA, 60 bp, Artificial Sequence
  Description of Artificial Sequence: Synthetic probe
atggtctagagaaccagtgcaaagtagcatcaaccagatttgaaagtctagtcgaagatg

SEQ ID NO: 12184 - DNA, 60 bp, Artificial Sequence
  Description of Artificial Sequence: Synthetic probe
atacttgattatgctctttgtcaaaacacttggagcaagatagaggcaggagaaccaata

SEQ ID NO: 12185 - DNA, 50 bp, Artificial Sequence
  Description of Artificial Sequence: Synthetic probe
ttctctgattcagaggaaatcacttcaatgggattaccagaaaccggaat

SEQ ID NO: 12186 - DNA, 60 bp, Artificial Sequence
  Description of Artificial Sequence: Synthetic probe
ccgatggggagagtgtatgcagtcaattattcacactggtcgggggaacctttttctccg

SEQ ID NO: 12187 - DNA, 55 bp, Artificial Sequence
  Description of Artificial Sequence: Synthetic probe
attttctcggaggaagatgcaaagggaatatctgtgaaaccgttcataattctac

SEQ ID NO: 12188 - DNA, 51 bp, Artificial Sequence
  Description of Artificial Sequence: Synthetic probe
acacataataacagtcactccccactctgttaaagttgatgagtataccgg

SEQ ID NO: 12189 - DNA, 60 bp, Artificial Sequence
  Description of Artificial Sequence: Synthetic probe
atacaaggatggagttagtttcaatcctggatttcctccccagagctgcggatatggttc

SEQ ID NO: 12190 - DNA, 60 bp, Artificial Sequence
  Description of Artificial Sequence: Synthetic probe
gaggaacctacggattatcagtgcttggaggccatcaaagcatacaaggatggagttagt

SEQ ID NO: 12191 - DNA, 60 bp, Artificial Sequence
  Description of Artificial Sequence: Synthetic probe
atacataatgaggaacctacggattatcagtgcttggaggccatcaaagcatacaaggat

SEQ ID NO: 12192 - DNA, 60 bp, Artificial Sequence
  Description of Artificial Sequence: Synthetic probe
aacagacatcaatatgttgtcttatctcatcctagcaattgctgtctcgcccatcttggg

SEQ ID NO: 12193 - DNA, 60 bp, Artificial Sequence
  Description of Artificial Sequence: Synthetic probe
aacagacatcaatatgttgtcttatctcatcctcgcaattgccgtctcgcccatcttggg

SEQ ID NO: 12194 - DNA, 60 bp, Artificial Sequence
  Description of Artificial Sequence: Synthetic probe
agaagaggtaatctattatggggacactggagtatccaaaaatcccgttgagttagtaga

SEQ ID NO: 12195 - DNA, 60 bp, Artificial Sequence
  Description of Artificial Sequence: Synthetic probe
atcaaaatggaaaggattgtaaaacattgggagcacccacacatagaagctgctcagacg

SEQ ID NO: 12196 - DNA, 60 bp, Artificial Sequence
  Description of Artificial Sequence: Synthetic probe
cgagttgagttagaaaatcctgttatacccagaatggaagggaaagttgcggggacccgg

SEQ ID NO: 12197 - DNA, 60 bp, Artificial Sequence
  Description of Artificial Sequence: Synthetic probe
cggatacttgattatgctctttgtcaaaatacctggagcaagattgaagcaggagaacca

SEQ ID NO: 12198 - DNA, 60 bp, Artificial Sequence
  Description of Artificial Sequence: Synthetic probe
gcagaaagccagggtataagcttaagaatgacctctggttccaaattgcagacccagact

SEQ ID NO: 12199 - DNA, 60 bp, Artificial Sequence
  Description of Artificial Sequence: Synthetic probe
aacagttcataattccacaaagtggtttacatcttcagatggggaaagtgtatgcagcca

SEQ ID NO: 12200 - DNA, 60 bp, Artificial Sequence
  Description of Artificial Sequence: Synthetic probe
gagaatggatcgaccctcattttataggaggaaggtgcaaagggaatatctgtgaaacag

SEQ ID NO: 12201 - DNA, 60 bp, Artificial Sequence
  Description of Artificial Sequence: Synthetic probe
ggtccagcacccaaagtcacggaatcaaatagtctatgggacttaaaatcaaccgaagta

SEQ ID NO: 12202 - DNA, 60 bp, Artificial Sequence
  Description of Artificial Sequence: Synthetic probe
gaagaccattgaggcagtctgtgagagctctaagtattggaatttgtcagaatgccagat

SEQ ID NO: 12203 - DNA, 60 bp, Artificial Sequence
  Description of Artificial Sequence: Synthetic probe
cctccggttggattgacaaaagttcagacagaccaatggaggaagaccattgaggcagtc

SEQ ID NO: 12204 - DNA, 60 bp, Artificial Sequence
  Description of Artificial Sequence: Synthetic probe
agtcaactctctgcagtcacttcgtgaaaagacaattggcaaatatgccaaggcagagtt

SEQ ID NO: 12205 - DNA, 60 bp, Artificial Sequence
  Description of Artificial Sequence: Synthetic probe
ggcagtctgtgagagctcaaaatattggaatttatcggagtgccggattgtaacttcaga

SEQ ID NO: 12206 - DNA, 60 bp, Artificial Sequence
  Description of Artificial Sequence: Synthetic probe
tgaggcagtctgtgagagctcaaaatattggaatttatcggagtgccggattgtaacttc

SEQ ID NO: 12207 - DNA, 60 bp, Artificial Sequence
  Description of Artificial Sequence: Synthetic probe
ttgaggcagtctgtgagagctcaaaatattggaatttatcagagtgccggattgtaactt

SEQ ID NO: 12208 - DNA, 60 bp, Artificial Sequence
  Description of Artificial Sequence: Synthetic probe
ttccgaatctttctcctcctcgcattcactcggtccagcaccaaaagtcacagagtcaac

SEQ ID NO: 12209 - DNA, 60 bp, Artificial Sequence
  Description of Artificial Sequence: Synthetic probe
gtctgtgagagctctaaatattggaatttatcagaatgccaaattgtgaactcagataat

SEQ ID NO: 12210 - DNA, 60 bp, Artificial Sequence
  Description of Artificial Sequence: Synthetic probe
ggagggaaacccacaccggatatgctcaacttcgcacgaagagcagtcagttcgttgcag

SEQ ID NO: 12211 - DNA, 60 bp, Artificial Sequence
  Description of Artificial Sequence: Synthetic probe
ggaggaaaacccacaccagatatgctcaacttcgcacgaagagcagtcagttcgttgcag

SEQ ID NO: 12212 - DNA, 60 bp, Artificial Sequence
  Description of Artificial Sequence: Synthetic probe
aatctgatgtcccaccgaaaggaagaaatgttgtcgactggcttggttggtatgatgaca

SEQ ID NO: 12213 - DNA, 51 bp, Artificial Sequence
  Description of Artificial Sequence: Synthetic probe
agcaaaaaatgctcggcaacccgatgacattgagtacacttcgctgacttg

SEQ ID NO: 12214 - DNA, 60 bp, Artificial Sequence
  Description of Artificial Sequence: Synthetic probe
tggggtcaactggctgcactcttgctaagatcaactcgagcaaaaaatgctcggcaaccc

SEQ ID NO: 12215 - DNA, 60 bp, Artificial Sequence
  Description of Artificial Sequence: Synthetic probe
gctttccacttctggggtcaactggccgcactcttgctaagatcaactcgagcaaaaaat

SEQ ID NO: 12216 - DNA, 60 bp, Artificial Sequence
  Description of Artificial Sequence: Synthetic probe
gagaagtcgcagacgaactatgccaaatgatgtacccaggtcaagaaattgataaggcgg

SEQ ID NO: 12217 - DNA, 60 bp, Artificial Sequence
  Description of Artificial Sequence: Synthetic probe
ctgaatcgagaagtcgcagacgaactatgccaaatgatgtacccaggtcaagaaattgat

SEQ ID NO: 12218 - DNA, 60 bp, Artificial Sequence
  Description of Artificial Sequence: Synthetic probe
catgggttctgaatcgagaagtcgcagacgaactatgccaaatgatgtacccaggccaag

SEQ ID NO: 12219 - DNA, 60 bp, Artificial Sequence
  Description of Artificial Sequence: Synthetic probe
caacatgggttctgaatcgagaagtcgcagacgaactatgccaaatgatgtacccaggcc

SEQ ID NO: 12220 - DNA, 60 bp, Artificial Sequence
  Description of Artificial Sequence: Synthetic probe
acatcctaggcctatatcgagtgggtagatccaaagttacagattacagaaagaaactcc

SEQ ID NO: 12221 - DNA, 60 bp, Artificial Sequence
  Description of Artificial Sequence: Synthetic probe
acatcctaggcctctaccgagtaggtagatccaaagttacagattacagaaagaaactcc

SEQ ID NO: 12222 - DNA, 60 bp, Artificial Sequence
  Description of Artificial Sequence: Synthetic probe
gctcttcctgacgggaaatcggatccagatcgatcagctgaagatgataaatggcttcct

SEQ ID NO: 12223 - DNA, 60 bp, Artificial Sequence
  Description of Artificial Sequence: Synthetic probe
gctcttcctgatgggaaatcggatccagatcgatcagctgaagatgataaatggcttcct

SEQ ID NO: 12224 - DNA, 60 bp, Artificial Sequence
  Description of Artificial Sequence: Synthetic probe
agctcttcctgacgggaaatcggatccagatcgatcagctgaagatgataaatggcttcc

SEQ ID NO: 12225 - DNA, 60 bp, Artificial Sequence
  Description of Artificial Sequence: Synthetic probe
agctcttcctgatgggaaatcggatccagatcgatcagctgaagatgataaatggcttcc

SEQ ID NO: 12226 - DNA, 60 bp, Artificial Sequence
  Description of Artificial Sequence: Synthetic probe
gtaccctaaaatactttgagaccagatacatcagagtcgatattgctgctccaatcctct

SEQ ID NO: 12227 - DNA, 60 bp, Artificial Sequence
  Description of Artificial Sequence: Synthetic probe
cggtactctgaaatactttgagaccagatacatcagagtcgatattgctgctccaattct

SEQ ID NO: 12228 - DNA, 60 bp, Artificial Sequence
  Description of Artificial Sequence: Synthetic probe
ccaaattctgaacttagaagactgcctcacccttaaaggccgagtgatgactcctgattg

SEQ ID NO: 12229 - DNA, 60 bp, Artificial Sequence
  Description of Artificial Sequence: Synthetic probe
tcagaatgccaaattctgaacttagaagactgcctcaccctcaaaggccgagtgatgact

SEQ ID NO: 12230 - DNA, 60 bp, Artificial Sequence
  Description of Artificial Sequence: Synthetic probe
ttgtcagaatgccaaattctgaacttagaagactgcctcacccttaaaggccgagtgatg

SEQ ID NO: 12231 - DNA, 60 bp, Artificial Sequence
  Description of Artificial Sequence: Synthetic probe
gaggtgcaactgacctcaaagagagcaggagttaaggacatgaccgtaaagttaacagac

SEQ ID NO: 12232 - DNA, 60 bp, Artificial Sequence
  Description of Artificial Sequence: Synthetic probe
aagtctacagaggtgcaactgacctcaaagagagcaggagttaaggacatgaccgtaaag

SEQ ID NO: 12233 - DNA, 51 bp, Artificial Sequence
  Description of Artificial Sequence: Synthetic probe
ttaaagtagatgagtatactggagaatggattgacccacatttcatcgggg

SEQ ID NO: 12234 - DNA, 60 bp, Artificial Sequence
  Description of Artificial Sequence: Synthetic probe
ttaaagtagatgagtatactggagaatggattgacccacatttcatcgggggaagatgca

SEQ ID NO: 12235 - DNA, 54 bp, Artificial Sequence
  Description of Artificial Sequence: Synthetic probe
ctgtgaaagtagatgagtatactggagaatggattgacccacatttcatcgggg

SEQ ID NO: 12236 - DNA, 60 bp, Artificial Sequence
  Description of Artificial Sequence: Synthetic probe
ctgtgaaagtagatgagtatactggagaatggattgacccacatttcatcgggggaagat

SEQ ID NO: 12237 - DNA, 60 bp, Artificial Sequence
  Description of Artificial Sequence: Synthetic probe
ctcactctgttaaagtagatgagtatactggagaatggattgacccacatttcatcgggg

SEQ ID NO: 12238 - DNA, 58 bp, Artificial Sequence
  Description of Artificial Sequence: Synthetic probe
tacagagttccgaatctctctactcctcccattcacccggacctgcacctagagcatc

SEQ ID NO: 12239 - DNA, 60 bp, Artificial Sequence
  Description of Artificial Sequence: Synthetic probe
taaatctcagaattctgtacagagttccgaatctctctactcctcccattcacccggacc

SEQ ID NO: 12240 - DNA, 60 bp, Artificial Sequence
  Description of Artificial Sequence: Synthetic probe
ccatcatcatgggattgaagtacaagaaactcttcaatcaggcaagaatgaagtatcgcc

SEQ ID NO: 12241 - DNA, 60 bp, Artificial Sequence
  Description of Artificial Sequence: Synthetic probe
tgggagccatcatcatgggattgaagtacaagaaactcttcaatcaggcaagaatgaagt

SEQ ID NO: 12242 - DNA, 60 bp, Artificial Sequence
  Description of Artificial Sequence: Synthetic probe
aaatattggaatttatcagaatgccaaattcttaacttagaagactgcctcactctcaaa

SEQ ID NO: 12243 - DNA, 56 bp, Artificial Sequence
  Description of Artificial Sequence: Synthetic probe
gccttgcaggatgccaatgaatctgaggaaagacgagaggataaatatctccaaga

SEQ ID NO: 12244 - DNA, 56 bp, Artificial Sequence
  Description of Artificial Sequence: Synthetic probe
gccctgcaggatgccaatgaatctgaggaaagacgagaggataaatatctccaaga

SEQ ID NO: 12245 - DNA, 60 bp, Artificial Sequence
  Description of Artificial Sequence: Synthetic probe
gtctgtgagagctctaaatattggaatttgtcagaatgccagattatgaactcagatgat

SEQ ID NO: 12246 - DNA, 60 bp, Artificial Sequence
  Description of Artificial Sequence: Synthetic probe
gtctgtgagagctctaaatattggaatttgtcagaatgccagattatgaactcagaagat

SEQ ID NO: 12247 - DNA, 58 bp, Artificial Sequence
  Description of Artificial Sequence: Synthetic probe
gtctgtgagagctctaaatattggaatttgtcagaatgccagattatgaactcagaag

SEQ ID NO: 12248 - DNA, 50 bp, Artificial Sequence
  Description of Artificial Sequence: Synthetic probe
aacagatatcatggacagtgttgatcggctcaagacttatttggctactt

SEQ ID NO: 12249 - DNA, 50 bp, Artificial Sequence
  Description of Artificial Sequence: Synthetic probe
aacagatatcatggacagtgttgatcggctcaagacttacttagctactt

SEQ ID NO: 12250 - DNA, 60 bp, Artificial Sequence
  Description of Artificial Sequence: Synthetic probe
tgggtatggtacggtcacggacgctgaagcccatattataacagtcactcctcactctgt

SEQ ID NO: 12251 - DNA, 60 bp, Artificial Sequence
  Description of Artificial Sequence: Synthetic probe
tttaatccagggttccctcctcagagttgtgggtatggtacggtcacggacgctgaagcc

SEQ ID NO: 12252 - DNA, 60 bp, Artificial Sequence
  Description of Artificial Sequence: Synthetic probe
caagcagacggttggatgtgtcatgcttccaaatgggttactacttgcgacttccgctgg

SEQ ID NO: 12253 - DNA, 60 bp, Artificial Sequence
  Description of Artificial Sequence: Synthetic probe
tattcaagcagacggttggatgtgtcatgcttccaaatgggtcactacttgtgatttccg

SEQ ID NO: 12254 - DNA, 60 bp, Artificial Sequence
  Description of Artificial Sequence: Synthetic probe
cccaagagtcacaaggctattcaagctgacggttggatgtgtcatgcttccaaatgggtc

SEQ ID NO: 12255 - DNA, 55 bp, Artificial Sequence
  Description of Artificial Sequence: Synthetic probe
ttcctgctgagtactttggaaaatccagggagatcccggtgttcatctcaactcg

SEQ ID NO: 12256 - DNA, 60 bp, Artificial Sequence
  Description of Artificial Sequence: Synthetic probe
ggacccaggttgtggcggctttgcctgcgagcgaagacccagtagaatttcctgctgagt

SEQ ID NO: 12257 - DNA, 60 bp, Artificial Sequence
  Description of Artificial Sequence: Synthetic probe
cgggacccaggttgtggcggctttgcctgcgagcgaagacccagtagaatttcctgctga

SEQ ID NO: 12258 - DNA, 60 bp, Artificial Sequence
  Description of Artificial Sequence: Synthetic probe
atcatcatgtctgtgtccgtgaagcgcatttcaaccgggacccaggttgtggcggctttg

SEQ ID NO: 12259 - DNA, 60 bp, Artificial Sequence
  Description of Artificial Sequence: Synthetic probe
aacattttaacagatatcatcatgtctgtgtccgtgaagcgcatttcaaccgggacccag

SEQ ID NO: 12260 - DNA, 50 bp, Artificial Sequence
  Description of Artificial Sequence: Synthetic probe
aacagacatcaaaatggctcctacagtcaagagaattgtcaatgactcta

SEQ ID NO: 12261 - DNA, 60 bp, Artificial Sequence
  Description of Artificial Sequence: Synthetic probe
ggctcctacagttaagagaatcattaacgactcaataattcagcctaaactaccggccaa

SEQ ID NO: 12262 - DNA, 60 bp, Artificial Sequence
  Description of Artificial Sequence: Synthetic probe
ggctcctacagttaagagaatcattaacgactcaattattcagcctaaattaccggccaa

SEQ ID NO: 12263 - DNA, 60 bp, Artificial Sequence
  Description of Artificial Sequence: Synthetic probe
ggctcctacagttaagagaatcattaacgactcaattattcagccgaaattaccggccaa

SEQ ID NO: 12264 - DNA, 60 bp, Artificial Sequence
  Description of Artificial Sequence: Synthetic probe
gcaggagtcaaagacatgacagtcaagttaacagacttctttggaagtgaggaagagtat

SEQ ID NO: 12265 - DNA, 60 bp, Artificial Sequence
  Description of Artificial Sequence: Synthetic probe
gagcaggagtcaaggacatgacagtcaagttaacagacttctttggaagtgaggaagagt

SEQ ID NO: 12266 - DNA, 60 bp, Artificial Sequence
  Description of Artificial Sequence: Synthetic probe
gagcaggagtcaaagacatgacagtcaagttaacagacttctttggaagtgaggaagagt

SEQ ID NO: 12267 - DNA, 60 bp, Artificial Sequence
  Description of Artificial Sequence: Synthetic probe
agagcaggagtcaaagacatgacagtcaagttaacagacttctttggaagtgaggaagag

SEQ ID NO: 12268 - DNA, 60 bp, Artificial Sequence
  Description of Artificial Sequence: Synthetic probe
cctcaaagagagcaggagtcaaggacatgacagtcaagttaacagacttctttggaagtg

SEQ ID NO: 12269 - DNA, 60 bp, Artificial Sequence
  Description of Artificial Sequence: Synthetic probe
ggacctgaagtcaacagaagtccaactgacctcaaagagagcaggagtcaaagacatgac

SEQ ID NO: 12270 - DNA, 60 bp, Artificial Sequence
  Description of Artificial Sequence: Synthetic probe
atcagggtcaatgaatttatgggacttgaagtcaacagaagtccaactgacctcaaagag

SEQ ID NO: 12271 - DNA, 60 bp, Artificial Sequence
  Description of Artificial Sequence: Synthetic probe
taactcctgattgcagttcatcagttaaatctcagaattctgtacggagttcagaatctc

SEQ ID NO: 12272 - DNA, 60 bp, Artificial Sequence
  Description of Artificial Sequence: Synthetic probe
cagaggacgagttataactcctgattgcagttcatcagttaaatctcagaattctgtacg

SEQ ID NO: 12273 - DNA, 60 bp, Artificial Sequence
  Description of Artificial Sequence: Synthetic probe
tgaacatcttacgatgttgtcgccagatgagagagtagacaagtgggaagaagacttgcc

SEQ ID NO: 12274 - DNA, 60 bp, Artificial Sequence
  Description of Artificial Sequence: Synthetic probe
tgaacatcttacgatgctgtcgccagacgagagagtagacaagtgggaagaagacttgcc

SEQ ID NO: 12275 - DNA, 60 bp, Artificial Sequence
  Description of Artificial Sequence: Synthetic probe
agttaactctctgcagtcacttcgtgagaagacaattggcaaatatgccaaggcagagtt

SEQ ID NO: 12276 - DNA, 60 bp, Artificial Sequence
  Description of Artificial Sequence: Synthetic probe
agtcaactctctgcagtcacttcgtgagaagacaattggcaaatatgccaaggcagagtt

SEQ ID NO: 12277 - DNA, 60 bp, Artificial Sequence
  Description of Artificial Sequence: Synthetic probe
ctatgggattcaaaatcaacagaagtacaactgatctcgaagagggccggagtgaaggac

SEQ ID NO: 12278 - DNA, 60 bp, Artificial Sequence
  Description of Artificial Sequence: Synthetic probe
cgatccgaacttcaccaagatagttgcagcagtagatatgttctttcatatgttcaagaa

SEQ ID NO: 12279 - DNA, 60 bp, Artificial Sequence
  Description of Artificial Sequence: Synthetic probe
gagtgccagattgtaacttcaggaaattgtcttattttgaggggacaagttatgacctct

SEQ ID NO: 12280 - DNA, 60 bp, Artificial Sequence
  Description of Artificial Sequence: Synthetic probe
tattggaatttgtcagagtgccagattgtaacttcaggaaattgtcttattttgagggga

SEQ ID NO: 12281 - DNA, 60 bp, Artificial Sequence
  Description of Artificial Sequence: Synthetic probe
gacagtctgtgagagctcaaaatattggaatttgtcagagtgccagattgtaacttcagg

SEQ ID NO: 12282 - DNA, 60 bp, Artificial Sequence
  Description of Artificial Sequence: Synthetic probe
gagacagtctgtgagagctcaaaatattggaatttgtcagagtgccagattgtaacttca

SEQ ID NO: 12283 - DNA, 60 bp, Artificial Sequence
  Description of Artificial Sequence: Synthetic probe
ggaagaagaccattgagacagtctgtgagagctcaaaatattggaatttgtcagagtgcc

SEQ ID NO: 12284 - DNA, 60 bp, Artificial Sequence
  Description of Artificial Sequence: Synthetic probe
agacagaacagtggaagaagaccattgagacagtctgtgagagctcaaaatattggaatt

SEQ ID NO: 12285 - DNA, 60 bp, Artificial Sequence
  Description of Artificial Sequence: Synthetic probe
ctggtcacattccctagttggactcaacctgtaataaaagagaatggtggggagagatca

SEQ ID NO: 12286 - DNA, 60 bp, Artificial Sequence
  Description of Artificial Sequence: Synthetic probe
atactggtcacattccctagttggactcaacctgtaataaaagagaatggtggggagaga

SEQ ID NO: 12287 - DNA, 60 bp, Artificial Sequence
  Description of Artificial Sequence: Synthetic probe
tatactggtcacattccctagttggactcaacctgtaataaaagagaatggtggggagag

SEQ ID NO: 12288 - DNA, 60 bp, Artificial Sequence
  Description of Artificial Sequence: Synthetic probe
atatactggtcacattccctagttggactcaacctgtaataaaagagaatggtggggaga

SEQ ID NO: 12289 - DNA, 60 bp, Artificial Sequence
  Description of Artificial Sequence: Synthetic probe
attttataggaggaaggtgcaaagggaatatctgtgaaaccgttcataattctaccaaat

SEQ ID NO: 12290 - DNA, 60 bp, Artificial Sequence
  Description of Artificial Sequence: Synthetic probe
cagtcacttcgtgagaagacaattggcaaatatgccaaggcagagtttaacaagtgaccc

SEQ ID NO: 12291 - DNA, 60 bp, Artificial Sequence
  Description of Artificial Sequence: Synthetic probe
cagtcactccgtgagaagacaattggcaaatatgccaaggcagagtttgacaagtgacaa

SEQ ID NO: 12292 - DNA, 52 bp, Artificial Sequence
  Description of Artificial Sequence: Synthetic probe
cagtcactccgtgagaagacaattggcaaatatgccaaggcagagtttgaca

SEQ ID NO: 12293 - DNA, 60 bp, Artificial Sequence
  Description of Artificial Sequence: Synthetic probe
gcagtcacttcgtgagaagacaattggcaaatatgccaaggccgagtttgacaagtgaca

SEQ ID NO: 12294 - DNA, 60 bp, Artificial Sequence
  Description of Artificial Sequence: Synthetic probe
tgaacatcttacgatgctgtcgccggatgaaagaatagacaagtgggaagaggacttgcc

SEQ ID NO: 12295 - DNA, 60 bp, Artificial Sequence
  Description of Artificial Sequence: Synthetic probe
ccgaatctctctcttcctcgcattcacccggtccagcacccaaagtcacggagtcaacta

SEQ ID NO: 12296 - DNA, 60 bp, Artificial Sequence
  Description of Artificial Sequence: Synthetic probe
tccgaatcgctctcttcctcgcattcacccggtccagcacccaaagtcacggaatcaact

SEQ ID NO: 12297 - DNA, 60 bp, Artificial Sequence
  Description of Artificial Sequence: Synthetic probe
ttccgaatctctctcttcctcgcattcacccggtccagcacccaaagtcacggagtcaac

SEQ ID NO: 12298 - DNA, 60 bp, Artificial Sequence
  Description of Artificial Sequence: Synthetic probe
ttccgaatcgctctcttcctcgcattcacccggtccagcacccaaagtcacggaatcaac

SEQ ID NO: 12299 - DNA, 60 bp, Artificial Sequence
  Description of Artificial Sequence: Synthetic probe
gagaagttgcagatgaaatggtccaaatgatgcttccaggccaagaaattgacaaggccg

SEQ ID NO: 12300 - DNA, 60 bp, Artificial Sequence
  Description of Artificial Sequence: Synthetic probe
cctctgcaaaataaccggaatgtctacagaagatgtaacgacctggatcttgaaccgaga

SEQ ID NO: 12301 - DNA, 60 bp, Artificial Sequence
  Description of Artificial Sequence: Synthetic probe
gatcaatgaacagtttgaacctcttgtgccagaaggtcgtgacatttttgatgtgtgggg

SEQ ID NO: 12302 - DNA, 59 bp, Artificial Sequence
  Description of Artificial Sequence: Synthetic probe
gattgtcttctaagtctccatattcttccgtcaaaaaccctgccttccacttctggggg

SEQ ID NO: 12303 - DNA, 60 bp, Artificial Sequence
  Description of Artificial Sequence: Synthetic probe
gagaagttgcagatgagatggtccaaatgatgcttccaggccaagaaattgacaaggccg

SEQ ID NO: 12304 - DNA, 60 bp, Artificial Sequence
  Description of Artificial Sequence: Synthetic probe
ccgagaagttgcagatgagatggtccaaatgatgcttccaggccaagaaattgacaaggc

SEQ ID NO: 12305 - DNA, 60 bp, Artificial Sequence
  Description of Artificial Sequence: Synthetic probe
tggatcttgaaccgagaagttgcagatgagatggtccaaatgatgcttccaggccaagaa

SEQ ID NO: 12306 - DNA, 60 bp, Artificial Sequence
  Description of Artificial Sequence: Synthetic probe
gatcaatgaacagtttgaacctcttgtgccagaaggtcgtgacatctttgatgtgtgggg

SEQ ID NO: 12307 - DNA, 60 bp, Artificial Sequence
  Description of Artificial Sequence: Synthetic probe
tggacggtgtacttccagatggagtatcggatgcttccagaaccagcgcagatgacaaat

SEQ ID NO: 12308 - DNA, 60 bp, Artificial Sequence
  Description of Artificial Sequence: Synthetic probe
actctctgcagtcacttcgtgagaagacaattggcaaatatgccaaggcagagtttgaca

SEQ ID NO: 12309 - DNA, 60 bp, Artificial Sequence
  Description of Artificial Sequence: Synthetic probe
ttgagaccagatacatcagagtcgatattgctgctccaatcctctcaagaatggtcggaa

SEQ ID NO: 12310 - DNA, 60 bp, Artificial Sequence
  Description of Artificial Sequence: Synthetic probe
ctttgagaccagatacatcagagtcgatattgctgctccaatcctctcaagaatggtcgg

SEQ ID NO: 12311 - DNA, 60 bp, Artificial Sequence
  Description of Artificial Sequence: Synthetic probe
cagtggaactaccacagaaagggtactgtgggatgactgggctccatatgaagacgtgga

SEQ ID NO: 12312 - DNA, 56 bp, Artificial Sequence
  Description of Artificial Sequence: Synthetic probe
ggatattaaatcgagaagttgcagatgaaatggtccaaatgatgcttccaggccaa

SEQ ID NO: 12313 - DNA, 60 bp, Artificial Sequence
  Description of Artificial Sequence: Synthetic probe
tgaagtcaacagaagtccaattgacctcaaagagagcaggagtcaaagacatgacagtca

SEQ ID NO: 12314 - DNA, 60 bp, Artificial Sequence
  Description of Artificial Sequence: Synthetic probe
cttcagatgattgtcttattctcagaggacgagttatgactcctgattgcagttcatcag

SEQ ID NO: 12315 - DNA, 60 bp, Artificial Sequence
  Description of Artificial Sequence: Synthetic probe
ggattgtaacttcagatgattgtcttattctcagaggacgagttatgactcctgattgca

SEQ ID NO: 12316 - DNA, 59 bp, Artificial Sequence
  Description of Artificial Sequence: Synthetic probe
tctggcaatccatctatactccacataaatgcttacctttacgcagcattgaagggagt

SEQ ID NO: 12317 - DNA, 60 bp, Artificial Sequence
  Description of Artificial Sequence: Synthetic probe
ccaagggatcaagtctggcaatccatctatactccacataaatgcttacctttacgcagc

SEQ ID NO: 12318 - DNA, 60 bp, Artificial Sequence
  Description of Artificial Sequence: Synthetic probe
ctaccaagggatcaagtctggcaatccatctatactccacataaatgcttacctttacgc

SEQ ID NO: 12319 - DNA, 60 bp, Artificial Sequence
  Description of Artificial Sequence: Synthetic probe
ccaggggatcaagtctggcaatccatctatactccacataaatgcttacctttatgcagc

SEQ ID NO: 12320 - DNA, 60 bp, Artificial Sequence
  Description of Artificial Sequence: Synthetic probe
ctaccaggggatcaagtctggcaatccatctatactccacataaatgcttacctttatgc

SEQ ID NO: 12321 - DNA, 60 bp, Artificial Sequence
  Description of Artificial Sequence: Synthetic probe
gcactaaagtggcactaaatgatttgagggcttatgtctaccaggggatcaagtctggca

SEQ ID NO: 12322 - DNA, 60 bp, Artificial Sequence
  Description of Artificial Sequence: Synthetic probe
ccaggggatcaagtctggcaatccatctatactccacataaatgcttacctttacgcagc

SEQ ID NO: 12323 - DNA, 60 bp, Artificial Sequence
  Description of Artificial Sequence: Synthetic probe
ctaccaggggatcaagtctggcaatccatctatactccacataaatgcttacctttacgc

SEQ ID NO: 12324 - DNA, 60 bp, Artificial Sequence
  Description of Artificial Sequence: Synthetic probe
gaattagttgaaggatggtttagtggatggaggagttccatcatgggactggtggctgtg

SEQ ID NO: 12325 - DNA, 60 bp, Artificial Sequence
  Description of Artificial Sequence: Synthetic probe
cccaggagcagggccggtctttaccatcattaatggttctctgcattactttatgtcaaa

SEQ ID NO: 12326 - DNA, 60 bp, Artificial Sequence
  Description of Artificial Sequence: Synthetic probe
ccctcatattaaagactgtgacctctcttcatccattgtcacaccgggagaacatgctac

SEQ ID NO: 12327 - DNA, 60 bp, Artificial Sequence
  Description of Artificial Sequence: Synthetic probe
gaggagatcacttcaatggggttgccagaaacaggaatcagaagtaattactttccctat

SEQ ID NO: 12328 - DNA, 60 bp, Artificial Sequence
  Description of Artificial Sequence: Synthetic probe
ggccatcaaggcatacaaagatggagtcagtttcaacccaggttttcctcctcagagctg

SEQ ID NO: 12329 - DNA, 60 bp, Artificial Sequence
  Description of Artificial Sequence: Synthetic probe
catgggactcaaacaggaattcctgttgagttgacaatgcccaaaggactgacaacccat

SEQ ID NO: 12330 - DNA, 60 bp, Artificial Sequence
  Description of Artificial Sequence: Synthetic probe
tccgaatcgctctcctcctcgcattcacccggtccagcacccaaagtcacggagtcaact

SEQ ID NO: 12331 - DNA, 60 bp, Artificial Sequence
  Description of Artificial Sequence: Synthetic probe
ctgcctcaccctcaaaggcagagtgatgactcctgattgtagttcttcagtcaaatctca

SEQ ID NO: 12332 - DNA, 60 bp, Artificial Sequence
  Description of Artificial Sequence: Synthetic probe
gactgcctcaccctcaaaggcagagtgatgactcctgattgtagttcttcagtcaaatct

SEQ ID NO: 12333 - DNA, 60 bp, Artificial Sequence
  Description of Artificial Sequence: Synthetic probe
gagtccatcaatctatgggatttaaagtccacagaggtccaattgatctccaagagagcc

SEQ ID NO: 12334 - DNA, 54 bp, Artificial Sequence
  Description of Artificial Sequence: Synthetic probe
ttatgtgtcactcagctttgtggatgaccacttgtgacttcagatggtatgggc

SEQ ID NO: 12335 - DNA, 54 bp, Artificial Sequence
  Description of Artificial Sequence: Synthetic probe
ttatgtgtcactcagccttgtggatgaccacttgtgacttcagatggtatgggc

SEQ ID NO: 12336 - DNA, 60 bp, Artificial Sequence
  Description of Artificial Sequence: Synthetic probe
gaactcacatgggactcaaacaggaatccctgttgagttaacaatgccaaaaggactaac

SEQ ID NO: 12337 - DNA, 60 bp, Artificial Sequence
  Description of Artificial Sequence: Synthetic probe
tggaagagagttccccatgaatataattattgccctaccagcgcagacaagaactcacat

SEQ ID NO: 12338 - DNA, 60 bp, Artificial Sequence
  Description of Artificial Sequence: Synthetic probe
ccactggggattggaagagagttccccatgaatataattattgccctaccagcgcagaca

SEQ ID NO: 12339 - DNA, 60 bp, Artificial Sequence
  Description of Artificial Sequence: Synthetic probe
caacataccactggggattggaagagagttccccatgaatataattattgccctaccagc

SEQ ID NO: 12340 - DNA, 60 bp, Artificial Sequence
  Description of Artificial Sequence: Synthetic probe
ctcaacataccactggggattggaagagagttccccatgaatataattattgccctacca

SEQ ID NO: 12341 - DNA, 60 bp, Artificial Sequence
  Description of Artificial Sequence: Synthetic probe
ccgaatctctctattcttcccattcaccgggccccgcacccagagtatcagagtcaatga

SEQ ID NO: 12342 - DNA, 60 bp, Artificial Sequence
  Description of Artificial Sequence: Synthetic probe
ctccgaatctctctattcttcccattcaccgggccccgcacccagagtatcagagtcaat

SEQ ID NO: 12343 - DNA, 60 bp, Artificial Sequence
  Description of Artificial Sequence: Synthetic probe
cctcagaggattgtcttatgctcaaaggaagagtcatgaccccggactgcagctcatctg

SEQ ID NO: 12344 - DNA, 60 bp, Artificial Sequence
  Description of Artificial Sequence: Synthetic probe
gttacctcagaggattgtcttatgctcaaaggaagagtcatgaccccggactgcagctca

SEQ ID NO: 12345 - DNA, 60 bp, Artificial Sequence
  Description of Artificial Sequence: Synthetic probe
gtgagagttcaaaatattggaatttatcagaatgccaacttgttacctcagaggattgtc

SEQ ID NO: 12346 - DNA, 60 bp, Artificial Sequence
  Description of Artificial Sequence: Synthetic probe
ggactcaacctgtaatgaaggagaatggtggtgagaagtccctatcgttgttccctcccg

SEQ ID NO: 12347 - DNA, 60 bp, Artificial Sequence
  Description of Artificial Sequence: Synthetic probe
agtcacaaggctattcaagcagacggttggatgtgtcatgcttccaaatgggttactact

SEQ ID NO: 12348 - DNA, 60 bp, Artificial Sequence
  Description of Artificial Sequence: Synthetic probe
cccaagagtcacaaggctattcaagcagacggttggatgtgtcatgcctctaaatggatc

SEQ ID NO: 12349 - DNA, 60 bp, Artificial Sequence
  Description of Artificial Sequence: Synthetic probe
gcacagccttacaggtcaagatgcccaagagtcacaaggctattcaagcagacggttgga

SEQ ID NO: 12350 - DNA, 60 bp, Artificial Sequence
  Description of Artificial Sequence: Synthetic probe
cctttcctaattggacacagcctgtaatgaaggaaaatggaggagagaaatcattgtccc

SEQ ID NO: 12351 - DNA, 60 bp, Artificial Sequence
  Description of Artificial Sequence: Synthetic probe
ccggtgacctttcctaattggacacagcctgtaatgaaggaaaatggaggagagaaatca

SEQ ID NO: 12352 - DNA, 60 bp, Artificial Sequence
  Description of Artificial Sequence: Synthetic probe
ccggtgacctttcctaattggacacagcctgtaatgaaggaaaatggaggagagaaatcc

SEQ ID NO: 12353 - DNA, 60 bp, Artificial Sequence
  Description of Artificial Sequence: Synthetic probe
ataccggtgacctttcctaattggacacagcctgtaatgaaggaaaatggaggagagaaa

SEQ ID NO: 12354 - DNA, 60 bp, Artificial Sequence
  Description of Artificial Sequence: Synthetic probe
gatataccggtgacctttcctaattggacacagcctgtaatgaaggaaaatggaggagag

SEQ ID NO: 12355 - DNA, 60 bp, Artificial Sequence
  Description of Artificial Sequence: Synthetic probe
gatataccggtaacctttcctaattggacacagcctgtaatgaaggaaaatggaggagag

SEQ ID NO: 12356 - DNA, 56 bp, Artificial Sequence
  Description of Artificial Sequence: Synthetic probe
tagtttcctctaaggagaaatgtagttatgatgtttttcaaacagtctagattctc

SEQ ID NO: 12357 - DNA, 52 bp, Artificial Sequence
  Description of Artificial Sequence: Synthetic probe
gtgtcagtatcaaggttttgaaggacgtttactcctaggtcaccttatgggc

SEQ ID NO: 12358 - DNA, 53 bp, Artificial Sequence
  Description of Artificial Sequence: Synthetic probe
caaacctactgcggacatgcttcaatatgcaaagaaagcagtgatgtctctac

SEQ ID NO: 12359 - DNA, 60 bp, Artificial Sequence
  Description of Artificial Sequence: Synthetic probe
atttgtctcaacagttctacgtcggtgacgataagtacatctctgaaaacacaacagggg

SEQ ID NO: 12360 - DNA, 60 bp, Artificial Sequence
  Description of Artificial Sequence: Synthetic probe
ccacagcaggactgctgtacgcctacgccgtgggctcatcagcggatttgtctcaacagt

SEQ ID NO: 12361 - DNA, 60 bp, Artificial Sequence
  Description of Artificial Sequence: Synthetic probe
cgaggaatgccagacagccggatgatattgagtacacatctctaaccacagcaggactgc

SEQ ID NO: 12362 - DNA, 54 bp, Artificial Sequence
  Description of Artificial Sequence: Synthetic probe
ttttggggacaattgactgcactgttgctcagatccacacgtgcgaggaatgcc

SEQ ID NO: 12363 - DNA, 60 bp, Artificial Sequence
  Description of Artificial Sequence: Synthetic probe
gggcatgtgtgcaagattacagggatgtctacagaggaagttacgacctggatactaaat

SEQ ID NO: 12364 - DNA, 60 bp, Artificial Sequence
  Description of Artificial Sequence: Synthetic probe
ggaaccattgtgtcccggttcaaggactgtgcagccctggcaacatttgggcatgtgtgc

SEQ ID NO: 12365 - DNA, 60 bp, Artificial Sequence
  Description of Artificial Sequence: Synthetic probe
cgcgcaatgcaagctcatcaacgagaaattcgagccccttataccagaaggccgagactt

SEQ ID NO: 12366 - DNA, 60 bp, Artificial Sequence
  Description of Artificial Sequence: Synthetic probe
ggccgcactcagatgaccgattaccggaagaaactgatggatgggctgatcgcgcaatgc

SEQ ID NO: 12367 - DNA, 60 bp, Artificial Sequence
  Description of Artificial Sequence: Synthetic probe
gcgccgatgaccaatggctcccattatacctactgggcttgtacagagtcggccgcactc

SEQ ID NO: 12368 - DNA, 60 bp, Artificial Sequence
  Description of Artificial Sequence: Synthetic probe
tgtgcccagatggtgtgtctgatgcaacccgcacaagcgccgatgaccaatggctcccat

SEQ ID NO: 12369 - DNA, 53 bp, Artificial Sequence
  Description of Artificial Sequence: Synthetic probe
gattggaaaggcaggggacaatgttggaatattcgacttggttacagtcaaaa

SEQ ID NO: 12370 - DNA, 60 bp, Artificial Sequence
  Description of Artificial Sequence: Synthetic probe
ccaaggcctcaaagcaggatctctctcaattgtgcatgtcaacagctatctatatgctgc

SEQ ID NO: 12371 - DNA, 60 bp, Artificial Sequence
  Description of Artificial Sequence: Synthetic probe
ctgtggaatatccagctgactacttcaaaaagtcacgagacatcccggtgtacatcaaca

SEQ ID NO: 12372 - DNA, 50 bp, Artificial Sequence
  Description of Artificial Sequence: Synthetic probe
attgcctgctaatgaggatcctgtggaatatccagctgactacttcaaaa

SEQ ID NO: 12373 - DNA, 60 bp, Artificial Sequence
  Description of Artificial Sequence: Synthetic probe
cggtgattacaccaaaattgcctgctaatgaggatcctgtggaatatccagctgactact

SEQ ID NO: 12374 - DNA, 60 bp, Artificial Sequence
  Description of Artificial Sequence: Synthetic probe
ggctgctactgtgaaacgcgtgattgatgattcggtgattacaccaaaattgcctgctaa

SEQ ID NO: 12375 - DNA, 51 bp, Artificial Sequence
  Description of Artificial Sequence: Synthetic probe
aagagcggtcaactccttgcaggcactccgtgagaaaacgattggcaagta

SEQ ID NO: 12376 - DNA, 60 bp, Artificial Sequence
  Description of Artificial Sequence: Synthetic probe
tatgacgataatggaggaaaaccaacaccggacatgctaaattttgcaaaaagagcggtc

SEQ ID NO: 12377 - DNA, 60 bp, Artificial Sequence
  Description of Artificial Sequence: Synthetic probe
actcagatgtaccacccaaagggaggaatgttgtagactggctcagctggtatgacgata

SEQ ID NO: 12378 - DNA, 60 bp, Artificial Sequence
  Description of Artificial Sequence: Synthetic probe
ggagaggacaagtacacaacagaaaaggatgatggtctaaggaaatcagatgtaccaccc

SEQ ID NO: 12379 - DNA, 60 bp, Artificial Sequence
  Description of Artificial Sequence: Synthetic probe
gcagtcgggtcttcagcagacatcgaacagcagttttatattggagaggacaagtacaca

SEQ ID NO: 12380 - DNA, 60 bp, Artificial Sequence
  Description of Artificial Sequence: Synthetic probe
catgggtcctcaatagggaagttgcagacgaactatgccagatgatgtatccaggtcaag

SEQ ID NO: 12381 - DNA, 60 bp, Artificial Sequence
  Description of Artificial Sequence: Synthetic probe
gggaaaatgatccgaatttcaccaagatagttgcggcagtagacatgttctttcatatgt

SEQ ID NO: 12382 - DNA, 60 bp, Artificial Sequence
  Description of Artificial Sequence: Synthetic probe
gctagatggtctagagaaccagtgcaaagtagcatcaaccagatttgaaagtctagtcga

SEQ ID NO: 12383 - DNA, 60 bp, Artificial Sequence
  Description of Artificial Sequence: Synthetic probe
aaatcagaccctgatcgttcggcagaggatgataaatggctccccatttatatcctaggt

SEQ ID NO: 12384 - DNA, 60 bp, Artificial Sequence
  Description of Artificial Sequence: Synthetic probe
ccacataaatgcttacctttacgcagcattaaagggagtagaagggaccttggacagaga

SEQ ID NO: 12385 - DNA, 60 bp, Artificial Sequence
  Description of Artificial Sequence: Synthetic probe
cgtagttccaaaacttcctgcaaatgaggatccagtggaatacccggcagattacttcag

SEQ ID NO: 12386 - DNA, 60 bp, Artificial Sequence
  Description of Artificial Sequence: Synthetic probe
gtctgttacagtcaagagaatcattgacaacacagtcgtagttccaaaacttcctgcaaa

SEQ ID NO: 12387 - DNA, 57 bp, Artificial Sequence
  Description of Artificial Sequence: Synthetic probe
gtctatactgatgttgaagagtgacctacatgaggaaaactcttggagagattaaaa

SEQ ID NO: 12388 - DNA, 60 bp, Artificial Sequence
  Description of Artificial Sequence: Synthetic probe
cagataattgtcttatcctcaaaggccgagttatgactactgactgcagctcatcaatca

SEQ ID NO: 12389 - DNA, 60 bp, Artificial Sequence
  Description of Artificial Sequence: Synthetic probe
ctcagataattgtcttatcctcaaaggccgagttatgactactgactgcagctcatcaat

SEQ ID NO: 12390 - DNA, 60 bp, Artificial Sequence
  Description of Artificial Sequence: Synthetic probe
tattcagtatgcccagaaggagcatcagatttgatgggagcaatcattatgggactgaag

SEQ ID NO: 12391 - DNA, 60 bp, Artificial Sequence
  Description of Artificial Sequence: Synthetic probe
caatgaatttatgggacctgaagtcaacagaagtccaactgacctcaaagagagcaggag

SEQ ID NO: 12392 - DNA, 60 bp, Artificial Sequence
  Description of Artificial Sequence: Synthetic probe
cagaagattgtcttatcctcaaaggccgaattatgactcccgactgcagctcatcaatca

SEQ ID NO: 12393 - DNA, 60 bp, Artificial Sequence
  Description of Artificial Sequence: Synthetic probe
ctcagaagattgtcttatcctcaaaggccgaattatgactcccgactgcagctcatcaat

SEQ ID NO: 12394 - DNA, 60 bp, Artificial Sequence
  Description of Artificial Sequence: Synthetic probe
gaactcagaagattgtcttatcctcaaaggccgaattatgactcctgactgcagctcatc

SEQ ID NO: 12395 - DNA, 60 bp, Artificial Sequence
  Description of Artificial Sequence: Synthetic probe
gaactcagaagattgtcttatcctcaaaggccgaattatgactcctgactgcagttcatc

SEQ ID NO: 12396 - DNA, 60 bp, Artificial Sequence
  Description of Artificial Sequence: Synthetic probe
aatgccagattatgaactcagaagattgtcttatcctcaaaggccgaattatgactcctg

SEQ ID NO: 12397 - DNA, 60 bp, Artificial Sequence
  Description of Artificial Sequence: Synthetic probe
gaatgccagattatgaactcagaagattgtcttatcctcaaaggccgaattatgactcct

SEQ ID NO: 12398 - DNA, 60 bp, Artificial Sequence
  Description of Artificial Sequence: Synthetic probe
gggtcaagaaattgacaaagcagattcatacatgccgtatatgatcgactttgggttatc

SEQ ID NO: 12399 - DNA, 60 bp, Artificial Sequence
  Description of Artificial Sequence: Synthetic probe
gggtcaagaaattgacaaagcagattcatacatgccgtatatgatcgactttggattatc

SEQ ID NO: 12400 - DNA, 60 bp, Artificial Sequence
  Description of Artificial Sequence: Synthetic probe
gagctatgccagatgatgtatccgggtcaagaaattgacaaagcagattcatacatgccg

SEQ ID NO: 12401 - DNA, 60 bp, Artificial Sequence
  Description of Artificial Sequence: Synthetic probe
gagctctgccagatgatgtatccgggtcaagaaattgacaaagcagattcatacatgccg

SEQ ID NO: 12402 - DNA, 60 bp, Artificial Sequence
  Description of Artificial Sequence: Synthetic probe
gagctctgccagatgatgtatccgggacaagaaattgacaaagcagattcatacatgccg

SEQ ID NO: 12403 - DNA, 60 bp, Artificial Sequence
  Description of Artificial Sequence: Synthetic probe
gagctatgccagatgatgtatccgggtcaagaaattgacaaagcagattcatatatgccg

SEQ ID NO: 12404 - DNA, 60 bp, Artificial Sequence
  Description of Artificial Sequence: Synthetic probe
cgagctatgccagatgatgtatccgggtcaagaaattgacaaagcagattcatacatgcc

SEQ ID NO: 12405 - DNA, 60 bp, Artificial Sequence
  Description of Artificial Sequence: Synthetic probe
cagacgagctatgccagatgatgtatccgggtcaagaaattgacaaagcagattcataca

SEQ ID NO: 12406 - DNA, 60 bp, Artificial Sequence
  Description of Artificial Sequence: Synthetic probe
cctgatgggaaatcagaccctgaccgttctgctgaggatgataaatggcttcccatctac

SEQ ID NO: 12407 - DNA, 60 bp, Artificial Sequence
  Description of Artificial Sequence: Synthetic probe
cacttcctgatgggaaatcagaccctgaccgttctgctgaggatgataaatggcttccca

SEQ ID NO: 12408 - DNA, 60 bp, Artificial Sequence
  Description of Artificial Sequence: Synthetic probe
gcacttcctgatgggaaatcagaccctgaccgttctgctgaggatgataaatggcttccc

SEQ ID NO: 12409 - DNA, 60 bp, Artificial Sequence
  Description of Artificial Sequence: Synthetic probe
gcacttcctgatgggaaatcagaccctgaccgttctgctgaggacgataaatggcttccc

SEQ ID NO: 12410 - DNA, 60 bp, Artificial Sequence
  Description of Artificial Sequence: Synthetic probe
agcacttcctgatgggaaatcagaccctgaccgttctgctgaggatgataaatggcttcc

SEQ ID NO: 12411 - DNA, 60 bp, Artificial Sequence
  Description of Artificial Sequence: Synthetic probe
acagcacttcctgatgggaaatcagaccctgaccgttctgctgaggatgataaatggctt

SEQ ID NO: 12412 - DNA, 60 bp, Artificial Sequence
  Description of Artificial Sequence: Synthetic probe
tgccagagggtttaagtggagagcagaaatcccagtggctttcgacgattaaagcagtcg

SEQ ID NO: 12413 - DNA, 60 bp, Artificial Sequence
  Description of Artificial Sequence: Synthetic probe
tgccagagggtttaagtggagagcagaaatcccagtggcttttgacgattaaagcagtcg

SEQ ID NO: 12414 - DNA, 60 bp, Artificial Sequence
  Description of Artificial Sequence: Synthetic probe
cggttgacattgccagagggtttaagtggagagcagaaatcccagtggctttcgacaatt

SEQ ID NO: 12415 - DNA, 60 bp, Artificial Sequence
  Description of Artificial Sequence: Synthetic probe
ttacggttgacatcgccagagggtttaagtggagagcagaaatcccagtggctttcgacg

SEQ ID NO: 12416 - DNA, 60 bp, Artificial Sequence
  Description of Artificial Sequence: Synthetic probe
ctgacgagcatggaaagaccttacggttgacattgccagagggtttaagtggagagcaga

SEQ ID NO: 12417 - DNA, 60 bp, Artificial Sequence
  Description of Artificial Sequence: Synthetic probe
cctagaatggaagggaaagttgcaggaacccggattgttcgacaactgtgggatcaatgg

SEQ ID NO: 12418 - DNA, 60 bp, Artificial Sequence
  Description of Artificial Sequence: Synthetic probe
gtccagtcatacccagaatggaagggaaagttgcaggaacccggattgttcgacaactgt

SEQ ID NO: 12419 - DNA, 60 bp, Artificial Sequence
  Description of Artificial Sequence: Synthetic probe
tctaatatcagatgtagaacggatcttggattatgctctttgtcaaaacacttggagcaa

SEQ ID NO: 12420 - DNA, 60 bp, Artificial Sequence
  Description of Artificial Sequence: Synthetic probe
ccccaggagaacatgcgacagatatatctctaatatcagatgtagaacggatacttgatt

SEQ ID NO: 12421 - DNA, 60 bp, Artificial Sequence
  Description of Artificial Sequence: Synthetic probe
ccatgggactcaaacagggattcctgttgaattaacaatgcctaaaggactgacaactca

SEQ ID NO: 12422 - DNA, 59 bp, Artificial Sequence
  Description of Artificial Sequence: Synthetic probe
cagtctccgtgtgccttccagcaaatgaagacccagtagagtttccaggggcattcttc

SEQ ID NO: 12423 - DNA, 60 bp, Artificial Sequence
  Description of Artificial Sequence: Synthetic probe
tgcatttctacaggtcaaacagtctccgtgtgccttccagcaaatgaagacccagtggag

SEQ ID NO: 12424 - DNA, 60 bp, Artificial Sequence
  Description of Artificial Sequence: Synthetic probe
ctcaagtattctgcatttctacaggtcaaacagtctccgtgtgccttccagcaaatgaag

SEQ ID NO: 12425 - DNA, 60 bp, Artificial Sequence
  Description of Artificial Sequence: Synthetic probe
agttctcaagtattctgcatttctacaggtcaaacagtctccgtgtgccttccagcaaat

SEQ ID NO: 12426 - DNA, 60 bp, Artificial Sequence
  Description of Artificial Sequence: Synthetic probe
gagttctcaagtattctgcatttctacaggtcaaacagtctccgtgtgccttccagcaaa

SEQ ID NO: 12427 - DNA, 60 bp, Artificial Sequence
  Description of Artificial Sequence: Synthetic probe
cataatcaatggtaccctaaaatactttgagaccagatatatcagggtcgatattgctgc

SEQ ID NO: 12428 - DNA, 60 bp, Artificial Sequence
  Description of Artificial Sequence: Synthetic probe
cagatcaggaagctgagcaagttgaaggctttatacaggggcctttagatgactatgcag

SEQ ID NO: 12429 - DNA, 60 bp, Artificial Sequence
  Description of Artificial Sequence: Synthetic probe
aaagcttgtatgtaccagatcaggaagctgagcaagttgaaggctttatacaggggcctt

SEQ ID NO: 12430 - DNA, 60 bp, Artificial Sequence
  Description of Artificial Sequence: Synthetic probe
catttcgttcctatgtttaaaggcctgacaatggcggatgatctaactgcagtcattaaa

SEQ ID NO: 12431 - DNA, 60 bp, Artificial Sequence
  Description of Artificial Sequence: Synthetic probe
cctggcattctgactataaggttaaaggactatgtgattctaacctcatttccatggaca

SEQ ID NO: 12432 - DNA, 60 bp, Artificial Sequence
  Description of Artificial Sequence: Synthetic probe
tggaaaagagtgccgcatgaatacaattattgccctaccagcgcagacaaaaactcccat

SEQ ID NO: 12433 - DNA, 60 bp, Artificial Sequence
  Description of Artificial Sequence: Synthetic probe
gagcaagattgaagcaggagaaccaatcactcctgttgatatcagctatctaggacctaa

SEQ ID NO: 12434 - DNA, 60 bp, Artificial Sequence
  Description of Artificial Sequence: Synthetic probe
gctctttgtcaaaatacttggagcaagattgaagcaggagaaccaatcactcctgtggat

SEQ ID NO: 12435 - DNA, 60 bp, Artificial Sequence
  Description of Artificial Sequence: Synthetic probe
gctctttgtcaaaatacttggagcaagattgaagcaggagaaccaatcactcctgtagat

SEQ ID NO: 12436 - DNA, 60 bp, Artificial Sequence
  Description of Artificial Sequence: Synthetic probe
atacttgattatgctctttgtcaaaatacttggagcaagattgaagcaggagaaccaatc

SEQ ID NO: 12437 - DNA, 60 bp, Artificial Sequence
  Description of Artificial Sequence: Synthetic probe
atacttgactatgctctttgtcaaaatacttggagcaagattgaagcaggagaaccaatc

SEQ ID NO: 12438 - DNA, 60 bp, Artificial Sequence
  Description of Artificial Sequence: Synthetic probe
cagatggggagagtgtatgcagtcaattattcacattggttggaggaacttttttctctg

SEQ ID NO: 12439 - DNA, 53 bp, Artificial Sequence
  Description of Artificial Sequence: Synthetic probe
cagatggggagagtgtatgcagtcaattattcacattggttggaggaactttt

SEQ ID NO: 12440 - DNA, 60 bp, Artificial Sequence
  Description of Artificial Sequence: Synthetic probe
acagtggataatcatttgaaatggtcaaatttgcgaagaaacacaggaatgattgaatgg

SEQ ID NO: 12441 - DNA, 60 bp, Artificial Sequence
  Description of Artificial Sequence: Synthetic probe
cgggaactggatcagatctctggaattggtccgaaaccaagttcgtctaaatccattcaa

SEQ ID NO: 12442 - DNA, 60 bp, Artificial Sequence
  Description of Artificial Sequence: Synthetic probe
catggccccaatcgggaactggatcagatctctggaattggtccgaaaccaagttcgtct

SEQ ID NO: 12443 - DNA, 60 bp, Artificial Sequence
  Description of Artificial Sequence: Synthetic probe
ttggacacctctgcaaaataaccggaatgtctacagaagatgtaacgacctggatcttga

SEQ ID NO: 12444 - DNA, 55 bp, Artificial Sequence
  Description of Artificial Sequence: Synthetic probe
aatggcccaaatgatgcttccaggccaagaaattgacaaggccgattcatacatg

SEQ ID NO: 12445 - DNA, 60 bp, Artificial Sequence
  Description of Artificial Sequence: Synthetic probe
cggcgtacttccagatggagtatcagatgcttccagaaccagcgcagatgacaaatggct

SEQ ID NO: 12446 - DNA, 56 bp, Artificial Sequence
  Description of Artificial Sequence: Synthetic probe
atggagtatcggatgcttccagaaccagcgcagatgacaaatggctgcctttgtat

SEQ ID NO: 12447 - DNA, 60 bp, Artificial Sequence
  Description of Artificial Sequence: Synthetic probe
ccagatggagtatcggatgcttccagaaccagcgcagatgacaaatggctgcctttgtat

SEQ ID NO: 12448 - DNA, 60 bp, Artificial Sequence
  Description of Artificial Sequence: Synthetic probe
gacggtgtacttccagatggagtatcggatgcttccagaaccagcgcagatgacaaatgg

SEQ ID NO: 12449 - DNA, 60 bp, Artificial Sequence
  Description of Artificial Sequence: Synthetic probe
gacggcgtacttccagatggagtatcggatgcttccagaaccagcgcagatgacaaatgg

SEQ ID NO: 12450 - DNA, 60 bp, Artificial Sequence
  Description of Artificial Sequence: Synthetic probe
ctgcctcaccctcaaaggccgagtgatgactcctgattgtagttcctcagccaaatctca

SEQ ID NO: 12451 - DNA, 60 bp, Artificial Sequence
  Description of Artificial Sequence: Synthetic probe
ctgcctcaccctcaaaggccgagtgatgactcctgattgtagttcctcagtaaaatctca

SEQ ID NO: 12452 - DNA, 60 bp, Artificial Sequence
  Description of Artificial Sequence: Synthetic probe
ctgcctcaccctcaaaggccgagtgatgactcctgattgtagttcctcagtcaaatctca

SEQ ID NO: 12453 - DNA, 60 bp, Artificial Sequence
  Description of Artificial Sequence: Synthetic probe
ctgcctcaccctcaaaggccgagtgatgactcccgattgtagttcctcagtcaagtctca

SEQ ID NO: 12454 - DNA, 60 bp, Artificial Sequence
  Description of Artificial Sequence: Synthetic probe
agactgcctcaccctcaaaggccgagtgatgactcctgattgtagttcctcagtaaaatc

SEQ ID NO: 12455 - DNA, 60 bp, Artificial Sequence
  Description of Artificial Sequence: Synthetic probe
agactgcctcaccctcaaaggccgagtgatgactcccgattgtagttcctcagtcaagtc

SEQ ID NO: 12456 - DNA, 60 bp, Artificial Sequence
  Description of Artificial Sequence: Synthetic probe
agactgcctcaccctcaaaggccgagtgatgactcctgattgtagttcctcagtcaaatc

SEQ ID NO: 12457 - DNA, 60 bp, Artificial Sequence
  Description of Artificial Sequence: Synthetic probe
agactgcctcaccctcaaaggccgagtgatgactcctgattgtagttcctcagccaaatc

SEQ ID NO: 12458 - DNA, 64 bp, Artificial Sequence
  Description of Artificial Sequence: Synthetic probe
ccaattgagtccatttaagtgattactccaatcgtaacaattagaacatttaatactccctctg

SEQ ID NO: 12459 - DNA, 60 bp, Artificial Sequence
  Description of Artificial Sequence: Synthetic probe
cttagaccaattgagtccatttaagtgattactccaatcgtaacaattagaacatttaat

SEQ ID NO: 12460 - DNA, 60 bp, Artificial Sequence
  Description of Artificial Sequence: Synthetic probe
cggattaatcctaagtaagaaagcaacaggaacttgggtcttagaccaattgagtccatt

SEQ ID NO: 12461 - DNA, 60 bp, Artificial Sequence
  Description of Artificial Sequence: Synthetic probe
ggactcaaattcggattaatcctaagtaagaaagcaacaggaacttgggtcttagaccaa

SEQ ID NO: 12462 - DNA, 60 bp, Artificial Sequence
  Description of Artificial Sequence: Synthetic probe
cctttaggaagccattcaacatagggttgtacaagggaactcttgattttacctttacag

SEQ ID NO: 12463 - DNA, 60 bp, Artificial Sequence
  Description of Artificial Sequence: Synthetic probe
agagacctttaggaagccattcaacatagggttgtacaagggaactcttgattttacctt

SEQ ID NO: 12464 - DNA, 60 bp, Artificial Sequence
  Description of Artificial Sequence: Synthetic probe
cctcacagactggggctaattccgccgatgttcaacgttcaagagacctttaggaagcca

SEQ ID NO: 12465 - DNA, 60 bp, Artificial Sequence
  Description of Artificial Sequence: Synthetic probe
tgttttcttcctcacagactggggctaattccgccgatgttcaacgttcaagagaccttt

SEQ ID NO: 12466 - DNA, 60 bp, Artificial Sequence
  Description of Artificial Sequence: Synthetic probe
atcaaccagaatattatgccacattaacgggccgttgttttcttcctcacagactggggc

SEQ ID NO: 12467 - DNA, 60 bp, Artificial Sequence
  Description of Artificial Sequence: Synthetic probe
tattggcagacttgaatcaaccagaatattatgccacattaacgggccgttgttttcttc

SEQ ID NO: 12468 - DNA, 60 bp, Artificial Sequence
  Description of Artificial Sequence: Synthetic probe
ttggaatggttggaaagcgccctttttacaaaatcatagctgtgattggctcgagtcatc

SEQ ID NO: 12469 - DNA, 60 bp, Artificial Sequence
  Description of Artificial Sequence: Synthetic probe
gtaaccgcagccgtctcacagtgggacaactcttatattggaatggttggaaagcgccct

SEQ ID NO: 12470 - DNA, 60 bp, Artificial Sequence
  Description of Artificial Sequence: Synthetic probe
atcgtatgatgatgtaaccgcagccgtctcacagtgggacaactcttatattggaatggt

SEQ ID NO: 12471 - DNA, 51 bp, Artificial Sequence
  Description of Artificial Sequence: Synthetic probe
attccgattcatgttgaaaatgacggtccgatctaataagcctttcagatc

SEQ ID NO: 12472 - DNA, 60 bp, Artificial Sequence
  Description of Artificial Sequence: Synthetic probe
aaattccgattcatgttgaaaatgacggtccgatctaataagcctttcagatcgtatgat

SEQ ID NO: 12473 - DNA, 50 bp, Artificial Sequence
  Description of Artificial Sequence: Synthetic probe
atggggttaccacctccctatgatgagtcttgtccaatggagactcaacc

SEQ ID NO: 12474 - DNA, 60 bp, Artificial Sequence
  Description of Artificial Sequence: Synthetic probe
tgtacagagctccgaatctctctactcctcccactcaccaggacctgcacctagagcatc

SEQ ID NO: 12475 - DNA, 60 bp, Artificial Sequence
  Description of Artificial Sequence: Synthetic probe
taaatctcagaattctgtacagagctccgaatctctctactcctcccactcaccaggacc

SEQ ID NO: 12476 - DNA, 60 bp, Artificial Sequence
  Description of Artificial Sequence: Synthetic probe
cattgaggcggtttgtgagagttcaaaatattggaatttatcagaatgccaaattctgaa

SEQ ID NO: 12477 - DNA, 58 bp, Artificial Sequence
  Description of Artificial Sequence: Synthetic probe
cattgaggcggtttgtgagagttcaaaatattggaatttatcagaatgccaaattctg

SEQ ID NO: 12478 - DNA, 60 bp, Artificial Sequence
  Description of Artificial Sequence: Synthetic probe
ggactattcttggttctccgagttggtatccatctttgcattaaattaaagcacaccaag

SEQ ID NO: 12479 - DNA, 60 bp, Artificial Sequence
  Description of Artificial Sequence: Synthetic probe
gctcaaaggctcaggtgttcgaacatcctcacattcaagacgctgcttcgcaacttcctg

SEQ ID NO: 12480 - DNA, 55 bp, Artificial Sequence
  Description of Artificial Sequence: Synthetic probe
actggaggcaaggcctgcaaaatgcaatactgcaagcattggggagtcagactcc

SEQ ID NO: 12481 - DNA, 60 bp, Artificial Sequence
  Description of Artificial Sequence: Synthetic probe
ggaaaatgcagcaattacatatgccccactgtccataactctacaacctggcattctgac

SEQ ID NO: 12482 - DNA, 60 bp, Artificial Sequence
  Description of Artificial Sequence: Synthetic probe
actaacagagatcgatctgtttacgcgtcactatgaagtgccttttgtacttagcctttt

SEQ ID NO: 12483 - DNA, 60 bp, Artificial Sequence
  Description of Artificial Sequence: Synthetic probe
cccagtggctttcgacgattaaagcagtcgtgcaaagtgccaaatactggaatctggcag

SEQ ID NO: 12484 - DNA, 60 bp, Artificial Sequence
  Description of Artificial Sequence: Synthetic probe
gcacaacgagctgaaaagtccaattatgagttgttccaagaggatggagtggaagagcat

SEQ ID NO: 12485 - DNA, 60 bp, Artificial Sequence
  Description of Artificial Sequence: Synthetic probe
gcctttcacttctggggtcaactggctgcactcttgctaagatcgactcgggcaaaaaat

SEQ ID NO: 12486 - DNA, 60 bp, Artificial Sequence
  Description of Artificial Sequence: Synthetic probe
gataaatggcttcctatttacatcctaggcctctatcgagtaggtagatccaaagtgaca

SEQ ID NO: 12487 - DNA, 60 bp, Artificial Sequence
  Description of Artificial Sequence: Synthetic probe
cagcaaggtcagcggactttcaattgaggacctaacaacatgggttctgaatcgagaagt

SEQ ID NO: 12488 - DNA, 60 bp, Artificial Sequence
  Description of Artificial Sequence: Synthetic probe
aggcagagtttaacaagtgacccttaaataccacatcactattatattctatgttatata

SEQ ID NO: 12489 - DNA, 51 bp, Artificial Sequence
  Description of Artificial Sequence: Synthetic probe
caaaaggaagaaatgtcgtggactggcttggctggtatgatgacaacgggg

SEQ ID NO: 12490 - DNA, 60 bp, Artificial Sequence
  Description of Artificial Sequence: Synthetic probe
caaaaggaagaaatgtcgtggactggcttggctggtatgatgacaacgggggaaaaccca

SEQ ID NO: 12491 - DNA, 53 bp, Artificial Sequence
  Description of Artificial Sequence: Synthetic probe
tatcagtgcttggaggccatcaaagcatataaggatggagtcagtttcaatcc

SEQ ID NO: 12492 - DNA, 60 bp, Artificial Sequence
  Description of Artificial Sequence: Synthetic probe
tgaagaaccgacagactatcagtgcttggaggccatcaaagcatataaggatggagttag

SEQ ID NO: 12493 - DNA, 60 bp, Artificial Sequence
  Description of Artificial Sequence: Synthetic probe
tgaggaaccgacagactatcagtgcttggaggccatcaaagcatataaggatggagttag

SEQ ID NO: 12494 - DNA, 60 bp, Artificial Sequence
  Description of Artificial Sequence: Synthetic probe
gacctgcacctagagcatcagattcaacgaatctatgggactttaagtctacagaggtgc

SEQ ID NO: 12495 - DNA, 60 bp, Artificial Sequence
  Description of Artificial Sequence: Synthetic probe
ccggacctgcacctagagcatcagattcaacgaatctatgggactttaagtctacagagg

SEQ ID NO: 12496 - DNA, 60 bp, Artificial Sequence
  Description of Artificial Sequence: Synthetic probe
caccaggacctgcacctagagcatcagattcaacgaatctatgggactttaagtctacag

SEQ ID NO: 12497 - DNA, 60 bp, Artificial Sequence
  Description of Artificial Sequence: Synthetic probe
caccaggacctgcccctagagcatcagattcaacgaatctatgggacttgaagtccacag

SEQ ID NO: 12498 - DNA, 60 bp, Artificial Sequence
  Description of Artificial Sequence: Synthetic probe
cacccggacctgcacctagagcatcagattcaacgaatctatgggactttaagtctacag

SEQ ID NO: 12499 - DNA, 60 bp, Artificial Sequence
  Description of Artificial Sequence: Synthetic probe
cctcccattcaccaggacctgcccctagagcatcagattcaacgaatctatgggacttga

SEQ ID NO: 12500 - DNA, 60 bp, Artificial Sequence
  Description of Artificial Sequence: Synthetic probe
gttggattgactaaggttcagacagaacagtggaagaagaccatcgaggcagtctgtgag

SEQ ID NO: 12501 - DNA, 50 bp, Artificial Sequence
  Description of Artificial Sequence: Synthetic probe
aagtctacagaggtgcaactgacctcaaagagagcaggagttaaggacat

SEQ ID NO: 12502 - DNA, 60 bp, Artificial Sequence
  Description of Artificial Sequence: Synthetic probe
cctccagttggattgactaaggttcagacagaacagtggaggaagaccattgaggcagtc

SEQ ID NO: 12503 - DNA, 60 bp, Artificial Sequence
  Description of Artificial Sequence: Synthetic probe
tccaaagtgccaaatactggaatctagccgagtgcacatttgaagcatctggagaagggg

SEQ ID NO: 12504 - DNA, 60 bp, Artificial Sequence
  Description of Artificial Sequence: Synthetic probe
cgtccaaagtgccaaatactggaatctagccgagtgcacattcgaagcatctggagaagg

SEQ ID NO: 12505 - DNA, 60 bp, Artificial Sequence
  Description of Artificial Sequence: Synthetic probe
cgattaaagcagtcgtccaaagtgccaaatactggaatctagccgagtgcacatttgaag

SEQ ID NO: 12506 - DNA, 60 bp, Artificial Sequence
  Description of Artificial Sequence: Synthetic probe
cagagggtttgagtggagagcagaaatcccagtggcttttaacgattaaagcagtcgtcc

SEQ ID NO: 12507 - DNA, 60 bp, Artificial Sequence
  Description of Artificial Sequence: Synthetic probe
ggctttgccagagggtttgagtggagagcagaaatcccagtggcttttaacgattaaagc

SEQ ID NO: 12508 - DNA, 59 bp, Artificial Sequence
  Description of Artificial Sequence: Synthetic probe
aagtggatattgtattcacttcggactggaaacagcctgagcttgaatctaatgagcat

SEQ ID NO: 12509 - DNA, 60 bp, Artificial Sequence
  Description of Artificial Sequence: Synthetic probe
tacactccagatgatagtaccggaggattgacgactaatgcaccgccacaaggcagagat

SEQ ID NO: 12510 - DNA, 60 bp, Artificial Sequence
  Description of Artificial Sequence: Synthetic probe
tcaatcatacatgtcaacagctacttgtatggagcattgaaggacatccggggtaagttg

SEQ ID NO: 12511 - DNA, 60 bp, Artificial Sequence
  Description of Artificial Sequence: Synthetic probe
tgtatcaatcatacatgtcaacagctacttgtatggagcattaaaggacatccggggtaa

SEQ ID NO: 12512 - DNA, 60 bp, Artificial Sequence
  Description of Artificial Sequence: Synthetic probe
tgtatcaatcatacatgtcaacagctacttgtatggagcattgaaggacatccggggtaa

SEQ ID NO: 12513 - DNA, 60 bp, Artificial Sequence
  Description of Artificial Sequence: Synthetic probe
tacagttaagagaatcattaacgactcaattattcagccgaaattaccggccaacgagga

SEQ ID NO: 12514 - DNA, 60 bp, Artificial Sequence
  Description of Artificial Sequence: Synthetic probe
ctacagttaagagaatcattaacgactcaattattcagccaaaattaccggccaacgagg

SEQ ID NO: 12515 - DNA, 60 bp, Artificial Sequence
  Description of Artificial Sequence: Synthetic probe
ctacagttaagagaatcattaacgactcaattattcagcctaaattaccggccaacgagg

SEQ ID NO: 12516 - DNA, 53 bp, Artificial Sequence
  Description of Artificial Sequence: Synthetic probe
tggaaaggattgtgaaacattgggagcacccacacatagaagctgctcagacg

SEQ ID NO: 12517 - DNA, 60 bp, Artificial Sequence
  Description of Artificial Sequence: Synthetic probe
agagagtcctgttatacccagaatggaagggaaagttgcgggaaccagaattgttcggca

SEQ ID NO: 12518 - DNA, 60 bp, Artificial Sequence
  Description of Artificial Sequence: Synthetic probe
tctacgagttgagttagaaaatcctgttatacccagaatggaagggaaagttgcggggac

SEQ ID NO: 12519 - DNA, 60 bp, Artificial Sequence
  Description of Artificial Sequence: Synthetic probe
caccaggggaacatgcaacagacatatctctaatatcagatgtggaacggatacttgatt

SEQ ID NO: 12520 - DNA, 64 bp, Artificial Sequence
  Description of Artificial Sequence: Synthetic probe
cacttgtgattttagatggtatggaccaaaatatataactcattccatacataatgaggaaccg

SEQ ID NO: 12521 - DNA, 60 bp, Artificial Sequence
  Description of Artificial Sequence: Synthetic probe
gggcaaaattgaaattgtctttccccaacataccacaggggattggaaaagagtgccaca

SEQ ID NO: 12522 - DNA, 60 bp, Artificial Sequence
  Description of Artificial Sequence: Synthetic probe
aatctgatgtcccaccgaaaggaagaaatgttgtagactggctcggttggtatgatgaca

SEQ ID NO: 12523 - DNA, 51 bp, Artificial Sequence
  Description of Artificial Sequence: Synthetic probe
ccctaaatgatttgagggcctatgtctaccagggaatcaaatccggtaatc

SEQ ID NO: 12524 - DNA, 60 bp, Artificial Sequence
  Description of Artificial Sequence: Synthetic probe
tattatatgtgagcactaaagtagccctaaatgatttgagggcctatgtctaccagggaa

SEQ ID NO: 12525 - DNA, 58 bp, Artificial Sequence
  Description of Artificial Sequence: Synthetic probe
catgaacgtgctccgatcagatacggaaccatagtctcacgattcaaagactgtgcag

SEQ ID NO: 12526 - DNA, 60 bp, Artificial Sequence
  Description of Artificial Sequence: Synthetic probe
tttgaaagccttgttgaagatggtcttgacttcttcgacatctgggaaaatgatcccaat

SEQ ID NO: 12527 - DNA, 60 bp, Artificial Sequence
  Description of Artificial Sequence: Synthetic probe
cagggaatcaaatccggtaatccatcaatactccacataaatgcttatctttatgccgcg

SEQ ID NO: 12528 - DNA, 60 bp, Artificial Sequence
  Description of Artificial Sequence: Synthetic probe
ccagggaatcaaatccggtaatccatcaatactccacataaatgcttatctttatgccgc

SEQ ID NO: 12529 - DNA, 60 bp, Artificial Sequence
  Description of Artificial Sequence: Synthetic probe
taccagggaatcaaatccggtaatccatcaatactccacataaatgcttatctttatgcc

SEQ ID NO: 12530 - DNA, 60 bp, Artificial Sequence
  Description of Artificial Sequence: Synthetic probe
gcctatgtctaccagggaatcaaatccggtaatccatcaatactccacataaatgcttat

SEQ ID NO: 12531 - DNA, 51 bp, Artificial Sequence
  Description of Artificial Sequence: Synthetic probe
ccctaaatgatttaagggcctatgtctaccagggaatcaaatccggtaatc

SEQ ID NO: 12532 - DNA, 60 bp, Artificial Sequence
  Description of Artificial Sequence: Synthetic probe
tattatatgtgagcactaaagtagccctaaatgatttaagggcctatgtctaccagggaa

SEQ ID NO: 12533 - DNA, 60 bp, Artificial Sequence
  Description of Artificial Sequence: Synthetic probe
ccggctgattacttcgaaaataacaccaacatagtattatatgtgaacaccaaagtggca

SEQ ID NO: 12534 - DNA, 57 bp, Artificial Sequence
  Description of Artificial Sequence: Synthetic probe
ccggctgattacttcgaaaataacaccaacatagtgttgtatgtgaacaccaaagta

SEQ ID NO: 12535 - DNA, 60 bp, Artificial Sequence
  Description of Artificial Sequence: Synthetic probe
cagcctaaactaccggccaatgaggatccggtagagtatccggctgattacttcgaaaat

SEQ ID NO: 12536 - DNA, 56 bp, Artificial Sequence
  Description of Artificial Sequence: Synthetic probe
gccttgcaggatgcaaatgaatccgaagagagaagagaggataaatatctccagga

SEQ ID NO: 12537 - DNA, 60 bp, Artificial Sequence
  Description of Artificial Sequence: Synthetic probe
gtttacatcttcagatggggagagtgtatgcagtcaattattcacactggtcggaggaac

SEQ ID NO: 12538 - DNA, 60 bp, Artificial Sequence
  Description of Artificial Sequence: Synthetic probe
gtggtttacatcttcagatggggagagtgtatgcagtcaattattcacattggttggagg

SEQ ID NO: 12539 - DNA, 60 bp, Artificial Sequence
  Description of Artificial Sequence: Synthetic probe
tctaccaagtggtttacatcttcagatggggagagtgtatgcagtcaattattcacattg

SEQ ID NO: 12540 - DNA, 60 bp, Artificial Sequence
  Description of Artificial Sequence: Synthetic probe
tctaccaaatggtttacatcttcagatggggagagtgtatgcagtcaattattcacactg

SEQ ID NO: 12541 - DNA, 60 bp, Artificial Sequence
  Description of Artificial Sequence: Synthetic probe
gaacggatacttgattatgctctttgtcaaaatacctggagcaagattgaagcaggagaa

SEQ ID NO: 12542 - DNA, 60 bp, Artificial Sequence
  Description of Artificial Sequence: Synthetic probe
gaggagattacctcaataggattaccagaaaccggaatcaggagcaattacttcccctat

SEQ ID NO: 12543 - DNA, 60 bp, Artificial Sequence
  Description of Artificial Sequence: Synthetic probe
cagacatcaatatgttgtcttacctcatccttgcaattgctatctcgcccatactgggca

SEQ ID NO: 12544 - DNA, 60 bp, Artificial Sequence
  Description of Artificial Sequence: Synthetic probe
cagacatcaatatgttgtcttacctcatccttgcacttaccatctcgcccatactgggca

SEQ ID NO: 12545 - DNA, 60 bp, Artificial Sequence
  Description of Artificial Sequence: Synthetic probe
aacagacatcaatatgttgtcttacctcatccttgcacttaccatctcgcccatactggg

SEQ ID NO: 12546 - DNA, 60 bp, Artificial Sequence
  Description of Artificial Sequence: Synthetic probe
aacagacatcaatatgttgtcttacctcatccttgcaattgctatctcgcccatactggg

SEQ ID NO: 12547 - DNA, 60 bp, Artificial Sequence
  Description of Artificial Sequence: Synthetic probe
ccatcaatctatgggatttaaagtccaccgaagtacaattgatctccaagagagccggag

SEQ ID NO: 12548 - DNA, 60 bp, Artificial Sequence
  Description of Artificial Sequence: Synthetic probe
gagtccatcaatctatgggatttaaagtccaccgaagtacaattgatctccaagagagcc

SEQ ID NO: 12549 - DNA, 60 bp, Artificial Sequence
  Description of Artificial Sequence: Synthetic probe
aaaacccaggggttgggccggtcttcaccatcattaacggttccctgcattattttacat

SEQ ID NO: 12550 - DNA, 60 bp, Artificial Sequence
  Description of Artificial Sequence: Synthetic probe
gaactcacatgggactcaaacaggaatccctgttgagttgacaatgccaaaaggactaac

SEQ ID NO: 12551 - DNA, 60 bp, Artificial Sequence
  Description of Artificial Sequence: Synthetic probe
gcgtgcagtcatgtctcttcaagggctaagggacaagacaatagggaaatatgccaagtc

SEQ ID NO: 12552 - DNA, 60 bp, Artificial Sequence
  Description of Artificial Sequence: Synthetic probe
atcatcggaaaccaacacccgatatgctgcagtatgctaagcgtgcagtcatgtctcttc

SEQ ID NO: 12553 - DNA, 60 bp, Artificial Sequence
  Description of Artificial Sequence: Synthetic probe
ggtggtttgatgacaatcatcggaaaccaacacccgatatgctgcagtatgctaagcgtg

SEQ ID NO: 12554 - DNA, 60 bp, Artificial Sequence
  Description of Artificial Sequence: Synthetic probe
gctcctcctcaagggagggatgtcgtagagtggcttgggtggtttgatgacaatcatcgg

SEQ ID NO: 12555 - DNA, 60 bp, Artificial Sequence
  Description of Artificial Sequence: Synthetic probe
gggagacaataagtatgtgccagataactcagatggaggcttaactacaaacgctcctcc

SEQ ID NO: 12556 - DNA, 60 bp, Artificial Sequence
  Description of Artificial Sequence: Synthetic probe
cggggttgctttatgcctatgcagttggttcctccgcagatctgactcagcaattctaca

SEQ ID NO: 12557 - DNA, 60 bp, Artificial Sequence
  Description of Artificial Sequence: Synthetic probe
gcaagacagccagatgacatagaatacacttcgttgacaactgcggggttgctttatgcc

SEQ ID NO: 12558 - DNA, 60 bp, Artificial Sequence
  Description of Artificial Sequence: Synthetic probe
ggggtcaattgacagccttgttgttaaggtctaccagagccaagaacgcaagacagccag

SEQ ID NO: 12559 - DNA, 60 bp, Artificial Sequence
  Description of Artificial Sequence: Synthetic probe
ccagggcaggaaatcgacaaagctgactcgtatatgccgtatttgattgacttcggcttg

SEQ ID NO: 12560 - DNA, 56 bp, Artificial Sequence
  Description of Artificial Sequence: Synthetic probe
caggaatgtcaactgaggaagtaactacgtggatcttaaacagagaagttggcgat

SEQ ID NO: 12561 - DNA, 60 bp, Artificial Sequence
  Description of Artificial Sequence: Synthetic probe
tctgagatatggaacaatcgtatcacgatttaaggactgtgccgctctggccacctttgg

SEQ ID NO: 12562 - DNA, 60 bp, Artificial Sequence
  Description of Artificial Sequence: Synthetic probe
gacaaatttgaaccgttgatcccagagggacgtgacttctttgatctttggggaaatgat

SEQ ID NO: 12563 - DNA, 60 bp, Artificial Sequence
  Description of Artificial Sequence: Synthetic probe
gagttggacgaacacaaatgacagactacaggaagcgtctgatggatggattgatcaatc

SEQ ID NO: 12564 - DNA, 60 bp, Artificial Sequence
  Description of Artificial Sequence: Synthetic probe
gtgcagacgacaactggcttccactttacctgctaggactctacagagttggacgaacac

SEQ ID NO: 12565 - DNA, 60 bp, Artificial Sequence
  Description of Artificial Sequence: Synthetic probe
ggcctggaaggggtttgcccagatggagtgtcagatgcatctaggactagtgcagacgac

SEQ ID NO: 12566 - DNA, 60 bp, Artificial Sequence
  Description of Artificial Sequence: Synthetic probe
ccaggccaaattggatcgggattggacatcctttggtgtcaacattggcagagcaggagc

SEQ ID NO: 12567 - DNA, 60 bp, Artificial Sequence
  Description of Artificial Sequence: Synthetic probe
tgtaaacagttatctttatgctgcattaaaagatgtccaggccaaattggatcgggattg

SEQ ID NO: 12568 - DNA, 60 bp, Artificial Sequence
  Description of Artificial Sequence: Synthetic probe
agtgtcaatcattcatgtaaacagttatctttatgctgcattaaaagatgtccaggccaa

SEQ ID NO: 12569 - DNA, 60 bp, Artificial Sequence
  Description of Artificial Sequence: Synthetic probe
gtcttgcagagctccgaggattcgtttatcaggggctaaaatcaggggtagtgtcaatca

SEQ ID NO: 12570 - DNA, 60 bp, Artificial Sequence
  Description of Artificial Sequence: Synthetic probe
cgcgagtgaagaccctgttgaataccctgcagattacttcaagaaaacatctgaaatccc

SEQ ID NO: 12571 - DNA, 51 bp, Artificial Sequence
  Description of Artificial Sequence: Synthetic probe
ccattgaggcggtttgtgagagttcaaaatattggaatttatcagaatgcc

SEQ ID NO: 12572 - DNA, 60 bp, Artificial Sequence
  Description of Artificial Sequence: Synthetic probe
cattgaggcggtttgtgagagttcaaaatattggaatttatcagaatgccaaattcttaa

SEQ ID NO: 12573 - DNA, 60 bp, Artificial Sequence
  Description of Artificial Sequence: Synthetic probe
ttcaaggggggaacaacatgtacttttacaaaaactacagacacgtaaaaaccatacctg

SEQ ID NO: 12574 - DNA, 60 bp, Artificial Sequence
  Description of Artificial Sequence: Synthetic probe
ttactccctttactctggaaaaaaacaagtctggggtatatgaatccagatggctctcgg

SEQ ID NO: 12575 - DNA, 54 bp, Artificial Sequence
  Description of Artificial Sequence: Synthetic probe
aaaacaagtctggggtatatgaatccagatggctctcggttagggtatccgaaa

SEQ ID NO: 12576 - DNA, 60 bp, Artificial Sequence
  Description of Artificial Sequence: Synthetic probe
gcaaggggtcagcatgatactggggctgctttcggataccctaaccgagagccatctgga

SEQ ID NO: 12577 - DNA, 60 bp, Artificial Sequence
  Description of Artificial Sequence: Synthetic probe
tggctctcggttagggtatccgaaagcagccccagtatcatgctgaccccttgcagagga

SEQ ID NO: 12578 - DNA, 60 bp, Artificial Sequence
  Description of Artificial Sequence: Synthetic probe
ggctctcggttagggtatccgaaagcagccccagtatcatgctgaccccttgcagaggaa

SEQ ID NO: 12579 - DNA, 60 bp, Artificial Sequence
  Description of Artificial Sequence: Synthetic probe
tagcctacagtgcggacggcgtggagcacagtttatttcagacaaacacggtagcctgct

SEQ ID NO: 12580 - DNA, 60 bp, Artificial Sequence
  Description of Artificial Sequence: Synthetic probe
gcctacagtgcggacggcgtggagcacagtttatttcagacaaacacggtagcctgctcc

SEQ ID NO: 12581 - DNA, 60 bp, Artificial Sequence
  Description of Artificial Sequence: Synthetic probe
ggtaggagcaggctaccgtgtttgtctgaaataaactgtgctccacgccgtccgcactgt

SEQ ID NO: 12582 - DNA, 60 bp, Artificial Sequence
  Description of Artificial Sequence: Synthetic probe
gacccgactctgaccgagcgaggcttcgatatgtcagtgaaggcagacctggtgtccatg

SEQ ID NO: 12583 - DNA, 60 bp, Artificial Sequence
  Description of Artificial Sequence: Synthetic probe
agaaccgtgtctgtgctccgagactacaaccctggtggactacaaggaccgaggcagctg

SEQ ID NO: 12584 - DNA, 60 bp, Artificial Sequence
  Description of Artificial Sequence: Synthetic probe
gatcctttgaagtacagtttaagtgtaaagagtacgtggcttcctttaatgtagggtccc

SEQ ID NO: 12585 - DNA, 60 bp, Artificial Sequence
  Description of Artificial Sequence: Synthetic probe
gctagcacctatttgggaccctacattaaaggaagccacgtactctttacacttaaactg

SEQ ID NO: 12586 - DNA, 60 bp, Artificial Sequence
  Description of Artificial Sequence: Synthetic probe
taaaaagctagcacctatttgggaccctacattaaaggaagccacgtactctttacactt

SEQ ID NO: 12587 - DNA, 60 bp, Artificial Sequence
  Description of Artificial Sequence: Synthetic probe
cgaaggagaaggacctggaggagaagtagaaggtcctggaggcgaaggagaaggacctgg

SEQ ID NO: 12588 - DNA, 60 bp, Artificial Sequence
  Description of Artificial Sequence: Synthetic probe
gcgaaggagaaggacctggaggagaagtagaaggtcctggaggcgaaggagaaggacctg

SEQ ID NO: 12589 - DNA, 60 bp, Artificial Sequence
  Description of Artificial Sequence: Synthetic probe
ctggaggcgaaggagaaggacctggaggagaagtagaaggtcctggaggcgaaggagaag

SEQ ID NO: 12590 - DNA, 60 bp, Artificial Sequence
  Description of Artificial Sequence: Synthetic probe
tcctggaggcgaaggagaaggacctggaggagaagtagaaggtcctggaggcgaaggaga

SEQ ID NO: 12591 - DNA, 59 bp, Artificial Sequence
  Description of Artificial Sequence: Synthetic probe
ggggaagaagacctgggcccaagaaaaaaacagtaactgaaggcaaaggagaaggacct

SEQ ID NO: 12592 - DNA, 51 bp, Artificial Sequence
  Description of Artificial Sequence: Synthetic probe
tgaccgctgtgagctacgggcgggccatgaggtcctttgaccagtttaagc

SEQ ID NO: 12593 - DNA, 60 bp, Artificial Sequence
  Description of Artificial Sequence: Synthetic probe
ccgacctggacatgctggagtacattggcacagtgaaaaccatcacctccgccctccagt

SEQ ID NO: 12594 - DNA, 60 bp, Artificial Sequence
  Description of Artificial Sequence: Synthetic probe
tacaacctgaccgtggatttgcagcccatggacgggttgagcaacagcgtgcgccgctac

SEQ ID NO: 12595 - DNA, 60 bp, Artificial Sequence
  Description of Artificial Sequence: Synthetic probe
tcaccaaccagcatgagttttcaaagtcggtgccccactacgaggcccggcggatggaca

SEQ ID NO: 12596 - DNA, 60 bp, Artificial Sequence
  Description of Artificial Sequence: Synthetic probe
ctattctgatgctatcaccaaccagcatgagttttcaaagtcggtgccccactacgaggc

SEQ ID NO: 12597 - DNA, 60 bp, Artificial Sequence
  Description of Artificial Sequence: Synthetic probe
ggaaaatcgtaaccacctctacggtctacaatggtatctattctgatgctatcaccaacc

SEQ ID NO: 12598 - DNA, 60 bp, Artificial Sequence
  Description of Artificial Sequence: Synthetic probe
ggaaaatcgtgaccacctctacggtctacaatggtatctattctgatgctatcaccaacc

SEQ ID NO: 12599 - DNA, 60 bp, Artificial Sequence
  Description of Artificial Sequence: Synthetic probe
gtgagaaagtaccggaaaatcgtgaccacctctacggtctacaatggtatctattctgat

SEQ ID NO: 12600 - DNA, 60 bp, Artificial Sequence
  Description of Artificial Sequence: Synthetic probe
gtgagaaagttccggaaaatcgtgaccacctctacggtctacaatggtatctattctgat

SEQ ID NO: 12601 - DNA, 60 bp, Artificial Sequence
  Description of Artificial Sequence: Synthetic probe
tcttcaaggaaaatatagtgccctatgtgtttaaggtgagaaagttccggaaaatcgtga

SEQ ID NO: 12602 - DNA, 60 bp, Artificial Sequence
  Description of Artificial Sequence: Synthetic probe
tctttaaggaaaatatagtgccctatgtgtttaaggtgagaaagtaccggaaaatcgtga

SEQ ID NO: 12603 - DNA, 60 bp, Artificial Sequence
  Description of Artificial Sequence: Synthetic probe
gatctttaaggaaaatatagtgccctatgtgtttaaggtgagaaagtaccggaaaatcgt

SEQ ID NO: 12604 - DNA, 60 bp, Artificial Sequence
  Description of Artificial Sequence: Synthetic probe
aggggattttgttgatctttaaggaaaatatagtgccctatgtgtttaaggtgagaaagt

SEQ ID NO: 12605 - DNA, 60 bp, Artificial Sequence
  Description of Artificial Sequence: Synthetic probe
aggggattttgttgatcttcaaggaaaatatagtgccctatgtgtttaaggtgagaaagt

SEQ ID NO: 12606 - DNA, 60 bp, Artificial Sequence
  Description of Artificial Sequence: Synthetic probe
gcagcgcctccaacatcggagacatcttccgcttccagacaacacactcctgccccaaca

SEQ ID NO: 12607 - DNA, 60 bp, Artificial Sequence
  Description of Artificial Sequence: Synthetic probe
atgcagcgcctccaacatcgaagagacatcttccgcttccagacaacacactcctgcccc

SEQ ID NO: 12608 - DNA, 60 bp, Artificial Sequence
  Description of Artificial Sequence: Synthetic probe
gtatgcagcgcctccaacatcggagacatcttccgcttccagacaacacactcctgcccc

SEQ ID NO: 12609 - DNA, 60 bp, Artificial Sequence
  Description of Artificial Sequence: Synthetic probe
ctcaatgaggaggaagggtctataaaccggggccccatggacccctctgccttccccttc

SEQ ID NO: 12610 - DNA, 60 bp, Artificial Sequence
  Description of Artificial Sequence: Synthetic probe
ctcaatgaggaggaagggtctataaaccggggcccccatggcccctctgccttccccttc

SEQ ID NO: 12611 - DNA, 60 bp, Artificial Sequence
  Description of Artificial Sequence: Synthetic probe
tgagctctgctgcgctcacggccctcttatgcctcgctgcctgcctgggacagactccca

SEQ ID NO: 12612 - DNA, 60 bp, Artificial Sequence
  Description of Artificial Sequence: Synthetic probe
gctcagccccacttgtcctagttcatagcaataaaaagtggatatttaaagacttgtacg

SEQ ID NO: 12613 - DNA, 60 bp, Artificial Sequence
  Description of Artificial Sequence: Synthetic probe
agagctcagccccacttgtcctagttcatagcaataaaaagtggatatttaaagacttgt

SEQ ID NO: 12614 - DNA, 60 bp, Artificial Sequence
  Description of Artificial Sequence: Synthetic probe
gagaggctgctaaatgttgttaactatgtgtgtactgaccacaaggaagactttagcatg

SEQ ID NO: 12615 - DNA, 60 bp, Artificial Sequence
  Description of Artificial Sequence: Synthetic probe
ggtcaacgttgtcagctacgtctgtactgaccacaaggaggactttagcatgcaggaatc

SEQ ID NO: 12616 - DNA, 60 bp, Artificial Sequence
  Description of Artificial Sequence: Synthetic probe
ttctggtcgggcggtcggaacgagacggagcctaacaaggagccccggagaaccgtgtct

SEQ ID NO: 12617 - DNA, 60 bp, Artificial Sequence
  Description of Artificial Sequence: Synthetic probe
ttctggtcgggcggtgcgaacgagacggagcctaacaaggagccccggagaaccgtgtct

SEQ ID NO: 12618 - DNA, 60 bp, Artificial Sequence
  Description of Artificial Sequence: Synthetic probe
gcccttctggtcgggcggtcggaacgagacggagcctaacaaggagccccggagaaccgt

SEQ ID NO: 12619 - DNA, 60 bp, Artificial Sequence
  Description of Artificial Sequence: Synthetic probe
gcccttctggtcgggcggtgcgaacgagacggagcctaacaaggagccccggagaaccgt

SEQ ID NO: 12620 - DNA, 60 bp, Artificial Sequence
  Description of Artificial Sequence: Synthetic probe
ccccgctagcaccctgagctctgctgcgctcacggccctcttatgcctcgctgcctgcct

SEQ ID NO: 12621 - DNA, 60 bp, Artificial Sequence
  Description of Artificial Sequence: Synthetic probe
tatcatccaggcccacaacctgtgctactccacgctgatacccggaggcgatctgcacct

SEQ ID NO: 12622 - DNA, 60 bp, Artificial Sequence
  Description of Artificial Sequence: Synthetic probe
cagtatcatccaggcccacaacctgtgctactccacgctgatacccggaggcgatctgca

SEQ ID NO: 12623 - DNA, 60 bp, Artificial Sequence
  Description of Artificial Sequence: Synthetic probe
acctgaccgtggatttgcagcccatggacgggttgagcaacagcgtgcgccgctacaaca

SEQ ID NO: 12624 - DNA, 60 bp, Artificial Sequence
  Description of Artificial Sequence: Synthetic probe
aacctgaccgtggatttgcagccatggacgggttgagcaacagcgtgcgccgctacaaca

SEQ ID NO: 12625 - DNA, 60 bp, Artificial Sequence
  Description of Artificial Sequence: Synthetic probe
caacctgaccgtggatttgcagccatggacgggttgagcaacagcgtgcgccgctacaac

SEQ ID NO: 12626 - DNA, 60 bp, Artificial Sequence
  Description of Artificial Sequence: Synthetic probe
tgagccctgctgcgctcacgaccctcttatgcctcgctgcctgcctgggacagactccca

SEQ ID NO: 12627 - DNA, 60 bp, Artificial Sequence
  Description of Artificial Sequence: Synthetic probe
cctatagcaaaacaaagaccaactcccttttttacgtgtacaagccccaggagggaaact

SEQ ID NO: 12628 - DNA, 60 bp, Artificial Sequence
  Description of Artificial Sequence: Synthetic probe
tctggacgtccagagcctacagcagatatgtccaacccagactctaaaaattcacgcgca

SEQ ID NO: 12629 - DNA, 51 bp, Artificial Sequence
  Description of Artificial Sequence: Synthetic probe
atgatagccgagaccgtgactctccagggccgaaccatgttggagaagaca

SEQ ID NO: 12630 - DNA, 60 bp, Artificial Sequence
  Description of Artificial Sequence: Synthetic probe
tgccctgcctcatgatagccgagaccgtgactctccagggccgaaccatgttggagaaga

SEQ ID NO: 12631 - DNA, 60 bp, Artificial Sequence
  Description of Artificial Sequence: Synthetic probe
atttacaggggtagcctccggcatgctgccctgcctcatgatagccgagaccgtgactct

SEQ ID NO: 12632 - DNA, 60 bp, Artificial Sequence
  Description of Artificial Sequence: Synthetic probe
actcggtgtatggatttacaggggtagcctccggcatgctgccctgcctcatgatagccg

SEQ ID NO: 12633 - DNA, 60 bp, Artificial Sequence
  Description of Artificial Sequence: Synthetic probe
gacctgtactaatgttaaccgctcctgcctgaggattattcattgcatcctgcaacaaga

SEQ ID NO: 12634 - DNA, 60 bp, Artificial Sequence
  Description of Artificial Sequence: Synthetic probe
tcttgttgcaggatgcaatgaataatcctcaggcaggagcggttaacattagtacaggtc

SEQ ID NO: 12635 - DNA, 60 bp, Artificial Sequence
  Description of Artificial Sequence: Synthetic probe
gttccaattcttgttgcaggatgcaatgaataatcctcaggcaggagcggttaacattag

SEQ ID NO: 12636 - DNA, 60 bp, Artificial Sequence
  Description of Artificial Sequence: Synthetic probe
aacaactggatcctttgaagtacagtttaagtgtaaagagtacgtggcttcctttaatgt

SEQ ID NO: 12637 - DNA, 55 bp, Artificial Sequence
  Description of Artificial Sequence: Synthetic probe
cggcgcaagcggccaccgaaacatcaaccagagactgacagggcaaaacgtaaaa

SEQ ID NO: 12638 - DNA, 60 bp, Artificial Sequence
  Description of Artificial Sequence: Synthetic probe
cggcgcaagcggccaccgaaacatcaaccagagactgacagggcaaaacgtaaaaagcta

SEQ ID NO: 12639 - DNA, 60 bp, Artificial Sequence
  Description of Artificial Sequence: Synthetic probe
atggaaggcccttctagcgggcctccagtaagaggccggcgcaagcggccaccgaaacat

SEQ ID NO: 12640 - DNA, 53 bp, Artificial Sequence
  Description of Artificial Sequence: Synthetic probe
cgcttgcgccggcctcttactggaggcccgctagaagggccttccatagggtc

SEQ ID NO: 12641 - DNA, 60 bp, Artificial Sequence
  Description of Artificial Sequence: Synthetic probe
agccagaagaccctatggaaggcccttctagcgggcctccagtaagaggccggcgcaagc

SEQ ID NO: 12642 - DNA, 60 bp, Artificial Sequence
  Description of Artificial Sequence: Synthetic probe
agaggctgctaaatgttgttaactatgtgtgcactgaccacaaggaggactttagcatgc

SEQ ID NO: 12643 - DNA, 60 bp, Artificial Sequence
  Description of Artificial Sequence: Synthetic probe
cctgcatgctaaagtcctccttgtggtcagtgcacacatagttaacaacatttagcagcc

SEQ ID NO: 12644 - DNA, 60 bp, Artificial Sequence
  Description of Artificial Sequence: Synthetic probe
ggctgctaaatgttgttaactatgtgtgcactgaccacaaggaggactttagcatgcagg

SEQ ID NO: 12645 - DNA, 60 bp, Artificial Sequence
  Description of Artificial Sequence: Synthetic probe
tttagcatgcaggaaggccttatttcctgcccctgttacagtctacacgtcccttcctac

SEQ ID NO: 12646 - DNA, 60 bp, Artificial Sequence
  Description of Artificial Sequence: Synthetic probe
catgcaggaaggccttatttcctgcccctgttacagtctacacgtcccttcctacatatc

SEQ ID NO: 12647 - DNA, 60 bp, Artificial Sequence
  Description of Artificial Sequence: Synthetic probe
taagaacaggttggtagtgttcttaatctgtgtgtctattgatatgtaggaagggacgtg

SEQ ID NO: 12648 - DNA, 60 bp, Artificial Sequence
  Description of Artificial Sequence: Synthetic probe
cccttcctacatatcaatagacacacagattaagaacactaccaacctgttcttagatgg

SEQ ID NO: 12649 - DNA, 60 bp, Artificial Sequence
  Description of Artificial Sequence: Synthetic probe
caatagacacacagattaagaacactaccaacctgttcttagatggagtcttctccactg

SEQ ID NO: 12650 - DNA, 60 bp, Artificial Sequence
  Description of Artificial Sequence: Synthetic probe
tcttagatggagtcttctccactgagctcatgggggattctaaccaccactcccaatctg

SEQ ID NO: 12651 - DNA, 60 bp, Artificial Sequence
  Description of Artificial Sequence: Synthetic probe
tctcacagtttgaactgtgcagagtagataccacctcagaggaaatgcaggagcagttac

SEQ ID NO: 12652 - DNA, 60 bp, Artificial Sequence
  Description of Artificial Sequence: Synthetic probe
tgtgcagagtagataccacctcagaggaaatgcaggagcagttacatcataccggcacag

SEQ ID NO: 12653 - DNA, 53 bp, Artificial Sequence
  Description of Artificial Sequence: Synthetic probe
gacgtaatctctgtgtcccactgcgtagtggtggaccagcagagcgtgtccct

SEQ ID NO: 12654 - DNA, 60 bp, Artificial Sequence
  Description of Artificial Sequence: Synthetic probe
ccagcccgtggtggtggagagcctacagaaaatgtataacgaggcccaggctccctttcc

SEQ ID NO: 12655 - DNA, 60 bp, Artificial Sequence
  Description of Artificial Sequence: Synthetic probe
gcaaccagcccgtggtggtggagagcctacagaaaatgtataacgaggcccaggctccct

SEQ ID NO: 12656 - DNA, 60 bp, Artificial Sequence
  Description of Artificial Sequence: Synthetic probe
gcagaccactattccggtttcggttgtcaaagtgggcaaccagcccgtggtggtggagag

SEQ ID NO: 12657 - DNA, 60 bp, Artificial Sequence
  Description of Artificial Sequence: Synthetic probe
atatagctccctaccgcagaccactattccggtttcggttgtcaaagtgggcaaccagcc

SEQ ID NO: 12658 - DNA, 60 bp, Artificial Sequence
  Description of Artificial Sequence: Synthetic probe
ctacgcctcctatgtggtgcgaggggagaacctcgtgaccgctgtgagctacgggcgggc

SEQ ID NO: 12659 - DNA, 60 bp, Artificial Sequence
  Description of Artificial Sequence: Synthetic probe
tggtgggcccgcggcctacgcctcctatgtggtgcgaggggagaacctcgtgaccgctgt

SEQ ID NO: 12660 - DNA, 60 bp, Artificial Sequence
  Description of Artificial Sequence: Synthetic probe
tctagacaaggccgaggccttccccaacccccgccagtacatcctggggatgctttcctc

SEQ ID NO: 12661 - DNA, 60 bp, Artificial Sequence
  Description of Artificial Sequence: Synthetic probe
atgtttaaagaccacctcatttcccattctttctttctagacaaggccgaggccttcccc

SEQ ID NO: 12662 - DNA, 60 bp, Artificial Sequence
  Description of Artificial Sequence: Synthetic probe
gcagacctggtgtccatgtttaaagaccacctcatttcccattctttctttctagacaag

SEQ ID NO: 12663 - DNA, 60 bp, Artificial Sequence
  Description of Artificial Sequence: Synthetic probe
cgctcagcgacccgactctgaccgagcgaggcttcgatatgtcagtgaaggcagacctgg

SEQ ID NO: 12664 - DNA, 60 bp, Artificial Sequence
  Description of Artificial Sequence: Synthetic probe
aaaactgcgccacgccccacccctgttcattctgcagtcgctcagcgacccgactctgac

SEQ ID NO: 12665 - DNA, 60 bp, Artificial Sequence
  Description of Artificial Sequence: Synthetic probe
cgtgctcgccacaaaactgcgccacgccccacccctgttcattctgcagtcgctcagcga

SEQ ID NO: 12666 - DNA, 51 bp, Artificial Sequence
  Description of Artificial Sequence: Synthetic probe
gcgctcgagcgcggcctggtggacaccgtgctcgccacaaaactgcgccac

SEQ ID NO: 12667 - DNA, 60 bp, Artificial Sequence
  Description of Artificial Sequence: Synthetic probe
tccgccctccagtttgggatagacgcgctcgagcgcggcctggtggacaccgtgctcgcc

SEQ ID NO: 12668 - DNA, 60 bp, Artificial Sequence
  Description of Artificial Sequence: Synthetic probe
agaccgacctggacatgctggagtacattggcacagtgaaaaccatcacctccgccctcc

SEQ ID NO: 12669 - DNA, 60 bp, Artificial Sequence
  Description of Artificial Sequence: Synthetic probe
ggccgtcgccccaacaagcagaggcagtatatcgtcatgaagaccactagcaagcaccac

SEQ ID NO: 12670 - DNA, 60 bp, Artificial Sequence
  Description of Artificial Sequence: Synthetic probe
acggccgtcgccccaacaagcagaggcagtatatcgtcatgaagaccactagcaagcacc

SEQ ID NO: 12671 - DNA, 60 bp, Artificial Sequence
  Description of Artificial Sequence: Synthetic probe
ggacgggaaaatacaatttaaggtttccgtgcccaccatcgcccacagcgacggccgtcg

SEQ ID NO: 12672 - DNA, 60 bp, Artificial Sequence
  Description of Artificial Sequence: Synthetic probe
ctggccgcctcatgcattaacaccgaattcagggacctgaggagaatggtggacgggaaa

SEQ ID NO: 12673 - DNA, 60 bp, Artificial Sequence
  Description of Artificial Sequence: Synthetic probe
atgtgatcgaatttgtcaagttcctggaaaccggcctggccgcctcatgcattaacaccg

SEQ ID NO: 12674 - DNA, 60 bp, Artificial Sequence
  Description of Artificial Sequence: Synthetic probe
tgggggtttatgcaaatgtgatcgaatttgtcaagttcctggaaaccggcctggccgcct

SEQ ID NO: 12675 - DNA, 55 bp, Artificial Sequence
  Description of Artificial Sequence: Synthetic probe
gctcgtgggaaaagacgtgcgagaaaatagtgtgcgctttgaggtcctactgggg

SEQ ID NO: 12676 - DNA, 55 bp, Artificial Sequence
  Description of Artificial Sequence: Synthetic probe
gctcgtgggaaaacacgtgcgagaaaatagtgtgcgctttgaggtcctactgggg

SEQ ID NO: 12677 - DNA, 60 bp, Artificial Sequence
  Description of Artificial Sequence: Synthetic probe
gctcgtgggaaaacacgtgcgagaaaatagtgtgcgctttgaggtcctactgggggttta

SEQ ID NO: 12678 - DNA, 60 bp, Artificial Sequence
  Description of Artificial Sequence: Synthetic probe
ggagagtgcagcagagggcctctttaaaagctttcagctgctcgtgggaaaacacgtgcg

SEQ ID NO: 12679 - DNA, 60 bp, Artificial Sequence
  Description of Artificial Sequence: Synthetic probe
cgccaagtgaaggagagtgcagcagagggcctctttaaaagctttcagctgctcgtggga

SEQ ID NO: 12680 - DNA, 60 bp, Artificial Sequence
  Description of Artificial Sequence: Synthetic probe
ccccttcctccccaaacacctcacggtgggaaaatccctcttccacctgcccgcttctgc

SEQ ID NO: 12681 - DNA, 60 bp, Artificial Sequence
  Description of Artificial Sequence: Synthetic probe
gccctccctgaacaaggctgccagcaaacccggtgatgattgcccgtgtgatgaccttac

SEQ ID NO: 12682 - DNA, 60 bp, Artificial Sequence
  Description of Artificial Sequence: Synthetic probe
caggccgcaagcgaaaacccgagcgcagaagccatatacaccgagctggaacaagacgtg

SEQ ID NO: 12683 - DNA, 60 bp, Artificial Sequence
  Description of Artificial Sequence: Synthetic probe
ataacgccaccgtgaagcgcaagcgacccgccgcctcgcccatatacagcaacaccgagt

SEQ ID NO: 12684 - DNA, 60 bp, Artificial Sequence
  Description of Artificial Sequence: Synthetic probe
atctcctggtgcaccgtatacaacgcccgcccggtgccagccaccgagcccgagcagaat

SEQ ID NO: 12685 - DNA, 60 bp, Artificial Sequence
  Description of Artificial Sequence: Synthetic probe
tgataatccgcccacgactacgcgcgacgcagaggccagcacgctgtgctttgtccttca

SEQ ID NO: 12686 - DNA, 60 bp, Artificial Sequence
  Description of Artificial Sequence: Synthetic probe
ggcagagcactccctttgttttgtcggactgatgatagaaggttgcgggaatcggggagc

SEQ ID NO: 12687 - DNA, 60 bp, Artificial Sequence
  Description of Artificial Sequence: Synthetic probe
attctgcgcccaccccgcctcgtccagttctctcttggccaaagtctacatttgcgccct

SEQ ID NO: 12688 - DNA, 60 bp, Artificial Sequence
  Description of Artificial Sequence: Synthetic probe
tagccatggagtccttgggactgaataaagcactgctgccctgagggaggaccgttggga

SEQ ID NO: 12689 - DNA, 51 bp, Artificial Sequence
  Description of Artificial Sequence: Synthetic probe
ctgggtccagggaaattacctgggactagcctacagtgcggacggcgtgga

SEQ ID NO: 12690 - DNA, 60 bp, Artificial Sequence
  Description of Artificial Sequence: Synthetic probe
ttgcagaggaatgatcctgccttgctgggtccagggaaattacctgggactagcctacag

SEQ ID NO: 12691 - DNA, 60 bp, Artificial Sequence
  Description of Artificial Sequence: Synthetic probe
cccggttgcatcgtcccttgaatcatggtggtcccggttgtcctgactccttagtcgcct

SEQ ID NO: 12692 - DNA, 60 bp, Artificial Sequence
  Description of Artificial Sequence: Synthetic probe
ataacgccaccgtgaagcgcaagcgacccgcagcctcgcccatatacagcaacaccgagt

SEQ ID NO: 12693 - DNA, 60 bp, Artificial Sequence
  Description of Artificial Sequence: Synthetic probe
ccccatccttgcagctagttaggtgagccttcggccctgcacgtatctgctcctctcgat

SEQ ID NO: 12694 - DNA, 58 bp, Artificial Sequence
  Description of Artificial Sequence: Synthetic probe
cccctgagccctgccccacctcacccgtgcaaaatctagaccccgatccactgcgacc

SEQ ID NO: 12695 - DNA, 60 bp, Artificial Sequence
  Description of Artificial Sequence: Synthetic probe
tgataatccacccacggctacgcgcgacgcagaggccagcacgctgtactttgtccttca

SEQ ID NO: 12696 - DNA, 60 bp, Artificial Sequence
  Description of Artificial Sequence: Synthetic probe
ccgcgctgttctgggctaccagctacctaaacaaccccgcctgcaccaacttcactgtca

SEQ ID NO: 12697 - DNA, 58 bp, Artificial Sequence
  Description of Artificial Sequence: Synthetic probe
ggggcttcgtgaccaatggcctgcacaggctctctgccgccatcttagctgccacccc

SEQ ID NO: 12698 - DNA, 60 bp, Artificial Sequence
  Description of Artificial Sequence: Synthetic probe
attcaaccatgtcgggtcttcttcagcgccgtgcaggtccaggtggatggtcatcggctg

SEQ ID NO: 12699 - DNA, 60 bp, Artificial Sequence
  Description of Artificial Sequence: Synthetic probe
agtaccgccaatgcccaggacacgtccctcatggtcatcgatgccgtggccaccgagctg

SEQ ID NO: 12700 - DNA, 60 bp, Artificial Sequence
  Description of Artificial Sequence: Synthetic probe
cggccagtcccaagatgtcgggaccagccccgcaaaatggcggccagtcccaagatgtcg

SEQ ID NO: 12701 - DNA, 60 bp, Artificial Sequence
  Description of Artificial Sequence: Synthetic probe
cttccccttcagagtatgcagcgcctccaacatcgaagagacatcttccgcttccagaca

SEQ ID NO: 12702 - DNA, 60 bp, Artificial Sequence
  Description of Artificial Sequence: Synthetic probe
gacctctctggcgggagcgccacgcccctttcccgcggtcccgcccggggcttttgtcgc

SEQ ID NO: 12703 - DNA, 60 bp, Artificial Sequence
  Description of Artificial Sequence: Synthetic probe
gtcccgagatctcgggacctctctggcgggagcgccacgcccctttcccgcggtcccgcc

SEQ ID NO: 12704 - DNA, 60 bp, Artificial Sequence
  Description of Artificial Sequence: Synthetic probe
ccctccccgccccctggccccatttttttgccggcaggggggcgtggcaggtcccgagat

SEQ ID NO: 12705 - DNA, 60 bp, Artificial Sequence
  Description of Artificial Sequence: Synthetic probe
aggggagccctctgggcatcgcccggcccccgaggtttttttctccgcggccctccccgc

SEQ ID NO: 12706 - DNA, 55 bp, Artificial Sequence
  Description of Artificial Sequence: Synthetic probe
accgggggggtgtgtctgccgggccgctgtcaggagcgcgtggcgccgcgcccca

SEQ ID NO: 12707 - DNA, 60 bp, Artificial Sequence
  Description of Artificial Sequence: Synthetic probe
gggccctggggtggctctgggggcttcgggaccctctcccgctttggacacgcccccttc

SEQ ID NO: 12708 - DNA, 60 bp, Artificial Sequence
  Description of Artificial Sequence: Synthetic probe
tctcgggacctgccctctcaaccctaaccctagccccgcgggccctggggtggctctggg

SEQ ID NO: 12709 - DNA, 60 bp, Artificial Sequence
  Description of Artificial Sequence: Synthetic probe
gggtcccgggctctcgggacctgccctctcaaccctaaccctagccccgcgggccctggg

SEQ ID NO: 12710 - DNA, 52 bp, Artificial Sequence
  Description of Artificial Sequence: Synthetic probe
ggtagggccccgtagcggcgcggcggggtccccggccctcgggacccaggtc

SEQ ID NO: 12711 - DNA, 60 bp, Artificial Sequence
  Description of Artificial Sequence: Synthetic probe
taacaggcagctaaacacccgagcccagaccccctctccgcgcctctgcctctttgtctc

SEQ ID NO: 12712 - DNA, 56 bp, Artificial Sequence
  Description of Artificial Sequence: Synthetic probe
ctgctctccgggcccccttctccttctccatcttaaacagaggggagagacttaaa

SEQ ID NO: 12713 - DNA, 60 bp, Artificial Sequence
  Description of Artificial Sequence: Synthetic probe
cccccgcgcgggcccggggtcccaggcgagtccccggctcggggacgggcctgctctccg

SEQ ID NO: 12714 - DNA, 50 bp, Artificial Sequence
  Description of Artificial Sequence: Synthetic probe
gagctcagccggctccccctagggttgactcgggtgctcagcctcacaga

SEQ ID NO: 12715 - DNA, 60 bp, Artificial Sequence
  Description of Artificial Sequence: Synthetic probe
agctgtgtagctgctatagtcactcttacaaatcctcaaaaatgtcccaaaactcaaatt

SEQ ID NO: 12716 - DNA, 53 bp, Artificial Sequence
  Description of Artificial Sequence: Synthetic probe
aactcaaattctgaaaacccaagtcctcgaaagaagagatatgttaaaatgtg

SEQ ID NO: 12717 - DNA, 60 bp, Artificial Sequence
  Description of Artificial Sequence: Synthetic probe
cggagaagaagcattaatagaagagcatctaaaaactttttaaagaggaggcgcattttt

SEQ ID NO: 12718 - DNA, 60 bp, Artificial Sequence
  Description of Artificial Sequence: Synthetic probe
tcctcttttccacttggcatcgcaggcgagagttttcgtactttaagttaatcagcccct

SEQ ID NO: 12719 - DNA, 60 bp, Artificial Sequence
  Description of Artificial Sequence: Synthetic probe
tgattaacttaaagtacgaaaactctcgcctgcgatgccaagtggaaaagaggaaagatg

SEQ ID NO: 12720 - DNA, 60 bp, Artificial Sequence
  Description of Artificial Sequence: Synthetic probe
acgaaaactctcgcctgcgatgccaagtggaaaagaggaaagatgaaattagaatccttc

SEQ ID NO: 12721 - DNA, 60 bp, Artificial Sequence
  Description of Artificial Sequence: Synthetic probe
gtgttgtacacttatgatagttgagccactcacgaaggattctaatttcatctttcctct

SEQ ID NO: 12722 - DNA, 60 bp, Artificial Sequence
  Description of Artificial Sequence: Synthetic probe
aggaaagatgaaattagaatccttcgtgagtggctcaactatcataagtgtacaacactt

SEQ ID NO: 12723 - DNA, 60 bp, Artificial Sequence
  Description of Artificial Sequence: Synthetic probe
agaatccttcgtgagtggctcaactatcataagtgtacaacacttcaaaactacaacact

SEQ ID NO: 12724 - DNA, 60 bp, Artificial Sequence
  Description of Artificial Sequence: Synthetic probe
tacaacacttcaaaactacaacactgggcccccggagccgcgtgtaaaagtggaaaactc

SEQ ID NO: 12725 - DNA, 56 bp, Artificial Sequence
  Description of Artificial Sequence: Synthetic probe
ctggatcaacagtatacaactaacaacttaaacattccagagacagtgtctgggaa

SEQ ID NO: 12726 - DNA, 60 bp, Artificial Sequence
  Description of Artificial Sequence: Synthetic probe
ctggatcaacagtatacaactaacaacttaaacattccagagacagtgtctgggaataac

SEQ ID NO: 12727 - DNA, 60 bp, Artificial Sequence
  Description of Artificial Sequence: Synthetic probe
aggtagctgttgctgctgcaaacccatttgtagtgttattcccagacactgtctctggaa

SEQ ID NO: 12728 - DNA, 52 bp, Artificial Sequence
  Description of Artificial Sequence: Synthetic probe
tgggaataacactacaaatgggtttgcagcagcaacagctaccttacacact

SEQ ID NO: 12729 - DNA, 60 bp, Artificial Sequence
  Description of Artificial Sequence: Synthetic probe
tcttgcaaataatacaaataactttgaggccaagttgaactgtgaagtgttgcctagttt

SEQ ID NO: 12730 - DNA, 60 bp, Artificial Sequence
  Description of Artificial Sequence: Synthetic probe
caaataactttgaggccaagttgaactgtgaagtgttgcctagttttactagtgctttgg

SEQ ID NO: 12731 - DNA, 60 bp, Artificial Sequence
  Description of Artificial Sequence: Synthetic probe
ccaaagcactagtaaaactaggcaacacttcacagttcaacttggcctcaaagttatttg

SEQ ID NO: 12732 - DNA, 60 bp, Artificial Sequence
  Description of Artificial Sequence: Synthetic probe
tgcctagttttactagtgctttggatgatcttttatcaatagattggaacaacttgtaca

SEQ ID NO: 12733 - DNA, 60 bp, Artificial Sequence
  Description of Artificial Sequence: Synthetic probe
aacttgtacaatttataaaactgaaaaaaagaaagtacttgaatgtgaatagtgccagga

SEQ ID NO: 12734 - DNA, 60 bp, Artificial Sequence
  Description of Artificial Sequence: Synthetic probe
agtgccaggaatatgtattaagggtgtgttttgtgggggtggctaataaagtatgactca

SEQ ID NO: 12735 - DNA, 60 bp, Artificial Sequence
  Description of Artificial Sequence: Synthetic probe
catgtggaacgagttaagtaaaatcaaccctaccagtgtgatgagctccatatacggccg

SEQ ID NO: 12736 - DNA, 60 bp, Artificial Sequence
  Description of Artificial Sequence: Synthetic probe
ctttcccctgccctccggcaataactcctataaatcagtttgttaattatcagcctgcgc

SEQ ID NO: 12737 - DNA, 60 bp, Artificial Sequence
  Description of Artificial Sequence: Synthetic probe
tttccaggctttcccctgccctccggcaataactcctataaatcagtttgttaattatca

SEQ ID NO: 12738 - DNA, 60 bp, Artificial Sequence
  Description of Artificial Sequence: Synthetic probe
ccagtattgtgggatgccactactactcctgtccctttccaggctttcccctgccctccg

SEQ ID NO: 12739 - DNA, 60 bp, Artificial Sequence
  Description of Artificial Sequence: Synthetic probe
gctacaccccaggggccagtattgtgggatgccactactactcctgtccctttccaggct

SEQ ID NO: 12740 - DNA, 60 bp, Artificial Sequence
  Description of Artificial Sequence: Synthetic probe
gcatctttggggactcatgcataagcactctgctacagctgacatgctacccatttcagc

SEQ ID NO: 12741 - DNA, 60 bp, Artificial Sequence
  Description of Artificial Sequence: Synthetic probe
cagttcctcaggccttcgagcctttagcgccatctacccctagcttgctggatgaactgc

SEQ ID NO: 12742 - DNA, 60 bp, Artificial Sequence
  Description of Artificial Sequence: Synthetic probe
ctgcttccagcagccaagtttctgattatttcagccccttcccttattttcctggcagtt

SEQ ID NO: 12743 - DNA, 60 bp, Artificial Sequence
  Description of Artificial Sequence: Synthetic probe
cgctctgcagtggaccactttgtttccaccggccagctcatctgcttccagcagccaagt

SEQ ID NO: 12744 - DNA, 60 bp, Artificial Sequence
  Description of Artificial Sequence: Synthetic probe
cagcagcaccgctctgcagtggaccactttgtttccaccggccagctcatctgcttccag

SEQ ID NO: 12745 - DNA, 60 bp, Artificial Sequence
  Description of Artificial Sequence: Synthetic probe
aagtaccagttactacaccagtaagcctgcgaccagccgcagcagcaccgctctgcagtg

SEQ ID NO: 12746 - DNA, 51 bp, Artificial Sequence
  Description of Artificial Sequence: Synthetic probe
ggggttactcagatgctaatggccagtctgttggtgcaagtaccagttact

SEQ ID NO: 12747 - DNA, 60 bp, Artificial Sequence
  Description of Artificial Sequence: Synthetic probe
ccagtcactaatcacggcttttcaacttctgtcttttcccatacagtacccacaacggcc

SEQ ID NO: 12748 - DNA, 60 bp, Artificial Sequence
  Description of Artificial Sequence: Synthetic probe
gcatctgccacatcaaccagttatgggtatccaggcccagtcactaatcacggcttttca

SEQ ID NO: 12749 - DNA, 60 bp, Artificial Sequence
  Description of Artificial Sequence: Synthetic probe
cctctcgtatagatgcatctgccacatcaaccagttatgggtatccaggcccagtcacta

SEQ ID NO: 12750 - DNA, 60 bp, Artificial Sequence
  Description of Artificial Sequence: Synthetic probe
ccactcagacgggattctactataaccagcagtcaagtgataattttgcctctcgtatag

SEQ ID NO: 12751 - DNA, 60 bp, Artificial Sequence
  Description of Artificial Sequence: Synthetic probe
cccaagagacacagagttgctgcagtgtctacaatccagctaccactcagacgggattct

SEQ ID NO: 12752 - DNA, 60 bp, Artificial Sequence
  Description of Artificial Sequence: Synthetic probe
gttcctgaagcaccccaagcagcaagccaaactcagccaacaactacccaagagacacag

SEQ ID NO: 12753 - DNA, 60 bp, Artificial Sequence
  Description of Artificial Sequence: Synthetic probe
cagaagacgatgatgttcctgaagcaccccaagcagcaagccaaactcagccaacaacta

SEQ ID NO: 12754 - DNA, 60 bp, Artificial Sequence
  Description of Artificial Sequence: Synthetic probe
gccaggttcgtccagaaagtactgactccgacacccatgcagaagacgatgatgttcctg

SEQ ID NO: 12755 - DNA, 60 bp, Artificial Sequence
  Description of Artificial Sequence: Synthetic probe
cccagcccgacctctccacctgattcggacactgagtcatgtgatagccaggttcgtcca

SEQ ID NO: 12756 - DNA, 60 bp, Artificial Sequence
  Description of Artificial Sequence: Synthetic probe
caatctgaatatgaccccagcccgacctctccacctgattcggacactgagtcatgtgat

SEQ ID NO: 12757 - DNA, 60 bp, Artificial Sequence
  Description of Artificial Sequence: Synthetic probe
gattcatcttcaactcaagaaaatacagacgaagaatctggcccgtgctgcagcaagact

SEQ ID NO: 12758 - DNA, 60 bp, Artificial Sequence
  Description of Artificial Sequence: Synthetic probe
agattcatcttcaactcaagaaaatacagacgaagaatctggcccgtgctgcagcaagac

SEQ ID NO: 12759 - DNA, 60 bp, Artificial Sequence
  Description of Artificial Sequence: Synthetic probe
ctggaagcaagtgaaccacagtcaaccctagcttacgggtgccctgacatttcatctctt

SEQ ID NO: 12760 - DNA, 60 bp, Artificial Sequence
  Description of Artificial Sequence: Synthetic probe
ggggccaggcagaggtatgtgttaccagaagttttactggaagcaagtgaaccacagtca

SEQ ID NO: 12761 - DNA, 60 bp, Artificial Sequence
  Description of Artificial Sequence: Synthetic probe
gtttgcaccaaggaaaagatgtcccaataagactgtgttctcacagtatggggccaggca

SEQ ID NO: 12762 - DNA, 60 bp, Artificial Sequence
  Description of Artificial Sequence: Synthetic probe
ggcttacatggcttacattttccagtgcctgacattgagcaggtattccaaccactgttt

SEQ ID NO: 12763 - DNA, 60 bp, Artificial Sequence
  Description of Artificial Sequence: Synthetic probe
ggcttacatggcttacattttcccagtgcctgacattgagcaggtattccaaccactgtt

SEQ ID NO: 12764 - DNA, 60 bp, Artificial Sequence
  Description of Artificial Sequence: Synthetic probe
gtgtactctagcctcagagacgatggagaaatcagtccagaagtaaaggcttacatggct

SEQ ID NO: 12765 - DNA, 60 bp, Artificial Sequence
  Description of Artificial Sequence: Synthetic probe
gaaggttttgacagtgtactctagcctcagagacgatggagaaatcagtccagaagtaaa

SEQ ID NO: 12766 - DNA, 60 bp, Artificial Sequence
  Description of Artificial Sequence: Synthetic probe
gccacatcgtgccctggaccctgggaccgagagatccaaaaccgaaacagcgtccatttg

SEQ ID NO: 12767 - DNA, 60 bp, Artificial Sequence
  Description of Artificial Sequence: Synthetic probe
ccacatctaccccagttcccacgaaggctctaaaacccacaccctcccaccagccgagta

SEQ ID NO: 12768 - DNA, 60 bp, Artificial Sequence
  Description of Artificial Sequence: Synthetic probe
atccaaaactccagtgcagcacacctctcccctcaaccggctctaccccaacgtggtgct

SEQ ID NO: 12769 - DNA, 60 bp, Artificial Sequence
  Description of Artificial Sequence: Synthetic probe
gccccttcactgtttccaagcactccatacatccacattcacattccaacagcagagcta

SEQ ID NO: 12770 - DNA, 60 bp, Artificial Sequence
  Description of Artificial Sequence: Synthetic probe
tggaagacacagtgcctcacgcgactcacccacctgccggagagggactagatttcagct

SEQ ID NO: 12771 - DNA, 60 bp, Artificial Sequence
  Description of Artificial Sequence: Synthetic probe
agctgctcgtggggaaggatgtgcgtgaaaacagtgtgcgctttgaggtgctacttgggg

SEQ ID NO: 12772 - DNA, 60 bp, Artificial Sequence
  Description of Artificial Sequence: Synthetic probe
gggctggcggggtatgtgctgcgtaggctgggcctgtgccaacatgtgaaggtgcacccc

SEQ ID NO: 12773 - DNA, 60 bp, Artificial Sequence
  Description of Artificial Sequence: Synthetic probe
ataatactcctgcgtttggacggcctctacctgcgcgtcctgcccgacaagcaccccggt

SEQ ID NO: 12774 - DNA, 60 bp, Artificial Sequence
  Description of Artificial Sequence: Synthetic probe
aactcctccctcagggaatctgccgccaaccttgctcgctccaggcccatagtcaccctc

SEQ ID NO: 12775 - DNA, 60 bp, Artificial Sequence
  Description of Artificial Sequence: Synthetic probe
aaagaagcgccgcgcagcagatagcccctctcccagccccagtctgatccctaaccctaa

SEQ ID NO: 12776 - DNA, 60 bp, Artificial Sequence
  Description of Artificial Sequence: Synthetic probe
agctcgcgggccgtcacggcaaagctgcccaccagagcgccctcgacccactccaccacc

SEQ ID NO: 12777 - DNA, 57 bp, Artificial Sequence
  Description of Artificial Sequence: Synthetic probe
ccgtcatggccgcgagctcgcgggccgtcacggcaaagctgcccaccagagcgccct

SEQ ID NO: 12778 - DNA, 59 bp, Artificial Sequence
  Description of Artificial Sequence: Synthetic probe
cagcccgtcgtcgtcgaagccgcactcggccagcatcgccatcacgtagtccgtcatgg

SEQ ID NO: 12779 - DNA, 60 bp, Artificial Sequence
  Description of Artificial Sequence: Synthetic probe
aggtgcgaggggcccaccgtcacgcagcgcgccgccacgaacaacaggctgcgcacaaac

SEQ ID NO: 12780 - DNA, 60 bp, Artificial Sequence
  Description of Artificial Sequence: Synthetic probe
tcgagaaacaccaccccacggccgccaggaggcgcagactgctgagggatgaggtgcgag

SEQ ID NO: 12781 - DNA, 60 bp, Artificial Sequence
  Description of Artificial Sequence: Synthetic probe
ttccgcaggccgccgagcccgggccgcgccagacgccccccgcgtgcgcctcgactcaac

SEQ ID NO: 12782 - DNA, 60 bp, Artificial Sequence
  Description of Artificial Sequence: Synthetic probe
tgcaccgcgggtgtttgtcgacctctagtgctgacatactgtctttccgcaggccgccga

SEQ ID NO: 12783 - DNA, 58 bp, Artificial Sequence
  Description of Artificial Sequence: Synthetic probe
cgctcccctcgtccctcctcactgcccgccccccagcccgcggtctctcccgccgcga

SEQ ID NO: 12784 - DNA, 60 bp, Artificial Sequence
  Description of Artificial Sequence: Synthetic probe
ggcgggcctgcacacggggaggcccagcctccccgagcagcctggcccggcgctcccctc

SEQ ID NO: 12785 - DNA, 60 bp, Artificial Sequence
  Description of Artificial Sequence: Synthetic probe
ggtcggggcgcggtctaactctgtccttcttctccggcgggcctgcacacggggaggccc

SEQ ID NO: 12786 - DNA, 50 bp, Artificial Sequence
  Description of Artificial Sequence: Synthetic probe
gacggggtcggggctcgggtggaaatagccgcggcggtgctggtagccgc

SEQ ID NO: 12787 - DNA, 60 bp, Artificial Sequence
  Description of Artificial Sequence: Synthetic probe
gccgacctcggcccgggcggctccggccagggccggagcgccggcccgccgggggtcggc

SEQ ID NO: 12788 - DNA, 60 bp, Artificial Sequence
  Description of Artificial Sequence: Synthetic probe
atggcgctcgctggccttctctcccggccggggttgccattgcggccgacctcggcccgg

SEQ ID NO: 12789 - DNA, 60 bp, Artificial Sequence
  Description of Artificial Sequence: Synthetic probe
gccgagcagcccggccaggctcgggccctggcgaccgcctggctgcggcgccagggccgc

SEQ ID NO: 12790 - DNA, 60 bp, Artificial Sequence
  Description of Artificial Sequence: Synthetic probe
tgtggtgggctgcgggtcgcggagtgggtgggcggggagccggccgcggcgattattgcc

SEQ ID NO: 12791 - DNA, 60 bp, Artificial Sequence
  Description of Artificial Sequence: Synthetic probe
gcatgcgcgagcagttactttcggtttggggatgacagcggcgactgcggctcgaaagtt

SEQ ID NO: 12792 - DNA, 60 bp, Artificial Sequence
  Description of Artificial Sequence: Synthetic probe
cctttggcattaatatttcagagtttaatattacagacagacaaaaagccagataattac

SEQ ID NO: 12793 - DNA, 60 bp, Artificial Sequence
  Description of Artificial Sequence: Synthetic probe
gcagcagctctgctcgctggcgagaccccaaagcgccaattgtggcatatttccgggtct

SEQ ID NO: 12794 - DNA, 60 bp, Artificial Sequence
  Description of Artificial Sequence: Synthetic probe
accccccgcagcagctctgctcgctggcgagaccccaaagcgccaattgtggcatatttc

SEQ ID NO: 12795 - DNA, 60 bp, Artificial Sequence
  Description of Artificial Sequence: Synthetic probe
cccttgcccctggccgcctggccggccggctaaagtataggccagaccaaaccccccgca

SEQ ID NO: 12796 - DNA, 60 bp, Artificial Sequence
  Description of Artificial Sequence: Synthetic probe
gccccgtttgcgtggaatgaggccaaacaagcatttggcccctgtttgtctagacggggc

SEQ ID NO: 12797 - DNA, 58 bp, Artificial Sequence
  Description of Artificial Sequence: Synthetic probe
atcgatgtgtctgagagggtaataaaacacacccagacgctcggcacttagctctcga

SEQ ID NO: 12798 - DNA, 59 bp, Artificial Sequence
  Description of Artificial Sequence: Synthetic probe
ttttgtccattagctaaaagtatctccggccataatcgatgtgtctgagagggtaataa

SEQ ID NO: 12799 - DNA, 54 bp, Artificial Sequence
  Description of Artificial Sequence: Synthetic probe
gcgtttgcaccccggcgcgaacgctctaccctcctccctcgaggcaggcgcaac

SEQ ID NO: 12800 - DNA, 60 bp, Artificial Sequence
  Description of Artificial Sequence: Synthetic probe
taaagtcagcgcgatgcgcaagccgctgcgcgggtgcgttggccggcccggcagtgagcc

SEQ ID NO: 12801 - DNA, 60 bp, Artificial Sequence
  Description of Artificial Sequence: Synthetic probe
aaaatacaagccccggcgcgcacgccgagcataacgcgcgccggaccccaaaggctggct

SEQ ID NO: 12802 - DNA, 60 bp, Artificial Sequence
  Description of Artificial Sequence: Synthetic probe
ggcgccggacccagggcggaggccagagcgggcccgggcccgccgcgccgaaatttccgc

SEQ ID NO: 12803 - DNA, 60 bp, Artificial Sequence
  Description of Artificial Sequence: Synthetic probe
acaagatcgagagcgggtgcgcccggccgctgtactacatggagtacaccgagtgcgagc

SEQ ID NO: 12804 - DNA, 50 bp, Artificial Sequence
  Description of Artificial Sequence: Synthetic probe
ggtacaagatcgagagcgggtgcgcccggccgctgtactacatggagtac

SEQ ID NO: 12805 - DNA, 60 bp, Artificial Sequence
  Description of Artificial Sequence: Synthetic probe
accgtcgtgtggtacaagatcgagagcgggtgcgcccggccgctgtactacatggagtac

SEQ ID NO: 12806 - DNA, 60 bp, Artificial Sequence
  Description of Artificial Sequence: Synthetic probe
gagggcgaaacctcgccctcggctccgccctccccgtccccaaccgagacggaaagctcc

SEQ ID NO: 12807 - DNA, 60 bp, Artificial Sequence
  Description of Artificial Sequence: Synthetic probe
gaaacctcgccctcggctccgccctccccgtccccaaccgagacggaaagctccgctggg

SEQ ID NO: 12808 - DNA, 59 bp, Artificial Sequence
  Description of Artificial Sequence: Synthetic probe
aagcctcgccctcgcctccgccctccccgtccccaaccgagacggaaagctccgccggg

SEQ ID NO: 12809 - DNA, 60 bp, Artificial Sequence
  Description of Artificial Sequence: Synthetic probe
gggtgccaataataaattttgcgcgaatcttatttaagtgcacaccgtgttatttgcggc

SEQ ID NO: 12810 - DNA, 60 bp, Artificial Sequence
  Description of Artificial Sequence: Synthetic probe
tgtatgggcagttcgggtgccaataataaattttgcgcgaatcttatttaagtgcacacc

SEQ ID NO: 12811 - DNA, 60 bp, Artificial Sequence
  Description of Artificial Sequence: Synthetic probe
cggagtaccagcagcttccgatggccgacgtcgggggggcatgaggcctatgtatgggca

SEQ ID NO: 12812 - DNA, 60 bp, Artificial Sequence
  Description of Artificial Sequence: Synthetic probe
gagcgcgagggcggggccgccccgtacgccgagccgctgtacgtgcactgcggcgtggcc

SEQ ID NO: 12813 - DNA, 56 bp, Artificial Sequence
  Description of Artificial Sequence: Synthetic probe
ctacatgtcgcccttctacgggctccgcgagggcgcgcaccgcgagcacaccagct

SEQ ID NO: 12814 - DNA, 60 bp, Artificial Sequence
  Description of Artificial Sequence: Synthetic probe
tttacatgtcgccgttctacgggctccgcgagggcgcgcaccgcgagcacaccagctact

SEQ ID NO: 12815 - DNA, 59 bp, Artificial Sequence
  Description of Artificial Sequence: Synthetic probe
aggacagcgtcgtcatctacgaccgggacgtgttttcgctgctctacgcggtcctgcag

SEQ ID NO: 12816 - DNA, 60 bp, Artificial Sequence
  Description of Artificial Sequence: Synthetic probe
tgctgaacgcgccgcgggcgccggatacggtcggcgaggacagcgtcgtcatctacgacc

SEQ ID NO: 12817 - DNA, 51 bp, Artificial Sequence
  Description of Artificial Sequence: Synthetic probe
ggtggagggccagctcggcgaggacaacgagctgctgccgggccgcgagct

SEQ ID NO: 12818 - DNA, 55 bp, Artificial Sequence
  Description of Artificial Sequence: Synthetic probe
agccggtggagggccagctcggcgaggacaacgagctgctgcccggccgcgagct

SEQ ID NO: 12819 - DNA, 60 bp, Artificial Sequence
  Description of Artificial Sequence: Synthetic probe
tgcggcctcggcgccgtggggctcctgctggtggcggccctgtgcctgcggcgcaaggcg

SEQ ID NO: 12820 - DNA, 60 bp, Artificial Sequence
  Description of Artificial Sequence: Synthetic probe
aagcgcacctacgacatcctcaaccccttcgggcccgtatacaccagcttgccgaccaac

SEQ ID NO: 12821 - DNA, 60 bp, Artificial Sequence
  Description of Artificial Sequence: Synthetic probe
ccgcgcgggccagaagcgcacctacgacatcctcaaccccttcgggccggtgtacaccag

SEQ ID NO: 12822 - DNA, 58 bp, Artificial Sequence
  Description of Artificial Sequence: Synthetic probe
cgcgggccagaagcgcacctacgacatcctcaaccccttcgggccggtgtacaccagc

SEQ ID NO: 12823 - DNA, 60 bp, Artificial Sequence
  Description of Artificial Sequence: Synthetic probe
ttggctgcctgcgcgcggcccacgggcgcgcggcccaaaacaaggcccgctcgctggtgt

SEQ ID NO: 12824 - DNA, 56 bp, Artificial Sequence
  Description of Artificial Sequence: Synthetic probe
agctgcgcgaccccggcgccgtctacgtctggggcggcgcgaacaacgccacgctc

SEQ ID NO: 12825 - DNA, 60 bp, Artificial Sequence
  Description of Artificial Sequence: Synthetic probe
gggagctgcgcgaccccggcgccgtctacgtctggggcggcgcgaacaacgccacgctcg

SEQ ID NO: 12826 - DNA, 60 bp, Artificial Sequence
  Description of Artificial Sequence: Synthetic probe
atcagaaaggtgtgcgtgaactgctgctccacgctgctcgcggggctgctcgtaaaggcg

SEQ ID NO: 12827 - DNA, 60 bp, Artificial Sequence
  Description of Artificial Sequence: Synthetic probe
gcgcgccgcgcaagccagaagcgcacctacgacatcctcaaccccttcgggcccgtatac

SEQ ID NO: 12828 - DNA, 60 bp, Artificial Sequence
  Description of Artificial Sequence: Synthetic probe
ctgggcgtgcgcgcgccgcgcgggccagaagcgcacctacgacatcctcaaccccttcgg

SEQ ID NO: 12829 - DNA, 60 bp, Artificial Sequence
  Description of Artificial Sequence: Synthetic probe
tacgccgagccgctgtacgtgcactgcggcgtggccgacaacgccactggcggtgcgcgc

SEQ ID NO: 12830 - DNA, 56 bp, Artificial Sequence
  Description of Artificial Sequence: Synthetic probe
ccgagccgctgtacgtgcactgcggcgtggccgacaacgccactggcggtgcgcgc

SEQ ID NO: 12831 - DNA, 56 bp, Artificial Sequence
  Description of Artificial Sequence: Synthetic probe
cgaccgcgttcgcctcctgcccgcgcgtcgcgaacgacgccttccgctcctgcctg

SEQ ID NO: 12832 - DNA, 60 bp, Artificial Sequence
  Description of Artificial Sequence: Synthetic probe
ttcgttatgctgcagacgaccgcgttcgcctcctgcccgcgcgtcgcgaacaacgccttt

SEQ ID NO: 12833 - DNA, 57 bp, Artificial Sequence
  Description of Artificial Sequence: Synthetic probe
acgcgcagtgcagcttcgcgtcgccgtaccgctccgagaccgtgtacagccggctgt

SEQ ID NO: 12834 - DNA, 60 bp, Artificial Sequence
  Description of Artificial Sequence: Synthetic probe
cggagcggctctcgaagcgctcgatggacagcctcgggcggtgcatccgcgaccagcggc

SEQ ID NO: 12835 - DNA, 60 bp, Artificial Sequence
  Description of Artificial Sequence: Synthetic probe
gccggcagcgctacgcggagcggctctcgaagcgctcgatggacagcctcgggcggtgca

SEQ ID NO: 12836 - DNA, 60 bp, Artificial Sequence
  Description of Artificial Sequence: Synthetic probe
ccgcccgagctgcgcgtgttcttcgagggcggcgaggccgtctgcgaggcgcgctgcgtc

SEQ ID NO: 12837 - DNA, 60 bp, Artificial Sequence
  Description of Artificial Sequence: Synthetic probe
aaatgtagcccgcgccgcggtcgcggccatcttggatccacccgcgcgcacgaccgccga

SEQ ID NO: 12838 - DNA, 60 bp, Artificial Sequence
  Description of Artificial Sequence: Synthetic probe
gtagcccgcgccgcggtcgcggccatcttggatccacccgcgcgcacgaccgccgagaga

SEQ ID NO: 12839 - DNA, 60 bp, Artificial Sequence
  Description of Artificial Sequence: Synthetic probe
tagcccgcgccgcggtcgcggccatcttggatccacccgcgcgcacgaccgccgagagac

SEQ ID NO: 12840 - DNA, 60 bp, Artificial Sequence
  Description of Artificial Sequence: Synthetic probe
gcgtccgccatgggcccgctggggcgagcgtggctgatcgcagctattttcgcctgggcg

SEQ ID NO: 12841 - DNA, 60 bp, Artificial Sequence
  Description of Artificial Sequence: Synthetic probe
atgggcccgctggggcgagcgtggctgatcgcagctattttcgcctgggcgctcctgtct

SEQ ID NO: 12842 - DNA, 54 bp, Artificial Sequence
  Description of Artificial Sequence: Synthetic probe
gcgaagggaaaatatagttgtcgcccagctccgcgctacggtacgcgatcgagc

SEQ ID NO: 12843 - DNA, 60 bp, Artificial Sequence
  Description of Artificial Sequence: Synthetic probe
gctcgatcgcgtaccgtagcgcggagctgggcgacaactatattttcccttcgcccgccg

SEQ ID NO: 12844 - DNA, 60 bp, Artificial Sequence
  Description of Artificial Sequence: Synthetic probe
gcgccatgatgtcggtgagctgcttcgtgcgcatgccgcgcgtgcagctctcgttccgct

SEQ ID NO: 12845 - DNA, 55 bp, Artificial Sequence
  Description of Artificial Sequence: Synthetic probe
gcggtgcagcttcgcgtcgccgtaccgctccgagagcgtgtacagccggctgtac

SEQ ID NO: 12846 - DNA, 60 bp, Artificial Sequence
  Description of Artificial Sequence: Synthetic probe
gcggtgcagcttcgcgtcgccgtaccgctccgagagcgtgtacagccggctgtacgagcg

SEQ ID NO: 12847 - DNA, 60 bp, Artificial Sequence
  Description of Artificial Sequence: Synthetic probe
gcggtgcagcttcgcgtcgccgtaccgctccgagagcatgtacagccggctgtacgagcg

SEQ ID NO: 12848 - DNA, 53 bp, Artificial Sequence
  Description of Artificial Sequence: Synthetic probe
gcggtgcagcttcgcgtcgccgtaccgctccgagagcatgtacagccggctgt

SEQ ID NO: 12849 - DNA, 60 bp, Artificial Sequence
  Description of Artificial Sequence: Synthetic probe
tccagaacggctcgatcgcgtaccgtagcgcggagctgggcggcaactacatcttccctt

SEQ ID NO: 12850 - DNA, 60 bp, Artificial Sequence
  Description of Artificial Sequence: Synthetic probe
ctgctgttcgtagtccagaacggctcgatcgcgtaccgtagcgcggagctgggcggcaac

SEQ ID NO: 12851 - DNA, 60 bp, Artificial Sequence
  Description of Artificial Sequence: Synthetic probe
ggacgccggagccgccgtccgtgtccgagcacgacccgcccgttaccaacagcacgccgc

SEQ ID NO: 12852 - DNA, 60 bp, Artificial Sequence
  Description of Artificial Sequence: Synthetic probe
ctactacgcccggggggacgccggagccgccgtccgtgtccgagcacgacccgcccgtta

SEQ ID NO: 12853 - DNA, 60 bp, Artificial Sequence
  Description of Artificial Sequence: Synthetic probe
ggcagcacgtacgcggccatcacgaaccagtacacggaccgcgtgcccgtgggcatggcc

SEQ ID NO: 12854 - DNA, 60 bp, Artificial Sequence
  Description of Artificial Sequence: Synthetic probe
ttcaaggcctacatctactacaagaacgtgatcgtgaccacgacctgggcgggcagcacg

SEQ ID NO: 12855 - DNA, 60 bp, Artificial Sequence
  Description of Artificial Sequence: Synthetic probe
gccccgcccatgctgctgtttgcggcccagaacggctcggtcgcgtaccgcagcgcggag

SEQ ID NO: 12856 - DNA, 60 bp, Artificial Sequence
  Description of Artificial Sequence: Synthetic probe
gagggggcccagcccccgcgcggggggcgcggagaaaaaaaaaattttctccgcgcggcg

SEQ ID NO: 12857 - DNA, 50 bp, Artificial Sequence
  Description of Artificial Sequence: Synthetic probe
ccgcccgttaccaacagcacgccgccgcccgccccgcctgaggacgggcg

SEQ ID NO: 12858 - DNA, 60 bp, Artificial Sequence
  Description of Artificial Sequence: Synthetic probe
gtttattgtcccagctgtgttcccgcctttgcgtgcccccccccctcgcccgaccgcccg

SEQ ID NO: 12859 - DNA, 60 bp, Artificial Sequence
  Description of Artificial Sequence: Synthetic probe
gtctgggggtgcgtgcgccgcgcgagccgcgagcgcacctacgacatcctcaaccccttc

SEQ ID NO: 12860 - DNA, 60 bp, Artificial Sequence
  Description of Artificial Sequence: Synthetic probe
cggccgctgtactacatggagtacaccgagtgcgacccccggaagcacttcgggtactgc

SEQ ID NO: 12861 - DNA, 60 bp, Artificial Sequence
  Description of Artificial Sequence: Synthetic probe
gcacgtacaacgccaccgtcgtgtggtacaagatcgagagcgggtgcgcccggccgctgt

SEQ ID NO: 12862 - DNA, 60 bp, Artificial Sequence
  Description of Artificial Sequence: Synthetic probe
ccgagcagagcggcgtctgcgccgagcggcccgggctggtgaacctgcgcggcgtgcgcc

SEQ ID NO: 12863 - DNA, 60 bp, Artificial Sequence
  Description of Artificial Sequence: Synthetic probe
cgtacccccgtccccgggtctccggatctaaaggtgagcagcaagcaaaccctttgccgc

SEQ ID NO: 12864 - DNA, 60 bp, Artificial Sequence
  Description of Artificial Sequence: Synthetic probe
cgcggccgccgcagccccagctgcccccccggcgcgcgcgatagcgaggttgctcggggg

SEQ ID NO: 12865 - DNA, 60 bp, Artificial Sequence
  Description of Artificial Sequence: Synthetic probe
gcggtggaggcagccgcggccggggcggaggcggccgcggccgaagcggccgtcatagcc

SEQ ID NO: 12866 - DNA, 60 bp, Artificial Sequence
  Description of Artificial Sequence: Synthetic probe
gccgggggccggtggaagtggaggtggaggacatgagggccggggcgccgcgggcggacc

SEQ ID NO: 12867 - DNA, 60 bp, Artificial Sequence
  Description of Artificial Sequence: Synthetic probe
tggaagtggaggtggaggacatgagggccggggcgccgcgggcggacccggaggacgggt

SEQ ID NO: 12868 - DNA, 60 bp, Artificial Sequence
  Description of Artificial Sequence: Synthetic probe
cggcgcacgccccccacgcccaacagccccgacgctacgccagaggacagcacgcccggt

SEQ ID NO: 12869 - DNA, 57 bp, Artificial Sequence
  Description of Artificial Sequence: Synthetic probe
cgtgttcatcgagaactcgatgcgcgcgcccggcggcgtctgctacagccgcccgcc

SEQ ID NO: 12870 - DNA, 60 bp, Artificial Sequence
  Description of Artificial Sequence: Synthetic probe
atcgcgccgtacacgttcaaggcctacatctactacaagaacgtgatcgtgaccaccacc

SEQ ID NO: 12871 - DNA, 52 bp, Artificial Sequence
  Description of Artificial Sequence: Synthetic probe
tccgtgtccgagcacgacccgcccgttaccaacagcacgccgccgcccgccc

SEQ ID NO: 12872 - DNA, 60 bp, Artificial Sequence
  Description of Artificial Sequence: Synthetic probe
cgccgtccgtgtccgagcacgacccgcccgttaccaacagcacgccgccgcccgccccgc

SEQ ID NO: 12873 - DNA, 58 bp, Artificial Sequence
  Description of Artificial Sequence: Synthetic probe
gcccgcgcgctgtgccgtctgagggaaagcacccgcgcgtagggctgcatataaatgg

SEQ ID NO: 12874 - DNA, 60 bp, Artificial Sequence
  Description of Artificial Sequence: Synthetic probe
cccgcccgcgcgctgtgccgtctgagggaaagcacccgcgcgtagggctgcatataaatg

SEQ ID NO: 12875 - DNA, 60 bp, Artificial Sequence
  Description of Artificial Sequence: Synthetic probe
acaccgtggtagcagcgcgactcaagtccatcctcgcgtaggcgcccccccccgcccgcg

SEQ ID NO: 12876 - DNA, 60 bp, Artificial Sequence
  Description of Artificial Sequence: Synthetic probe
tcgtcgaagccgcactcggccagcatcgccatcacgtagtcagtcatggtcgcgagctcg

SEQ ID NO: 12877 - DNA, 60 bp, Artificial Sequence
  Description of Artificial Sequence: Synthetic probe
aatggcggtcaggtcggaggtgctgagccccgacgacgactcttctgactccgaccaaga

SEQ ID NO: 12878 - DNA, 60 bp, Artificial Sequence
  Description of Artificial Sequence: Synthetic probe
aatatatccgcgagctcgtcctggcccgcgctgtcttcgcgtccgtgtttcactgcggac

SEQ ID NO: 12879 - DNA, 60 bp, Artificial Sequence
  Description of Artificial Sequence: Synthetic probe
agatcgagggctactacaagcgcgacatgaccacgggccggcgcctcaaggagccggtct

SEQ ID NO: 12880 - DNA, 60 bp, Artificial Sequence
  Description of Artificial Sequence: Synthetic probe
agcagatcgagggctactacaagcgcgacatgaccacgggccggcgcctcaaggagccgg

SEQ ID NO: 12881 - DNA, 50 bp, Artificial Sequence
  Description of Artificial Sequence: Synthetic probe
gttcactgcggcgtggccgacaacgccactggcggtgcgcgcctggagct

SEQ ID NO: 12882 - DNA, 60 bp, Artificial Sequence
  Description of Artificial Sequence: Synthetic probe
ccgccgagtacttcccgccgcgctccacgcgcctgcgctggttccgcaacggctaccccg

SEQ ID NO: 12883 - DNA, 60 bp, Artificial Sequence
  Description of Artificial Sequence: Synthetic probe
ctgccgcgccgccgactactacccgccgcgctccacgcgcctgcgctggttccgcgacgg

SEQ ID NO: 12884 - DNA, 60 bp, Artificial Sequence
  Description of Artificial Sequence: Synthetic probe
gctgtttgtttttcctggaggcgggacgctgcgcgcgagctcggccggattagggttcgg

SEQ ID NO: 12885 - DNA, 60 bp, Artificial Sequence
  Description of Artificial Sequence: Synthetic probe
gctgtgtgttttttctggaggcgggacgctgcgcgcgagctcggccggattagggttcgg

SEQ ID NO: 12886 - DNA, 60 bp, Artificial Sequence
  Description of Artificial Sequence: Synthetic probe
tgtacctgctggcgctacggcactcagaggcgcccggctacacggcaaatgagcgctacg

SEQ ID NO: 12887 - DNA, 60 bp, Artificial Sequence
  Description of Artificial Sequence: Synthetic probe
ggctggcctttgcgcatatgtacgtggcgacggcgcgcgaagtctcttggcgcctgcact

SEQ ID NO: 12888 - DNA, 60 bp, Artificial Sequence
  Description of Artificial Sequence: Synthetic probe
tgctgcggcggcaaccatggacccgtacgacgccattgaagcgttcgatgactccctgct

SEQ ID NO: 12889 - DNA, 60 bp, Artificial Sequence
  Description of Artificial Sequence: Synthetic probe
aagcaaccggcaccgcggcagccgcacccgctgggcgcacgccagacgcgaacgcagcac

SEQ ID NO: 12890 - DNA, 60 bp, Artificial Sequence
  Description of Artificial Sequence: Synthetic probe
tcatccgcatatacgagacgtgcatcttccaccccgaggcaccggcctgcctgcaccccg

SEQ ID NO: 12891 - DNA, 60 bp, Artificial Sequence
  Description of Artificial Sequence: Synthetic probe
gccggagacacgcccgctcgcttccggcgccaactggcgtcgatcctagtgcctctgtgc

SEQ ID NO: 12892 - DNA, 60 bp, Artificial Sequence
  Description of Artificial Sequence: Synthetic probe
gccgagacgtctttcccttggccgcgtttgtacacagcttcggtgagcccggagacccag

SEQ ID NO: 12893 - DNA, 60 bp, Artificial Sequence
  Description of Artificial Sequence: Synthetic probe
tcgcgaacaacgcctttcgctcctgcctgcacgccgacacgcgccccgctcgcagcgagc

SEQ ID NO: 12894 - DNA, 60 bp, Artificial Sequence
  Description of Artificial Sequence: Synthetic probe
ttgtcctccggcgcgctcgcgatgcggtgcctgttgctctggatggtggtgctggccgcg

SEQ ID NO: 12895 - DNA, 53 bp, Artificial Sequence
  Description of Artificial Sequence: Synthetic probe
gagccgcgagcgcacctacgacatcctcaaccccttcgggacggtgtacacca

SEQ ID NO: 12896 - DNA, 60 bp, Artificial Sequence
  Description of Artificial Sequence: Synthetic probe
aatatatccgcgagctcgtcctggcccgcgccgtcttcgcgtccgtcttccacagcggac

SEQ ID NO: 12897 - DNA, 60 bp, Artificial Sequence
  Description of Artificial Sequence: Synthetic probe
aatatatccgcgagctcgtcctggcccgcgccgtcttcgcgtccgtcttccactgcggac

SEQ ID NO: 12898 - DNA, 60 bp, Artificial Sequence
  Description of Artificial Sequence: Synthetic probe
atatatccgcgagctcgtcctggcccgcgccgtcttcgcgtccgtcttccactgcggacg

SEQ ID NO: 12899 - DNA, 53 bp, Artificial Sequence
  Description of Artificial Sequence: Synthetic probe
cgggcacgcagggcgctttacttatgtttggcgcgcggtggctccggcaccgg

SEQ ID NO: 12900 - DNA, 60 bp, Artificial Sequence
  Description of Artificial Sequence: Synthetic probe
gcgcgagctcggccggattagggttcggcgccacccgggcacgcagggcgctttacttat

SEQ ID NO: 12901 - DNA, 57 bp, Artificial Sequence
  Description of Artificial Sequence: Synthetic probe
agcaggcccgcgagatgatcaagtatatgtcgctcgtgtcggcggtcgagcggcaag

SEQ ID NO: 12902 - DNA, 60 bp, Artificial Sequence
  Description of Artificial Sequence: Synthetic probe
ctattccattctcatttgcatacccaccatcgcacatgccgccatattgctcctcctccc

SEQ ID NO: 12903 - DNA, 60 bp, Artificial Sequence
  Description of Artificial Sequence: Synthetic probe
ggccgagggtaaggttggcaccacactgccaagatcaccgagcctgtgcgcggccatctt

SEQ ID NO: 12904 - DNA, 60 bp, Artificial Sequence
  Description of Artificial Sequence: Synthetic probe
ggatgggcgcggccgagggtaaggttggcaccacactgccaagatcaccgagcctgtgcg

SEQ ID NO: 12905 - DNA, 50 bp, Artificial Sequence
  Description of Artificial Sequence: Synthetic probe
gcaaccccatgaaggccctgtacccgatcaccacgcgcgcgctcaaggac

SEQ ID NO: 12906 - DNA, 53 bp, Artificial Sequence
  Description of Artificial Sequence: Synthetic probe
gccgcagttaccaacagcacgccggcgtacgccccgcctgaggacgggcgacc

SEQ ID NO: 12907 - DNA, 60 bp, Artificial Sequence
  Description of Artificial Sequence: Synthetic probe
aggcgcgacgccggaaccgccgtccgtgtccgagcacgacgccgcagttaccaacagcac

SEQ ID NO: 12908 - DNA, 60 bp, Artificial Sequence
  Description of Artificial Sequence: Synthetic probe
aaaccacgccaggcgcgacgccggaaccgccgtccgtgtccgagcacgacgccgcagtta

SEQ ID NO: 12909 - DNA, 60 bp, Artificial Sequence
  Description of Artificial Sequence: Synthetic probe
aacagccccgtcgccgcgccagaggacagcacacgcgctgaaaccacgccaggcgcgacg

SEQ ID NO: 12910 - DNA, 60 bp, Artificial Sequence
  Description of Artificial Sequence: Synthetic probe
ccccacgcccaacagccccgtcgccgcgccagaggacagcacacgcgctgaaaccacgcc

SEQ ID NO: 12911 - DNA, 54 bp, Artificial Sequence
  Description of Artificial Sequence: Synthetic probe
tcgccctcgcctccgccctccccgtcgccgatcgagccggaaatcgccgccggg

SEQ ID NO: 12912 - DNA, 54 bp, Artificial Sequence
  Description of Artificial Sequence: Synthetic probe
cggaccgtggccccgctcgcgcggtactcaacgcgcggcgcggcagcccgcgcg

SEQ ID NO: 12913 - DNA, 60 bp, Artificial Sequence
  Description of Artificial Sequence: Synthetic probe
gggtccgaggacagcgggcccgaggacagcagcgatgccgggcccgaggacgatgggggc

SEQ ID NO: 12914 - DNA, 60 bp, Artificial Sequence
  Description of Artificial Sequence: Synthetic probe
ccctcaaggccgaagcggggaccgaggcggggggcggcggtgccgtcggggccaggaccg

SEQ ID NO: 12915 - DNA, 60 bp, Artificial Sequence
  Description of Artificial Sequence: Synthetic probe
gagtccgcggacctcggcccgacggggggctcggaggaggacccggccctgctcgacgcg

SEQ ID NO: 12916 - DNA, 60 bp, Artificial Sequence
  Description of Artificial Sequence: Synthetic probe
cctttgccgcgcgcgccccgccagccgccgcggcgagagagccggcgagggcttctcccg

SEQ ID NO: 12917 - DNA, 60 bp, Artificial Sequence
  Description of Artificial Sequence: Synthetic probe
gggtctccggatctaaaggtgagcagcaagcaaaccctttgccgcgcgcgccccgccagc

SEQ ID NO: 12918 - DNA, 60 bp, Artificial Sequence
  Description of Artificial Sequence: Synthetic probe
ccgtctgcctcgacgaccgcgagtgcttcaccgacgtggccctggacgcggcctgcctgc

SEQ ID NO: 12919 - DNA, 60 bp, Artificial Sequence
  Description of Artificial Sequence: Synthetic probe
catcgacgtcaacaccctcttccgctgcatcgccaccggctccgcgttcgtcacggccga

SEQ ID NO: 12920 - DNA, 60 bp, Artificial Sequence
  Description of Artificial Sequence: Synthetic probe
tcgaggcaggcgcaacggaccccgcccagtccatcccacttcgcacaatcgccaaatttt

SEQ ID NO: 12921 - DNA, 60 bp, Artificial Sequence
  Description of Artificial Sequence: Synthetic probe
acttcagctttggcggggaggtcataaaggtctcgcgctcgcccctcgcggccacgacgg

SEQ ID NO: 12922 - DNA, 60 bp, Artificial Sequence
  Description of Artificial Sequence: Synthetic probe
tcgaacgccgtgagctgttccgcctccatgagggttacgtggggtgccgccgttcccagc

SEQ ID NO: 12923 - DNA, 60 bp, Artificial Sequence
  Description of Artificial Sequence: Synthetic probe
tggcctttgaccgcgacgacgacccctgggaggcgccgctgaagcctgcgcggctgagcg

SEQ ID NO: 12924 - DNA, 60 bp, Artificial Sequence
  Description of Artificial Sequence: Synthetic probe
gtcggcctcggcgcccgcgatcggctccaggttgtccgcggtgcagttgacttccacgtc

SEQ ID NO: 12925 - DNA, 60 bp, Artificial Sequence
  Description of Artificial Sequence: Synthetic probe
agttcctcgcgacgttcgtgcgctgccacaccgacttgcaccagccgccaatgctgcgct

SEQ ID NO: 12926 - DNA, 60 bp, Artificial Sequence
  Description of Artificial Sequence: Synthetic probe
aagactacttgacggcccacctgcgcgccatcgaggtcctgcccgagtcagcgccccacc

SEQ ID NO: 12927 - DNA, 60 bp, Artificial Sequence
  Description of Artificial Sequence: Synthetic probe
tgtaccaccacatgcgccgcggccgcacggcccacactacacccgtgcacttcgttggcc

SEQ ID NO: 12928 - DNA, 60 bp, Artificial Sequence
  Description of Artificial Sequence: Synthetic probe
tgcgccgcaaccccatgaaggcgctctacccgatcaccacgcgcgcgctcaaggacgacg

SEQ ID NO: 12929 - DNA, 60 bp, Artificial Sequence
  Description of Artificial Sequence: Synthetic probe
atcgcctcgttcgtcgcgaaccccttcggcgcgctggccacggggctgctggtgctcgcc

SEQ ID NO: 12930 - DNA, 60 bp, Artificial Sequence
  Description of Artificial Sequence: Synthetic probe
agcgtcgtcatctacgaccgggacgtgttctcgctgctctacgcggtcctgcagcgcctg

SEQ ID NO: 12931 - DNA, 59 bp, Artificial Sequence
  Description of Artificial Sequence: Synthetic probe
acagcgtggtcatctacgaccgggacgtgttctcgctgctctacgcggtgctgcagcac

SEQ ID NO: 12932 - DNA, 60 bp, Artificial Sequence
  Description of Artificial Sequence: Synthetic probe
cccgcggccgagcagggccccgccgcgcgagcgcaagtggatgctctgcgagcgcgaggt

SEQ ID NO: 12933 - DNA, 60 bp, Artificial Sequence
  Description of Artificial Sequence: Synthetic probe
gcatgccgtcatgctggaacgccccttcgccgaggccatgagccgctacttgcgcgactt

SEQ ID NO: 12934 - DNA, 60 bp, Artificial Sequence
  Description of Artificial Sequence: Synthetic probe
atgctggaacgccccttcgccgaggccatgagccgctacttgcgcgactttgccttcgtt

SEQ ID NO: 12935 - DNA, 60 bp, Artificial Sequence
  Description of Artificial Sequence: Synthetic probe
actttgccttcgttgacgcggctgtctacacgcacgggcacagcctgcgtttgccctttt

SEQ ID NO: 12936 - DNA, 55 bp, Artificial Sequence
  Description of Artificial Sequence: Synthetic probe
tgagcgcaaggccgccgtcaaccgcgcggcctttcacggcgtgcgcgtttccctg

SEQ ID NO: 12937 - DNA, 60 bp, Artificial Sequence
  Description of Artificial Sequence: Synthetic probe
accgcgcagggctttggctgcctgcgcgcggcccacgggcgcgcggcccaaaacaaggcc

SEQ ID NO: 12938 - DNA, 60 bp, Artificial Sequence
  Description of Artificial Sequence: Synthetic probe
aaacaaggcccgctcgctggtgtccctcagtgtcgactcgcacgaccgcctgtgtgcctc

SEQ ID NO: 12939 - DNA, 60 bp, Artificial Sequence
  Description of Artificial Sequence: Synthetic probe
gctggtgtccctcagtgtcgactcgcacgaccgcctgtgtgcctcgctcatccagcagtg

SEQ ID NO: 12940 - DNA, 60 bp, Artificial Sequence
  Description of Artificial Sequence: Synthetic probe
agcactgctggatgagcgaggcacacaggcggtcgtgcgagtcgacactgagggacacca

SEQ ID NO: 12941 - DNA, 60 bp, Artificial Sequence
  Description of Artificial Sequence: Synthetic probe
tgtgtgcctcgctcatccagcagtgcttcgctaccaagtgcggcagcaaccgcctcggta

SEQ ID NO: 12942 - DNA, 58 bp, Artificial Sequence
  Description of Artificial Sequence: Synthetic probe
gtggccggcgcgcgcgattgccgcgcctacctgtggtccgcgcaggctcgcagcgcgc

SEQ ID NO: 12943 - DNA, 60 bp, Artificial Sequence
  Description of Artificial Sequence: Synthetic probe
cggcataacgcacgcgccctgcgcggccgcctacccgctgtacctgaaaatctgggcgtg

SEQ ID NO: 12944 - DNA, 60 bp, Artificial Sequence
  Description of Artificial Sequence: Synthetic probe
tccaatccggcaaagagggcgacgtgaacccacgcccagattttcaggtacagcgggtag

SEQ ID NO: 12945 - DNA, 60 bp, Artificial Sequence
  Description of Artificial Sequence: Synthetic probe
ccccacgatagcggccaggtagagcgcctttacgagcagccccgcgagcagcgtggagca

SEQ ID NO: 12946 - DNA, 60 bp, Artificial Sequence
  Description of Artificial Sequence: Synthetic probe
ctcgcggggctgctcgtaaaggcgctctacctggccgctatcgtggggggcgtcatcgcg

SEQ ID NO: 12947 - DNA, 60 bp, Artificial Sequence
  Description of Artificial Sequence: Synthetic probe
cgtcatcgcgctgctgcactacgagcacaacctgcgcctgcggctgctgggcgcgcagac

SEQ ID NO: 12948 - DNA, 60 bp, Artificial Sequence
  Description of Artificial Sequence: Synthetic probe
gcactacgagcacaacctgcgcctgcggctgctgggcgcgcagacgtgaccgcccctatt

SEQ ID NO: 12949 - DNA, 56 bp, Artificial Sequence
  Description of Artificial Sequence: Synthetic probe
ttcgccggccccaccctgcgcggcagcagcgccgcccaataggggcggtcacgtct

SEQ ID NO: 12950 - DNA, 60 bp, Artificial Sequence
  Description of Artificial Sequence: Synthetic probe
tgaccgcccctattgggcggcgctgctgccgcgcagggtggggccggcgaacataaaatg

SEQ ID NO: 12951 - DNA, 60 bp, Artificial Sequence
  Description of Artificial Sequence: Synthetic probe
ggggccggcgaacataaaatgccggtctcagtgcgaacacggcgccggagtgcgagccct

SEQ ID NO: 12952 - DNA, 60 bp, Artificial Sequence
  Description of Artificial Sequence: Synthetic probe
aaaatgccggtctcagtgcgaacacggcgccggagtgcgagccctcttttagaaacgcga

SEQ ID NO: 12953 - DNA, 60 bp, Artificial Sequence
  Description of Artificial Sequence: Synthetic probe
tgcgagccctcttttagaaacgcgagacaccgaccgtccggcccgaacggcgacgcaccc

SEQ ID NO: 12954 - DNA, 60 bp, Artificial Sequence
  Description of Artificial Sequence: Synthetic probe
gcggaccccgagatcgcaaccctcagcacggccagcgagagcgacgacttgagcctcttc

SEQ ID NO: 12955 - DNA, 60 bp, Artificial Sequence
  Description of Artificial Sequence: Synthetic probe
tcagagccgaagaggctcaagtcgtcgctctcgctggccgtgctgagggttgcgatctcg

SEQ ID NO: 12956 - DNA, 60 bp, Artificial Sequence
  Description of Artificial Sequence: Synthetic probe
cccgcgccgaagacagcccgccggagagcagcggtcccgcggcccggcagcaaagcgcga

SEQ ID NO: 12957 - DNA, 52 bp, Artificial Sequence
  Description of Artificial Sequence: Synthetic probe
aagacagcccgccggagagcagcggtcccgcggcccggcagcaaagcgcgag

SEQ ID NO: 12958 - DNA, 60 bp, Artificial Sequence
  Description of Artificial Sequence: Synthetic probe
acaagcagcaggcggccatcaaggtcgtgtgcaactcggtgtatgggtttacgggcgtgg

SEQ ID NO: 12959 - DNA, 60 bp, Artificial Sequence
  Description of Artificial Sequence: Synthetic probe
gccccccaggacccgaaggcgacggcgagagtcagacccccgaagccaacggaggcgccg

SEQ ID NO: 12960 - DNA, 52 bp, Artificial Sequence
  Description of Artificial Sequence: Synthetic probe
gcgacgacgaggcccgcgaggatgaaggggagaccgaggacggggcagccgg

SEQ ID NO: 12961 - DNA, 60 bp, Artificial Sequence
  Description of Artificial Sequence: Synthetic probe
gcgcgtgcttcccggcccgggattacgagcaaaagaaggttctgcgcctgacgtatctca

SEQ ID NO: 12962 - DNA, 60 bp, Artificial Sequence
  Description of Artificial Sequence: Synthetic probe
gcgggtacacctttggcgcgtgcttcccggcccgggattacgagcaaaagaaggttctgc

SEQ ID NO: 12963 - DNA, 60 bp, Artificial Sequence
  Description of Artificial Sequence: Synthetic probe
cggggactgctggttctcgaaactcggcgcggctcgcgggtacacctttggcgcgtgctt

SEQ ID NO: 12964 - DNA, 60 bp, Artificial Sequence
  Description of Artificial Sequence: Synthetic probe
ggtttcgctgccggccggggactgctggttctcgaaactcggcgcggctcgcgggtacac

SEQ ID NO: 12965 - DNA, 60 bp, Artificial Sequence
  Description of Artificial Sequence: Synthetic probe
ccccacgcccaacagccccgacgctacgccagaggacagcacgcccggtgctactacgcc

SEQ ID NO: 12966 - DNA, 60 bp, Artificial Sequence
  Description of Artificial Sequence: Synthetic probe
acgcccaacagccccgacgctacgccagaggacagcacgcccggtgctactacgcccggg

SEQ ID NO: 12967 - DNA, 50 bp, Artificial Sequence
  Description of Artificial Sequence: Synthetic probe
ccgcccgttaccaacagcacgccgccgcccgccccgcccgaggacgggcg

SEQ ID NO: 12968 - DNA, 52 bp, Artificial Sequence
  Description of Artificial Sequence: Synthetic probe
acccgcccgttaccaacagcacgccgccgcccgccccgcccgaggacgggcg

SEQ ID NO: 12969 - DNA, 53 bp, Artificial Sequence
  Description of Artificial Sequence: Synthetic probe
ccgaccgccccgaaggctggccgagcctcgaagccatcacgcaccccccgccc

SEQ ID NO: 12970 - DNA, 60 bp, Artificial Sequence
  Description of Artificial Sequence: Synthetic probe
gggctacgagccgccgcctgccgccgatgggggttcccccgcgccacccggcgacgacga

SEQ ID NO: 12971 - DNA, 52 bp, Artificial Sequence
  Description of Artificial Sequence: Synthetic probe
caaggccatagtcgactactggttcatgcgccacgggggcgtcgttccgccg

SEQ ID NO: 12972 - DNA, 60 bp, Artificial Sequence
  Description of Artificial Sequence: Synthetic probe
cgcctgacgtatctcacgcagtactacccgcaggaggcacacaaggccatagtcgactac

SEQ ID NO: 12973 - DNA, 60 bp, Artificial Sequence
  Description of Artificial Sequence: Synthetic probe
aaggttctgcgcctgacgtatctcacgcagtactacccgcaggaggcacacaaggccata

SEQ ID NO: 12974 - DNA, 60 bp, Artificial Sequence
  Description of Artificial Sequence: Synthetic probe
ttgggacagcttcctggcgggcttcgcctaccccacggacgacgagctgggactgattat

SEQ ID NO: 12975 - DNA, 60 bp, Artificial Sequence
  Description of Artificial Sequence: Synthetic probe
gttttgggacagcttcctggcgggcttcgcctaccccacggacgacgagctgggactgat

SEQ ID NO: 12976 - DNA, 60 bp, Artificial Sequence
  Description of Artificial Sequence: Synthetic probe
gagtgcgagcccaggaagcactttgggtactgccgctaccgcacacccccgttttgggac

SEQ ID NO: 12977 - DNA, 52 bp, Artificial Sequence
  Description of Artificial Sequence: Synthetic probe
accgagtgcgagcccaggaagcactttgggtactgccgctaccgcacacccc

SEQ ID NO: 12978 - DNA, 60 bp, Artificial Sequence
  Description of Artificial Sequence: Synthetic probe
aagcggtacgccggcacgcgcgcgcgtacaacgccacggtcatatggtacaagatcgaga

SEQ ID NO: 12979 - DNA, 60 bp, Artificial Sequence
  Description of Artificial Sequence: Synthetic probe
ggaagcggtacgccggcacgcgcgcgcgtacaacgccacggtcatatggtacaagatcga

SEQ ID NO: 12980 - DNA, 60 bp, Artificial Sequence
  Description of Artificial Sequence: Synthetic probe
tgcgacatgctggcgctgatcgcagacccgcaggtggggcgcacgctgtgggaagcggta

SEQ ID NO: 12981 - DNA, 52 bp, Artificial Sequence
  Description of Artificial Sequence: Synthetic probe
gacggtatacgtcgacccgccggcgtacccgatgccgcgatacaactacact

SEQ ID NO: 12982 - DNA, 60 bp, Artificial Sequence
  Description of Artificial Sequence: Synthetic probe
gtgtggcgcaaacgccagagtcgagcccgctgccggcgttagatttgaccccacaacccc

SEQ ID NO: 12983 - DNA, 60 bp, Artificial Sequence
  Description of Artificial Sequence: Synthetic probe
ccctggacgtggcccgggaagcagaggccatggtgacgcgacatgtagacgccgaggaaa

SEQ ID NO: 12984 - DNA, 60 bp, Artificial Sequence
  Description of Artificial Sequence: Synthetic probe
tggcaatatatccgcgagctcgtcctggcccgcgccgtcttcgcgtccgtcttccacagc

SEQ ID NO: 12985 - DNA, 55 bp, Artificial Sequence
  Description of Artificial Sequence: Synthetic probe
gcgcgctcggtgtacccgtacgactcgttcgcgctctcgaccggggacattatct

SEQ ID NO: 12986 - DNA, 60 bp, Artificial Sequence
  Description of Artificial Sequence: Synthetic probe
aacggctcggtcgcgtaccgcagcgcggagctgggcggcaactacatcttcccctcgccc

SEQ ID NO: 12987 - DNA, 60 bp, Artificial Sequence
  Description of Artificial Sequence: Synthetic probe
aacggctcggtcgcgtaccgcagcgcggagctgggcggcaactacatcttcccctcgcct

SEQ ID NO: 12988 - DNA, 60 bp, Artificial Sequence
  Description of Artificial Sequence: Synthetic probe
atcgtgaccacgacctgggcgggcagcacgtacgcggccattacaaaccagtacacggac

SEQ ID NO: 12989 - DNA, 60 bp, Artificial Sequence
  Description of Artificial Sequence: Synthetic probe
aaacgtgatcgtgaccacgacctgggcgggcagcacgtacgcggccattacaaaccagta

SEQ ID NO: 12990 - DNA, 60 bp, Artificial Sequence
  Description of Artificial Sequence: Synthetic probe
tttactacaaaaacgtgatcgtgaccacgacctgggcgggcagcacgtacgcggccatta

SEQ ID NO: 12991 - DNA, 60 bp, Artificial Sequence
  Description of Artificial Sequence: Synthetic probe
atggccacggccgagtcctggctgctgttgccctcgacggccacgcgcaccgccgagaag

SEQ ID NO: 12992 - DNA, 60 bp, Artificial Sequence
  Description of Artificial Sequence: Synthetic probe
tccgcagcaaccccatgaaggcgctgtacccgatcaccacgcgcgcgctcaaggacgacg

SEQ ID NO: 12993 - DNA, 60 bp, Artificial Sequence
  Description of Artificial Sequence: Synthetic probe
tgcagttcacctacgaccacatccaggaccacgtgaacaccatgttcagccgcctggcca

SEQ ID NO: 12994 - DNA, 60 bp, Artificial Sequence
  Description of Artificial Sequence: Synthetic probe
ttcgcggcgctgcagttcacctacgaccacatccaggaccacgtgaacaccatgttcagc

SEQ ID NO: 12995 - DNA, 60 bp, Artificial Sequence
  Description of Artificial Sequence: Synthetic probe
ccgagttcgcggcgctgcagttcacctacgaccacatccaggaccacgtgaacaccatgt

SEQ ID NO: 12996 - DNA, 58 bp, Artificial Sequence
  Description of Artificial Sequence: Synthetic probe
gtgagctcggccgagttcgccgcgctgcagttcacctacgaccacatccaggaccacg

SEQ ID NO: 12997 - DNA, 52 bp, Artificial Sequence
  Description of Artificial Sequence: Synthetic probe
ggcgctgggctcggcggggctctaccgcacgggcacctcggtgaactgcatc

SEQ ID NO: 12998 - DNA, 60 bp, Artificial Sequence
  Description of Artificial Sequence: Synthetic probe
acacggagggcatcggcgtcatctacaaggagaacatcgcgccgtacacgttcaaggcct

SEQ ID NO: 12999 - DNA, 56 bp, Artificial Sequence
  Description of Artificial Sequence: Synthetic probe
agagctcgcgcttcttcgtgtgcccgccgccctcgggcgccacggtggtccggctc

SEQ ID NO: 13000 - DNA, 50 bp, Artificial Sequence
  Description of Artificial Sequence: Synthetic probe
ccgcctttgcgtttattgtcccagctgtgttcccgcctttgcgtggcccc

SEQ ID NO: 13001 - DNA, 60 bp, Artificial Sequence
  Description of Artificial Sequence: Synthetic probe
ggaggcgggacgtgcgcgcgagctcggccggattagggttcggcgccacccgggcacgca

SEQ ID NO: 13002 - DNA, 60 bp, Artificial Sequence
  Description of Artificial Sequence: Synthetic probe
aaggagatggagctgttcgagtacacgaccgacacctcctggccctggttgttagccgtc

SEQ ID NO: 13003 - DNA, 60 bp, Artificial Sequence
  Description of Artificial Sequence: Synthetic probe
cggctaacaaccagggccaggaggtgtcggtcgtgtactcgaacagctccatctccttga

SEQ ID NO: 13004 - DNA, 60 bp, Artificial Sequence
  Description of Artificial Sequence: Synthetic probe
aaatacggcgccaggatcagggagatggagctgttcgagtacacgaccgacacctcctgg

SEQ ID NO: 13005 - DNA, 60 bp, Artificial Sequence
  Description of Artificial Sequence: Synthetic probe
cttcggcttcctgatcgcgcaccaggaggcgtgcaggtcggaggaggagctatgcggggc

SEQ ID NO: 13006 - DNA, 60 bp, Artificial Sequence
  Description of Artificial Sequence: Synthetic probe
ttttaaacaccgccccgcatagctcctcctccgacctgcacgcctcctggtgcgcgatca

SEQ ID NO: 13007 - DNA, 60 bp, Artificial Sequence
  Description of Artificial Sequence: Synthetic probe
tgatcgcgcaccaggaggcgtgcaggtcggaggaggagctatgcggggcggtgtttaaaa

SEQ ID NO: 13008 - DNA, 60 bp, Artificial Sequence
  Description of Artificial Sequence: Synthetic probe
ttttaaacaccgccccgcagagctcctcctccgacctgcacgcctcctggtgcgcgatca

SEQ ID NO: 13009 - DNA, 60 bp, Artificial Sequence
  Description of Artificial Sequence: Synthetic probe
tatgcggggcggtgtttaaaaaaacgcgcctggagacgtacctcgcggagctcgctgcga

SEQ ID NO: 13010 - DNA, 55 bp, Artificial Sequence
  Description of Artificial Sequence: Synthetic probe
aaaacgcgcctggagacgtacctcgcggagctcgctgcgatcttcacggccgacg

SEQ ID NO: 13011 - DNA, 60 bp, Artificial Sequence
  Description of Artificial Sequence: Synthetic probe
tgctaaatacggctatgtgcatggccggctacagccccttcgacagccagctggtgttgc

SEQ ID NO: 13012 - DNA, 60 bp, Artificial Sequence
  Description of Artificial Sequence: Synthetic probe
tgcgccgcgcgagccgcgagcgcacctacgacatcctcaaccccttcggggcggtgtaca

SEQ ID NO: 13013 - DNA, 60 bp, Artificial Sequence
  Description of Artificial Sequence: Synthetic probe
tgctctgcgagcacaaggcgttggccgccggttacgcgaagccgctgtgcgttcactgcg

SEQ ID NO: 13014 - DNA, 60 bp, Artificial Sequence
  Description of Artificial Sequence: Synthetic probe
acgcgagccgcgatgggcgacctagcggcggggggcgggctcgccccccgcaaccgagca

SEQ ID NO: 13015 - DNA, 59 bp, Artificial Sequence
  Description of Artificial Sequence: Synthetic probe
gacgccggaccgcgcgtccgtgtccgagcacaacccgcccgttaccaacagcacgccgc

SEQ ID NO: 13016 - DNA, 60 bp, Artificial Sequence
  Description of Artificial Sequence: Synthetic probe
ctactacgcccggtgggacgccggaccgcgcgtccgtgtccgagcacaacccgcccgtta

SEQ ID NO: 13017 - DNA, 60 bp, Artificial Sequence
  Description of Artificial Sequence: Synthetic probe
gaagccgtgcgctcccaaccgccctccccgtccccaaccgagacggaaagctccgccggg

SEQ ID NO: 13018 - DNA, 60 bp, Artificial Sequence
  Description of Artificial Sequence: Synthetic probe
gcggaagccgtgcgctcccaaccgccctccccgtccccaaccgagacggaaagctccgcc

SEQ ID NO: 13019 - DNA, 60 bp, Artificial Sequence
  Description of Artificial Sequence: Synthetic probe
tgggttcacgtcgccctctttgccggattggaactggtctcgctgctataccgcaagccc

SEQ ID NO: 13020 - DNA, 60 bp, Artificial Sequence
  Description of Artificial Sequence: Synthetic probe
ccgcctttgcgtttattgtcccagctgtgttcccgcctttgcgtggcccccctccccgcc

SEQ ID NO: 13021 - DNA, 60 bp, Artificial Sequence
  Description of Artificial Sequence: Synthetic probe
gccgtggccgtcgtctgcggcctcggcgccgtggggctcctgctgctggcggccctgtgc

SEQ ID NO: 13022 - DNA, 60 bp, Artificial Sequence
  Description of Artificial Sequence: Synthetic probe
cggccgcgtgccgcgccgccgagtacttcccgccgcgctccacgcgcctgcgctggttcc

SEQ ID NO: 13023 - DNA, 60 bp, Artificial Sequence
  Description of Artificial Sequence: Synthetic probe
atgggcgccaagtcgcagcgcaaggtcgtgacggtcacgacgtaccgcgcgcccgacgtc

SEQ ID NO: 13024 - DNA, 60 bp, Artificial Sequence
  Description of Artificial Sequence: Synthetic probe
gccgccccgtacgccgagccgctgtacgtgcactgcggcgtggccgacaacgccactggc

SEQ ID NO: 13025 - DNA, 60 bp, Artificial Sequence
  Description of Artificial Sequence: Synthetic probe
ctggccgcctcgtacgccgagccgctgtacgtgcactgcggcgtggccgacaacgccaca

SEQ ID NO: 13026 - DNA, 55 bp, Artificial Sequence
  Description of Artificial Sequence: Synthetic probe
ctggccgcctcgtacgccgagccgctgtacgtgcactgcggcgtggccgacaacg

SEQ ID NO: 13027 - DNA, 60 bp, Artificial Sequence
  Description of Artificial Sequence: Synthetic probe
cggcgtggccgacaacgccactggcggtgcgcgcctggagctctggtgccagcgcgtggg

SEQ ID NO: 13028 - DNA, 60 bp, Artificial Sequence
  Description of Artificial Sequence: Synthetic probe
gccactcgcggtggtgctgaacgcgccgcgggcgccggatacggtcggcgaggacagcgt

SEQ ID NO: 13029 - DNA, 60 bp, Artificial Sequence
  Description of Artificial Sequence: Synthetic probe
tgcccgagcggcgtctacctgacctacgaagagtcatggccactcgcggtggtgctgaac

SEQ ID NO: 13030 - DNA, 60 bp, Artificial Sequence
  Description of Artificial Sequence: Synthetic probe
gggcggcagtcgtgcccgagcggcgtctacctgacctacgaagagtcatggccactcgcg

SEQ ID NO: 13031 - DNA, 60 bp, Artificial Sequence
  Description of Artificial Sequence: Synthetic probe
acttcgcgcagccgccgaacaccgcgctgtactttagcgtggagaacgtgggcctgctcc

SEQ ID NO: 13032 - DNA, 60 bp, Artificial Sequence
  Description of Artificial Sequence: Synthetic probe
ggcggtgcatccgcgaccagcggcgggagctggagaagaccctgcgcgtgagcgtctacg

SEQ ID NO: 13033 - DNA, 60 bp, Artificial Sequence
  Description of Artificial Sequence: Synthetic probe
gggcggtgcatccgcgaccagcggcgggagctggagaagaccctgcgcgtgagcgtctac

SEQ ID NO: 13034 - DNA, 55 bp, Artificial Sequence
  Description of Artificial Sequence: Synthetic probe
ccggctcgggcgaagaggggggtggagccgacgacgacggcggggacggggacgg

SEQ ID NO: 13035 - DNA, 60 bp, Artificial Sequence
  Description of Artificial Sequence: Synthetic probe
tttgaccgcgcgctcgcagacgggctggcgcggctggacggcgtggactgcctgctcgtg

SEQ ID NO: 13036 - DNA, 60 bp, Artificial Sequence
  Description of Artificial Sequence: Synthetic probe
ctttgaccgcgcgctcgcagacgggctggcgcggctggacggcgtggactgcctgctcgt

SEQ ID NO: 13037 - DNA, 60 bp, Artificial Sequence
  Description of Artificial Sequence: Synthetic probe
gcgcgcggtggctccggcaccggtctctgtggccctccccccgcctttgcgtttattgtc

SEQ ID NO: 13038 - DNA, 60 bp, Artificial Sequence
  Description of Artificial Sequence: Synthetic probe
gcgccctttacttatgtttggcgcgcggtggctccggcaccggtctctgtggccctcccc

SEQ ID NO: 13039 - DNA, 60 bp, Artificial Sequence
  Description of Artificial Sequence: Synthetic probe
tagggttcggcgccacccgggcacggcagggcgccctttacttatgtttggcgcgcggtg

SEQ ID NO: 13040 - DNA, 60 bp, Artificial Sequence
  Description of Artificial Sequence: Synthetic probe
ttttctggaggcgggacgctgcgcgcgagctcggccggattagggttcggcgccacccgg

SEQ ID NO: 13041 - DNA, 60 bp, Artificial Sequence
  Description of Artificial Sequence: Synthetic probe
ttttcctggaggcgggacgctgcgcgcgagctcggccggattagggttcggcgccacccg

SEQ ID NO: 13042 - DNA, 58 bp, Artificial Sequence
  Description of Artificial Sequence: Synthetic probe
ctgaacccgccgcgggcgccggagacggtcggcgaggacagcgtcgtcatctacgacc

SEQ ID NO: 13043 - DNA, 60 bp, Artificial Sequence
  Description of Artificial Sequence: Synthetic probe
tgagggctcgacgctggagagcctgctgcaggacgcgcgcgagggctcgggtggcccgcc

SEQ ID NO: 13044 - DNA, 60 bp, Artificial Sequence
  Description of Artificial Sequence: Synthetic probe
acgcgctcccgcgcttcgtctgcgaggtccgcgagatcccagcagggccgccgacgttca

SEQ ID NO: 13045 - DNA, 60 bp, Artificial Sequence
  Description of Artificial Sequence: Synthetic probe
tcgtctgcgaggtccgcgagatcccagcagggccgccgacgttcacgtcatcgtccatta

SEQ ID NO: 13046 - DNA, 60 bp, Artificial Sequence
  Description of Artificial Sequence: Synthetic probe
ccgacgttcacgtcatcgtccattacgcacctgcgcgtagagccgagcacgggcgcgcta

SEQ ID NO: 13047 - DNA, 60 bp, Artificial Sequence
  Description of Artificial Sequence: Synthetic probe
tcacgtcatcgtccattacgcacctgcgcgtagagccgagcacgggcgcgctactactga

SEQ ID NO: 13048 - DNA, 54 bp, Artificial Sequence
  Description of Artificial Sequence: Synthetic probe
gggcgcgctactactgacgctcgacggccgcgccgaagaagtggactgcgacgc

SEQ ID NO: 13049 - DNA, 60 bp, Artificial Sequence
  Description of Artificial Sequence: Synthetic probe
aagccatgccggccttccggggcttcgccttcgccgtgctcaccgccatggaggatgcgg

SEQ ID NO: 13050 - DNA, 60 bp, Artificial Sequence
  Description of Artificial Sequence: Synthetic probe
gccttccggggcttcgccttcgccgtgctcaccgccatggaggatgcggtctttgccact

SEQ ID NO: 13051 - DNA, 60 bp, Artificial Sequence
  Description of Artificial Sequence: Synthetic probe
tggccttgtgccgccccgagacgcgggaggactttgccctctgcgtcgtgcaaatgtttt

SEQ ID NO: 13052 - DNA, 60 bp, Artificial Sequence
  Description of Artificial Sequence: Synthetic probe
ccctctgcgtcgtgcaaatgtttttagagggctgcagcgaggcgcgcgtcggggccgccc

SEQ ID NO: 13053 - DNA, 60 bp, Artificial Sequence
  Description of Artificial Sequence: Synthetic probe
ggggccgccctgttcgtgcagctgtcgtgcctgctgcggcgtctgcgcccgccgcctgcg

SEQ ID NO: 13054 - DNA, 60 bp, Artificial Sequence
  Description of Artificial Sequence: Synthetic probe
tgttcgtgcagctgtcgtgcctgctgcggcgtctgcgcccgccgcctgcgcgcaagatga

SEQ ID NO: 13055 - DNA, 60 bp, Artificial Sequence
  Description of Artificial Sequence: Synthetic probe
agatgagccggttgctctacgtgggcgccatgcgcgtgctaaatacggctatgtgcatgg

SEQ ID NO: 13056 - DNA, 60 bp, Artificial Sequence
  Description of Artificial Sequence: Synthetic probe
agtggggcaacaccagctggctctcgaaggggctgtagccggccatgcacatagccgtat

SEQ ID NO: 13057 - DNA, 60 bp, Artificial Sequence
  Description of Artificial Sequence: Synthetic probe
ctggtgttgccccactacgccgtcgcccggctgctgctagcggccggcaaccccccgtcg

SEQ ID NO: 13058 - DNA, 57 bp, Artificial Sequence
  Description of Artificial Sequence: Synthetic probe
gcgccagagcggtgcccgccgggcgtgattaacgcgcgcccggggctgctgaacggg

SEQ ID NO: 13059 - DNA, 60 bp, Artificial Sequence
  Description of Artificial Sequence: Synthetic probe
gttccgcgacgcggtgtatcattggtggacgcgcatccccgacaaactgacgccggacaa

SEQ ID NO: 13060 - DNA, 60 bp, Artificial Sequence
  Description of Artificial Sequence: Synthetic probe
cgacgcggtgtatcattggtggacgcgcatccccgacaaactgacgccggacaagatgtt

SEQ ID NO: 13061 - DNA, 60 bp, Artificial Sequence
  Description of Artificial Sequence: Synthetic probe
ctcagtcgtacgacacaaacatcttgtccggcgtcagtttgtcggggatgcgcgtccacc

SEQ ID NO: 13062 - DNA, 57 bp, Artificial Sequence
  Description of Artificial Sequence: Synthetic probe
tccccccctcaatcccctcaggcaaataaaaaatcgaaatcggccaggttgtactcg

SEQ ID NO: 13063 - DNA, 51 bp, Artificial Sequence
  Description of Artificial Sequence: Synthetic probe
ccgcaaccgagcaaggccccgccgaaggagctccagtggatgctctgcgag

SEQ ID NO: 13064 - DNA, 60 bp, Artificial Sequence
  Description of Artificial Sequence: Synthetic probe
ccgcccgccccgcctgaggacgggcgacccggcgacgctggcaacgcgagccgcgatcgg

SEQ ID NO: 13065 - DNA, 60 bp, Artificial Sequence
  Description of Artificial Sequence: Synthetic probe
agccgccgcgcgtgtccgagcggaacctgcccgctaccaacagcacgccgccgcccgccc

SEQ ID NO: 13066 - DNA, 60 bp, Artificial Sequence
  Description of Artificial Sequence: Synthetic probe
tacgccagaggacagaaaaggggttgcgcacggcctcggcgtgacgccggagccgccgcg

SEQ ID NO: 13067 - DNA, 53 bp, Artificial Sequence
  Description of Artificial Sequence: Synthetic probe
tacgccagaggacagaaaaggggttgcgcacggcctcggcgtgacgccggagc

SEQ ID NO: 13068 - DNA, 50 bp, Artificial Sequence
  Description of Artificial Sequence: Synthetic probe
ccccggggcccgacagccccgacgctacgccagaggacagaaaaggggtt

SEQ ID NO: 13069 - DNA, 60 bp, Artificial Sequence
  Description of Artificial Sequence: Synthetic probe
tgggctacgaacaccggcgcagcacccccggggcccgacagccccgacgctacgccagag

SEQ ID NO: 13070 - DNA, 60 bp, Artificial Sequence
  Description of Artificial Sequence: Synthetic probe
ctccgcgctaccggtacgcgatcgagccggaaatctgggctacgaacaccggcgcagcac

SEQ ID NO: 13071 - DNA, 60 bp, Artificial Sequence
  Description of Artificial Sequence: Synthetic probe
aagcctcgccctcgcctccgcgctaccggtacgcgatcgagccggaaatctgggctacga

SEQ ID NO: 13072 - DNA, 60 bp, Artificial Sequence
  Description of Artificial Sequence: Synthetic probe
ctgaccgccgccaccgagggcgtgtacacctggcgccgcgacatgggcgccaagtcgcag

SEQ ID NO: 13073 - DNA, 60 bp, Artificial Sequence
  Description of Artificial Sequence: Synthetic probe
tgcgctccctgaccgccgccaccgagggcgtgtacacctggcgccgcgacatgggcgcca

SEQ ID NO: 13074 - DNA, 60 bp, Artificial Sequence
  Description of Artificial Sequence: Synthetic probe
cttcccgcgggccccgcccgtgctgctgttcgcgatccagaacggctcggtcgcgtaccg

SEQ ID NO: 13075 - DNA, 60 bp, Artificial Sequence
  Description of Artificial Sequence: Synthetic probe
gtgcgcaaccccttcccgcgggccccgcccgtgctgctgttcgcgatccagaacggctcg

SEQ ID NO: 13076 - DNA, 60 bp, Artificial Sequence
  Description of Artificial Sequence: Synthetic probe
cgtgcgcaaccccttcccgcgggccccgcccgtgctgctgttcgcgatccagaacggctc

SEQ ID NO: 13077 - DNA, 57 bp, Artificial Sequence
  Description of Artificial Sequence: Synthetic probe
cccgccgcgcgagcgcaagtggatgctctgcgagcgcgaggtcgtggccgtccccta

SEQ ID NO: 13078 - DNA, 60 bp, Artificial Sequence
  Description of Artificial Sequence: Synthetic probe
ccccgccgcgcgagcgcaagtggatgctctgcgagcgcgaggtcgtggccgtcccctacg

SEQ ID NO: 13079 - DNA, 50 bp, Artificial Sequence
  Description of Artificial Sequence: Synthetic probe
cccctcaccgccgccggagggctccatcgtgtccatccccatcctcgagc

SEQ ID NO: 13080 - DNA, 64 bp, Artificial Sequence
  Description of Artificial Sequence: Synthetic probe
agcttcggtgagcccggagacccagaggccgcggcgcgcaccccggcaccgtcgaggcagtcga

SEQ ID NO: 13081 - DNA, 60 bp, Artificial Sequence
  Description of Artificial Sequence: Synthetic probe
agataaagcgcccgcgtcggcgactcaagccattgccgcgaccttgtcctccggcgcgct

SEQ ID NO: 13082 - DNA, 50 bp, Artificial Sequence
  Description of Artificial Sequence: Synthetic probe
ccagcgcgggccccggccgcaccagattacaccgtggtagcagcgcgact

SEQ ID NO: 13083 - DNA, 50 bp, Artificial Sequence
  Description of Artificial Sequence: Synthetic probe
ccagcgcggaccccggccgcaccagattacaccgtggtagcagcgcgact

SEQ ID NO: 13084 - DNA, 60 bp, Artificial Sequence
  Description of Artificial Sequence: Synthetic probe
tgaagacgatgccgcgccagcgcgggccccggccgcaccagattacaccgtggtagcagc

SEQ ID NO: 13085 - DNA, 60 bp, Artificial Sequence
  Description of Artificial Sequence: Synthetic probe
tcgagtcgctctgggttcaaagtttggtttagggacccgcctgaagacgatgccgcgcca

SEQ ID NO: 13086 - DNA, 60 bp, Artificial Sequence
  Description of Artificial Sequence: Synthetic probe
gccaacggcacgcgctcgagtcgctctgggttcaaagtttggtttagggacccgcctgaa

SEQ ID NO: 13087 - DNA, 51 bp, Artificial Sequence
  Description of Artificial Sequence: Synthetic probe
ccccgccaacggcacgcgctcgagtcgctctgggttcaaagtttggtttag

SEQ ID NO: 13088 - DNA, 60 bp, Artificial Sequence
  Description of Artificial Sequence: Synthetic probe
atcgggcgcgacatgctgctcgagacgcggcggtacatccacgagcgctgggccgcgccc

SEQ ID NO: 13089 - DNA, 56 bp, Artificial Sequence
  Description of Artificial Sequence: Synthetic probe
ccgacaacgccactggcggtgcgcgcctggagctctggtgccagcgcgtgggcagg

SEQ ID NO: 13090 - DNA, 60 bp, Artificial Sequence
  Description of Artificial Sequence: Synthetic probe
tccttcggcggggccttgctcggccgcgggagcgcaagtggatgctctgcgagcgcgagg

SEQ ID NO: 13091 - DNA, 56 bp, Artificial Sequence
  Description of Artificial Sequence: Synthetic probe
cgtggagcaacctgcccacgcgcgacgcccaaagcgccaggcgcgcaccgccagtg

SEQ ID NO: 13092 - DNA, 60 bp, Artificial Sequence
  Description of Artificial Sequence: Synthetic probe
tacgccagcagaggccgcgcgtggagcaacctgcccacgcgcgacgcccaaagcgccagg

SEQ ID NO: 13093 - DNA, 60 bp, Artificial Sequence
  Description of Artificial Sequence: Synthetic probe
tccgctgcgaacaccggcgcaacgccccccacgcccaacagccccgacgctacgccagca

SEQ ID NO: 13094 - DNA, 60 bp, Artificial Sequence
  Description of Artificial Sequence: Synthetic probe
ctccgccctccgcgtacgcgaccgagccggaaagctccgctgcgaacaccggcgcaacgc

SEQ ID NO: 13095 - DNA, 60 bp, Artificial Sequence
  Description of Artificial Sequence: Synthetic probe
aagcctcgccctcgcctccgccctccgcgtacgcgaccgagccggaaagctccgctgcga

SEQ ID NO: 13096 - DNA, 60 bp, Artificial Sequence
  Description of Artificial Sequence: Synthetic probe
ctccacgcgcctgcgctggttccgcaacggctaccccgtggaggctcggcacgcgcgcga

SEQ ID NO: 13097 - DNA, 60 bp, Artificial Sequence
  Description of Artificial Sequence: Synthetic probe
ctggttccgcaacggctaccccgtggaggctcggcacgcgcgcgacgtctttacggtcga

SEQ ID NO: 13098 - DNA, 60 bp, Artificial Sequence
  Description of Artificial Sequence: Synthetic probe
tctttacggtcgacgactccgggctcttttcgcgcacgtccgtcctcacgctcgaggacg

SEQ ID NO: 13099 - DNA, 60 bp, Artificial Sequence
  Description of Artificial Sequence: Synthetic probe
tccgtcctcacgctcgaggacgcgacgccaaccgcccacccgcccaacctgcgctgcgag

SEQ ID NO: 13100 - DNA, 60 bp, Artificial Sequence
  Description of Artificial Sequence: Synthetic probe
agacgtcgcagcgcaggttgggcgggtgggcggttggcgtcgcgtcctcgagcgtaagga

SEQ ID NO: 13101 - DNA, 60 bp, Artificial Sequence
  Description of Artificial Sequence: Synthetic probe
ttacgctcgaggacgcgacgccaaccgcccacccgcccaacctgcgctgcgacgtctcct

SEQ ID NO: 13102 - DNA, 60 bp, Artificial Sequence
  Description of Artificial Sequence: Synthetic probe
gaggacgcgacgccaaccgcccacccgcccaacctgcgctgcgaggtttcctggttccag

SEQ ID NO: 13103 - DNA, 60 bp, Artificial Sequence
  Description of Artificial Sequence: Synthetic probe
tctggaaccaggaaacctcgcagcgcaggttgggcgggtgggcggttggcgtcgcgtcct

SEQ ID NO: 13104 - DNA, 60 bp, Artificial Sequence
  Description of Artificial Sequence: Synthetic probe
atttgcatacccaccatcgcacatgccgccatattgctcctcctccctcgctcctcctcc

SEQ ID NO: 13105 - DNA, 60 bp, Artificial Sequence
  Description of Artificial Sequence: Synthetic probe
gcctgtgcgcggccatcttgcttccaaactcattagcataccccgcccactattccattc

SEQ ID NO: 13106 - DNA, 60 bp, Artificial Sequence
  Description of Artificial Sequence: Synthetic probe
gcatgtgcgcggccatcttgcttccaaactcattagcataccccgcccattattccattc

SEQ ID NO: 13107 - DNA, 60 bp, Artificial Sequence
  Description of Artificial Sequence: Synthetic probe
agcctgtgcgcggccatcttgcttccaaactcattagcataccccgcccactattccatt

SEQ ID NO: 13108 - DNA, 60 bp, Artificial Sequence
  Description of Artificial Sequence: Synthetic probe
aagactacttgacggcccacctgcgcgccatagaggccctgcccgagtcagcgccccacc

SEQ ID NO: 13109 - DNA, 60 bp, Artificial Sequence
  Description of Artificial Sequence: Synthetic probe
cccgcctgaagacgatgccgcgccagcgcgggccccggccgcaccagattacaccgtggt

SEQ ID NO: 13110 - DNA, 60 bp, Artificial Sequence
  Description of Artificial Sequence: Synthetic probe
tctgggttcaaagtttggtttagggacccgcctgaagacgatgccgcgccagcgcgggcc

SEQ ID NO: 13111 - DNA, 60 bp, Artificial Sequence
  Description of Artificial Sequence: Synthetic probe
cgcgagggcctctgggactgccccgagatccgcgaggcggccgcgcgctacgcggcggcc

SEQ ID NO: 13112 - DNA, 60 bp, Artificial Sequence
  Description of Artificial Sequence: Synthetic probe
cgcggcggccgcgggccccgcggccgtgttcgtgccggagatgggggacgcggggaagca

SEQ ID NO: 13113 - DNA, 60 bp, Artificial Sequence
  Description of Artificial Sequence: Synthetic probe
cggggaagcagtacgcggcgctggtggacctggtgtacgcgcgccgcgacgccatggcct

SEQ ID NO: 13114 - DNA, 54 bp, Artificial Sequence
  Description of Artificial Sequence: Synthetic probe
ggcgctggtggacctggtgtacgcgcgccgcgacgccatggcctggctgcagag

SEQ ID NO: 13115 - DNA, 55 bp, Artificial Sequence
  Description of Artificial Sequence: Synthetic probe
ggcgctggtggacctggtgtacgcgcgccgcgacgccatggcctggctgcagagc

SEQ ID NO: 13116 - DNA, 59 bp, Artificial Sequence
  Description of Artificial Sequence: Synthetic probe
tgcgtggccatgagccgccgctacgactgcgaccagaagctgttcctcctgcagagcct

SEQ ID NO: 13117 - DNA, 59 bp, Artificial Sequence
  Description of Artificial Sequence: Synthetic probe
aggctctgcaggaggaacagcttctggtcgcagtcgtagcggcggctcatggccacgca

SEQ ID NO: 13118 - DNA, 60 bp, Artificial Sequence
  Description of Artificial Sequence: Synthetic probe
tgcgtggccatgagccgccgctacgactgcgaccagaagctgttcctcctgcagagcctg

SEQ ID NO: 13119 - DNA, 54 bp, Artificial Sequence
  Description of Artificial Sequence: Synthetic probe
tctcgctggacagcatagaggcgctggtcggccgcgagccgctaggttcgcggc

SEQ ID NO: 13120 - DNA, 60 bp, Artificial Sequence
  Description of Artificial Sequence: Synthetic probe
cctggccggcaagcggcgggtcatggagctgtacctctcgctggacagcatagaggcgct

SEQ ID NO: 13121 - DNA, 60 bp, Artificial Sequence
  Description of Artificial Sequence: Synthetic probe
tgagcgccgggacgtgcgcgagatgacagcggccttcctgggcgtggggctgatcgcgca

SEQ ID NO: 13122 - DNA, 60 bp, Artificial Sequence
  Description of Artificial Sequence: Synthetic probe
tgagcgccgggacgtgcggcagatgacagcggccttcctgggcgtggggctgatcgcgca

SEQ ID NO: 13123 - DNA, 60 bp, Artificial Sequence
  Description of Artificial Sequence: Synthetic probe
acggtggactcggccaccttccaggaggccctggcttttagcgcgctggcacatgtttac

SEQ ID NO: 13124 - DNA, 60 bp, Artificial Sequence
  Description of Artificial Sequence: Synthetic probe
acggtggactcggccaccttccaagaggccctggcttttagcgcgctggcacatgtttac

SEQ ID NO: 13125 - DNA, 60 bp, Artificial Sequence
  Description of Artificial Sequence: Synthetic probe
agcggcggccttccgcgaagtgcgcgccaagatcccgtacgagcggctgccgctaggcag

SEQ ID NO: 13126 - DNA, 60 bp, Artificial Sequence
  Description of Artificial Sequence: Synthetic probe
gctggctgtatctagcgggcgcgcacctgctcgggccgcaccccacagcggcggccttcc

SEQ ID NO: 13127 - DNA, 52 bp, Artificial Sequence
  Description of Artificial Sequence: Synthetic probe
tgtgcgcgcgctacgcgggcgccgggctgcagtcggccgagctgtacctgct

SEQ ID NO: 13128 - DNA, 59 bp, Artificial Sequence
  Description of Artificial Sequence: Synthetic probe
ccggccccggctagtgtggcggcgcgcgatgaagcaggccatggcgctgcagtaccggc

SEQ ID NO: 13129 - DNA, 60 bp, Artificial Sequence
  Description of Artificial Sequence: Synthetic probe
gctcctaataaccacgtggagcacggtggacccggaattctcgatcggcggcatgtacgt

SEQ ID NO: 13130 - DNA, 60 bp, Artificial Sequence
  Description of Artificial Sequence: Synthetic probe
tgggctcctaataaccacgtggagcacggtggacccggaattctcgatcggcggcatgta

SEQ ID NO: 13131 - DNA, 60 bp, Artificial Sequence
  Description of Artificial Sequence: Synthetic probe
tgccgctgcccaggattttggagggccgggtgcggcccagcgccttcttcgcgcagatgc

SEQ ID NO: 13132 - DNA, 51 bp, Artificial Sequence
  Description of Artificial Sequence: Synthetic probe
ccggcgatgctatggacacagacgcaccacccgagcgcgccccggaagggg

SEQ ID NO: 13133 - DNA, 60 bp, Artificial Sequence
  Description of Artificial Sequence: Synthetic probe
ttattttactgctaaccgcggccccaatcacggcgccggcgatgctatggacacagacgc

SEQ ID NO: 13134 - DNA, 51 bp, Artificial Sequence
  Description of Artificial Sequence: Synthetic probe
ccccggacgaggacaccagtgaggacgagaacgtgtatgattacatcgacg

SEQ ID NO: 13135 - DNA, 53 bp, Artificial Sequence
  Description of Artificial Sequence: Synthetic probe
ccccggacgaggacaccagtgaggacgagaacgtgtatgattacatcgacggc

SEQ ID NO: 13136 - DNA, 52 bp, Artificial Sequence
  Description of Artificial Sequence: Synthetic probe
tttgcgaggcctccctctggcgtaaggcctctggcgccgccctgcgggcggc

SEQ ID NO: 13137 - DNA, 60 bp, Artificial Sequence
  Description of Artificial Sequence: Synthetic probe
acttctaagggcgggcgggcagtggcgctttcgacccggcgcgtggcgtttgcgaggcct

SEQ ID NO: 13138 - DNA, 60 bp, Artificial Sequence
  Description of Artificial Sequence: Synthetic probe
acacatctggctcaggcgccttcagccaagggcgccgccccggccgagtttgccgccttg

SEQ ID NO: 13139 - DNA, 53 bp, Artificial Sequence
  Description of Artificial Sequence: Synthetic probe
ccgcgagcgctgggcttcctgaattaccaagtacgcgcgaagatgggcgcgcc

SEQ ID NO: 13140 - DNA, 60 bp, Artificial Sequence
  Description of Artificial Sequence: Synthetic probe
ctctggtggaggagccgccgttttcgggaagcttgccgcgggcgctgggcttcctgaatt

SEQ ID NO: 13141 - DNA, 60 bp, Artificial Sequence
  Description of Artificial Sequence: Synthetic probe
ttcgtttcgctgtactatgcttggccgcagcggcggcagttcacctgcctgttccacccc

SEQ ID NO: 13142 - DNA, 60 bp, Artificial Sequence
  Description of Artificial Sequence: Synthetic probe
tcggaggagggcctcccggagtatgtggccggcgtacaggcgcattttctggcagagctg

SEQ ID NO: 13143 - DNA, 60 bp, Artificial Sequence
  Description of Artificial Sequence: Synthetic probe
ttggacttgaacgcgcacgcgaaccagccgcttcccgcaccgccggcctcggaggagggc

SEQ ID NO: 13144 - DNA, 60 bp, Artificial Sequence
  Description of Artificial Sequence: Synthetic probe
cggtagtgggcgccatgtacctagcggtgcctggggacgcggagcgcttggacttgaacg

SEQ ID NO: 13145 - DNA, 60 bp, Artificial Sequence
  Description of Artificial Sequence: Synthetic probe
tctgccgaccaacgcagacctgtacgcagacgccgcgctgctctcggcagacgcagacgc

SEQ ID NO: 13146 - DNA, 52 bp, Artificial Sequence
  Description of Artificial Sequence: Synthetic probe
aaaacgtgtgctcgctggccaagtggcgcgaggcggacgaaatgctgcgaga

SEQ ID NO: 13147 - DNA, 60 bp, Artificial Sequence
  Description of Artificial Sequence: Synthetic probe
ctgggactgggtgcccaagcgcaaaaacgtgtgctcgctggccaagtggcgcgaggcgga

SEQ ID NO: 13148 - DNA, 53 bp, Artificial Sequence
  Description of Artificial Sequence: Synthetic probe
ttttgcgtacacagcacgtgacggtagcctgggactgggtgcccaagcgcaaa

SEQ ID NO: 13149 - DNA, 60 bp, Artificial Sequence
  Description of Artificial Sequence: Synthetic probe
aaggagccggtctcgcggaactttttgcgtacacagcacgtgacggtagcctgggactgg

SEQ ID NO: 13150 - DNA, 60 bp, Artificial Sequence
  Description of Artificial Sequence: Synthetic probe
tcgtggaagaagtggaagcgcgctcggtgtacccgtacgactcgttcgcgctctcgaccg

SEQ ID NO: 13151 - DNA, 60 bp, Artificial Sequence
  Description of Artificial Sequence: Synthetic probe
tcagcagggctctaccgcacgggcacctctgtgaactgcatcgtggaagaagtggaagcg

SEQ ID NO: 13152 - DNA, 60 bp, Artificial Sequence
  Description of Artificial Sequence: Synthetic probe
tcggcggggctctaccgcacgggcacctctgtgaactgcatcgtggaagaagtggaggcg

SEQ ID NO: 13153 - DNA, 60 bp, Artificial Sequence
  Description of Artificial Sequence: Synthetic probe
ggcgctgggctcagcagggctctaccgcacgggcacctctgtgaactgcatcgtggaaga

SEQ ID NO: 13154 - DNA, 60 bp, Artificial Sequence
  Description of Artificial Sequence: Synthetic probe
gtgcggggctggcacacgacggacgatgtgtacacggcgctgggctcagcagggctctac

SEQ ID NO: 13155 - DNA, 60 bp, Artificial Sequence
  Description of Artificial Sequence: Synthetic probe
ctgagcgcgcccggggtgcggggctggcacacgacggacgatgtgtacacggcgctgggc

SEQ ID NO: 13156 - DNA, 58 bp, Artificial Sequence
  Description of Artificial Sequence: Synthetic probe
aagtggcgctgcctttcgaaagccgagtacctgcgcagcggacgcaaggtggtggcct

SEQ ID NO: 13157 - DNA, 55 bp, Artificial Sequence
  Description of Artificial Sequence: Synthetic probe
gcggccattacaaaccagtacacggaccgcgtgcccgtgggcatgggcgagatca

SEQ ID NO: 13158 - DNA, 60 bp, Artificial Sequence
  Description of Artificial Sequence: Synthetic probe
cggcgtcatttacaaggagaacatcgcgccgtacacgttcatggcctacatttactacaa

SEQ ID NO: 13159 - DNA, 60 bp, Artificial Sequence
  Description of Artificial Sequence: Synthetic probe
tctaccgcccgcccgagctgcgcgtctacttcgagggcggcgaggccgtctgcgaggcgc

SEQ ID NO: 13160 - DNA, 60 bp, Artificial Sequence
  Description of Artificial Sequence: Synthetic probe
agcttcgcgtcgccgtaccgctccgagacggtgtacagcaagctgttcccgcggtgccac

SEQ ID NO: 13161 - DNA, 60 bp, Artificial Sequence
  Description of Artificial Sequence: Synthetic probe
acgcgcgctgcagcttcgcgtcgccgtaccgctccgagacggtgtacagcaagctgttcc

SEQ ID NO: 13162 - DNA, 60 bp, Artificial Sequence
  Description of Artificial Sequence: Synthetic probe
aacagccccgacgctacgccagaggacagcacgcccggtgctactacgcccggtgggacg

SEQ ID NO: 13163 - DNA, 60 bp, Artificial Sequence
  Description of Artificial Sequence: Synthetic probe
tactacccgccgcgctccacgcgcctgcgctggtttcggaacggctaccccgtggacccc

SEQ ID NO: 13164 - DNA, 60 bp, Artificial Sequence
  Description of Artificial Sequence: Synthetic probe
ggcgtgcgcctgctctccgcgatagacgggcccgtcgactacacctgcaccgccaccggc

SEQ ID NO: 13165 - DNA, 60 bp, Artificial Sequence
  Description of Artificial Sequence: Synthetic probe
gtgcgcctgctctccgcgatagacgggcccgtcgactacacctgcaccgccaccggctac

SEQ ID NO: 13166 - DNA, 56 bp, Artificial Sequence
  Description of Artificial Sequence: Synthetic probe
gtggcgctgcctctcgaaggccgagtacctgcgcagcgggcgcaaggtcgtggcct

SEQ ID NO: 13167 - DNA, 58 bp, Artificial Sequence
  Description of Artificial Sequence: Synthetic probe
aagtggcgctgcctctcgaaggccgagtacctgcgcagcgggcgcaaggtggcggcct

SEQ ID NO: 13168 - DNA, 60 bp, Artificial Sequence
  Description of Artificial Sequence: Synthetic probe
gcggacgtggcgctcttcggccgctccccggagcactttgaccgcgcgctcgcagacggg

SEQ ID NO: 13169 - DNA, 60 bp, Artificial Sequence
  Description of Artificial Sequence: Synthetic probe
ctgcaggtggccgcggcggacgtggcgctcttcggccgctccccggagcactttgaccgc

SEQ ID NO: 13170 - DNA, 60 bp, Artificial Sequence
  Description of Artificial Sequence: Synthetic probe
gcccagaacggctcggtcgcgtaccgcagcgcggagctgggcggcaactacatcttcccc

SEQ ID NO: 13171 - DNA, 60 bp, Artificial Sequence
  Description of Artificial Sequence: Synthetic probe
agctgcgcgtctacttcgagggcggcgaggccgtctgcgaggcgcgctgcgtgcccgagg

SEQ ID NO: 13172 - DNA, 50 bp, Artificial Sequence
  Description of Artificial Sequence: Synthetic probe
tgcgcttcgagggcggcgaggccgtctgcgaggcgcgctgcgtgcccgac

SEQ ID NO: 13173 - DNA, 60 bp, Artificial Sequence
  Description of Artificial Sequence: Synthetic probe
tgtccgagcggaacctgcccgctaccaacagcacgccgccgcccgccccgcctgaggacg

SEQ ID NO: 13174 - DNA, 60 bp, Artificial Sequence
  Description of Artificial Sequence: Synthetic probe
ccaacggagtgtacgcggctggagctccaactaaagaaagtgtggaagagcgtctcgtaa

SEQ ID NO: 13175 - DNA, 60 bp, Artificial Sequence
  Description of Artificial Sequence: Synthetic probe
atacagacaatttaaccaacggagtgtacgcggctggagctccaactaaagaaagtgtgg

SEQ ID NO: 13176 - DNA, 60 bp, Artificial Sequence
  Description of Artificial Sequence: Synthetic probe
tgacggagaaaacctattggctcagcctgatgatgatacagacaatttaaccaacggagt

SEQ ID NO: 13177 - DNA, 60 bp, Artificial Sequence
  Description of Artificial Sequence: Synthetic probe
actaactctcgcaccttaaactacctccatcaccaatatgctgatctacggacctcgtct

SEQ ID NO: 13178 - DNA, 60 bp, Artificial Sequence
  Description of Artificial Sequence: Synthetic probe
agagcagctgctatttaaccggctcagcgagcgccgcgtgtatgcgttcatgcgacgctt

SEQ ID NO: 13179 - DNA, 58 bp, Artificial Sequence
  Description of Artificial Sequence: Synthetic probe
agagcagctgctatttaaccggctcagcgagcgccgcgtgtatgcgttcatgcgacgc

SEQ ID NO: 13180 - DNA, 60 bp, Artificial Sequence
  Description of Artificial Sequence: Synthetic probe
acgacgtttgctgcgaggacggaaacccgccccgctggttcgtagagtgcgcgccctctg

SEQ ID NO: 13181 - DNA, 60 bp, Artificial Sequence
  Description of Artificial Sequence: Synthetic probe
tccgacgatgacttcgtcctggtggtcgacaacgacatgaccttccgcaagcccgagatg

SEQ ID NO: 13182 - DNA, 60 bp, Artificial Sequence
  Description of Artificial Sequence: Synthetic probe
ccatctcgggcttgcggaaggtcatgtcgttgtcgaccaccaggatgaagtcatcgtcgg

SEQ ID NO: 13183 - DNA, 60 bp, Artificial Sequence
  Description of Artificial Sequence: Synthetic probe
cgtcctggtggtcgacaacgacatgaccttccgcaagcccgagatggtaaagccgctcat

SEQ ID NO: 13184 - DNA, 60 bp, Artificial Sequence
  Description of Artificial Sequence: Synthetic probe
gcctcgataagcggctttaccatctcgggcttgcggaaggtcatgtcgttgtcgaccacc

SEQ ID NO: 13185 - DNA, 60 bp, Artificial Sequence
  Description of Artificial Sequence: Synthetic probe
acaagctgccggccaagcagatcgcgaaggagctcggcatatccaaacacgaggcgaacc

SEQ ID NO: 13186 - DNA, 58 bp, Artificial Sequence
  Description of Artificial Sequence: Synthetic probe
gacaagctgccggccaagcatatcgcgaaggagctcggcatatccaaacacgaggcta

SEQ ID NO: 13187 - DNA, 60 bp, Artificial Sequence
  Description of Artificial Sequence: Synthetic probe
gacaagctgccggccaagcagatcgcgaaggagctcggcatatccaaacacgaggcgaac

SEQ ID NO: 13188 - DNA, 58 bp, Artificial Sequence
  Description of Artificial Sequence: Synthetic probe
acctgcctcacggtgggcgtcgacgagcggcacatggcggcggtcgcggacgcggaag

SEQ ID NO: 13189 - DNA, 60 bp, Artificial Sequence
  Description of Artificial Sequence: Synthetic probe
tggggcacgtgcgcgcgaacggctccgcctcggtgacctgcctcacggtgggcgtcgacg

SEQ ID NO: 13190 - DNA, 60 bp, Artificial Sequence
  Description of Artificial Sequence: Synthetic probe
agaaacactacagccgcctcggacaccacacccgaacaccgccgccgccatgcacccctc

SEQ ID NO: 13191 - DNA, 60 bp, Artificial Sequence
  Description of Artificial Sequence: Synthetic probe
cccgggcagaaacactacagccgcctcggacaccacacccgaacaccgccgccgccatgc

SEQ ID NO: 13192 - DNA, 60 bp, Artificial Sequence
  Description of Artificial Sequence: Synthetic probe
cgcgcaaagtgaaaaaggaccgcccgcagtcgagaccgcccctccccccgcccgggcaga

SEQ ID NO: 13193 - DNA, 60 bp, Artificial Sequence
  Description of Artificial Sequence: Synthetic probe
ctgctgaccaccctgctcgtggatcacctggtccgagcgcgccgcccctcgctcgccctc

SEQ ID NO: 13194 - DNA, 60 bp, Artificial Sequence
  Description of Artificial Sequence: Synthetic probe
tccctgctgaccaccctgctcgtggatcacctggtccgagcgcgccgcccctcgctcgcc

SEQ ID NO: 13195 - DNA, 60 bp, Artificial Sequence
  Description of Artificial Sequence: Synthetic probe
taacatagcgtctctccgcgtcgccgcacatgactcccactccccgagaatccctgctga

SEQ ID NO: 13196 - DNA, 60 bp, Artificial Sequence
  Description of Artificial Sequence: Synthetic probe
ggcggagtgaaaggcggcataaaccctggcgttaacggcggagtgaacggcgatgtcaag

SEQ ID NO: 13197 - DNA, 60 bp, Artificial Sequence
  Description of Artificial Sequence: Synthetic probe
ggacgcgcgatcgacggcggagtgaaaggcggcataaaccctggcgttaacggcggagtg

SEQ ID NO: 13198 - DNA, 60 bp, Artificial Sequence
  Description of Artificial Sequence: Synthetic probe
tttagactggaacacctccggtccaaacgacgggtccgatctgagaacagagttcgcgac

SEQ ID NO: 13199 - DNA, 60 bp, Artificial Sequence
  Description of Artificial Sequence: Synthetic probe
agagagattaaaattctacagcacactacgtgcgaatacggaccttatgatttagactgg

SEQ ID NO: 13200 - DNA, 60 bp, Artificial Sequence
  Description of Artificial Sequence: Synthetic probe
gtgccgcatgtggaggagttcacctttgaagcacacatcataattagtcacaatcaatgc

SEQ ID NO: 13201 - DNA, 60 bp, Artificial Sequence
  Description of Artificial Sequence: Synthetic probe
ctctcacacgacgtggtgaccgtcacagagcactcattcgaagtgccgcatgtggaggag

SEQ ID NO: 13202 - DNA, 60 bp, Artificial Sequence
  Description of Artificial Sequence: Synthetic probe
agcaatcgcttgaggatatctctagcggtgatggcgggtctgtcatccccccgtgtgttc

SEQ ID NO: 13203 - DNA, 60 bp, Artificial Sequence
  Description of Artificial Sequence: Synthetic probe
cgaacgggaacgcaggcgcgaacataaccagtgagaagctccgcagcaatcgcttgagga

SEQ ID NO: 13204 - DNA, 60 bp, Artificial Sequence
  Description of Artificial Sequence: Synthetic probe
ctgcagcgaacgggaacgcaggcgcgaacataaccagtgagaagctccgcagcaatcgct

SEQ ID NO: 13205 - DNA, 60 bp, Artificial Sequence
  Description of Artificial Sequence: Synthetic probe
tacatcaacgcatcagaacaaactgcgcctggctgactgcagcgaacgggaacgcaggcg

SEQ ID NO: 13206 - DNA, 60 bp, Artificial Sequence
  Description of Artificial Sequence: Synthetic probe
actaaaaaaacaaacacgcatgaaaattaattattgtatactgatctgtagcacactgat

SEQ ID NO: 13207 - DNA, 60 bp, Artificial Sequence
  Description of Artificial Sequence: Synthetic probe
cgccgtaaaactaggtgtgagtgtaagcgtgttaacatcttacccgtgtatcaataactg

SEQ ID NO: 13208 - DNA, 60 bp, Artificial Sequence
  Description of Artificial Sequence: Synthetic probe
cggtagcagtgcgactgtcgctgctgtgtcacacactgtagatttgctttaggttttttg

SEQ ID NO: 13209 - DNA, 60 bp, Artificial Sequence
  Description of Artificial Sequence: Synthetic probe
caggtgtttctggatctacaggcgcaactagtaacttccaaactataagtgttgaagaac

SEQ ID NO: 13210 - DNA, 60 bp, Artificial Sequence
  Description of Artificial Sequence: Synthetic probe
gtgtcacagttagaagatgtggtggttgttgtaacgacgaatctcaaatatgtactgcta

SEQ ID NO: 13211 - DNA, 60 bp, Artificial Sequence
  Description of Artificial Sequence: Synthetic probe
agtatccaggagacgtagaacaaaggtacaatccaagatgtgtcacagttagaagatgtg

SEQ ID NO: 13212 - DNA, 60 bp, Artificial Sequence
  Description of Artificial Sequence: Synthetic probe
agaaaagagcagttgtaaacctagagatactgtagttcagttaatatctgagtatccagg

SEQ ID NO: 13213 - DNA, 60 bp, Artificial Sequence
  Description of Artificial Sequence: Synthetic probe
taatttaccagaatgcttttctggatctacgggaggtagttctagtggtggaagcagttc

SEQ ID NO: 13214 - DNA, 60 bp, Artificial Sequence
  Description of Artificial Sequence: Synthetic probe
cagacgacatgaagttgataactacgttacaatttgcggtagcgttgttgatatgtatgt

SEQ ID NO: 13215 - DNA, 60 bp, Artificial Sequence
  Description of Artificial Sequence: Synthetic probe
cgtcacatggtaagtaatatacaattgtaagcacactattcagacgacatgaagttgata

SEQ ID NO: 13216 - DNA, 60 bp, Artificial Sequence
  Description of Artificial Sequence: Synthetic probe
gctgctgcgccgcgcgctaaggatccggttccaatactcgaagccgctgaatacgcttcg

SEQ ID NO: 13217 - DNA, 60 bp, Artificial Sequence
  Description of Artificial Sequence: Synthetic probe
gaagatgtggcgcagtgctccccggaagacatgtcaaacatgctagacgatttcctcgaa

SEQ ID NO: 13218 - DNA, 60 bp, Artificial Sequence
  Description of Artificial Sequence: Synthetic probe
agcacctggcctgggacctcatgaaccgctacaacaccttctactccatgatcgtggagc

SEQ ID NO: 13219 - DNA, 60 bp, Artificial Sequence
  Description of Artificial Sequence: Synthetic probe
ggctccacgatcatggagtagaaggtgttgtagcggttcatgaggtcccaggccaggtgc

SEQ ID NO: 13220 - DNA, 60 bp, Artificial Sequence
  Description of Artificial Sequence: Synthetic probe
tcggccccgtccccggtccggtagcacacggctgacatgagccggtacatgatgccgttg

SEQ ID NO: 13221 - DNA, 60 bp, Artificial Sequence
  Description of Artificial Sequence: Synthetic probe
gcggtcccgcagccgtcggccccgtccccggtccggtagcacacggctgacatgagccgg

SEQ ID NO: 13222 - DNA, 56 bp, Artificial Sequence
  Description of Artificial Sequence: Synthetic probe
cgcataagccggctctcgcgggcgccgcggctaagcgcggacatggggtcgtagag

SEQ ID NO: 13223 - DNA, 60 bp, Artificial Sequence
  Description of Artificial Sequence: Synthetic probe
tgcgcatggcgcgcataagccggctctcgcgggcgccgcggctaagcgcggacatggggt

SEQ ID NO: 13224 - DNA, 60 bp, Artificial Sequence
  Description of Artificial Sequence: Synthetic probe
gtacgcggcgtaccacgacgcgtcgcgggagcccgccatttggttagcacaaaacgtcgc

SEQ ID NO: 13225 - DNA, 60 bp, Artificial Sequence
  Description of Artificial Sequence: Synthetic probe
agcaccgggtgcatcgccggggcgggtccagcgtgacggagtacgcggcgtaccacgacg

SEQ ID NO: 13226 - DNA, 60 bp, Artificial Sequence
  Description of Artificial Sequence: Synthetic probe
gtgcactcggacgcaatggatcggcgagcgcgacttctgcacggcccacgcgcaggacgt

SEQ ID NO: 13227 - DNA, 60 bp, Artificial Sequence
  Description of Artificial Sequence: Synthetic probe
caatatggaggaaaatgacggagaaaacctattggctcagcctgatgatgatacagacaa

SEQ ID NO: 13228 - DNA, 60 bp, Artificial Sequence
  Description of Artificial Sequence: Synthetic probe
ccgagatgatacagttttacttggaagaggtgatgccgcaggcggaaaatcacgggccgg

SEQ ID NO: 13229 - DNA, 60 bp, Artificial Sequence
  Description of Artificial Sequence: Synthetic probe
ggggtggcactttccgagatgatacagttttacttggaagaggtgatgccgcaggcggaa

SEQ ID NO: 13230 - DNA, 60 bp, Artificial Sequence
  Description of Artificial Sequence: Synthetic probe
tttgtacgatcataaaatcgatatttgatgcacatatattagtaagtgtattagactaaa

SEQ ID NO: 13231 - DNA, 60 bp, Artificial Sequence
  Description of Artificial Sequence: Synthetic probe
cctgatttttctggagaaagtgtaaattgtacaccccgtagtcgatcggccgctcgccac

SEQ ID NO: 13232 - DNA, 60 bp, Artificial Sequence
  Description of Artificial Sequence: Synthetic probe
gagaaagtgtaaattgtacaccccgtagtcgatcggccgctcgccaccctagccatggag

SEQ ID NO: 13233 - DNA, 60 bp, Artificial Sequence
  Description of Artificial Sequence: Synthetic probe
ggcaccaggagatcctctggctggtatagtggcgttttggctgaggcgaacaacctgaag

SEQ ID NO: 13234 - DNA, 60 bp, Artificial Sequence
  Description of Artificial Sequence: Synthetic probe
gtccgcctcagccaaaacgccactataccagccagaggatctcccggtgccgcaggatta

SEQ ID NO: 13235 - DNA, 60 bp, Artificial Sequence
  Description of Artificial Sequence: Synthetic probe
ttggggtctcctggcggtgatcgcgctgtgcgggagcgtgcactcgacgcaatggtatcg

SEQ ID NO: 13236 - DNA, 60 bp, Artificial Sequence
  Description of Artificial Sequence: Synthetic probe
cttggggtctcctggcggtgatcgcgctgtgcgggagcgtgcactcgacgcaatggtatc

SEQ ID NO: 13237 - DNA, 60 bp, Artificial Sequence
  Description of Artificial Sequence: Synthetic probe
acaaaccgccagctgtaccgcatgctggactcggacgacgtttgctgcgaggacggaaac

SEQ ID NO: 13238 - DNA, 60 bp, Artificial Sequence
  Description of Artificial Sequence: Synthetic probe
cgagacaaaccgccagctgtaccgcatgctggactcggacgacgtttgctgcgaggacgg

SEQ ID NO: 13239 - DNA, 60 bp, Artificial Sequence
  Description of Artificial Sequence: Synthetic probe
cggccaagcagatcgcgaaggagctcggcatatccaaacacgagacaaaccgccagctgt

SEQ ID NO: 13240 - DNA, 60 bp, Artificial Sequence
  Description of Artificial Sequence: Synthetic probe
ttccaggaccccgcgaacctcttctacaagggctacttccccatcccgccgctgatcatc

SEQ ID NO: 13241 - DNA, 52 bp, Artificial Sequence
  Description of Artificial Sequence: Synthetic probe
acccaagtcaacacctcccccagaaaccactgaggaatcacacagacgatag

SEQ ID NO: 13242 - DNA, 60 bp, Artificial Sequence
  Description of Artificial Sequence: Synthetic probe
gcctgcatccactttacacattggaggcagagtagtaacgcgaggctccattgcatgcac

SEQ ID NO: 13243 - DNA, 60 bp, Artificial Sequence
  Description of Artificial Sequence: Synthetic probe
gtatgcatgcaatggagcctcgcgttactactctgcctccagtgtgtgaagtggatgcaa

SEQ ID NO: 13244 - DNA, 60 bp, Artificial Sequence
  Description of Artificial Sequence: Synthetic probe
atgtggccgttctcctccatccccgtgggcgccgactgccgcgtcgtggagacgctgccc

SEQ ID NO: 13245 - DNA, 60 bp, Artificial Sequence
  Description of Artificial Sequence: Synthetic probe
gttctcctccatccccgtgggcgccgactgccgcgtcgtggagacgctgcccgcagaggt

SEQ ID NO: 13246 - DNA, 60 bp, Artificial Sequence
  Description of Artificial Sequence: Synthetic probe
cgggacgacgccgcgaacaacactaagctgctcatcgtggacgacaccttcgcgcacctc

SEQ ID NO: 13247 - DNA, 60 bp, Artificial Sequence
  Description of Artificial Sequence: Synthetic probe
tgaggtgcgcgaaggtgtcgtccacgatgagcagcttggtgttgttcgcagcgtcgtccc

SEQ ID NO: 13248 - DNA, 60 bp, Artificial Sequence
  Description of Artificial Sequence: Synthetic probe
tgaggtgcgcgaaggtgtcgtccacgatgagcagcttagtgttgttcgcggcgtcgtccc

SEQ ID NO: 13249 - DNA, 60 bp, Artificial Sequence
  Description of Artificial Sequence: Synthetic probe
ggaccgcagatccaaacgatgatgcgatcaggtcatgcggaagaaggcgccacggagcaa

SEQ ID NO: 13250 - DNA, 60 bp, Artificial Sequence
  Description of Artificial Sequence: Synthetic probe
gcagcaggccaagcgtgacggctactcccgctaatgcagtccacacacttcacacactac

SEQ ID NO: 13251 - DNA, 60 bp, Artificial Sequence
  Description of Artificial Sequence: Synthetic probe
atgaacaacaccgcggtctcgcgcttcttgaccaagtacccgccgcccatgtgcttcttc

SEQ ID NO: 13252 - DNA, 60 bp, Artificial Sequence
  Description of Artificial Sequence: Synthetic probe
tgcacgcactcaaccaccccaaggtgcggccctcgcccacgctggagttcgaggtcgtcc

SEQ ID NO: 13253 - DNA, 60 bp, Artificial Sequence
  Description of Artificial Sequence: Synthetic probe
tggagctgctcttcccgcacgagagcatgacctggttcctggagataagcgcgctctgga

SEQ ID NO: 13254 - DNA, 60 bp, Artificial Sequence
  Description of Artificial Sequence: Synthetic probe
tcacgttgctcatccaggcgctgcggtcgggctttatggcgatgggcactaccttggtgt

SEQ ID NO: 13255 - DNA, 60 bp, Artificial Sequence
  Description of Artificial Sequence: Synthetic probe
acgttgaagtacccgctgtagtcgtggtccggcacctcctcgatgtcgtagggcacgcgc

SEQ ID NO: 13256 - DNA, 60 bp, Artificial Sequence
  Description of Artificial Sequence: Synthetic probe
tttatcgcccgcccgctcactccggtaagggaacgcggttaacccactcacgagaacaag

SEQ ID NO: 13257 - DNA, 56 bp, Artificial Sequence
  Description of Artificial Sequence: Synthetic probe
acggagctggagtgcttcgggcactggggcaaggtgcgcctctacgagacgcacgt

SEQ ID NO: 13258 - DNA, 60 bp, Artificial Sequence
  Description of Artificial Sequence: Synthetic probe
aagttcgtcttcgagcaccgcaacggcatgtccgagatcgacgcctccacagagtacacg

SEQ ID NO: 13259 - DNA, 60 bp, Artificial Sequence
  Description of Artificial Sequence: Synthetic probe
tcaagttcgtcttcgagcaccgcaacggcatgtccgagatcgacgcctccaccgagtaca

SEQ ID NO: 13260 - DNA, 60 bp, Artificial Sequence
  Description of Artificial Sequence: Synthetic probe
acatcgacatcacagcgcgctggtttgcggtaccgggacgtgacgacgcctctaacaaca

SEQ ID NO: 13261 - DNA, 60 bp, Artificial Sequence
  Description of Artificial Sequence: Synthetic probe
agtggggcacatcgacatcacagcgcgctggtttgcggtaccgggacgtgacgacgcctc

SEQ ID NO: 13262 - DNA, 60 bp, Artificial Sequence
  Description of Artificial Sequence: Synthetic probe
tgtccgtggcagcggtgcgcgcactggatgatttcggagtggggcacatcgacatcacag

SEQ ID NO: 13263 - DNA, 60 bp, Artificial Sequence
  Description of Artificial Sequence: Synthetic probe
aacgcggatccgctgtccgtggcagcggtgcgcgcactggatgatttcggagtggggcac

SEQ ID NO: 13264 - DNA, 60 bp, Artificial Sequence
  Description of Artificial Sequence: Synthetic probe
tagaccgcagcgtacgcgtgcgtatcatcatcagccagtggcgcaacgcggatccgctgt

SEQ ID NO: 13265 - DNA, 60 bp, Artificial Sequence
  Description of Artificial Sequence: Synthetic probe
ccgcgatagaccgcagcgtacgcgtgcgtatcatcatcagccagtggcgcaacgcggatc

SEQ ID NO: 13266 - DNA, 60 bp, Artificial Sequence
  Description of Artificial Sequence: Synthetic probe
gctgtccatggtgccggtggtgcgctccggcagcgccgttcactactggccactgataat

SEQ ID NO: 13267 - DNA, 60 bp, Artificial Sequence
  Description of Artificial Sequence: Synthetic probe
atcactgctgtccatggtgccggtggtgcgctccggcagcgccgttcactactggccact

SEQ ID NO: 13268 - DNA, 60 bp, Artificial Sequence
  Description of Artificial Sequence: Synthetic probe
caccgcatcgattccgcggaaaacagcatcgatctatcactgctgtccatggtgccggtg

SEQ ID NO: 13269 - DNA, 60 bp, Artificial Sequence
  Description of Artificial Sequence: Synthetic probe
gaagacctggtgttgcaccgcatcgattccgcggaaaacagcatcgatctatcactgctg

SEQ ID NO: 13270 - DNA, 60 bp, Artificial Sequence
  Description of Artificial Sequence: Synthetic probe
tttctcggactccccagagcgcttcctgggattctaccgcacgctcgacgaagacctggt

SEQ ID NO: 13271 - DNA, 60 bp, Artificial Sequence
  Description of Artificial Sequence: Synthetic probe
ttttctcggactccccagagcgcttcctgggattctaccgcacgctcgacgaagacctgg

SEQ ID NO: 13272 - DNA, 60 bp, Artificial Sequence
  Description of Artificial Sequence: Synthetic probe
cactccgacggccacggacttccatatgaatcactcaggcggtggcgtttttttctcgga

SEQ ID NO: 13273 - DNA, 51 bp, Artificial Sequence
  Description of Artificial Sequence: Synthetic probe
cactccgacggccacggacttccatatgaatcactcaggcggtggcgtttt

SEQ ID NO: 13274 - DNA, 60 bp, Artificial Sequence
  Description of Artificial Sequence: Synthetic probe
aagcagccgttcgcacgactctgttgcgccatcatcactccgacggccacggacttccat

SEQ ID NO: 13275 - DNA, 60 bp, Artificial Sequence
  Description of Artificial Sequence: Synthetic probe
atggtcgtagaccccaagcagccgttcgcacgactctgttgcgccatcatcactccgacg

SEQ ID NO: 13276 - DNA, 60 bp, Artificial Sequence
  Description of Artificial Sequence: Synthetic probe
ggtcctcgtccagagtgcggtagaatcccaggaacttctcgggcgcgtccgagaagaaga

SEQ ID NO: 13277 - DNA, 60 bp, Artificial Sequence
  Description of Artificial Sequence: Synthetic probe
ccttcggctccacgatccatagagtagaaggtgttgtagcggttcatgaggtccgcggcc

SEQ ID NO: 13278 - DNA, 60 bp, Artificial Sequence
  Description of Artificial Sequence: Synthetic probe
tcttcgccgcgctgcggcgcttgtgggaccctggcgcgccagagcagctgctatttaacc

SEQ ID NO: 13279 - DNA, 60 bp, Artificial Sequence
  Description of Artificial Sequence: Synthetic probe
agccagcggctcttcgccgcgctgcggcgcttgtgggaccctggcgcgccagagcagctg

SEQ ID NO: 13280 - DNA, 60 bp, Artificial Sequence
  Description of Artificial Sequence: Synthetic probe
ttgctcacgctgcgcaataagcacctttcagaggcagagggcggcgatgagatccgcgta

SEQ ID NO: 13281 - DNA, 60 bp, Artificial Sequence
  Description of Artificial Sequence: Synthetic probe
agcggcactgtgggtttgctcacgctgcgcaataagcacctttcagaggcagagggcggc

SEQ ID NO: 13282 - DNA, 60 bp, Artificial Sequence
  Description of Artificial Sequence: Synthetic probe
tcggctccacgatcatggagtagaaggtgttgtagcggttcatgaggtcccaggccaggt

SEQ ID NO: 13283 - DNA, 54 bp, Artificial Sequence
  Description of Artificial Sequence: Synthetic probe
tatcgtgatggtgcaggtgaagagcggacagtgatccttgccgccagaacgcgt

SEQ ID NO: 13284 - DNA, 60 bp, Artificial Sequence
  Description of Artificial Sequence: Synthetic probe
agacgcgttctggcggcaaggatcactgtccgctcttcacctgcaccatcacgatatccg

SEQ ID NO: 13285 - DNA, 56 bp, Artificial Sequence
  Description of Artificial Sequence: Synthetic probe
acgatatccggaaaggtcgttgccgcggccgacggggccagcaagaaactggcgcg

SEQ ID NO: 13286 - DNA, 60 bp, Artificial Sequence
  Description of Artificial Sequence: Synthetic probe
ggcaaattgtttttgttaatcaggacaattggaacacaatcagattaatttttgtacgat

SEQ ID NO: 13287 - DNA, 60 bp, Artificial Sequence
  Description of Artificial Sequence: Synthetic probe
catcgcacacaaatgaaggacacaattggtttgttaatccggacaatgaaggcaaattgt

SEQ ID NO: 13288 - DNA, 55 bp, Artificial Sequence
  Description of Artificial Sequence: Synthetic probe
gatgcgcggtcgcaattggcctgcgaccgacatcgcacacaaatgaaggacacaa

SEQ ID NO: 13289 - DNA, 60 bp, Artificial Sequence
  Description of Artificial Sequence: Synthetic probe
cgcaggattagacttatgtagcgcgtacgactgtgtcatcccttcgcattgcagttgcgt

SEQ ID NO: 13290 - DNA, 60 bp, Artificial Sequence
  Description of Artificial Sequence: Synthetic probe
cgctcgccaccctagccatggagttctgctgcacggaaacccttcaggttgtccgcctca

SEQ ID NO: 13291 - DNA, 60 bp, Artificial Sequence
  Description of Artificial Sequence: Synthetic probe
ggagatcgtgacttccatcctgtgcttcctgtcgtacgattcgctgctggacctgcgccg

SEQ ID NO: 13292 - DNA, 60 bp, Artificial Sequence
  Description of Artificial Sequence: Synthetic probe
cgccggagatcgtgacttccatcctgtgcttcctgtcgtacgattcgctgctggacctgc

SEQ ID NO: 13293 - DNA, 52 bp, Artificial Sequence
  Description of Artificial Sequence: Synthetic probe
tacgggacggcgttcttcagcaagatctgcatgatgcggctgcgcgtctcgc

SEQ ID NO: 13294 - DNA, 50 bp, Artificial Sequence
  Description of Artificial Sequence: Synthetic probe
atggcctgcgagtgcgcgtctctgatcctcgagcttctcagaaaatccga

SEQ ID NO: 13295 - DNA, 60 bp, Artificial Sequence
  Description of Artificial Sequence: Synthetic probe
atggatgtcgtgcaggaggtgcgcttcaagcgggagagcctcatcgaggcgcccttcagg

SEQ ID NO: 13296 - DNA, 60 bp, Artificial Sequence
  Description of Artificial Sequence: Synthetic probe
atgtcgtgcaggaggtgcgcttcaagcgggagagcctcatcgaggcgcccttcaggatgg

SEQ ID NO: 13297 - DNA, 57 bp, Artificial Sequence
  Description of Artificial Sequence: Synthetic probe
agaggttgtactcgagctcctcgtgcgtggtgaccttgtggatgtggtccggccaca

SEQ ID NO: 13298 - DNA, 57 bp, Artificial Sequence
  Description of Artificial Sequence: Synthetic probe
tgtggccggaccacatccacaaggtcaccacgcacgaggagctcgagtacaacctct

SEQ ID NO: 13299 - DNA, 60 bp, Artificial Sequence
  Description of Artificial Sequence: Synthetic probe
tcgagcggcacgcgcagacgaagaagcagaagttcctcatcattctcgacgatatgggcg

SEQ ID NO: 13300 - DNA, 60 bp, Artificial Sequence
  Description of Artificial Sequence: Synthetic probe
cgcccatatcgtcgagaatgatgaggaacttctgcttcttcgtctgcgcgtgccgctcga

SEQ ID NO: 13301 - DNA, 60 bp, Artificial Sequence
  Description of Artificial Sequence: Synthetic probe
ggcacgcgcagacgaagaagcagaagttcctcatcattctcgacgatatgggcgacacgc

SEQ ID NO: 13302 - DNA, 60 bp, Artificial Sequence
  Description of Artificial Sequence: Synthetic probe
acacgcagacgcggtcgcccacactcttgggcctcatgaactacgggcggcacatcaacg

SEQ ID NO: 13303 - DNA, 60 bp, Artificial Sequence
  Description of Artificial Sequence: Synthetic probe
ttcgatccgcgtatggacatggaccggagcacgttctccacgtcggagtcggagacgttg

SEQ ID NO: 13304 - DNA, 60 bp, Artificial Sequence
  Description of Artificial Sequence: Synthetic probe
aacgtctccgactccgacgtggagaacgtgctccggtccatgtccatacgcggatcgaag

SEQ ID NO: 13305 - DNA, 60 bp, Artificial Sequence
  Description of Artificial Sequence: Synthetic probe
ccggatgagcctcttcttcgatccgcgtatggacatggaccggagcacgttctccacgtc

SEQ ID NO: 13306 - DNA, 60 bp, Artificial Sequence
  Description of Artificial Sequence: Synthetic probe
gtccatgtccatacgcggatcgaagaagaggctcatccgggccatggccatcatgcggtc

SEQ ID NO: 13307 - DNA, 60 bp, Artificial Sequence
  Description of Artificial Sequence: Synthetic probe
tccatgtccatacgcggatcgaagaagaggctcatccgggccatggccatcatgcggtcg

SEQ ID NO: 13308 - DNA, 60 bp, Artificial Sequence
  Description of Artificial Sequence: Synthetic probe
aacaccgagtcttcgatgatcaacaccctcctggtcccggccgaccgcatgatggccatg

SEQ ID NO: 13309 - DNA, 60 bp, Artificial Sequence
  Description of Artificial Sequence: Synthetic probe
aaccaggagcgcatctgctacgacttcgccgacgagagcgtcgtcaagcgctgtctcgac

SEQ ID NO: 13310 - DNA, 60 bp, Artificial Sequence
  Description of Artificial Sequence: Synthetic probe
tcatgtgcgagaactgcgcgagcaggatgccggggtcgagacagcgcttgacgacgctct

SEQ ID NO: 13311 - DNA, 60 bp, Artificial Sequence
  Description of Artificial Sequence: Synthetic probe
cgtcaagcgctgtctcgaccccggcatcctgctcgcgcagttctcgcacatgaagacgcg

SEQ ID NO: 13312 - DNA, 60 bp, Artificial Sequence
  Description of Artificial Sequence: Synthetic probe
gccgcgtcttcatgtgcgagaactgcgcgagcaggatgccggggtcgagacagcgcttga

SEQ ID NO: 13313 - DNA, 60 bp, Artificial Sequence
  Description of Artificial Sequence: Synthetic probe
acttggagagtctacgtaaagctcttcttgatctcaacagaaaaatagatgtacagacag

SEQ ID NO: 13314 - DNA, 60 bp, Artificial Sequence
  Description of Artificial Sequence: Synthetic probe
cctagccatggagttctgctgcacggaaacccttcaggttgtccgcctcagccaaaacgc

SEQ ID NO: 13315 - DNA, 60 bp, Artificial Sequence
  Description of Artificial Sequence: Synthetic probe
gataaagctcccacctggttgctacggacgcatagcaccacgttccggccttgcggtcaa

SEQ ID NO: 13316 - DNA, 60 bp, Artificial Sequence
  Description of Artificial Sequence: Synthetic probe
ctcccacctggttgctacggacgcatagcaccacgttccggccttgcggtcaaacacttt

SEQ ID NO: 13317 - DNA, 60 bp, Artificial Sequence
  Description of Artificial Sequence: Synthetic probe
gcccacgtcgataaagtgtttgaccgcaaggccggaacgtggtgctatgcgtccgtagca

SEQ ID NO: 13318 - DNA, 60 bp, Artificial Sequence
  Description of Artificial Sequence: Synthetic probe
ttgcggtcaaacactttatcgacgtgggcgctggcgttatcgacgaagactaccgaggca

SEQ ID NO: 13319 - DNA, 60 bp, Artificial Sequence
  Description of Artificial Sequence: Synthetic probe
ttatcgacgtgggcgctggcgttatcgacgaagactaccgaggcaatgtcggagtggtgc

SEQ ID NO: 13320 - DNA, 60 bp, Artificial Sequence
  Description of Artificial Sequence: Synthetic probe
taaacagcaccaccccgacattgcctcggtagtcttcgtcgataacgccagcgcccacgt

SEQ ID NO: 13321 - DNA, 60 bp, Artificial Sequence
  Description of Artificial Sequence: Synthetic probe
accgcaccaaccctgaaaactcgcacatccccgccgccctcgtctccgcgcttctcgaaa

SEQ ID NO: 13322 - DNA, 60 bp, Artificial Sequence
  Description of Artificial Sequence: Synthetic probe
aaatctcgcactccccgcaccccgcaccaacacaccccgcggaaccggtgtcctgaacgt

SEQ ID NO: 13323 - DNA, 60 bp, Artificial Sequence
  Description of Artificial Sequence: Synthetic probe
atgctcagcaacttcctcccgcacatgcaggaaagcgccaaccagctcaagggcctgtac

SEQ ID NO: 13324 - DNA, 60 bp, Artificial Sequence
  Description of Artificial Sequence: Synthetic probe
aaagatgcccctcacgttgatgcggtccagaatgcccatgtcctgcgagcacagcaccac

SEQ ID NO: 13325 - DNA, 60 bp, Artificial Sequence
  Description of Artificial Sequence: Synthetic probe
aggccacgaagcggtccacaaactcgctctctacggggtccttgagcacgcggaagggca

SEQ ID NO: 13326 - DNA, 60 bp, Artificial Sequence
  Description of Artificial Sequence: Synthetic probe
cgaccaggagcagttgcctgtgcccgaaaccgtgcccgaactgccagccaagactcctaa

SEQ ID NO: 13327 - DNA, 60 bp, Artificial Sequence
  Description of Artificial Sequence: Synthetic probe
tgccgggcagcagccgcgccttggcctctatgtcgacggtgctcgagagacagccgcagg

SEQ ID NO: 13328 - DNA, 60 bp, Artificial Sequence
  Description of Artificial Sequence: Synthetic probe
cgctgtgtgtaccgcaggcccacggccatgcacccgtccgactccaccagcacgagcttg

SEQ ID NO: 13329 - DNA, 60 bp, Artificial Sequence
  Description of Artificial Sequence: Synthetic probe
tttccgcgaagaataccatcagctccagccccacgccgcacagacccaggacgccgaaca

SEQ ID NO: 13330 - DNA, 60 bp, Artificial Sequence
  Description of Artificial Sequence: Synthetic probe
attaataccgccgtttacgctgcctttcactctaccaccgccgtcgctgtgtcctgcccc

SEQ ID NO: 13331 - DNA, 50 bp, Artificial Sequence
  Description of Artificial Sequence: Synthetic probe
aggacttgcgtacatacggagtaaactacaccttcttgtacaacttctgg

SEQ ID NO: 13332 - DNA, 60 bp, Artificial Sequence
  Description of Artificial Sequence: Synthetic probe
gcgtgtacatgttcatgcggcgcttcggtatccgagtaaaggacttgcgtacatacggag

SEQ ID NO: 13333 - DNA, 60 bp, Artificial Sequence
  Description of Artificial Sequence: Synthetic probe
cagcgagcgccgcgtgtacatgttcatgcggcgcttcggtatccgagtaaaggacttgcg

SEQ ID NO: 13334 - DNA, 60 bp, Artificial Sequence
  Description of Artificial Sequence: Synthetic probe
cctggtgcacccgagaggctgcttttcgacaggctcagcgagcgccgcgtgtacatgttc

SEQ ID NO: 13335 - DNA, 60 bp, Artificial Sequence
  Description of Artificial Sequence: Synthetic probe
aggcgcctatgggaccctggtgcacccgagaggctgcttttcgacaggctcagcgagcgc

SEQ ID NO: 13336 - DNA, 60 bp, Artificial Sequence
  Description of Artificial Sequence: Synthetic probe
tagctcacgaattcgccgtccgcaacgggcagcgtctgttctccgcactgaggcgcctat

SEQ ID NO: 13337 - DNA, 60 bp, Artificial Sequence
  Description of Artificial Sequence: Synthetic probe
gaggagatacgcgtgaggttcgtaggtaaggacagggtagctcacgaattcgccgtccgc

SEQ ID NO: 13338 - DNA, 60 bp, Artificial Sequence
  Description of Artificial Sequence: Synthetic probe
atcggaggggggagaggagatacgcgtgaggttcgtaggtaaggacagggtagctcacga

SEQ ID NO: 13339 - DNA, 60 bp, Artificial Sequence
  Description of Artificial Sequence: Synthetic probe
gagagcgggaccgtgggcctgctaacgttgcgcaacaaacacctctcggaatcggagggg

SEQ ID NO: 13340 - DNA, 60 bp, Artificial Sequence
  Description of Artificial Sequence: Synthetic probe
atggagacgagcttcttcatccgcataggcaagacgcggtacgagaaggagagcgggacc

SEQ ID NO: 13341 - DNA, 60 bp, Artificial Sequence
  Description of Artificial Sequence: Synthetic probe
tcatggagacgagcttcttcatccgcataggcaagacgcggtacgagaaggagagcggga

SEQ ID NO: 13342 - DNA, 60 bp, Artificial Sequence
  Description of Artificial Sequence: Synthetic probe
tgcacggcccacgcgcaggacgtcttcgcgcggctgcagagtgtggatgcgcatcgaccg

SEQ ID NO: 13343 - DNA, 54 bp, Artificial Sequence
  Description of Artificial Sequence: Synthetic probe
gaccacgccaccgacaaccacaaggctgcccagaagacgccgctagaattccgc

SEQ ID NO: 13344 - DNA, 57 bp, Artificial Sequence
  Description of Artificial Sequence: Synthetic probe
gtacacgacgagtacccgacgctgacttctcagcggtttaacccgccgtgtgtcacg

SEQ ID NO: 13345 - DNA, 59 bp, Artificial Sequence
  Description of Artificial Sequence: Synthetic probe
gtacacgacgagtacccgacgctgacttctcagcggtttaacccgccgtgtgtcacgtt

SEQ ID NO: 13346 - DNA, 50 bp, Artificial Sequence
  Description of Artificial Sequence: Synthetic probe
cgtgtcgtgttcttgctgcgctgtgcgggagcgtgcactcggcgcaatgg

SEQ ID NO: 13347 - DNA, 59 bp, Artificial Sequence
  Description of Artificial Sequence: Synthetic probe
aactcgctgggcagaaaaactcaaaacgctgcgtcttcggactgcgtcgctgccaccgc

SEQ ID NO: 13348 - DNA, 60 bp, Artificial Sequence
  Description of Artificial Sequence: Synthetic probe
gccacaggcggaaaatcacgggccggcacatcaaagagcacgttaactcgctgggcagaa

SEQ ID NO: 13349 - DNA, 60 bp, Artificial Sequence
  Description of Artificial Sequence: Synthetic probe
ggtgatgccacaggcggaaaatcacgggccggcacatcaaagagcacgttaactcgctgg

SEQ ID NO: 13350 - DNA, 60 bp, Artificial Sequence
  Description of Artificial Sequence: Synthetic probe
ggcaaagaggccatgagacgagttccacataaacttggaagaggtgatgccacaggcgga

SEQ ID NO: 13351 - DNA, 60 bp, Artificial Sequence
  Description of Artificial Sequence: Synthetic probe
ctccgcttggcaaagaggccatgagacgagttccacataaacttggaagaggtgatgcca

SEQ ID NO: 13352 - DNA, 58 bp, Artificial Sequence
  Description of Artificial Sequence: Synthetic probe
cgcgctggttcgcgataccaggccgcgacgacgcgtccaacaacactaagctgctcat

SEQ ID NO: 13353 - DNA, 60 bp, Artificial Sequence
  Description of Artificial Sequence: Synthetic probe
gcatatcgacatcaccgcgcgctggttcgcgataccaggccgcgacgacgcgtccaacaa

SEQ ID NO: 13354 - DNA, 60 bp, Artificial Sequence
  Description of Artificial Sequence: Synthetic probe
gcatattgacatcactgcgcgctggttcgcgataccaggccgcgacgacgcgtccaacaa

SEQ ID NO: 13355 - DNA, 60 bp, Artificial Sequence
  Description of Artificial Sequence: Synthetic probe
tactactggccgctgatcatggacgcgttgctgcgagccgctgtcgaccgcagcgtgcgt

SEQ ID NO: 13356 - DNA, 60 bp, Artificial Sequence
  Description of Artificial Sequence: Synthetic probe
ctgggcgtgtactccaccaacaagcacttggccgtcgaccttatgaaccggtacaacacc

SEQ ID NO: 13357 - DNA, 60 bp, Artificial Sequence
  Description of Artificial Sequence: Synthetic probe
ctgggcgtgtactccaccaacaagcacttggccgtcgacctcatgaaccggtacaacacc

SEQ ID NO: 13358 - DNA, 60 bp, Artificial Sequence
  Description of Artificial Sequence: Synthetic probe
aggtgatgccacaggcggaaaatcacgggccggtatttcaaagagcacgttaactcgctg

SEQ ID NO: 13359 - DNA, 60 bp, Artificial Sequence
  Description of Artificial Sequence: Synthetic probe
aggtgatgccacaggcggaaaatcacgggccggtacatcaaagagcacgttaactcgctg

SEQ ID NO: 13360 - DNA, 60 bp, Artificial Sequence
  Description of Artificial Sequence: Synthetic probe
gtgtgcgctggcgatagagacgccgccgagaaacttcgacgcggacgtctacgtcgctgc

SEQ ID NO: 13361 - DNA, 56 bp, Artificial Sequence
  Description of Artificial Sequence: Synthetic probe
gtgtgcgctggcgatagagacgccgccgagaaacttcgacgcggacgtctacgtcg

SEQ ID NO: 13362 - DNA, 57 bp, Artificial Sequence
  Description of Artificial Sequence: Synthetic probe
gacgatcttcgcgcggctgcagtgtgtggatgcgcatcgaccggggcgtgtaccacc

SEQ ID NO: 13363 - DNA, 60 bp, Artificial Sequence
  Description of Artificial Sequence: Synthetic probe
tcagggaaacagaagtcaagtagtcgggtagacaggagtcaggtggtcgggtgaccgcgc

SEQ ID NO: 13364 - DNA, 60 bp, Artificial Sequence
  Description of Artificial Sequence: Synthetic probe
cgcggtcacccgaccacctgactcctgtctacccgactacttgacttctgtttccctgac

SEQ ID NO: 13365 - DNA, 60 bp, Artificial Sequence
  Description of Artificial Sequence: Synthetic probe
ctgtccacacaggacctgcgggcctccggactggccgagtagctttttctgagataagtg

SEQ ID NO: 13366 - DNA, 60 bp, Artificial Sequence
  Description of Artificial Sequence: Synthetic probe
tgcgcggctgcgtgctcccgcgcgaggtgctggagcgcgtgctgcggtgtctgtccacac

SEQ ID NO: 13367 - DNA, 60 bp, Artificial Sequence
  Description of Artificial Sequence: Synthetic probe
atcgcggacaataactccgcgctggtgaccgcggcgctggacacacagcccgagccgcgg

SEQ ID NO: 13368 - DNA, 60 bp, Artificial Sequence
  Description of Artificial Sequence: Synthetic probe
aggtgatgccgcaggcggaaaatcacgggccggacatcaaagagcacgttaactcgctgg

SEQ ID NO: 13369 - DNA, 60 bp, Artificial Sequence
  Description of Artificial Sequence: Synthetic probe
agttttacttggaagaggtgatgccgcaggcggaaaatcacgggccggacatcaaagagc

SEQ ID NO: 13370 - DNA, 60 bp, Artificial Sequence
  Description of Artificial Sequence: Synthetic probe
tggaagttagtggccgtgggcgtgacgacgcgcagcagaagctgcgtgaacggcaccttc

SEQ ID NO: 13371 - DNA, 60 bp, Artificial Sequence
  Description of Artificial Sequence: Synthetic probe
gcgctgtgcgggagcgtgcactcggacgcaatggatcggcgagcgcgacttctgcacggc

SEQ ID NO: 13372 - DNA, 60 bp, Artificial Sequence
  Description of Artificial Sequence: Synthetic probe
cgacatattcatcaactacatagaatcatacatgactactaaaatgtaaaaatgtatata

SEQ ID NO: 13373 - DNA, 56 bp, Artificial Sequence
  Description of Artificial Sequence: Synthetic probe
gtgtgttgcgattattcttacttatacattatacacagatgcgtattgtgttgagt

SEQ ID NO: 13374 - DNA, 60 bp, Artificial Sequence
  Description of Artificial Sequence: Synthetic probe
aggtgatgccacaggcggaaaatcacgggccggacatcaaagagcacgttaactcgctgg

SEQ ID NO: 13375 - DNA, 60 bp, Artificial Sequence
  Description of Artificial Sequence: Synthetic probe
agttttacttggaagaggtgatgccacaggcggaaaatcacgggccggacatcaaagagc

SEQ ID NO: 13376 - DNA, 60 bp, Artificial Sequence
  Description of Artificial Sequence: Synthetic probe
gtgtgcgcatcatcatcagccagtggcgtaacgcggatccgctgtccgtggctgcagttc

SEQ ID NO: 13377 - DNA, 60 bp, Artificial Sequence
  Description of Artificial Sequence: Synthetic probe
gcgtgcgcatcatcatcagccagtggcgtaacgcggatccgctgtctgtagccgcagttc

SEQ ID NO: 13378 - DNA, 60 bp, Artificial Sequence
  Description of Artificial Sequence: Synthetic probe
tcgaccgcagcgtgcgtgtgcgcatcatcatcagccagtggcgtaacgcggatccgctgt

SEQ ID NO: 13379 - DNA, 60 bp, Artificial Sequence
  Description of Artificial Sequence: Synthetic probe
ttaaccgcagcgtgcgcgtgcgcatcatcatcagccagtggcgtaacgcggatccgctgt

SEQ ID NO: 13380 - DNA, 60 bp, Artificial Sequence
  Description of Artificial Sequence: Synthetic probe
agtgcactactggccgctgatcatggacgcgttgctgcgcgccgctattaaccgcagcgt

SEQ ID NO: 13381 - DNA, 60 bp, Artificial Sequence
  Description of Artificial Sequence: Synthetic probe
cctgggcgtgtactccaccaacaagcacttggccgtcgaccttatgaaccggtacaacac

SEQ ID NO: 13382 - DNA, 60 bp, Artificial Sequence
  Description of Artificial Sequence: Synthetic probe
cctgggcgtgtactccaccaacaagcacttggccgtcgacctcatgaaccggtacaacac

SEQ ID NO: 13383 - DNA, 60 bp, Artificial Sequence
  Description of Artificial Sequence: Synthetic probe
cctgggcgtgtactccaccaacaagcacttggctgttgaccttatgaaccggtacaacac

SEQ ID NO: 13384 - DNA, 60 bp, Artificial Sequence
  Description of Artificial Sequence: Synthetic probe
tacgtgggaagcgcctcgcttactggcggctcgctagctaccattaaaaacctgggcgtg

SEQ ID NO: 13385 - DNA, 60 bp, Artificial Sequence
  Description of Artificial Sequence: Synthetic probe
tgctcgcgctgtgcgggagcgtgcactcggcgcaatggatcggcgagcgcgacttctgca

SEQ ID NO: 13386 - DNA, 54 bp, Artificial Sequence
  Description of Artificial Sequence: Synthetic probe
atggatccacccgaaatcacgggctacataatcggggttgccgaaggccgcggg

SEQ ID NO: 13387 - DNA, 60 bp, Artificial Sequence
  Description of Artificial Sequence: Synthetic probe
gtcgatgaggtcttcgacttctagacggggtccgtagatcagcatatttggtgatggagg

SEQ ID NO: 13388 - DNA, 60 bp, Artificial Sequence
  Description of Artificial Sequence: Synthetic probe
tcgcaccttaaactacctccatcaccaaatatgctgatctacggaccccgtctagaagtc

SEQ ID NO: 13389 - DNA, 58 bp, Artificial Sequence
  Description of Artificial Sequence: Synthetic probe
gtggtgcgtcttaagacgttgaatccagtgagtgcggttaacgagttctgcatgatca

SEQ ID NO: 13390 - DNA, 59 bp, Artificial Sequence
  Description of Artificial Sequence: Synthetic probe
cgtgatgcgtcttaagacgttgaatccagtgagtgcggttaacgagttctgcatgatca

SEQ ID NO: 13391 - DNA, 60 bp, Artificial Sequence
  Description of Artificial Sequence: Synthetic probe
gacaccgagcccatggagaccgaggcgggatgcgataccatcttcggcggcgatattgac

SEQ ID NO: 13392 - DNA, 60 bp, Artificial Sequence
  Description of Artificial Sequence: Synthetic probe
cccgccaaggacatcgctaaagaactcggtatctccaagcacgaggcgaaccgctacctg

SEQ ID NO: 13393 - DNA, 60 bp, Artificial Sequence
  Description of Artificial Sequence: Synthetic probe
cccgccaagaacatcgctaaagaactcggtatctccaagcacgaggcgaaccgctacctg

SEQ ID NO: 13394 - DNA, 60 bp, Artificial Sequence
  Description of Artificial Sequence: Synthetic probe
cgacaaactccccgccaagaacatcgctaaagaactcggtatctccaagcacgaggcgaa

SEQ ID NO: 13395 - DNA, 60 bp, Artificial Sequence
  Description of Artificial Sequence: Synthetic probe
cgtcaaactccccgccaaggacatcgctaaagaactcggtatctccaagcacgaggcgaa

SEQ ID NO: 13396 - DNA, 60 bp, Artificial Sequence
  Description of Artificial Sequence: Synthetic probe
gatgccacaggcggaaaatcacgggccggtacatcaaagagcacgttaactcgctgggag

SEQ ID NO: 13397 - DNA, 54 bp, Artificial Sequence
  Description of Artificial Sequence: Synthetic probe
cggcaacacagcggttatctaatatctgctgtatcctgtctgtacatctatttt

SEQ ID NO: 13398 - DNA, 60 bp, Artificial Sequence
  Description of Artificial Sequence: Synthetic probe
gttatagttagtgtacttacaattggaatgtcgaagaacaaaattctggtgtgtgttgcg

SEQ ID NO: 13399 - DNA, 60 bp, Artificial Sequence
  Description of Artificial Sequence: Synthetic probe
ttcgggtgtcaggcactttctgagaatgatacagttttacttggaagaggtgtatgccac

SEQ ID NO: 13400 - DNA, 60 bp, Artificial Sequence
  Description of Artificial Sequence: Synthetic probe
gagttctaaggctacttcgggtgtcaggcactttctgagaatgatacagttttacttgga

SEQ ID NO: 13401 - DNA, 60 bp, Artificial Sequence
  Description of Artificial Sequence: Synthetic probe
ctagttgtgattctgtcgctatctctagacgaatgtctgcacagagaacaccctcatgac

SEQ ID NO: 13402 - DNA, 60 bp, Artificial Sequence
  Description of Artificial Sequence: Synthetic probe
ctagttgtaattctgtcgctatctctagacgaatgtctgcacagagaacaccctcatgac

SEQ ID NO: 13403 - DNA, 60 bp, Artificial Sequence
  Description of Artificial Sequence: Synthetic probe
ctagttgtgatcctgtcgctatctctagacgaatgtctgcacagagaacaccctcatgac

SEQ ID NO: 13404 - DNA, 60 bp, Artificial Sequence
  Description of Artificial Sequence: Synthetic probe
tgtcttggctattctagttgtaattctgtcgctatctctagacgaatgtctgcacagaga

SEQ ID NO: 13405 - DNA, 60 bp, Artificial Sequence
  Description of Artificial Sequence: Synthetic probe
cggcgatacattaagatgttcttccggttcgttacggcgatagctatcattgtcctggct

SEQ ID NO: 13406 - DNA, 60 bp, Artificial Sequence
  Description of Artificial Sequence: Synthetic probe
cggcgatacattaagatgttcttccggttcgttacggcgatagctatcattgtcttggct

SEQ ID NO: 13407 - DNA, 60 bp, Artificial Sequence
  Description of Artificial Sequence: Synthetic probe
gcaagatggcacataacacgttcgaaaacgatagcgagtcggctaacaaccagtacgtgg

SEQ ID NO: 13408 - DNA, 60 bp, Artificial Sequence
  Description of Artificial Sequence: Synthetic probe
catgaggtccgcggccaggtgcttgttggtggagtagagaccgaggttcttgatgttggg

SEQ ID NO: 13409 - DNA, 60 bp, Artificial Sequence
  Description of Artificial Sequence: Synthetic probe
gctccacggtcatagagtagaaagtgttgttagcggttcatgaggtccgcggccaggtgc

SEQ ID NO: 13410 - DNA, 60 bp, Artificial Sequence
  Description of Artificial Sequence: Synthetic probe
aaagcaccttcggctccacggtcatagagtagaaagtgttgttagcggttcatgaggtcc

SEQ ID NO: 13411 - DNA, 60 bp, Artificial Sequence
  Description of Artificial Sequence: Synthetic probe
cgtgggcgtgacgatggcgcaacagagccgcgtgaaaagcaccttcggctccacggtcat

SEQ ID NO: 13412 - DNA, 60 bp, Artificial Sequence
  Description of Artificial Sequence: Synthetic probe
gtggaagtccgtggccgtgggcgtgacgatggcgcaacagagccgcgtgaaaagcacctt

SEQ ID NO: 13413 - DNA, 60 bp, Artificial Sequence
  Description of Artificial Sequence: Synthetic probe
ggcgtcgtgcggcccggtatcacgaacttgcgcacggacatgtccacgctgcccacgccg

SEQ ID NO: 13414 - DNA, 60 bp, Artificial Sequence
  Description of Artificial Sequence: Synthetic probe
acctttccggatatcgtgatggtgcaggtgaagcgcggacagtgatcctctccgccagca

SEQ ID NO: 13415 - DNA, 60 bp, Artificial Sequence
  Description of Artificial Sequence: Synthetic probe
ctggcggcaaggatcactgtccgctcttcacctgcaccatcacgatatccggaaaggtcg

SEQ ID NO: 13416 - DNA, 60 bp, Artificial Sequence
  Description of Artificial Sequence: Synthetic probe
tggcggagaggatcactgtccgcgcttcacctgcaccatcacgatatccggaaaggtcgt

SEQ ID NO: 13417 - DNA, 60 bp, Artificial Sequence
  Description of Artificial Sequence: Synthetic probe
tcgcaccttaaactacctccatcaccaaatatgctgatctacggacctcgtctagaagtc

SEQ ID NO: 13418 - DNA, 60 bp, Artificial Sequence
  Description of Artificial Sequence: Synthetic probe
gtataacactaactctcgcaccttaaactacctccatccaccaatatgctgatctacgga

SEQ ID NO: 13419 - DNA, 60 bp, Artificial Sequence
  Description of Artificial Sequence: Synthetic probe
gtataacactaactctcgcaccttaaactacctccatcaccaaatatgctgatctacgga

SEQ ID NO: 13420 - DNA, 60 bp, Artificial Sequence
  Description of Artificial Sequence: Synthetic probe
gcggtcacccgaccacctgactcctgtctcacccgtactacttggacttctgtttccctg

SEQ ID NO: 13421 - DNA, 58 bp, Artificial Sequence
  Description of Artificial Sequence: Synthetic probe
cagagtgtggatgcgcatcgaccgggaacgtgaccgccgcggacaacagactcggcct

SEQ ID NO: 13422 - DNA, 60 bp, Artificial Sequence
  Description of Artificial Sequence: Synthetic probe
gcgagcgcgacttctgcacggcccacgcgcaggacgtcttcgcgcggctgcagagtgtgg

SEQ ID NO: 13423 - DNA, 60 bp, Artificial Sequence
  Description of Artificial Sequence: Synthetic probe
tgagtactcggctgtgcgggagcgtgcactcggcgcaatggatcggcgagcgcgacttct

SEQ ID NO: 13424 - DNA, 60 bp, Artificial Sequence
  Description of Artificial Sequence: Synthetic probe
tctcttgagtactcggctgtgcgggagcgtgcactcggcgcaatggatcggcgagcgcga

SEQ ID NO: 13425 - DNA, 60 bp, Artificial Sequence
  Description of Artificial Sequence: Synthetic probe
cacaaatgccgcttagtttccagccttaaaaggcaggtgggaccttgctcgctgcccggc

SEQ ID NO: 13426 - DNA, 60 bp, Artificial Sequence
  Description of Artificial Sequence: Synthetic probe
cacaaatgccgcttagtttccagccttaaaaggcaagtgggaccctgctcgctgcccggc

SEQ ID NO: 13427 - DNA, 60 bp, Artificial Sequence
  Description of Artificial Sequence: Synthetic probe
ctcataaatctgcgccacaaatgccgcttagtttccagccttaaaaggcaggtgggacct

SEQ ID NO: 13428 - DNA, 60 bp, Artificial Sequence
  Description of Artificial Sequence: Synthetic probe
agcaaggaggtctttggcactgttatctcctcgcgtgcgctgcgcgtcgtgcgggaggtc

SEQ ID NO: 13429 - DNA, 60 bp, Artificial Sequence
  Description of Artificial Sequence: Synthetic probe
tcagcaaggaggtctttggcactgttatctcctcgcgtgcgctgcgcgtcgtgcgggagg

SEQ ID NO: 13430 - DNA, 60 bp, Artificial Sequence
  Description of Artificial Sequence: Synthetic probe
gctcgacgaagacctggtgctgcaccgcatcgacgctgcagaaaacagcattgacctctc

SEQ ID NO: 13431 - DNA, 60 bp, Artificial Sequence
  Description of Artificial Sequence: Synthetic probe
tagctccatggttgtggaccccaagcagccgtttacgcgcttctgctgcgccatgataac

SEQ ID NO: 13432 - DNA, 60 bp, Artificial Sequence
  Description of Artificial Sequence: Synthetic probe
tagctccatggttgtggaccccaagcagccgttcacgcgcatctgctgcgccatgattac

SEQ ID NO: 13433 - DNA, 60 bp, Artificial Sequence
  Description of Artificial Sequence: Synthetic probe
gctccacgatccatggagtagaaagtgttgtagcggttcatgaggtcccaggccaggtgc

SEQ ID NO: 13434 - DNA, 60 bp, Artificial Sequence
  Description of Artificial Sequence: Synthetic probe
atctctagagttctgtgagacgcgttctggcggcgaggatcactgtccgcgcttcacctg

SEQ ID NO: 13435 - DNA, 60 bp, Artificial Sequence
  Description of Artificial Sequence: Synthetic probe
cacagatctctagagttctgtgagacgcgttctggcggcgaggatcactgtccgcgcttc

SEQ ID NO: 13436 - DNA, 60 bp, Artificial Sequence
  Description of Artificial Sequence: Synthetic probe
tgctggaatcgggcgacatttgctgcgaggacggaaacccgccccgctggttcgtagagt

SEQ ID NO: 13437 - DNA, 60 bp, Artificial Sequence
  Description of Artificial Sequence: Synthetic probe
atgctggaatcgggcgacatttgctgcgaggacggaaacccgccccgctggttcgtagag

SEQ ID NO: 13438 - DNA, 60 bp, Artificial Sequence
  Description of Artificial Sequence: Synthetic probe
gcagtagtactggtgcgcctgcgagtttaccgcacatgctcagagaactcagggccgcgt

SEQ ID NO: 13439 - DNA, 60 bp, Artificial Sequence
  Description of Artificial Sequence: Synthetic probe
gacgctgcccgcagaggtggcgtccctggcgcagggcaacatgagcaccctcgactgctt

SEQ ID NO: 13440 - DNA, 60 bp, Artificial Sequence
  Description of Artificial Sequence: Synthetic probe
tgcccgccgaggtggcgtccctggcgcagggcaacatgagcaccctcgactgcttcaccg

SEQ ID NO: 13441 - DNA, 59 bp, Artificial Sequence
  Description of Artificial Sequence: Synthetic probe
ccgcgaacaacactaagctgctcatcgtggacgacaccttcgcgcacctcacggtcgcc

SEQ ID NO: 13442 - DNA, 60 bp, Artificial Sequence
  Description of Artificial Sequence: Synthetic probe
taccgctaccacgccttcgtgagcgtgaacgccgagaagggcgacatcgtcaaagacctg

SEQ ID NO: 13443 - DNA, 60 bp, Artificial Sequence
  Description of Artificial Sequence: Synthetic probe
taccgctaccacgccttcgtgagcgtgaacgccgagaagggcgacatcgtcaaggacctg

SEQ ID NO: 13444 - DNA, 60 bp, Artificial Sequence
  Description of Artificial Sequence: Synthetic probe
ttcgtgagcgtgaacgccgagaagggcgacatcgtcaaggacctgtccgcggtcttcgag

SEQ ID NO: 13445 - DNA, 60 bp, Artificial Sequence
  Description of Artificial Sequence: Synthetic probe
ttcgtgagcgtgaacgccgagaagggcgacatcgtcaaagacctgtccgcggtcttcgag

SEQ ID NO: 13446 - DNA, 60 bp, Artificial Sequence
  Description of Artificial Sequence: Synthetic probe
ttgcagaactccgagcgccagtcccgctcgaagaccgcggacaggtccttaacgatgtcg

SEQ ID NO: 13447 - DNA, 60 bp, Artificial Sequence
  Description of Artificial Sequence: Synthetic probe
ttgcagaactccgagcgccagtcccgctcgaagaccgcggacaggtccttgacgatgtcg

SEQ ID NO: 13448 - DNA, 60 bp, Artificial Sequence
  Description of Artificial Sequence: Synthetic probe
gcgagcacctgcatcaagggcccgctgatgaagctgttgctcgctaaccgaaccgtgatg

SEQ ID NO: 13449 - DNA, 60 bp, Artificial Sequence
  Description of Artificial Sequence: Synthetic probe
gcgagcacctgcatcaagggcccgctgatgaagctgttgctagcaaaccgcactgtgatg

SEQ ID NO: 13450 - DNA, 60 bp, Artificial Sequence
  Description of Artificial Sequence: Synthetic probe
taaggtccctaacccgccagtctataaggactttgaaaaaggtgtcctgcccggtcgcca

SEQ ID NO: 13451 - DNA, 60 bp, Artificial Sequence
  Description of Artificial Sequence: Synthetic probe
ctttggaccaactggcgaactcgagcaggtcatgggacagcacgaaacccgcaaatattt

SEQ ID NO: 13452 - DNA, 60 bp, Artificial Sequence
  Description of Artificial Sequence: Synthetic probe
tctttggaccaactggcgaactcgagcaggtcatgggacagcacgaaacccgcaaatatt

SEQ ID NO: 13453 - DNA, 60 bp, Artificial Sequence
  Description of Artificial Sequence: Synthetic probe
gtgtagcaatctaggtttcagtttaccatcaaaaggactacttaaaacgccgtggctcac

SEQ ID NO: 13454 - DNA, 60 bp, Artificial Sequence
  Description of Artificial Sequence: Synthetic probe
gcacagagaacaccctcatgactattcgcatgtacaaaattcaacatgtcccggaattcc

SEQ ID NO: 13455 - DNA, 60 bp, Artificial Sequence
  Description of Artificial Sequence: Synthetic probe
gcacagagaacaccctcatgactattcacatgtacaaaattcaacatgtcccggaattcc

SEQ ID NO: 13456 - DNA, 60 bp, Artificial Sequence
  Description of Artificial Sequence: Synthetic probe
tagagcataagaaatgcgattgtaaaccacgattcacaaccacgccaccgacgaccacaa

SEQ ID NO: 13457 - DNA, 60 bp, Artificial Sequence
  Description of Artificial Sequence: Synthetic probe
cgggatccgccatgaagttgctcgtctgcatactagtagtcgtgtgcttgcaccagcatc

SEQ ID NO: 13458 - DNA, 60 bp, Artificial Sequence
  Description of Artificial Sequence: Synthetic probe
gcgggatccgccatgaagttgctcgtctgcatactagtagtcgtgtgcttgcaccagcat

SEQ ID NO: 13459 - DNA, 60 bp, Artificial Sequence
  Description of Artificial Sequence: Synthetic probe
tcggctccacgatcatggagtagaaggtgttgttgcggtcatgaggtcccaggccagtgc

SEQ ID NO: 13460 - DNA, 60 bp, Artificial Sequence
  Description of Artificial Sequence: Synthetic probe
agagcagcgagaggtcgatgctgttcttggcgttctcgatgcggtgcagcacgaggtcct

SEQ ID NO: 13461 - DNA, 60 bp, Artificial Sequence
  Description of Artificial Sequence: Synthetic probe
gagagcagcgagaggtcgatgctgttcttggcgttctcgatgcggtgcagcacgaggtcc

SEQ ID NO: 13462 - DNA, 60 bp, Artificial Sequence
  Description of Artificial Sequence: Synthetic probe
atagagccgcaccggaacctgacggtgctgcccatgctcgacataagctgatttttcttt

SEQ ID NO: 13463 - DNA, 55 bp, Artificial Sequence
  Description of Artificial Sequence: Synthetic probe
atagagccgcaccggaacctgacggtgctgcccatgcttgacataagctgatttt

SEQ ID NO: 13464 - DNA, 55 bp, Artificial Sequence
  Description of Artificial Sequence: Synthetic probe
atagagccgcaccggaacctgacggtgctgcccatgctcgacataagctgatttt

SEQ ID NO: 13465 - DNA, 60 bp, Artificial Sequence
  Description of Artificial Sequence: Synthetic probe
cggacggtgcgcaacgtctgctgccgtataaagttgtctacacaaatagagccgcaccgg

SEQ ID NO: 13466 - DNA, 60 bp, Artificial Sequence
  Description of Artificial Sequence: Synthetic probe
ttttgcggacggtgcgcaacgtctgctgccgtataaagttgtctacacaaatagagccgc

SEQ ID NO: 13467 - DNA, 60 bp, Artificial Sequence
  Description of Artificial Sequence: Synthetic probe
cgcggagtacgtggaaattgaaagcgaacccagactgttaaagctgcggtagcatggtgt

SEQ ID NO: 13468 - DNA, 60 bp, Artificial Sequence
  Description of Artificial Sequence: Synthetic probe
caacgcggagtacgtggaaattgaaagcgaacccagactgttaaagctgcggtagcatgg

SEQ ID NO: 13469 - DNA, 60 bp, Artificial Sequence
  Description of Artificial Sequence: Synthetic probe
gccatgttcttcaacgcggagtacgtggaaattgaaagcgaacccagactgttaaagctg

SEQ ID NO: 13470 - DNA, 55 bp, Artificial Sequence
  Description of Artificial Sequence: Synthetic probe
gggcgctggccgctgctcgtgaccacggaccaggacgcgcttttgttcacgtcca

SEQ ID NO: 13471 - DNA, 54 bp, Artificial Sequence
  Description of Artificial Sequence: Synthetic probe
aggtcgttaagtcgctgatagagtccacgctcgcgcgcgctggcgatgccgtgg

SEQ ID NO: 13472 - DNA, 60 bp, Artificial Sequence
  Description of Artificial Sequence: Synthetic probe
aggtcgttaagtcgctgatagagtccacgctcgcgcgcgctggcgatgccgtggagatcg

SEQ ID NO: 13473 - DNA, 60 bp, Artificial Sequence
  Description of Artificial Sequence: Synthetic probe
gcgcatccgcttccagctcagcatcgccaaccacgaggtcgttaagtcgctgatagagtc

SEQ ID NO: 13474 - DNA, 60 bp, Artificial Sequence
  Description of Artificial Sequence: Synthetic probe
tgcagcgcatccgcttccagctcagcatcgccaaccacgaggtcgttaagtcgctgatag

SEQ ID NO: 13475 - DNA, 60 bp, Artificial Sequence
  Description of Artificial Sequence: Synthetic probe
gcagctaaagctgcagcgcatccgcttccagctcagcatcgccaaccacgaggtcgttaa

SEQ ID NO: 13476 - DNA, 60 bp, Artificial Sequence
  Description of Artificial Sequence: Synthetic probe
tcttcctcgaccgcggcgagattccgatcaagcagccgctgcgcgaccagcgccgcaaag

SEQ ID NO: 13477 - DNA, 60 bp, Artificial Sequence
  Description of Artificial Sequence: Synthetic probe
gcggatcgtggtcttcctcgaccgcggcgagattccgatcaagcagccgctgcgcgacca

SEQ ID NO: 13478 - DNA, 60 bp, Artificial Sequence
  Description of Artificial Sequence: Synthetic probe
agcgcgtgcagcactggatgagcgtgtccgagagcgggcggatcgtggtcttcctcgacc

SEQ ID NO: 13479 - DNA, 60 bp, Artificial Sequence
  Description of Artificial Sequence: Synthetic probe
gcggccgtcgaggagcgcgtgcagcactggatgagcgtgtccgagagcgggcggatcgtg

SEQ ID NO: 13480 - DNA, 60 bp, Artificial Sequence
  Description of Artificial Sequence: Synthetic probe
gatccgctgtccgtggctgcagttcgcgcgctggacaactttggagtggggcatatcgac

SEQ ID NO: 13481 - DNA, 60 bp, Artificial Sequence
  Description of Artificial Sequence: Synthetic probe
ggtacaacacctttagctccatggttgtggaccccaagcagccgttcacgcgcatctgct

SEQ ID NO: 13482 - DNA, 60 bp, Artificial Sequence
  Description of Artificial Sequence: Synthetic probe
cgagccgcgggccgtggcagagtcgctgcgagcgaccacgcccgtcggcgagacagcgtg

SEQ ID NO: 13483 - DNA, 60 bp, Artificial Sequence
  Description of Artificial Sequence: Synthetic probe
gcgcggaaccgaatcggcaacacgccgctgcacgaggccgcaaaacactcctcctgcaaa

SEQ ID NO: 13484 - DNA, 60 bp, Artificial Sequence
  Description of Artificial Sequence: Synthetic probe
ctgctcgccgcgagcgcggaaccgaatcggcaacacgccgctgcacgaggccgcaaaaca

SEQ ID NO: 13485 - DNA, 60 bp, Artificial Sequence
  Description of Artificial Sequence: Synthetic probe
ggctgctcgccgcgagcgcggaaccgaatcggcaacacgccgctgcacgaggccgcaaaa

SEQ ID NO: 13486 - DNA, 56 bp, Artificial Sequence
  Description of Artificial Sequence: Synthetic probe
aatgtatataacttttagctatcgttcggattctcgtatcgttctgcataccatgt

SEQ ID NO: 13487 - DNA, 60 bp, Artificial Sequence
  Description of Artificial Sequence: Synthetic probe
gaggtgtactactggccgctgatcatggacgcgttgctgcgcgctgctatcaaccgcagc

SEQ ID NO: 13488 - DNA, 60 bp, Artificial Sequence
  Description of Artificial Sequence: Synthetic probe
cgaggtgtactactggccgctgatcatggacgcgttgctgcgcgctgctatcaaccgcag

SEQ ID NO: 13489 - DNA, 60 bp, Artificial Sequence
  Description of Artificial Sequence: Synthetic probe
ccgccttcctggaggtggggcacgtgcgcgcgaacggctccgcctcggtgacctgcctca

SEQ ID NO: 13490 - DNA, 60 bp, Artificial Sequence
  Description of Artificial Sequence: Synthetic probe
cggtggaccgcgatatatacaactccatgcagtacacttacaagataactgccaactccg

SEQ ID NO: 13491 - DNA, 60 bp, Artificial Sequence
  Description of Artificial Sequence: Synthetic probe
atagcgcggtggaccgcgatatatacaactccatgcagtacacttacaagataactgcca

SEQ ID NO: 13492 - DNA, 60 bp, Artificial Sequence
  Description of Artificial Sequence: Synthetic probe
tttcccgcgccgcgctttatcaccgtaccatgcgagccgcgttctccagatctcgtgtca

SEQ ID NO: 13493 - DNA, 60 bp, Artificial Sequence
  Description of Artificial Sequence: Synthetic probe
agatccgccggcgctttcccgcgccgcgctttatcaccgtaccatgcgagccgcgttctc

SEQ ID NO: 13494 - DNA, 60 bp, Artificial Sequence
  Description of Artificial Sequence: Synthetic probe
gtcatggctcccaggcagaagatctacgataagcacgtgctcatattcgactacaacagc

SEQ ID NO: 13495 - DNA, 60 bp, Artificial Sequence
  Description of Artificial Sequence: Synthetic probe
ggagagtcatggctcccaggcagaagatctacgataagcacgtgctcatattcgactaca

SEQ ID NO: 13496 - DNA, 60 bp, Artificial Sequence
  Description of Artificial Sequence: Synthetic probe
cggtccgatatcaagtccaagtacttcttcgagggcgggagagtcatggctcccaggcag

SEQ ID NO: 13497 - DNA, 60 bp, Artificial Sequence
  Description of Artificial Sequence: Synthetic probe
aaccgtgatggtacggtccgatatcaagtccaagtacttcttcgagggcgggagagtcat

SEQ ID NO: 13498 - DNA, 60 bp, Artificial Sequence
  Description of Artificial Sequence: Synthetic probe
catcaagggcccgctgatgaagctgttgctcgctaaccgaaccgtgatggtacggtccga

SEQ ID NO: 13499 - DNA, 60 bp, Artificial Sequence
  Description of Artificial Sequence: Synthetic probe
ataaacgtcagcgtgtccgcgatcaactgcggcttccttaacatgcgccaggtagaaaca

SEQ ID NO: 13500 - DNA, 60 bp, Artificial Sequence
  Description of Artificial Sequence: Synthetic probe
ataaacgtcagcgtgtccgcgatcaactgcggcttcttcagcatgcgccaggtagagaca

SEQ ID NO: 13501 - DNA, 60 bp, Artificial Sequence
  Description of Artificial Sequence: Synthetic probe
cgttgtgattgtaaacccaaaactacgcctacaccagaaccacaaggtcagcctcgtaga

SEQ ID NO: 13502 - DNA, 60 bp, Artificial Sequence
  Description of Artificial Sequence: Synthetic probe
ttacgttgtgattgtaaacccaaaactacgcctacaccagaaccacaaggtcagcctcgt

SEQ ID NO: 13503 - DNA, 60 bp, Artificial Sequence
  Description of Artificial Sequence: Synthetic probe
gcgtataggtgacgaatatccaagtttaatatctcagcgtttcagtcctccttgtgtatc

SEQ ID NO: 13504 - DNA, 60 bp, Artificial Sequence
  Description of Artificial Sequence: Synthetic probe
gtgcgtataggtgacgaatatccaagtttaatatctcagcgtttcagtcctccttgtgta

SEQ ID NO: 13505 - DNA, 59 bp, Artificial Sequence
  Description of Artificial Sequence: Synthetic probe
ctcagagtcccaacacgacccctagaaaatggacggatgtactaggtagtggatcatgc

SEQ ID NO: 13506 - DNA, 60 bp, Artificial Sequence
  Description of Artificial Sequence: Synthetic probe
gatctacggaccccgtctagaagtcgaagacctcatcgacaggattatggacgacgttca

SEQ ID NO: 13507 - DNA, 60 bp, Artificial Sequence
  Description of Artificial Sequence: Synthetic probe
cccgtctagaagtcgaagacctcatcgacaggattatggacgacgttcaagtaagcggag

SEQ ID NO: 13508 - DNA, 60 bp, Artificial Sequence
  Description of Artificial Sequence: Synthetic probe
tctagcatgttcgccatgtcttccggggagcactgcgccacatcttcggggacaggatcg

SEQ ID NO: 13509 - DNA, 60 bp, Artificial Sequence
  Description of Artificial Sequence: Synthetic probe
aaaccgtctagcatgttcgccatgtcttccggggagcactgcgccacatcttcggggaca

SEQ ID NO: 13510 - DNA, 60 bp, Artificial Sequence
  Description of Artificial Sequence: Synthetic probe
cgtcacgcagcctgtgccaccgcactcattatcctcatcgacaactgcggcatcagcttc

SEQ ID NO: 13511 - DNA, 60 bp, Artificial Sequence
  Description of Artificial Sequence: Synthetic probe
gcgtcacgcagcctgtgccaccgcactcattatcctcatcgacaactgcggcatcagctt

SEQ ID NO: 13512 - DNA, 60 bp, Artificial Sequence
  Description of Artificial Sequence: Synthetic probe
acaggaccactgccccaacttcacctgcaccatcgtggtgtcgggcaagctaatcgccac

SEQ ID NO: 13513 - DNA, 60 bp, Artificial Sequence
  Description of Artificial Sequence: Synthetic probe
actcgctccggtggacaggaccactgccccaacttcacctgcaccatcgtggtgtcgggc

SEQ ID NO: 13514 - DNA, 60 bp, Artificial Sequence
  Description of Artificial Sequence: Synthetic probe
aggaggacgacaccgagcccatggagaccgaggcgggatgcgataccatcttcggcggcg

SEQ ID NO: 13515 - DNA, 60 bp, Artificial Sequence
  Description of Artificial Sequence: Synthetic probe
acactggtatgtggagtgcgagcccgccacgtgcgttgaggaggacgacaccgagcccat

SEQ ID NO: 13516 - DNA, 60 bp, Artificial Sequence
  Description of Artificial Sequence: Synthetic probe
gggacatccgccacactggtatgtggagtgcgagcccgccacgtgcgttgaggaggacga

SEQ ID NO: 13517 - DNA, 60 bp, Artificial Sequence
  Description of Artificial Sequence: Synthetic probe
gggcttccctgatcctcgatctcctcaagacgtgtggcgacaaactccccgccaagaaca

SEQ ID NO: 13518 - DNA, 60 bp, Artificial Sequence
  Description of Artificial Sequence: Synthetic probe
atggcctgcgagtgggcttccctgatcctcgatctcctcaagacgtgtggcgacaaactc

SEQ ID NO: 13519 - DNA, 52 bp, Artificial Sequence
  Description of Artificial Sequence: Synthetic probe
aaaaccgcggcacttgcaccgtgaacatccacgtgctgaccacgcccggctt

SEQ ID NO: 13520 - DNA, 60 bp, Artificial Sequence
  Description of Artificial Sequence: Synthetic probe
aagaaccgcggcacctgcaccgtgaacatccacgtgctgaccacgcccggctttaaccac

SEQ ID NO: 13521 - DNA, 60 bp, Artificial Sequence
  Description of Artificial Sequence: Synthetic probe
aagaaccgcggcacctgcaccgtgaacatccacgtgctgaccacgcccggcttcaaccac

SEQ ID NO: 13522 - DNA, 55 bp, Artificial Sequence
  Description of Artificial Sequence: Synthetic probe
gtccgcggtcttcgagcgggactggcgctcggagttctgcaagccaataaattaa

SEQ ID NO: 13523 - DNA, 60 bp, Artificial Sequence
  Description of Artificial Sequence: Synthetic probe
ggacctgtccgcggtcttcgagcgggactggcgctcggagttctgcaagccaataaatta

SEQ ID NO: 13524 - DNA, 60 bp, Artificial Sequence
  Description of Artificial Sequence: Synthetic probe
tggtcgctgctcgccacgtggctggcgcgcttctggcccggcgccatctacttcctcacc

SEQ ID NO: 13525 - DNA, 60 bp, Artificial Sequence
  Description of Artificial Sequence: Synthetic probe
acgtggctggcgcgcttctggcccggcgccatctacttcctcaccacgccgctcttctcc

SEQ ID NO: 13526 - DNA, 60 bp, Artificial Sequence
  Description of Artificial Sequence: Synthetic probe
aagagccccatgaaggaaaagagcggcgtggtgaggaagtagatggcgccgggccagaag

SEQ ID NO: 13527 - DNA, 60 bp, Artificial Sequence
  Description of Artificial Sequence: Synthetic probe
tctcctgcggtgctcgcgctgtgcgggagcgtgcactcggcgcaatggatcggcgagcgc

SEQ ID NO: 13528 - DNA, 60 bp, Artificial Sequence
  Description of Artificial Sequence: Synthetic probe
tcaaggtgtccacgcgggaaggcgtcggcaaccttctcggcagcttctggctctcggacg

SEQ ID NO: 13529 - DNA, 60 bp, Artificial Sequence
  Description of Artificial Sequence: Synthetic probe
cggagatcagccggtacatgatcccgttgagcatcatgtcctgggacacctcgatgggga

SEQ ID NO: 13530 - DNA, 60 bp, Artificial Sequence
  Description of Artificial Sequence: Synthetic probe
cctgtgacacacgacggagatcagccggtacatgatcccgttgagcatcatgtcctggga

SEQ ID NO: 13531 - DNA, 60 bp, Artificial Sequence
  Description of Artificial Sequence: Synthetic probe
gcgctcgggctgcgagagcagcagcatgcgcgcgttgtcggggtcctcgttgatgaagcg

SEQ ID NO: 13532 - DNA, 54 bp, Artificial Sequence
  Description of Artificial Sequence: Synthetic probe
tccccaaggagaccaacgagctcacctacctgctgggcatgatcgtgaagtaca

SEQ ID NO: 13533 - DNA, 60 bp, Artificial Sequence
  Description of Artificial Sequence: Synthetic probe
gcacgctcgacgaagacctggtgctgcaccgcatcgacgctgcgaaaaacagcatcgacc

SEQ ID NO: 13534 - DNA, 60 bp, Artificial Sequence
  Description of Artificial Sequence: Synthetic probe
gcacgctcgacgaagacctggtgctgcaccgcatcgacgctgcagaaaacagcattgacc

SEQ ID NO: 13535 - DNA, 60 bp, Artificial Sequence
  Description of Artificial Sequence: Synthetic probe
gcacgctcgacgaagacctggtgctgcaccgcattgacgctgcgaaaaacagcattgacc

SEQ ID NO: 13536 - DNA, 60 bp, Artificial Sequence
  Description of Artificial Sequence: Synthetic probe
gagaaatgagtttcttacaacataacaaatgtgagtgcaaacccaagtcaacacctcccc

SEQ ID NO: 13537 - DNA, 60 bp, Artificial Sequence
  Description of Artificial Sequence: Synthetic probe
agtggaatgcgagaaatgagtttcttacaacataacaaatgtgagtgcaaacccaagtca

SEQ ID NO: 13538 - DNA, 60 bp, Artificial Sequence
  Description of Artificial Sequence: Synthetic probe
acgtaacaatgcaactaatggtaacatcagcacataacggaggtagtaacgataatggta

SEQ ID NO: 13539 - DNA, 60 bp, Artificial Sequence
  Description of Artificial Sequence: Synthetic probe
ctaacgtaacaatgcaactaatggtaacatcagcacataacggaggtagtaacgataatg

SEQ ID NO: 13540 - DNA, 60 bp, Artificial Sequence
  Description of Artificial Sequence: Synthetic probe
gcgaaaggtataatcctcaatgtgttacattgatgcgttgtggagggtgttgtaacgatg

SEQ ID NO: 13541 - DNA, 60 bp, Artificial Sequence
  Description of Artificial Sequence: Synthetic probe
gcctatgcccacgaccgtacgtgtatcagatgagtatccaaatgatacaagcgaaaggta

SEQ ID NO: 13542 - DNA, 60 bp, Artificial Sequence
  Description of Artificial Sequence: Synthetic probe
atgaagtgcttaatagtatgcatgcaatggagcctcgcgttactactctgcctccagtgt

SEQ ID NO: 13543 - DNA, 60 bp, Artificial Sequence
  Description of Artificial Sequence: Synthetic probe
gtgcactcggcgcaatggatcggcgagcgcgacttctgcacggcccacgcgcaggaacgt

SEQ ID NO: 13544 - DNA, 60 bp, Artificial Sequence
  Description of Artificial Sequence: Synthetic probe
cgtgcactcggcgcaatggatcggcgagcgcgacttctgcacggcccacgcgcaggacgt

SEQ ID NO: 13545 - DNA, 60 bp, Artificial Sequence
  Description of Artificial Sequence: Synthetic probe
agcgtgcactcggcgcaatggatcggcgagcgcgacttctgcacggcccacgcgcaggac

SEQ ID NO: 13546 - DNA, 60 bp, Artificial Sequence
  Description of Artificial Sequence: Synthetic probe
taccggcggctcgctagccactattaaaaacctgggcgtgtactccaccaacaagcactt

SEQ ID NO: 13547 - DNA, 55 bp, Artificial Sequence
  Description of Artificial Sequence: Synthetic probe
gcgagacgcacccagagctgacttctcagcggttcaacccgccgtgtgttacgtt

SEQ ID NO: 13548 - DNA, 55 bp, Artificial Sequence
  Description of Artificial Sequence: Synthetic probe
gcgagacgcacccagagctgacttctcagcggttcaacccgccgtgtgtcacgtt

SEQ ID NO: 13549 - DNA, 60 bp, Artificial Sequence
  Description of Artificial Sequence: Synthetic probe
ggctccacggtcatggagtagaaagtgttgtagcggttccatgtggtcccaggccagtgc

SEQ ID NO: 13550 - DNA, 60 bp, Artificial Sequence
  Description of Artificial Sequence: Synthetic probe
ggaaggcaccttcggctccacggtcatggagtagaaagtgttgtagcggttccatgtggt

SEQ ID NO: 13551 - DNA, 60 bp, Artificial Sequence
  Description of Artificial Sequence: Synthetic probe
tgtgtggttgcggtgctcgacgccaaccgggtaccgcgaacttgcgcacggacatgtcca

SEQ ID NO: 13552 - DNA, 60 bp, Artificial Sequence
  Description of Artificial Sequence: Synthetic probe
ccgaagatgcagacgttggggtacaggctgttgtagtcgaagaccgcgacgttgttctcg

SEQ ID NO: 13553 - DNA, 60 bp, Artificial Sequence
  Description of Artificial Sequence: Synthetic probe
agaggttgccgaagatgcagacgttggggtacaggctgttgtagtcgaagaccgcgacgt

SEQ ID NO: 13554 - DNA, 60 bp, Artificial Sequence
  Description of Artificial Sequence: Synthetic probe
gccgctcaccatcacgccgaccagcgtctccggcgagaggttgccgaagatgcagacgtt

SEQ ID NO: 13555 - DNA, 60 bp, Artificial Sequence
  Description of Artificial Sequence: Synthetic probe
cgcctccaggcggttgccgctcaccatcacgccgaccagcgtctccggcgagaggttgcc

SEQ ID NO: 13556 - DNA, 50 bp, Artificial Sequence
  Description of Artificial Sequence: Synthetic probe
aggacttacgcacatacggcgttaactacaccttcttgtacaacttctgg

SEQ ID NO: 13557 - DNA, 60 bp, Artificial Sequence
  Description of Artificial Sequence: Synthetic probe
ggcattcgcgttaaggacctgcgcacgtacggcgttaactacaccttcttgtacaacttc

SEQ ID NO: 13558 - DNA, 60 bp, Artificial Sequence
  Description of Artificial Sequence: Synthetic probe
gcgtgtatgcgttcatgcgacgctttggcattcgcgttaaggacttacgcacatacggcg

SEQ ID NO: 13559 - DNA, 60 bp, Artificial Sequence
  Description of Artificial Sequence: Synthetic probe
ttgctcacgagtttaccgtccgcaacagccagcggctctttgccgcgctgcggcgcttgt

SEQ ID NO: 13560 - DNA, 60 bp, Artificial Sequence
  Description of Artificial Sequence: Synthetic probe
tgggcttactcacgctgcgcaacaagcacctttcagaggcagagggtggcgaggaaatcc

SEQ ID NO: 13561 - DNA, 60 bp, Artificial Sequence
  Description of Artificial Sequence: Synthetic probe
tgtgggcttgctcacgctgcgcaacaagcacctttcagaggcagagggcggcgaggaagt

SEQ ID NO: 13562 - DNA, 60 bp, Artificial Sequence
  Description of Artificial Sequence: Synthetic probe
gagagcggcactgtgggcttgctcacgctgcgcaacaagcacctttcagaggcagagggc

SEQ ID NO: 13563 - DNA, 60 bp, Artificial Sequence
  Description of Artificial Sequence: Synthetic probe
gagagcggcactgtgggcttactcacgctgcgcaacaagcacctttcagaggcagagggt

SEQ ID NO: 13564 - DNA, 52 bp, Artificial Sequence
  Description of Artificial Sequence: Synthetic probe
cgtgagcacatcgagctgtgatccccgcggagctggtcgcgcgcgtgctgcg

SEQ ID NO: 13565 - DNA, 60 bp, Artificial Sequence
  Description of Artificial Sequence: Synthetic probe
acctggtggtcgtgaccgtccacgacgtttctcgtttgcacaccgatgactggatcgggt

SEQ ID NO: 13566 - DNA, 60 bp, Artificial Sequence
  Description of Artificial Sequence: Synthetic probe
tctttgtggtgttcttgatcgcgctcaacgcgatggtggggaacacgccacaggaagcgc

SEQ ID NO: 13567 - DNA, 60 bp, Artificial Sequence
  Description of Artificial Sequence: Synthetic probe
ttacactgcgtcagatatggcgtcccttcgcagactcgtcgcgtccaccctctttgtggt

SEQ ID NO: 13568 - DNA, 60 bp, Artificial Sequence
  Description of Artificial Sequence: Synthetic probe
gcggttcaggttcgcgacgcgcctgcgagtgtgagcacaataagtgaaggttaactacca

SEQ ID NO: 13569 - DNA, 60 bp, Artificial Sequence
  Description of Artificial Sequence: Synthetic probe
gtcggtcctgctgtcggtggccgcggtggttgtcgtcggcacggtggccgtgtcgctgtt

SEQ ID NO: 13570 - DNA, 60 bp, Artificial Sequence
  Description of Artificial Sequence: Synthetic probe
cgcacccgatagagcacctagcgcggatcgtgcgccgcgacctattctcccgctggataa

SEQ ID NO: 13571 - DNA, 60 bp, Artificial Sequence
  Description of Artificial Sequence: Synthetic probe
tgcgcgaacttcctgcacgtggacctcaagcccgacaacgtgctcatcttcgacagctcg

SEQ ID NO: 13572 - DNA, 60 bp, Artificial Sequence
  Description of Artificial Sequence: Synthetic probe
gcacttcttcgagcacgagaagcgcgcgcggtacgtcttcgaccgcggggccgtgatcgt

SEQ ID NO: 13573 - DNA, 60 bp, Artificial Sequence
  Description of Artificial Sequence: Synthetic probe
agcgcccctccgtggagatggccaagaagccgctgctgcgctggttcgagtcgcgcaagg

SEQ ID NO: 13574 - DNA, 60 bp, Artificial Sequence
  Description of Artificial Sequence: Synthetic probe
tctgcgcgctggccatggggctgaactaccgcctcgggttcctgcactcgctgtaccggc

SEQ ID NO: 13575 - DNA, 60 bp, Artificial Sequence
  Description of Artificial Sequence: Synthetic probe
aggacacgctcgaccgcatgtccaagcgcgggtacgtcaaccgctcctactaccagatgt

SEQ ID NO: 13576 - DNA, 60 bp, Artificial Sequence
  Description of Artificial Sequence: Synthetic probe
atacggcatctcgccgctgcacatggcggccgggtacaacaacaccgccgcctgcgaaaa

SEQ ID NO: 13577 - DNA, 60 bp, Artificial Sequence
  Description of Artificial Sequence: Synthetic probe
tcatgcgggagctcatccgactgggctgcgaccccatgaccaccaacgtgttcgggaaca

SEQ ID NO: 13578 - DNA, 60 bp, Artificial Sequence
  Description of Artificial Sequence: Synthetic probe
taaactacgtcggccacttcgacaagtccgcgctgcacctctacctccacaccagacacc

SEQ ID NO: 13579 - DNA, 60 bp, Artificial Sequence
  Description of Artificial Sequence: Synthetic probe
taaacgcggtgctgaatcgagcgcccacaatccccgcacatttcagtcatggacaggaac

SEQ ID NO: 13580 - DNA, 60 bp, Artificial Sequence
  Description of Artificial Sequence: Synthetic probe
gaagaataaacgcggtgctgaatcgagcgcccacaatccctgcacatttcggtcatggac

SEQ ID NO: 13581 - DNA, 56 bp, Artificial Sequence
  Description of Artificial Sequence: Synthetic probe
ccccggaaatgctcgaccgcgtgctcctctgcctgaccacgaccgaactccgcagc

SEQ ID NO: 13582 - DNA, 57 bp, Artificial Sequence
  Description of Artificial Sequence: Synthetic probe
gagcgtcgtcgaccgcacgccgctccacatctgcctcacgggcatgtccacgcaccc

SEQ ID NO: 13583 - DNA, 60 bp, Artificial Sequence
  Description of Artificial Sequence: Synthetic probe
ggcctccgtacaccaccgcggggagttcgaccgcacgcccttgcacctgtacatgggcaa

SEQ ID NO: 13584 - DNA, 60 bp, Artificial Sequence
  Description of Artificial Sequence: Synthetic probe
gagagtgttcagcgagcttcaggaaagaggcgtgtacaaggccatgagtgagtttgacat

SEQ ID NO: 13585 - DNA, 60 bp, Artificial Sequence
  Description of Artificial Sequence: Synthetic probe
ggtgaaaagctgaagacattgcgacttcgactgcgtcgctgccaccgctttctcccgtgc

SEQ ID NO: 13586 - DNA, 60 bp, Artificial Sequence
  Description of Artificial Sequence: Synthetic probe
ggtcatgccacaggcagaaaatcacggacccgacataaaagaacacgtcaattccctggg

SEQ ID NO: 13587 - DNA, 60 bp, Artificial Sequence
  Description of Artificial Sequence: Synthetic probe
tgcttctcacacagtctcttttggatgacttcaaaggctatttagggtgccaagctctgt

SEQ ID NO: 13588 - DNA, 60 bp, Artificial Sequence
  Description of Artificial Sequence: Synthetic probe
gcggtaagtccgtgctctctgccgcccgaggtgctgtacaggatattcctatacgttccc

SEQ ID NO: 13589 - DNA, 60 bp, Artificial Sequence
  Description of Artificial Sequence: Synthetic probe
gtccccgactcgctgatagccggaactgtgaaccgcctgaacgtgctcgtgcccacggac

SEQ ID NO: 13590 - DNA, 60 bp, Artificial Sequence
  Description of Artificial Sequence: Synthetic probe
ggtaatcatggcgcacagagcgcgtggaacggctgcttggggtctacgaccatagagcta

SEQ ID NO: 13591 - DNA, 60 bp, Artificial Sequence
  Description of Artificial Sequence: Synthetic probe
gttggggtaatcatggcgcacagagcgcgtggaacggctgcttggggtctacgaccatag

SEQ ID NO: 13592 - DNA, 60 bp, Artificial Sequence
  Description of Artificial Sequence: Synthetic probe
caccgccggagtggtttaagtggaagttagtggcagttggggtaatcatggcgcacagag

SEQ ID NO: 13593 - DNA, 60 bp, Artificial Sequence
  Description of Artificial Sequence: Synthetic probe
ctgagaaaaaaacaccaccgccggagtggtttaagtggaagttagtggcagttggggtaa

SEQ ID NO: 13594 - DNA, 60 bp, Artificial Sequence
  Description of Artificial Sequence: Synthetic probe
agcagcgagaggtcgatgctgttttctgcggcatcgatgcggtgcaacacgaggtcttcg

SEQ ID NO: 13595 - DNA, 60 bp, Artificial Sequence
  Description of Artificial Sequence: Synthetic probe
atccatgatgcgaggccagtagtgcacggcgttgcctgatcgcaccaccggcaccatgga

SEQ ID NO: 13596 - DNA, 60 bp, Artificial Sequence
  Description of Artificial Sequence: Synthetic probe
gcgcatccatgatgcgaggccagtagtgcacggcgttgcctgatcgcaccaccggcacca

SEQ ID NO: 13597 - DNA, 60 bp, Artificial Sequence
  Description of Artificial Sequence: Synthetic probe
attattatacgcacgcgcacgctgcggtcaatagcggcgcgcagcagcgcatccatgatg

SEQ ID NO: 13598 - DNA, 60 bp, Artificial Sequence
  Description of Artificial Sequence: Synthetic probe
actaattattatacgcacgcgcacgctgcggtcaatagcggcgcgcagcagcgcatccat

SEQ ID NO: 13599 - DNA, 60 bp, Artificial Sequence
  Description of Artificial Sequence: Synthetic probe
gcagccacagacagtgggtctgcgttgcgccactgactaattattatacgcacgcgcacg

SEQ ID NO: 13600 - DNA, 60 bp, Artificial Sequence
  Description of Artificial Sequence: Synthetic probe
tctagtgcgcgcactgcagccacagacagtgggtctgcgttgcgccactgactaattatt

SEQ ID NO: 13601 - DNA, 60 bp, Artificial Sequence
  Description of Artificial Sequence: Synthetic probe
gcgccgtaatgtcaatgtacccaactccaaagttgtctagtgcgcgcactgcagccacag

SEQ ID NO: 13602 - DNA, 60 bp, Artificial Sequence
  Description of Artificial Sequence: Synthetic probe
gaattgcaaaccatcgcgccgtaatgtcaatgtacccaactccaaagttgtctagtgcgc

SEQ ID NO: 13603 - DNA, 59 bp, Artificial Sequence
  Description of Artificial Sequence: Synthetic probe
atcatgactcagtctgccgtgatgcgcctcaaaagtcttaacccggtcagcgcggtcaa

SEQ ID NO: 13604 - DNA, 60 bp, Artificial Sequence
  Description of Artificial Sequence: Synthetic probe
atcatgactcagtcttccgtgatgcgcctcaaaagtcttaacccggtcagcgcggtcaac

SEQ ID NO: 13605 - DNA, 59 bp, Artificial Sequence
  Description of Artificial Sequence: Synthetic probe
ttgaccgcgctgaccgggttaagacttttgaggcgcatcacggcagactgagtcatgat

SEQ ID NO: 13606 - DNA, 59 bp, Artificial Sequence
  Description of Artificial Sequence: Synthetic probe
atcctgactcagtctgccgtgatgcgcctcaaaagtcttaacccggtcagcgcggtcaa

SEQ ID NO: 13607 - DNA, 60 bp, Artificial Sequence
  Description of Artificial Sequence: Synthetic probe
gcaggcggaaaatcacgggccggacatcaaagagcacgttaactcgctgggagaaaaact

SEQ ID NO: 13608 - DNA, 60 bp, Artificial Sequence
  Description of Artificial Sequence: Synthetic probe
agttttacttagaagaggtgatgccacaggcggaaaatcacgggccggacatcaaagagc

SEQ ID NO: 13609 - DNA, 54 bp, Artificial Sequence
  Description of Artificial Sequence: Synthetic probe
catggactcctggggacccttgggtggatcgacgacccccagccgctcttcacg

SEQ ID NO: 13610 - DNA, 60 bp, Artificial Sequence
  Description of Artificial Sequence: Synthetic probe
cgcgcgcgtggcgaccgcgctgacgcgccgcgtgcccgcgagccggcacggcctcgcgga

SEQ ID NO: 13611 - DNA, 60 bp, Artificial Sequence
  Description of Artificial Sequence: Synthetic probe
aggtcccaggccaggtgcttgttggtggagtagagcccgaggttcttgatggtggacacg

SEQ ID NO: 13612 - DNA, 50 bp, Artificial Sequence
  Description of Artificial Sequence: Synthetic probe
gcgggatccgccatgaagttgctcgtctgcatactggtagtcgtgtgctt

SEQ ID NO: 13613 - DNA, 60 bp, Artificial Sequence
  Description of Artificial Sequence: Synthetic probe
gatatgggcgacacgcagacgcggtcgcccacactcttgggcctcatgaactacgggcgg

SEQ ID NO: 13614 - DNA, 55 bp, Artificial Sequence
  Description of Artificial Sequence: Synthetic probe
tggaccggagcacgttctccacgtcggagtcggagacgttgcagcagcagaggtg

SEQ ID NO: 13615 - DNA, 60 bp, Artificial Sequence
  Description of Artificial Sequence: Synthetic probe
cacctctgctgctgcaacgtctccgactccgacgtggagaacgtgctccggtccatgtcc

SEQ ID NO: 13616 - DNA, 60 bp, Artificial Sequence
  Description of Artificial Sequence: Synthetic probe
tggacatggaccggagcacgttctccacgtcggagtcggacacgttgcagcagcagaggt

SEQ ID NO: 13617 - DNA, 60 bp, Artificial Sequence
  Description of Artificial Sequence: Synthetic probe
tatggacatggaccggagcacgttctccacgtcggagtcggagacgttgcagcagcagag

SEQ ID NO: 13618 - DNA, 60 bp, Artificial Sequence
  Description of Artificial Sequence: Synthetic probe
gtcttcgatgatcaacactctcctgctcccggccgaccgcatgatggccatggcccggat

SEQ ID NO: 13619 - DNA, 60 bp, Artificial Sequence
  Description of Artificial Sequence: Synthetic probe
tcatgcggtcggccgggaccaggagggtgttgatcatcgaagactcggtgttctgccaga

SEQ ID NO: 13620 - DNA, 60 bp, Artificial Sequence
  Description of Artificial Sequence: Synthetic probe
gggaccaggagggtgttgatcatcgaagactcggtgttctgccagaaccaggagcgcatc

SEQ ID NO: 13621 - DNA, 60 bp, Artificial Sequence
  Description of Artificial Sequence: Synthetic probe
ttctgccagaaccaggagcgcatctgctacgacttcgccgacgagagcgtcgtcaagcgc

SEQ ID NO: 13622 - DNA, 60 bp, Artificial Sequence
  Description of Artificial Sequence: Synthetic probe
tctcgaccccggcatcctgctcgcgcagttctcgcacatgaagacgcggctcgccgacat

SEQ ID NO: 13623 - DNA, 55 bp, Artificial Sequence
  Description of Artificial Sequence: Synthetic probe
acttccacatgaaccactctggcggcggcgtttttttctcggactcaccagagcg

SEQ ID NO: 13624 - DNA, 58 bp, Artificial Sequence
  Description of Artificial Sequence: Synthetic probe
ccatgataacgcccacagccacggacttccacatgaaccactctggcggcggcgtttt

SEQ ID NO: 13625 - DNA, 60 bp, Artificial Sequence
  Description of Artificial Sequence: Synthetic probe
ccatgataacgcccacagccacggacttccacatgaaccactctggcggcggcgtttttt

SEQ ID NO: 13626 - DNA, 60 bp, Artificial Sequence
  Description of Artificial Sequence: Synthetic probe
attctgctgcgccatgataacgcccacagccacggacttccacatgaaccactctggcgg

SEQ ID NO: 13627 - DNA, 60 bp, Artificial Sequence
  Description of Artificial Sequence: Synthetic probe
attctgctgcgccatgatcacacccacggccacggacttccacatgaaccactctggcgg

SEQ ID NO: 13628 - DNA, 60 bp, Artificial Sequence
  Description of Artificial Sequence: Synthetic probe
gcagccgtttacgcgattctgctgcgccatgataacgcccacagccacggacttccacat

SEQ ID NO: 13629 - DNA, 51 bp, Artificial Sequence
  Description of Artificial Sequence: Synthetic probe
ccgttgagcatcatgtcctgggacacctcgattgggatgtcgctgatcatg

SEQ ID NO: 13630 - DNA, 60 bp, Artificial Sequence
  Description of Artificial Sequence: Synthetic probe
cgccgtctccgaccctgtgacacacaacggagataagccggtacatgatcccgttgagca

SEQ ID NO: 13631 - DNA, 59 bp, Artificial Sequence
  Description of Artificial Sequence: Synthetic probe
agtaccgtcatggggtcgtacagccagggacccgcgtccgtgaacaggatggtgcagta

SEQ ID NO: 13632 - DNA, 60 bp, Artificial Sequence
  Description of Artificial Sequence: Synthetic probe
aaccactcgttcagacactggttgtcgccgccggtaccgctctcctgcgagaaggtgttg

SEQ ID NO: 13633 - DNA, 60 bp, Artificial Sequence
  Description of Artificial Sequence: Synthetic probe
acgcaaccactcgttcagacactggttgtcgccgccggtaccgctctcctgcgagaaggt

SEQ ID NO: 13634 - DNA, 60 bp, Artificial Sequence
  Description of Artificial Sequence: Synthetic probe
gctcgaccgagtacgccgcgaaccaagcgccgttgcgatccatggggcgtatttattaac

SEQ ID NO: 13635 - DNA, 60 bp, Artificial Sequence
  Description of Artificial Sequence: Synthetic probe
tcgagctcgaccgagtacgccgcgaaccaagcgccgttgcgatccatggggcgtatttat

SEQ ID NO: 13636 - DNA, 59 bp, Artificial Sequence
  Description of Artificial Sequence: Synthetic probe
gtacacgacgagcacccggagctaacttctcagcggttcaacccgccgtgtgtcacgtt

SEQ ID NO: 13637 - DNA, 60 bp, Artificial Sequence
  Description of Artificial Sequence: Synthetic probe
cgtaaacggcgagcacccggagctaacttctcagcggttcaacccgccatgtgtcacgtt

SEQ ID NO: 13638 - DNA, 56 bp, Artificial Sequence
  Description of Artificial Sequence: Synthetic probe
cccgcgtgcgcatcagatttttttaacgcaaagttcgacctggtcccggaaagaat

SEQ ID NO: 13639 - DNA, 60 bp, Artificial Sequence
  Description of Artificial Sequence: Synthetic probe
gcgaaatccgtcacacagtcggccatcaacgacttgcgtcgtctgctcacgggggcggct

SEQ ID NO: 13640 - DNA, 60 bp, Artificial Sequence
  Description of Artificial Sequence: Synthetic probe
tcaacgccgagtcgctcagcctcacgcgcgacatcgagacggcgaaatccgtcacacagt

SEQ ID NO: 13641 - DNA, 60 bp, Artificial Sequence
  Description of Artificial Sequence: Synthetic probe
tgcgcgacctcaacgccgagtcgctcagcctcacgcgcgacatcgagacggcgaaatccg

SEQ ID NO: 13642 - DNA, 60 bp, Artificial Sequence
  Description of Artificial Sequence: Synthetic probe
gtcgtcgcggcccggtatcacgaacttgcgcacggacatgtccacgctgcccacgccgaa

SEQ ID NO: 13643 - DNA, 60 bp, Artificial Sequence
  Description of Artificial Sequence: Synthetic probe
tgtcgttgtcgaccaccaggatgaagtcatcgtcggagtacttggtggggacagtgccgg

SEQ ID NO: 13644 - DNA, 60 bp, Artificial Sequence
  Description of Artificial Sequence: Synthetic probe
aacctctgggagagcatatcggccggcactgtccccaccaagtactccgacgatgacttc

SEQ ID NO: 13645 - DNA, 60 bp, Artificial Sequence
  Description of Artificial Sequence: Synthetic probe
agtcatcgtcggagtacttggtggggacagtgccggccgatatgctctcccagaggttga

SEQ ID NO: 13646 - DNA, 60 bp, Artificial Sequence
  Description of Artificial Sequence: Synthetic probe
ctcaatctctgggagagcatatcggccggcactgtccccaccaagtactccgacgatgac

SEQ ID NO: 13647 - DNA, 60 bp, Artificial Sequence
  Description of Artificial Sequence: Synthetic probe
acctcaatctctgggagagcatatcggccggcactgtccccaccaagtactccgacgatg

SEQ ID NO: 13648 - DNA, 60 bp, Artificial Sequence
  Description of Artificial Sequence: Synthetic probe
acctcaacctctgggagagcatatcggccggcactgtccccaccaagtactccgacgatg

SEQ ID NO: 13649 - DNA, 60 bp, Artificial Sequence
  Description of Artificial Sequence: Synthetic probe
acacctgggacccctgggtgctcgacgacccccagccgctcttcagccaggagtacgaaa

SEQ ID NO: 13650 - DNA, 60 bp, Artificial Sequence
  Description of Artificial Sequence: Synthetic probe
gaggctgtacattcgcgtgggctgcacggtgcctggagagcagccctttgaggtgatcac

SEQ ID NO: 13651 - DNA, 60 bp, Artificial Sequence
  Description of Artificial Sequence: Synthetic probe
acgaaacgcttccgtacctgctggaggttctggagctagcgaggctgtacattcgcgtgg

SEQ ID NO: 13652 - DNA, 60 bp, Artificial Sequence
  Description of Artificial Sequence: Synthetic probe
aacgaaacgctgccgtacctgctggaggttctggagctagcgaggctgtacattcgcgtg

SEQ ID NO: 13653 - DNA, 60 bp, Artificial Sequence
  Description of Artificial Sequence: Synthetic probe
gagtacgaaaacgaaacgctgccgtacctgctggaggttctggagctagcgaggctgtac

SEQ ID NO: 13654 - DNA, 52 bp, Artificial Sequence
  Description of Artificial Sequence: Synthetic probe
ccccagccgctcttcagccaggagtacgaaaacgaaacgctgccgtacctgc

SEQ ID NO: 13655 - DNA, 60 bp, Artificial Sequence
  Description of Artificial Sequence: Synthetic probe
cgtgggaaagaaccacaatatgtgcagtcttaacctcaaccctggccattaagctgtttt

SEQ ID NO: 13656 - DNA, 60 bp, Artificial Sequence
  Description of Artificial Sequence: Synthetic probe
acgtgggaaagaaccacaatatgtgcagtcttaacctcaaccctggccattaagctgttt

SEQ ID NO: 13657 - DNA, 60 bp, Artificial Sequence
  Description of Artificial Sequence: Synthetic probe
ccctcacctgtcacaacaacgctttccccaacaacgactttaaacccgaataacgaaaac

SEQ ID NO: 13658 - DNA, 60 bp, Artificial Sequence
  Description of Artificial Sequence: Synthetic probe
caactacccaacccccctcacctgtcacaacaacgctttccccaacaacgactttaaacc

SEQ ID NO: 13659 - DNA, 60 bp, Artificial Sequence
  Description of Artificial Sequence: Synthetic probe
ctatccgcgaacgacggctggggtattaaacaggttctagaaaaagagatactggccatc

SEQ ID NO: 13660 - DNA, 60 bp, Artificial Sequence
  Description of Artificial Sequence: Synthetic probe
tcaacgtctcgtcacgggctccttgggatcaacagactctggacctatccgcgaacgacg

SEQ ID NO: 13661 - DNA, 60 bp, Artificial Sequence
  Description of Artificial Sequence: Synthetic probe
tgtacgtcaacgtctcgtcacgggctccttgggatcaacagactctggacctatccgcga

SEQ ID NO: 13662 - DNA, 60 bp, Artificial Sequence
  Description of Artificial Sequence: Synthetic probe
gctaagttacataggcctcggattcaacccattgcttaaagatggctacctgtacgtcaa

SEQ ID NO: 13663 - DNA, 60 bp, Artificial Sequence
  Description of Artificial Sequence: Synthetic probe
aacggagtgaacgtgtccgtggcactaatgggagaaggcgtgagcataccgctaagttac

SEQ ID NO: 13664 - DNA, 60 bp, Artificial Sequence
  Description of Artificial Sequence: Synthetic probe
ccaggttctggcttcagatgcgtgtgggtgtacgacacagttcgctctacgctcccagca

SEQ ID NO: 13665 - DNA, 60 bp, Artificial Sequence
  Description of Artificial Sequence: Synthetic probe
aagtgtacgccaggttctggcttcagatgcgtgtgggtgtacgacacagttcgctctacg

SEQ ID NO: 13666 - DNA, 60 bp, Artificial Sequence
  Description of Artificial Sequence: Synthetic probe
gtggtctgcgcgctggccatggggctgaactaccggctgggcttcctgcactcgctgtac

SEQ ID NO: 13667 - DNA, 60 bp, Artificial Sequence
  Description of Artificial Sequence: Synthetic probe
aagtacgtcttcgagcaccgcaacggcatgtccgagatggacgcctctacggagtacacg

SEQ ID NO: 13668 - DNA, 51 bp, Artificial Sequence
  Description of Artificial Sequence: Synthetic probe
aaaattctgctcgacgcatcatgacaaagtgtacgccaggttctggcttca

SEQ ID NO: 13669 - DNA, 60 bp, Artificial Sequence
  Description of Artificial Sequence: Synthetic probe
gcgtcttggcagtgcagaggaagaaaaattctgctcgacgcatcatgacaaagtgtacgc

SEQ ID NO: 13670 - DNA, 60 bp, Artificial Sequence
  Description of Artificial Sequence: Synthetic probe
gggagcgttcaccaacgcagcgcctttgttaagcaaccagcgtcttggcagtgcagagga

SEQ ID NO: 13671 - DNA, 60 bp, Artificial Sequence
  Description of Artificial Sequence: Synthetic probe
atcttgcaacaaccaagatgaaggcggtgttgttgctagcgctactgggagcgttcacca

SEQ ID NO: 13672 - DNA, 60 bp, Artificial Sequence
  Description of Artificial Sequence: Synthetic probe
aagaagagttctagaatcttgcaacaaccaagatgaaggcggtgttgttgctagcgctac

SEQ ID NO: 13673 - DNA, 52 bp, Artificial Sequence
  Description of Artificial Sequence: Synthetic probe
gccagtgcttgttggtgggatagaacccgcagttcttggtggtgggacaccg

SEQ ID NO: 13674 - DNA, 60 bp, Artificial Sequence
  Description of Artificial Sequence: Synthetic probe
gcgtgacgaccgcgcagcataaccgcgtgaaggcaccttcggctccacgatcatgggata

SEQ ID NO: 13675 - DNA, 60 bp, Artificial Sequence
  Description of Artificial Sequence: Synthetic probe
aattcgtggccgtgggcgtgacgaccgcgcagcataaccgcgtgaaggcaccttcggctc

SEQ ID NO: 13676 - DNA, 60 bp, Artificial Sequence
  Description of Artificial Sequence: Synthetic probe
ggctagggggcggcagcgtcgtcccggccgggtaccgcgaacttgcgcacggacatgtcc

SEQ ID NO: 13677 - DNA, 60 bp, Artificial Sequence
  Description of Artificial Sequence: Synthetic probe
cacctggcctgggacctcatgaaccgctacaacaccttctactccatgatcgtggagccg

SEQ ID NO: 13678 - DNA, 60 bp, Artificial Sequence
  Description of Artificial Sequence: Synthetic probe
cgcaacgccgccgtgagtctgtgcacgcggcttcagcgtcatgatgaccatggcttactc

SEQ ID NO: 13679 - DNA, 60 bp, Artificial Sequence
  Description of Artificial Sequence: Synthetic probe
ccggaattctccgtgcgcaacgccgccgtgagtctgtgcacgcggcttcagcgtcatgat

SEQ ID NO: 13680 - DNA, 60 bp, Artificial Sequence
  Description of Artificial Sequence: Synthetic probe
gggtggatgccacggagggctacaataacggaacggcacatctgaaaatctacgtggcct

SEQ ID NO: 13681 - DNA, 60 bp, Artificial Sequence
  Description of Artificial Sequence: Synthetic probe
ctagcatcgcagggtggatgccacggagggctacaataacggaacggcacatctgaaaat

SEQ ID NO: 13682 - DNA, 51 bp, Artificial Sequence
  Description of Artificial Sequence: Synthetic probe
tctccctagggactttacatggaaggcgcccgcggatgtcgatccacataa

SEQ ID NO: 13683 - DNA, 60 bp, Artificial Sequence
  Description of Artificial Sequence: Synthetic probe
gcaccttcggctccacgatccatggagtagaaagtgttgtagcggttcatgaggtcccag

SEQ ID NO: 13684 - DNA, 60 bp, Artificial Sequence
  Description of Artificial Sequence: Synthetic probe
taggtgtctcggcgcttcccggccgggtaccgcgaacttgcgcacggacatgtccacgct

SEQ ID NO: 13685 - DNA, 53 bp, Artificial Sequence
  Description of Artificial Sequence: Synthetic probe
gaccacgccaccgacgaccacaaggccgcccagaagacgccgctagaactttt

SEQ ID NO: 13686 - DNA, 52 bp, Artificial Sequence
  Description of Artificial Sequence: Synthetic probe
catggactcctgggacccttgggtggatcgacgacccccagccgctcttcgg

SEQ ID NO: 13687 - DNA, 60 bp, Artificial Sequence
  Description of Artificial Sequence: Synthetic probe
actcggacgaggtttgctgcgaggacggaaacccgccccgctggttcgtggagtgcgcgc

SEQ ID NO: 13688 - DNA, 60 bp, Artificial Sequence
  Description of Artificial Sequence: Synthetic probe
cgtcgtccatcatcctgtcgatgaggtcttcgacttctagacggggtccgtagatcagca

SEQ ID NO: 13689 - DNA, 60 bp, Artificial Sequence
  Description of Artificial Sequence: Synthetic probe
gacctcgtctagaagtcgaagacctcatcgacaggatgatggacgacgttcaagtaagcg

SEQ ID NO: 13690 - DNA, 60 bp, Artificial Sequence
  Description of Artificial Sequence: Synthetic probe
acgacgttcaagtaagcggagacctaatgcccaaacccgatcccatccccgaagatgtgg

SEQ ID NO: 13691 - DNA, 60 bp, Artificial Sequence
  Description of Artificial Sequence: Synthetic probe
acgacgttcaagtaagcggagacctaatgcccacacccgatcctgtccccgaagaggtgg

SEQ ID NO: 13692 - DNA, 51 bp, Artificial Sequence
  Description of Artificial Sequence: Synthetic probe
aaaactccgacactgagcccatggagaccgaggctgggtgcgatacgcttt

SEQ ID NO: 13693 - DNA, 51 bp, Artificial Sequence
  Description of Artificial Sequence: Synthetic probe
aaaactccgacaccgagcccatggagaccgaggctgggtgcgatacgcttt

SEQ ID NO: 13694 - DNA, 51 bp, Artificial Sequence
  Description of Artificial Sequence: Synthetic probe
aaagcgtatcgcacccagcctcggtctccatgggctcggtgtcggagtttt

SEQ ID NO: 13695 - DNA, 51 bp, Artificial Sequence
  Description of Artificial Sequence: Synthetic probe
agagcgtatcgcacccagcctcggtctccatgggctcggtgtcggagtttt

SEQ ID NO: 13696 - DNA, 50 bp, Artificial Sequence
  Description of Artificial Sequence: Synthetic probe
aaaagacatatgcattttaaacacgcacttttaaagccaccaaggccacg

SEQ ID NO: 13697 - DNA, 60 bp, Artificial Sequence
  Description of Artificial Sequence: Synthetic probe
gtgtgacgaaggatggatgccaataaaaagacatatgcattttaaacacgcacttttaaa

SEQ ID NO: 13698 - DNA, 52 bp, Artificial Sequence
  Description of Artificial Sequence: Synthetic probe
ccggtcgccagcctcgtcaccattctcttcctagctccagcctctgtgcgat

SEQ ID NO: 13699 - DNA, 60 bp, Artificial Sequence
  Description of Artificial Sequence: Synthetic probe
gggacgatgctaatcaaatgtgtagcaatctaggtttcagtttaccatcaaaaggactac

SEQ ID NO: 13700 - DNA, 60 bp, Artificial Sequence
  Description of Artificial Sequence: Synthetic probe
atgggacgatgctaatcaaatgtgtagcaatctaggtttcagtttaccatcaaaaggact

SEQ ID NO: 13701 - DNA, 53 bp, Artificial Sequence
  Description of Artificial Sequence: Synthetic probe
agtgtttaacacttaacacaccgtctacatgggacgatgctaatcaaatgtgt

SEQ ID NO: 13702 - DNA, 60 bp, Artificial Sequence
  Description of Artificial Sequence: Synthetic probe
cccggaattccattgggtgataagtgtttaacacttaacacaccgtctacatgggacgat

SEQ ID NO: 13703 - DNA, 60 bp, Artificial Sequence
  Description of Artificial Sequence: Synthetic probe
tgcacagagaacaccctcatgactattcacatgtacaaaattcaacatgtcccggaattc

SEQ ID NO: 13704 - DNA, 60 bp, Artificial Sequence
  Description of Artificial Sequence: Synthetic probe
gagcataagaaatgcgattgtaaaccaccactcacgaccacgccaccgacaaccacaagg

SEQ ID NO: 13705 - DNA, 60 bp, Artificial Sequence
  Description of Artificial Sequence: Synthetic probe
gagcataagaaatgcgattgtaaaccaccactcacgaccacgccaccgacgaccacaagg

SEQ ID NO: 13706 - DNA, 57 bp, Artificial Sequence
  Description of Artificial Sequence: Synthetic probe
acgcggacagcacaaaaacatggttcgaagtgtttgaaaacagcgggtgcaagccaa

SEQ ID NO: 13707 - DNA, 59 bp, Artificial Sequence
  Description of Artificial Sequence: Synthetic probe
agcaccgtcatggggtcgtacagccaggggcccgcgtccgtgaacaggatggtgcagta

SEQ ID NO: 13708 - DNA, 57 bp, Artificial Sequence
  Description of Artificial Sequence: Synthetic probe
tcgagatcgaccgagtatgccgcgaaccaggcgccgttgcgatccatgaggcgtatt

SEQ ID NO: 13709 - DNA, 60 bp, Artificial Sequence
  Description of Artificial Sequence: Synthetic probe
cgattctgctgcgccatgatcacacccacggccacggacttccacatgaaccactctggc

SEQ ID NO: 13710 - DNA, 60 bp, Artificial Sequence
  Description of Artificial Sequence: Synthetic probe
ctgggcgtgtactccaccaacaagcacttggctgttgaccttatgaaccggtacaacacc

SEQ ID NO: 13711 - DNA, 60 bp, Artificial Sequence
  Description of Artificial Sequence: Synthetic probe
accatcgagaaccgcaagatctcgggcagcgtccgcgtgccgcagaactggtactacgac

SEQ ID NO: 13712 - DNA, 60 bp, Artificial Sequence
  Description of Artificial Sequence: Synthetic probe
cacgaacgcccagtggaccgcttccgcagccatggaaaacaacgaaggcaacgaacgcaa

SEQ ID NO: 13713 - DNA, 60 bp, Artificial Sequence
  Description of Artificial Sequence: Synthetic probe
tacaccagccacagaaccgactcctcaaccaaccgtagaaacaacaccatctgctccagc

SEQ ID NO: 13714 - DNA, 60 bp, Artificial Sequence
  Description of Artificial Sequence: Synthetic probe
tccggcttcagatgcgcgtgggtgtacgacacagtccgctctacgttcccagcaacatgt

SEQ ID NO: 13715 - DNA, 60 bp, Artificial Sequence
  Description of Artificial Sequence: Synthetic probe
accgtgcgcctccatcgagaagtactactgcgtgtgcaaacccgactgcgcgctcgagcc

SEQ ID NO: 13716 - DNA, 60 bp, Artificial Sequence
  Description of Artificial Sequence: Synthetic probe
aatgtggatgtggtcgcactccagtgacatgcccgcattgtcgtagcccgggaccaagtc

SEQ ID NO: 13717 - DNA, 60 bp, Artificial Sequence
  Description of Artificial Sequence: Synthetic probe
tcacggacgtacaggcggccggcatacgcaggtgcttctcgacgctcggcaaggctctga

SEQ ID NO: 13718 - DNA, 60 bp, Artificial Sequence
  Description of Artificial Sequence: Synthetic probe
gcgtgcatggacagcgcgagagtgacgaagtcgagaaggtccgcgtcgccgaagcgcacg

SEQ ID NO: 13719 - DNA, 60 bp, Artificial Sequence
  Description of Artificial Sequence: Synthetic probe
tcgaagttgtgcccgttgaaggtgaccacgaagtccagcggcatctcgagcaggcgcttg

SEQ ID NO: 13720 - DNA, 60 bp, Artificial Sequence
  Description of Artificial Sequence: Synthetic probe
agctgttgctcactcaatcgcccctcggagtaagggaacaagagcagtcaacgcacccac

SEQ ID NO: 13721 - DNA, 52 bp, Artificial Sequence
  Description of Artificial Sequence: Synthetic probe
catggacacctgggacccctgggtgctcgacaacccccagccgctcttcacg

SEQ ID NO: 13722 - DNA, 53 bp, Artificial Sequence
  Description of Artificial Sequence: Synthetic probe
cggacgtctacgtcgctgcggccggcataaacgtcagcgtgtccgcgatcaac

SEQ ID NO: 13723 - DNA, 60 bp, Artificial Sequence
  Description of Artificial Sequence: Synthetic probe
cgctgtgcgggagcgtgcactcgacgcaatggtatcggcggagcgcgcacttctgcatgg

SEQ ID NO: 13724 - DNA, 60 bp, Artificial Sequence
  Description of Artificial Sequence: Synthetic probe
tcgcgctgtgcgggagcgtgcactcgacgcaatggtatcggcggagcgcgcacttctgca

SEQ ID NO: 13725 - DNA, 53 bp, Artificial Sequence
  Description of Artificial Sequence: Synthetic probe
ggacccccgatgcgtgacctctgtaaacctgcacttcgagatcaaggacgcgt

SEQ ID NO: 13726 - DNA, 60 bp, Artificial Sequence
  Description of Artificial Sequence: Synthetic probe
aacgaaaacacagacactacgccgacgcccaccggcgccagtgtagacggaaagcgcaat

SEQ ID NO: 13727 - DNA, 60 bp, Artificial Sequence
  Description of Artificial Sequence: Synthetic probe
actttaaacccgaataacgaaaacacagacactacgccgacgcccaccggcgccagtgta

SEQ ID NO: 13728 - DNA, 60 bp, Artificial Sequence
  Description of Artificial Sequence: Synthetic probe
ccagcaacatgtgcatgatggacatagaagactctacggatgacatagaagagtccacgg

SEQ ID NO: 13729 - DNA, 60 bp, Artificial Sequence
  Description of Artificial Sequence: Synthetic probe
cccagcaacatgtgcatgatggacatagaagactctacggtggacatagaaggctccacg

SEQ ID NO: 13730 - DNA, 60 bp, Artificial Sequence
  Description of Artificial Sequence: Synthetic probe
tcgctctacgctcccagcaacatgtgcatgatggacatagaagactctacggtggacata

SEQ ID NO: 13731 - DNA, 60 bp, Artificial Sequence
  Description of Artificial Sequence: Synthetic probe
ctagcgctactgggagcgttcaccaacgcagcgcctttgttaagcaaccagcgtcttggc

SEQ ID NO: 13732 - DNA, 60 bp, Artificial Sequence
  Description of Artificial Sequence: Synthetic probe
gcggcgacattgacatcatgactcagtcttccgtgatacgcctcaaaagtcttaacccgg

SEQ ID NO: 13733 - DNA, 60 bp, Artificial Sequence
  Description of Artificial Sequence: Synthetic probe
tgcgtgctcccgcgcgaggtgctggagcgcgtgctgcggtgtctgtccacacaggacctg

SEQ ID NO: 13734 - DNA, 52 bp, Artificial Sequence
  Description of Artificial Sequence: Synthetic probe
gaggtggtgcgcgagctcatccgccacggctgctcgccgcgagcgcggaacc

SEQ ID NO: 13735 - DNA, 60 bp, Artificial Sequence
  Description of Artificial Sequence: Synthetic probe
ttcagtccgcgcgcccgcggccggaggtggtgcgcgagctcatccgccacggctgctcgc

SEQ ID NO: 13736 - DNA, 60 bp, Artificial Sequence
  Description of Artificial Sequence: Synthetic probe
agacacacacgctgttgacagtcgcctggactcgctgctgcaccagcacttgcagtccgc

SEQ ID NO: 13737 - DNA, 60 bp, Artificial Sequence
  Description of Artificial Sequence: Synthetic probe
agacgcacacgctgtcgacagtcgcctggactcgctgctgcaccagcactttcagtccgc

SEQ ID NO: 13738 - DNA, 60 bp, Artificial Sequence
  Description of Artificial Sequence: Synthetic probe
agacgcacacgcggtcgacagtcgcctggactcgctgctgcaccagcactttcagtccgc

SEQ ID NO: 13739 - DNA, 60 bp, Artificial Sequence
  Description of Artificial Sequence: Synthetic probe
ttcggcgcggacgtgaacgccgtggacctctgcggcatgtcgccgctggcggtgctcgtg

SEQ ID NO: 13740 - DNA, 50 bp, Artificial Sequence
  Description of Artificial Sequence: Synthetic probe
gcggactggaactgtgtggtagaaaccaggttctggtagctggacatgct

SEQ ID NO: 13741 - DNA, 60 bp, Artificial Sequence
  Description of Artificial Sequence: Synthetic probe
ccgaacagagccatgacgatggggtgtacgaatcccacggagtcggcagacttgaacgag

SEQ ID NO: 13742 - DNA, 60 bp, Artificial Sequence
  Description of Artificial Sequence: Synthetic probe
gccgaacagagccatgacgatggggtgtacgaatcccacggagtcggcagacttgaacga

SEQ ID NO: 13743 - DNA, 60 bp, Artificial Sequence
  Description of Artificial Sequence: Synthetic probe
gacgagagcttggaatgcgtccccacggaagaagtaaacgtgacgatggaactcctgggg

SEQ ID NO: 13744 - DNA, 50 bp, Artificial Sequence
  Description of Artificial Sequence: Synthetic probe
aaaatttcccgaagaacccacaactacccaacctccctcacctgtcacga

SEQ ID NO: 13745 - DNA, 60 bp, Artificial Sequence
  Description of Artificial Sequence: Synthetic probe
cctcggattcaacccattgcttaaagatggctacctgtacgtcaacgtctcgtcacgggc

SEQ ID NO: 13746 - DNA, 60 bp, Artificial Sequence
  Description of Artificial Sequence: Synthetic probe
aggagaaggcgtgagcataccgctaagttacataggcctcggattcaacccatcgcttgc

SEQ ID NO: 13747 - DNA, 60 bp, Artificial Sequence
  Description of Artificial Sequence: Synthetic probe
cgtgtccgtggcactaatgggagaaggcgtgagcataccgctaagttacataggcctcgg

SEQ ID NO: 13748 - DNA, 60 bp, Artificial Sequence
  Description of Artificial Sequence: Synthetic probe
tgtactactggccgctgatcacggacgcgttgctgcgcgctgctatcaaccgcagcgtgc

SEQ ID NO: 13749 - DNA, 60 bp, Artificial Sequence
  Description of Artificial Sequence: Synthetic probe
cgaggtgtactactggccgctgatcacggacgcgttgctgcgcgctgctatcaaccgcag

SEQ ID NO: 13750 - DNA, 54 bp, Artificial Sequence
  Description of Artificial Sequence: Synthetic probe
actcgaacgacgtttgctgcgaggacggaaacccgccccgctggttcgtagagt

SEQ ID NO: 13751 - DNA, 60 bp, Artificial Sequence
  Description of Artificial Sequence: Synthetic probe
actcgaacgacgtttgctgcgaggacggaaacccgccccgctggttcgtagagtgcgcgc

SEQ ID NO: 13752 - DNA, 60 bp, Artificial Sequence
  Description of Artificial Sequence: Synthetic probe
gcccgcaaggcgcggacgccgctctacttcgcggggcatggctccaaccatccagatcgt

SEQ ID NO: 13753 - DNA, 60 bp, Artificial Sequence
  Description of Artificial Sequence: Synthetic probe
caggacgcctgcagcgcccgcaaggcgcggacgccgctctacttcgcggggcatggctcc

SEQ ID NO: 13754 - DNA, 60 bp, Artificial Sequence
  Description of Artificial Sequence: Synthetic probe
tttctccagcacgttctacggccaaaccgccggttcgctccagcgaagctgcacatggac

SEQ ID NO: 13755 - DNA, 60 bp, Artificial Sequence
  Description of Artificial Sequence: Synthetic probe
tccgcgatcaactgcggcttcttcagcatgcgccaggtagagacaacgtacgacacggca

SEQ ID NO: 13756 - DNA, 51 bp, Artificial Sequence
  Description of Artificial Sequence: Synthetic probe
tttggatgcgcatcgaccggaacgtgaccgctgcggataacaactcggcct

SEQ ID NO: 13757 - DNA, 60 bp, Artificial Sequence
  Description of Artificial Sequence: Synthetic probe
gtgttcctggcggtgttcgcgctgtgcggaagcgtgcactcggcgcaatggatcggcgag

SEQ ID NO: 13758 - DNA, 60 bp, Artificial Sequence
  Description of Artificial Sequence: Synthetic probe
atggcgtgcctccgggtgttcctggcggtgttcgcgctgtgcggaagcgtgcactcggcg

SEQ ID NO: 13759 - DNA, 60 bp, Artificial Sequence
  Description of Artificial Sequence: Synthetic probe
gatgtggcgcagtgctccccggaagacatgtcaaacatgctagacgatttcctcgaagat

SEQ ID NO: 13760 - DNA, 60 bp, Artificial Sequence
  Description of Artificial Sequence: Synthetic probe
ggatgggtctggctcacagacaggcccgagtccgtcatggcggcgcgaacgctgtgcagc

SEQ ID NO: 13761 - DNA, 60 bp, Artificial Sequence
  Description of Artificial Sequence: Synthetic probe
tccgtagatgatcaccagcggatgagtctggctcacagacaggcccgagtccgtcatggc

SEQ ID NO: 13762 - DNA, 60 bp, Artificial Sequence
  Description of Artificial Sequence: Synthetic probe
tcgatccgcgtccgtagatgatcaccagcggatgagtctggctcacagacaggcccgagt

SEQ ID NO: 13763 - DNA, 60 bp, Artificial Sequence
  Description of Artificial Sequence: Synthetic probe
gaagatcgctggatgagctcatgtccttgaagtgcgcggactggaactgtgtggtggaaa

SEQ ID NO: 13764 - DNA, 60 bp, Artificial Sequence
  Description of Artificial Sequence: Synthetic probe
gaagatcgctggatgagctcatgtccttgaagtgtgcggactggaactgtgtggtagaaa

SEQ ID NO: 13765 - DNA, 60 bp, Artificial Sequence
  Description of Artificial Sequence: Synthetic probe
acttgaacgagaatagaagatcgctggatgagctcatgtccttgaagtgcgcggactgga

SEQ ID NO: 13766 - DNA, 60 bp, Artificial Sequence
  Description of Artificial Sequence: Synthetic probe
acttgaacgagaatagaagatcgctggatgagctcatgtccttgaagtgtgcggactgga

SEQ ID NO: 13767 - DNA, 60 bp, Artificial Sequence
  Description of Artificial Sequence: Synthetic probe
aaagactgtcgccggtcacgaaggcggtctcgatggcgggcagcttcacgccgaacagag

SEQ ID NO: 13768 - DNA, 60 bp, Artificial Sequence
  Description of Artificial Sequence: Synthetic probe
aaagactgtctccggtcacgaaggcggtctcgatggcgggcagcttcacgccgaacagag

SEQ ID NO: 13769 - DNA, 60 bp, Artificial Sequence
  Description of Artificial Sequence: Synthetic probe
gaaagactgtctccggtcacgaaggcggtctcgatggcgggcagcttcacgccgaacaga

SEQ ID NO: 13770 - DNA, 60 bp, Artificial Sequence
  Description of Artificial Sequence: Synthetic probe
gaaagactgtcgccggtcacgaaggcggtctcgatggcgggcagcttcacgccgaacaga

SEQ ID NO: 13771 - DNA, 60 bp, Artificial Sequence
  Description of Artificial Sequence: Synthetic probe
ttgacctctcgctactgtctatggtgccagtggtgcgctctggcggcgaggtgtactact

SEQ ID NO: 13772 - DNA, 60 bp, Artificial Sequence
  Description of Artificial Sequence: Synthetic probe
agcattgacctctcgctactgtctatggtgccagtggtgcgctctggcggcgaggtgtac

SEQ ID NO: 13773 - DNA, 60 bp, Artificial Sequence
  Description of Artificial Sequence: Synthetic probe
ctgtgcgggagcgtgcactcggcgcaatggatcggcgagcgcgacttctgcacggcccac

SEQ ID NO: 13774 - DNA, 60 bp, Artificial Sequence
  Description of Artificial Sequence: Synthetic probe
agcggttcatgaggtccgcggccaggtgcttgttgggtggagtagagaccgcaggttctt

SEQ ID NO: 13775 - DNA, 60 bp, Artificial Sequence
  Description of Artificial Sequence: Synthetic probe
ggctctactccaccaacaagcacctggccgcggacctcatgaaccgctacaacaccttct

SEQ ID NO: 13776 - DNA, 60 bp, Artificial Sequence
  Description of Artificial Sequence: Synthetic probe
atcgctctcggccgcgcgcagcctcaacgacttcggcgtgggcagcgtggacatgtccgt

SEQ ID NO: 13777 - DNA, 60 bp, Artificial Sequence
  Description of Artificial Sequence: Synthetic probe
ctcgctctcggccgcgcgcagcctcaacgacttcggcgtgggcagcgtggacatgtccgt

SEQ ID NO: 13778 - DNA, 60 bp, Artificial Sequence
  Description of Artificial Sequence: Synthetic probe
gcgcagcctcaacgacttcggcgtgggcagcgtggacatgtccgtgcgcaagttcgtgat

SEQ ID NO: 13779 - DNA, 60 bp, Artificial Sequence
  Description of Artificial Sequence: Synthetic probe
gcgcagcctcaacgacttcggcgtgggcagcgtggacatgtccgttcgcaagttcgtgat

SEQ ID NO: 13780 - DNA, 60 bp, Artificial Sequence
  Description of Artificial Sequence: Synthetic probe
tatcacgaacttgcgcacggacatgtccacgctgcccacgccgaagtcgttgaggctgcg

SEQ ID NO: 13781 - DNA, 60 bp, Artificial Sequence
  Description of Artificial Sequence: Synthetic probe
ggtatcacgaacttgcgcacggacatgtccacgctgcccacgccgaagtcgttgaggctg

SEQ ID NO: 13782 - DNA, 60 bp, Artificial Sequence
  Description of Artificial Sequence: Synthetic probe
gacggcgccgaagggcttattagcagcagtttttgtagcgggacgtttctgggtttcttg

SEQ ID NO: 13783 - DNA, 58 bp, Artificial Sequence
  Description of Artificial Sequence: Synthetic probe
cactcaacatctggaattcgtggagcatacaaagtgcgactgtcagccgcgcggcgga

SEQ ID NO: 13784 - DNA, 60 bp, Artificial Sequence
  Description of Artificial Sequence: Synthetic probe
cactcaacatctggaattcgtggagcatacaaagtgcgactgtcagccgcgcggcggaca

SEQ ID NO: 13785 - DNA, 60 bp, Artificial Sequence
  Description of Artificial Sequence: Synthetic probe
ggtgtaggtgtgtccagcactggatctagtgtgagcactcaacatctggaattcgtggag

SEQ ID NO: 13786 - DNA, 60 bp, Artificial Sequence
  Description of Artificial Sequence: Synthetic probe
acgatggaattcatgggtgtaggtgtgtccagcactggatctagtgtgagcactcaacat

SEQ ID NO: 13787 - DNA, 60 bp, Artificial Sequence
  Description of Artificial Sequence: Synthetic probe
ggcgtcggcaacctgctcggcagcttctggctctcggacgcggggcagtggtacgtgggc

SEQ ID NO: 13788 - DNA, 60 bp, Artificial Sequence
  Description of Artificial Sequence: Synthetic probe
tgcccacgtaccagttcccggtgtccgagagccagaagctgccgagcaggttgccgacgc

SEQ ID NO: 13789 - DNA, 60 bp, Artificial Sequence
  Description of Artificial Sequence: Synthetic probe
atcgaccggaacgtgaccgccgcggacaacagctcggcctgcgcgctggcgatagaaaca

SEQ ID NO: 13790 - DNA, 60 bp, Artificial Sequence
  Description of Artificial Sequence: Synthetic probe
cgcatcgaccggaacgtgaccgccgcggacaacagctcggcctgcgcgctggcgatagaa

SEQ ID NO: 13791 - DNA, 60 bp, Artificial Sequence
  Description of Artificial Sequence: Synthetic probe
cgacgagagcttggaatgcgtccccacggaagaggcaaacgtgacgatggaattcatggg

SEQ ID NO: 13792 - DNA, 60 bp, Artificial Sequence
  Description of Artificial Sequence: Synthetic probe
gctgcaacgacgagagcttggaatgcgtccccacggaagaagtaaacgtgacgatggaac

SEQ ID NO: 13793 - DNA, 60 bp, Artificial Sequence
  Description of Artificial Sequence: Synthetic probe
gctgcaacgacgagagcttggaatgcgtccccacggaagaggcaaacgtgacgatgcaac

SEQ ID NO: 13794 - DNA, 60 bp, Artificial Sequence
  Description of Artificial Sequence: Synthetic probe
gctgcaacgacgagagcttggaatgcgtccccacggaagaggcaaacgtgacgatggaat

SEQ ID NO: 13795 - DNA, 60 bp, Artificial Sequence
  Description of Artificial Sequence: Synthetic probe
ctcgaaacacggccctagggccttccagcagtttctgggacaccagctgactgggttatc

SEQ ID NO: 13796 - DNA, 60 bp, Artificial Sequence
  Description of Artificial Sequence: Synthetic probe
tccagatggctcgaaacacggccctagggccttccagcagtttctgggacaccagctgac

SEQ ID NO: 13797 - DNA, 60 bp, Artificial Sequence
  Description of Artificial Sequence: Synthetic probe
gagccacggggaagaaggcgccacacgaacatttcgggaacaagtgtcttctgagtgggg

SEQ ID NO: 13798 - DNA, 60 bp, Artificial Sequence
  Description of Artificial Sequence: Synthetic probe
ttgagccacggggaagaaggcgccacacgaacatttcgggaacaagtgtcttctgagtgg

SEQ ID NO: 13799 - DNA, 60 bp, Artificial Sequence
  Description of Artificial Sequence: Synthetic probe
tcggagagaatgtctcacagcgcataggggcagaattgagccacggggaagaaggcgcca

SEQ ID NO: 13800 - DNA, 60 bp, Artificial Sequence
  Description of Artificial Sequence: Synthetic probe
tcatcttaagtgaagtcggagagaatgtctcacagcgcataggggcagaattgagccacg

SEQ ID NO: 13801 - DNA, 60 bp, Artificial Sequence
  Description of Artificial Sequence: Synthetic probe
gaaagcatggtctccagacctccacacatcacagtacaggagtcacgaaaagcctcacgc

SEQ ID NO: 13802 - DNA, 60 bp, Artificial Sequence
  Description of Artificial Sequence: Synthetic probe
atgcacaagtctaggaaagcatggtctccagacctccacacatcacagtacaggagtcac

SEQ ID NO: 13803 - DNA, 60 bp, Artificial Sequence
  Description of Artificial Sequence: Synthetic probe
gagcgtggggtactcttctgttcccgcactgtacaaatgcacaagtctaggaaagcatgg

SEQ ID NO: 13804 - DNA, 60 bp, Artificial Sequence
  Description of Artificial Sequence: Synthetic probe
gcgttgtctcagatgagcgtggggtactcttctgttcccgcactgtacaaatgcacaagt

SEQ ID NO: 13805 - DNA, 60 bp, Artificial Sequence
  Description of Artificial Sequence: Synthetic probe
tgctcggcagcttctggctctcggacgcggggcagtggtacgtgggcagcgcctcgctca

SEQ ID NO: 13806 - DNA, 52 bp, Artificial Sequence
  Description of Artificial Sequence: Synthetic probe
gcgccgcgtgtatgcgttcatgcgacgctttggcattcgcgttaaggacctg

SEQ ID NO: 13807 - DNA, 60 bp, Artificial Sequence
  Description of Artificial Sequence: Synthetic probe
cagcgagcgccgcgtgtatgcgttcatgcgacgctttggcattcgcgttaaggacttacg

SEQ ID NO: 13808 - DNA, 60 bp, Artificial Sequence
  Description of Artificial Sequence: Synthetic probe
ctgctatttaaccggctcagcgagcgccgcgtgtatgcgttcatgcgacgctttggcatt

SEQ ID NO: 13809 - DNA, 60 bp, Artificial Sequence
  Description of Artificial Sequence: Synthetic probe
ctaatcctggaatgcaaaacatgcaatttgtagagcacttacattgtgattgtagaccca

SEQ ID NO: 13810 - DNA, 60 bp, Artificial Sequence
  Description of Artificial Sequence: Synthetic probe
caagtactgattctaatcctggaatgcaaaacatgcaatttgtagagcacttacattgtg

SEQ ID NO: 13811 - DNA, 60 bp, Artificial Sequence
  Description of Artificial Sequence: Synthetic probe
caagtactggttctaatcctggaatgcaaaacatgcaatttgtagagcacttacgttgtg

SEQ ID NO: 13812 - DNA, 60 bp, Artificial Sequence
  Description of Artificial Sequence: Synthetic probe
atgaagttactatcgtttaaacttagcgttataataactgtgtgtttacatcagtattgt

SEQ ID NO: 13813 - DNA, 60 bp, Artificial Sequence
  Description of Artificial Sequence: Synthetic probe
tcccggccgggtaccgcgtaacttgcgcacggacatgtccacgctgccgacgccaaagtc

SEQ ID NO: 13814 - DNA, 60 bp, Artificial Sequence
  Description of Artificial Sequence: Synthetic probe
ttcccggccgggtaccgcgaacttgcgcacggacatgtccacgctgccgacgccaaagtc

SEQ ID NO: 13815 - DNA, 60 bp, Artificial Sequence
  Description of Artificial Sequence: Synthetic probe
acagtatgctactcacacagtcgctcctcgacgacttcaaaggctacctcgggtgtcagg

SEQ ID NO: 13816 - DNA, 60 bp, Artificial Sequence
  Description of Artificial Sequence: Synthetic probe
acagtatgctactcacacagtcgctcctcgacgacttcaaaggctacctcgggtgccagg

SEQ ID NO: 13817 - DNA, 60 bp, Artificial Sequence
  Description of Artificial Sequence: Synthetic probe
gaacagtatgctactcacacagtcgctcctcgacgacttcaaaggctacctcgggtgtca

SEQ ID NO: 13818 - DNA, 60 bp, Artificial Sequence
  Description of Artificial Sequence: Synthetic probe
caactgaacagtatgctactcacacagtcgctcctcgacgacttcaaaggctacctcggg

SEQ ID NO: 13819 - DNA, 60 bp, Artificial Sequence
  Description of Artificial Sequence: Synthetic probe
ccaactgaacagtatgctactcacacagtcgctcctcgacgacttcaaaggctacctcgg

SEQ ID NO: 13820 - DNA, 55 bp, Artificial Sequence
  Description of Artificial Sequence: Synthetic probe
aaaactttcttccagatgaaagaccaactgaacagtatgctactcacacagtcgc

SEQ ID NO: 13821 - DNA, 54 bp, Artificial Sequence
  Description of Artificial Sequence: Synthetic probe
aaaactttcttccagatgaaagaccaactgaacagtatgctactcacacagtcg

SEQ ID NO: 13822 - DNA, 60 bp, Artificial Sequence
  Description of Artificial Sequence: Synthetic probe
agggccgcgttcggaaaggtaaaaactttcttccagatgaaagaccaactgaacagtatg

SEQ ID NO: 13823 - DNA, 57 bp, Artificial Sequence
  Description of Artificial Sequence: Synthetic probe
gctgtgcagcaaatcgaacagctccgagcggtctctgttgtgaatacccaccttcga

SEQ ID NO: 13824 - DNA, 60 bp, Artificial Sequence
  Description of Artificial Sequence: Synthetic probe
tcacagacaggcccgagtccgtcatggcggcgcgaacgctgtgcagcaaatcgaacagct

SEQ ID NO: 13825 - DNA, 60 bp, Artificial Sequence
  Description of Artificial Sequence: Synthetic probe
ttgttcacgcgagtcgatccgcgtccgtagatgatcaccagcggatgggtctggctcaca

SEQ ID NO: 13826 - DNA, 60 bp, Artificial Sequence
  Description of Artificial Sequence: Synthetic probe
tcatctgcttgttcacgcgagtcgatccgcgtccgtagatgatcaccagcggatgggtct

SEQ ID NO: 13827 - DNA, 50 bp, Artificial Sequence
  Description of Artificial Sequence: Synthetic probe
gcggactggaactgtgtggtggaaaccaggttctggtagctggacatgct

SEQ ID NO: 13828 - DNA, 60 bp, Artificial Sequence
  Description of Artificial Sequence: Synthetic probe
ccgaacagagccatgacgatggggtgcacgaatcccacggagtcggtagacttgaacgag

SEQ ID NO: 13829 - DNA, 60 bp, Artificial Sequence
  Description of Artificial Sequence: Synthetic probe
gccgaacagagccatgacgatggggtgcacgaatcccacggagtcggtagacttgaacga

SEQ ID NO: 13830 - DNA, 60 bp, Artificial Sequence
  Description of Artificial Sequence: Synthetic probe
gtccgcgatcaactgcggcttccttaacatgcgccaggtagaaacaacgtacaacacggc

SEQ ID NO: 13831 - DNA, 60 bp, Artificial Sequence
  Description of Artificial Sequence: Synthetic probe
tgtgcgggagcgtgcactcggcgcaatggtatcggcgagcgcgacttctgcacggcccac

SEQ ID NO: 13832 - DNA, 60 bp, Artificial Sequence
  Description of Artificial Sequence: Synthetic probe
tcgcacacatgaaggacacaattggtttgttaatccggacaatgaaggacaaattgtttt

SEQ ID NO: 13833 - DNA, 60 bp, Artificial Sequence
  Description of Artificial Sequence: Synthetic probe
tttcacctgcaatgaaggacgatgcgcggtcgcaattggcctgcgaccgacatcgcacac

SEQ ID NO: 13834 - DNA, 60 bp, Artificial Sequence
  Description of Artificial Sequence: Synthetic probe
gcctcagccaaaacgccactataccagccagaggatctcccggtgccgcaggattagact

SEQ ID NO: 13835 - DNA, 60 bp, Artificial Sequence
  Description of Artificial Sequence: Synthetic probe
aatatgcgaacgcatatcgtgcccagcagttcaagaggttaaccgcttggacgacaccta

SEQ ID NO: 13836 - DNA, 50 bp, Artificial Sequence
  Description of Artificial Sequence: Synthetic probe
ttagactagaacacctctggtctaaacaacatgtccgatcttagaacaga

SEQ ID NO: 13837 - DNA, 60 bp, Artificial Sequence
  Description of Artificial Sequence: Synthetic probe
cggacctcgtaattgtttagactagaacacctctggtctaaacaacatgtccgatcttag

SEQ ID NO: 13838 - DNA, 60 bp, Artificial Sequence
  Description of Artificial Sequence: Synthetic probe
gagattagcgttctacagcacaccacgtgcgaatacggacctcgtgattgtttagactgg

SEQ ID NO: 13839 - DNA, 60 bp, Artificial Sequence
  Description of Artificial Sequence: Synthetic probe
gatcagtgcataagagagattagcattctacagcacaccacgtgcgaatacggacctcgt

SEQ ID NO: 13840 - DNA, 56 bp, Artificial Sequence
  Description of Artificial Sequence: Synthetic probe
gctgcttggggtccaccaccatggaacttaaagtgttgtacctgttcatgaaggcc

SEQ ID NO: 13841 - DNA, 60 bp, Artificial Sequence
  Description of Artificial Sequence: Synthetic probe
cgccgcccgaatggttcatgtggaaaccctggctgtgggcgttatcatggcgcaacagaa

SEQ ID NO: 13842 - DNA, 60 bp, Artificial Sequence
  Description of Artificial Sequence: Synthetic probe
ccgccgcccgaatggttcatgtggaaaccctggctgtgggcgttatcatggcgcaacaga

SEQ ID NO: 13843 - DNA, 60 bp, Artificial Sequence
  Description of Artificial Sequence: Synthetic probe
gcgtgcggtaaaaacccaagaagcgctctggtgagtctgaaaaaaaaacgccgccgcccg

SEQ ID NO: 13844 - DNA, 60 bp, Artificial Sequence
  Description of Artificial Sequence: Synthetic probe
ggtgttttccgcggcgtccatgccgtgcaacacccaggcttcctccagcgtgcggtaaaa

SEQ ID NO: 13845 - DNA, 60 bp, Artificial Sequence
  Description of Artificial Sequence: Synthetic probe
aatggtgttttccgcggcgtccatgccgtgcaacacccaggcttcctccagcgtgcggta

SEQ ID NO: 13846 - DNA, 60 bp, Artificial Sequence
  Description of Artificial Sequence: Synthetic probe
acctcgctgcccgagcgcaccactgggaccctaaacagcagaaaaaggtcaatggtgttt

SEQ ID NO: 13847 - DNA, 60 bp, Artificial Sequence
  Description of Artificial Sequence: Synthetic probe
tgtatgtgcggcgcgcaacaacccgtccatgatcagcggccaataatacacctcgctgcc

SEQ ID NO: 13848 - DNA, 60 bp, Artificial Sequence
  Description of Artificial Sequence: Synthetic probe
ttgtatgtgcggcgcgcaacaacccgtccatgatcagcggccaataatacacctcgctgc

SEQ ID NO: 13849 - DNA, 60 bp, Artificial Sequence
  Description of Artificial Sequence: Synthetic probe
aaagttgtccaccgcacgcaactgtgaaccacacgacagtgggtccgcgcttacgccact

SEQ ID NO: 13850 - DNA, 60 bp, Artificial Sequence
  Description of Artificial Sequence: Synthetic probe
tatgccccactccaaagttgtccaccgcacgcaactgtgaaccacacgacagtgggtccg

SEQ ID NO: 13851 - DNA, 60 bp, Artificial Sequence
  Description of Artificial Sequence: Synthetic probe
acgtggctggcacgcttctggcccggcgccatatacttcctcaccacgccgctcttctcc

SEQ ID NO: 13852 - DNA, 60 bp, Artificial Sequence
  Description of Artificial Sequence: Synthetic probe
tggtcgctgctcgccacgtggctggcacgcttctggcccggcgccatatacttcctcacc

SEQ ID NO: 13853 - DNA, 60 bp, Artificial Sequence
  Description of Artificial Sequence: Synthetic probe
atcaacgtcggcggcatgaagaagctatacgaggcgatcatcaaggagggaggggtgcgc

SEQ ID NO: 13854 - DNA, 60 bp, Artificial Sequence
  Description of Artificial Sequence: Synthetic probe
ccaagccatctcctcccgcgccgcaccccaagggcgaccacgtgctcaaggcggtggaat

SEQ ID NO: 13855 - DNA, 60 bp, Artificial Sequence
  Description of Artificial Sequence: Synthetic probe
ggccgctatcaactgcggcttcttcaacaggcgccaagtagagacgacgtacaacacggc

SEQ ID NO: 13856 - DNA, 60 bp, Artificial Sequence
  Description of Artificial Sequence: Synthetic probe
ataaacgtcagcgtggccgctatcaactgcggcttcttcaacaggcgccaagtagagacg

SEQ ID NO: 13857 - DNA, 52 bp, Artificial Sequence
  Description of Artificial Sequence: Synthetic probe
gcgcgcgggcgtaagtaaacaccgccgtagcaacttcttacgcggtacgtct

SEQ ID NO: 13858 - DNA, 50 bp, Artificial Sequence
  Description of Artificial Sequence: Synthetic probe
ctgggagcgctaattgctgcactgtctacgggagaaggacttcttttccc

SEQ ID NO: 13859 - DNA, 60 bp, Artificial Sequence
  Description of Artificial Sequence: Synthetic probe
ctgggagcgctaattgctgcactgtctacgggagaaggacttcttttcccggatgcagag

SEQ ID NO: 13860 - DNA, 60 bp, Artificial Sequence
  Description of Artificial Sequence: Synthetic probe
ctctgtggcgttcattatgtgcgggattgtgtactcgagctctatggatctgggagcgct

SEQ ID NO: 13861 - DNA, 60 bp, Artificial Sequence
  Description of Artificial Sequence: Synthetic probe
tctctgtggcgttcattatgtgcgggattgtgtactcgagctctatggatctgggagcgc

SEQ ID NO: 13862 - DNA, 56 bp, Artificial Sequence
  Description of Artificial Sequence: Synthetic probe
ctagacgcctacatcatcaacgtcggcggcatgaagaagctatacgacgcgatcat

SEQ ID NO: 13863 - DNA, 60 bp, Artificial Sequence
  Description of Artificial Sequence: Synthetic probe
ctagacgcctacatcatcaacgtcggcggcatgaagaagctatacgaggcgatcatcaag

SEQ ID NO: 13864 - DNA, 60 bp, Artificial Sequence
  Description of Artificial Sequence: Synthetic probe
agagcttcttcatgccgccgacgttgatgatgtaggcgtctagcgagacgtcgtacccgc

SEQ ID NO: 13865 - DNA, 60 bp, Artificial Sequence
  Description of Artificial Sequence: Synthetic probe
agctcatggtctaccccggcgggtacgacgtctcgctagacgcctacatcatcaacgtcg

SEQ ID NO: 13866 - DNA, 60 bp, Artificial Sequence
  Description of Artificial Sequence: Synthetic probe
agagctcatggtctaccccggcgggtacgacgtctcgctagacgcctacatcatcaacgt

SEQ ID NO: 13867 - DNA, 60 bp, Artificial Sequence
  Description of Artificial Sequence: Synthetic probe
tgggcttctaccgcacgctcgacgaggacctcgtgctgcaccgcatcgagaacgcgaaca

SEQ ID NO: 13868 - DNA, 60 bp, Artificial Sequence
  Description of Artificial Sequence: Synthetic probe
tgggcttctaccgcacgctcgacgaggacctcgtgctgcaccgcatcgagaacgccaaga

SEQ ID NO: 13869 - DNA, 60 bp, Artificial Sequence
  Description of Artificial Sequence: Synthetic probe
tgggcttctaccgcacactcgacgaggacctcgtgctgcaccgcatcgagaacgcgaaga

SEQ ID NO: 13870 - DNA, 60 bp, Artificial Sequence
  Description of Artificial Sequence: Synthetic probe
tgggcttctaccgcacactcgacgaggacctcgtgctgcaccgcatcgagaacgccaaga

SEQ ID NO: 13871 - DNA, 60 bp, Artificial Sequence
  Description of Artificial Sequence: Synthetic probe
cactcgacgaggacctcgtgctgcaccgcatcgagaacgcgaagaacaacatcgacctct

SEQ ID NO: 13872 - DNA, 60 bp, Artificial Sequence
  Description of Artificial Sequence: Synthetic probe
cactcgacgaggacctcgtgctgcaccgcatcgagaacgccaagaacagcatcgacctct

SEQ ID NO: 13873 - DNA, 60 bp, Artificial Sequence
  Description of Artificial Sequence: Synthetic probe
cgctcgacgaggacctcgtgctgcaccgcatcgagaacgccaagaacagcatcgacctct

SEQ ID NO: 13874 - DNA, 60 bp, Artificial Sequence
  Description of Artificial Sequence: Synthetic probe
cgctcgacgaggacctcgtgctgcaccgcatcgagaacgcgaacaacagcatcgacctct

SEQ ID NO: 13875 - DNA, 60 bp, Artificial Sequence
  Description of Artificial Sequence: Synthetic probe
gctgaacgcggacagcacgaaaacatggtccgaagtgtttgaaaacagcgggtgcaagcc

SEQ ID NO: 13876 - DNA, 60 bp, Artificial Sequence
  Description of Artificial Sequence: Synthetic probe
gcaccagtatctgctgaacgcggacagcacgaaaacatggtccgaggtgtttgaaagcag

SEQ ID NO: 13877 - DNA, 60 bp, Artificial Sequence
  Description of Artificial Sequence: Synthetic probe
ctttggcattcgcgttaaggacctgcgcacgtacggcgttaactacaccttcttgtacaa

SEQ ID NO: 13878 - DNA, 60 bp, Artificial Sequence
  Description of Artificial Sequence: Synthetic probe
gcagagggcggcgaggaagtccgcgtaaagtttgtgggcaaagacaaggttgctcacgag

SEQ ID NO: 13879 - DNA, 60 bp, Artificial Sequence
  Description of Artificial Sequence: Synthetic probe
ggcagagggcggcgaggaagtccgcgtaaagtttgtgggcaaagacaaggttgctcacga

SEQ ID NO: 13880 - DNA, 60 bp, Artificial Sequence
  Description of Artificial Sequence: Synthetic probe
tcatggagacgagcttcttcatccgcattggcaagtcgcggtacgaaaaagagagcggca

SEQ ID NO: 13881 - DNA, 60 bp, Artificial Sequence
  Description of Artificial Sequence: Synthetic probe
aggtgatgccgcaggcggaaaatcacgggccggacatcaaagagcacgttaactcactgg

SEQ ID NO: 13882 - DNA, 60 bp, Artificial Sequence
  Description of Artificial Sequence: Synthetic probe
gaggtgatgccgcaggcggaaaatcacgggccggacatcaaagagcacgttaactcgctg

SEQ ID NO: 13883 - DNA, 60 bp, Artificial Sequence
  Description of Artificial Sequence: Synthetic probe
tcaagaagacggacggcagctaccgcacgcacccgcactactcctggatgcagaacatct

SEQ ID NO: 13884 - DNA, 60 bp, Artificial Sequence
  Description of Artificial Sequence: Synthetic probe
gttcaagaagacggacggcagctaccgcacgcacccgcactactcctggatgcagaacat

SEQ ID NO: 13885 - DNA, 60 bp, Artificial Sequence
  Description of Artificial Sequence: Synthetic probe
gcgcgtcacgcagcctgtgccaccgcactaattatactcatcgacaactgcggcatcagc

SEQ ID NO: 13886 - DNA, 60 bp, Artificial Sequence
  Description of Artificial Sequence: Synthetic probe
ctccggtggacaggaccactgtcccaacttcacctgtaccatcatggtgtcgggcaaggt

SEQ ID NO: 13887 - DNA, 60 bp, Artificial Sequence
  Description of Artificial Sequence: Synthetic probe
actcgctccggtggacaggaccactgtcccaacttcacctgtaccatcatggtgtcgggc

SEQ ID NO: 13888 - DNA, 60 bp, Artificial Sequence
  Description of Artificial Sequence: Synthetic probe
gatgcgataccatcttcggcggcgagattgacgtattgactcagtcatgcgtggtgcgtc

SEQ ID NO: 13889 - DNA, 60 bp, Artificial Sequence
  Description of Artificial Sequence: Synthetic probe
tgaggaggacgacacagacaccgagcccatggagaccgaggcgggatgcgataccatctt

SEQ ID NO: 13890 - DNA, 60 bp, Artificial Sequence
  Description of Artificial Sequence: Synthetic probe
gtccgttgaggaggacgacacagacaccgagcccatggagaccgaggcgggatgcgatac

SEQ ID NO: 13891 - DNA, 60 bp, Artificial Sequence
  Description of Artificial Sequence: Synthetic probe
tccgccacgctggtacgcggagtgcgagcccgccacgtccgttgaggaggacgacacaga

SEQ ID NO: 13892 - DNA, 60 bp, Artificial Sequence
  Description of Artificial Sequence: Synthetic probe
gtcgaggacggacatccgccacgctggtacgcggagtgcgagcccgccacgtccgttgag

SEQ ID NO: 13893 - DNA, 60 bp, Artificial Sequence
  Description of Artificial Sequence: Synthetic probe
gcgcttccctgatcctcgatctcctcaagaagtgtggcgtcaaactccccgccaaggaca

SEQ ID NO: 13894 - DNA, 60 bp, Artificial Sequence
  Description of Artificial Sequence: Synthetic probe
atggcctgcgagtgcgcttccctgatcctcgatctcctcaagaagtgtggcgtcaaactc

SEQ ID NO: 13895 - DNA, 60 bp, Artificial Sequence
  Description of Artificial Sequence: Synthetic probe
tgatctgccaccgcgtgtacacctacgggcgctacttcgaggcgctggccatggacgagc

SEQ ID NO: 13896 - DNA, 60 bp, Artificial Sequence
  Description of Artificial Sequence: Synthetic probe
cccatcgcttgcagatggctacctgtacgtcaacgtctcgtcacgagctccttgggttca

SEQ ID NO: 13897 - DNA, 60 bp, Artificial Sequence
  Description of Artificial Sequence: Synthetic probe
tagagaccacgtacaacacggcacgccggcagatgtacgtgtacatggactcctgggacc

SEQ ID NO: 13898 - DNA, 60 bp, Artificial Sequence
  Description of Artificial Sequence: Synthetic probe
tagagacgacgtacaacacggcacgccggcagatgtacgtgtacatggactcctgggacc

SEQ ID NO: 13899 - DNA, 60 bp, Artificial Sequence
  Description of Artificial Sequence: Synthetic probe
ggtagagacaacgtacgacacggcacgccggcagatgtacgtgtacatggacacctggga

SEQ ID NO: 13900 - DNA, 60 bp, Artificial Sequence
  Description of Artificial Sequence: Synthetic probe
ggtagaaacaacgtacaacacggcacgccggcagatgtacgtgtacatggactcctgggg

SEQ ID NO: 13901 - DNA, 56 bp, Artificial Sequence
  Description of Artificial Sequence: Synthetic probe
ggtagagacaacgtacgacacggcacgccggcagatgtacgtgtacatggacacct

SEQ ID NO: 13902 - DNA, 60 bp, Artificial Sequence
  Description of Artificial Sequence: Synthetic probe
ttcgtggtacccggccgggacgacgccgcgaacaacactaagctgctcatcgtggacgac

SEQ ID NO: 13903 - DNA, 54 bp, Artificial Sequence
  Description of Artificial Sequence: Synthetic probe
gcgaaatccgtcacacagtcggccatcaacgacttgcgtcgtctgctcacgggg

SEQ ID NO: 13904 - DNA, 60 bp, Artificial Sequence
  Description of Artificial Sequence: Synthetic probe
ggcagagtcgctgcgagcgaccacgcccgtcggcgagacagcgtgctcgcggctctgtgt

SEQ ID NO: 13905 - DNA, 60 bp, Artificial Sequence
  Description of Artificial Sequence: Synthetic probe
gagcagcagcatgcgcgcgttgtcggggtcctcgttgatgaagcgcgtgaggttcagcga

SEQ ID NO: 13906 - DNA, 60 bp, Artificial Sequence
  Description of Artificial Sequence: Synthetic probe
tgctcgctgcccggcgaactggtggagcgcgtgctcgcgaccgtgccactggccgacttg

SEQ ID NO: 13907 - DNA, 60 bp, Artificial Sequence
  Description of Artificial Sequence: Synthetic probe
ttgctcgctgcccggcgaactggtggagcgcgtgctcgcgaccgtgccactgaccgactt

SEQ ID NO: 13908 - DNA, 60 bp, Artificial Sequence
  Description of Artificial Sequence: Synthetic probe
ggtgggaccttgctcgctgcccggcgaactggtggagcgcgtgctcgcgaccgtgccact

SEQ ID NO: 13909 - DNA, 60 bp, Artificial Sequence
  Description of Artificial Sequence: Synthetic probe
gcgcgcactctacgaaccagcggggcgggtttccgtcctcacagcaaacctcgtccgagt

SEQ ID NO: 13910 - DNA, 60 bp, Artificial Sequence
  Description of Artificial Sequence: Synthetic probe
accggcaccatggacagcagcgagaggtcgatgctgttttctgcggcatcgatgcggtgc

SEQ ID NO: 13911 - DNA, 60 bp, Artificial Sequence
  Description of Artificial Sequence: Synthetic probe
gctcgcgctgtgcgggagcgtgcactcggcgcaatggtatcggcgagcgcgacttctgca

SEQ ID NO: 13912 - DNA, 57 bp, Artificial Sequence
  Description of Artificial Sequence: Synthetic probe
gcactcggcgcaatggatcggcgagcgcgacttctgcatggcccacgcgcaggacgt

SEQ ID NO: 13913 - DNA, 60 bp, Artificial Sequence
  Description of Artificial Sequence: Synthetic probe
gtcgaggtggaagttagtggccgtgggcgtgacgaccgcgcaacagagccgcgtgaacgg

SEQ ID NO: 13914 - DNA, 60 bp, Artificial Sequence
  Description of Artificial Sequence: Synthetic probe
gtcgaggtggaagttagtggccgtgggcgtgacgacgcgcagcagaagctgcgtgaacgg

SEQ ID NO: 13915 - DNA, 60 bp, Artificial Sequence
  Description of Artificial Sequence: Synthetic probe
cgcggtcaacgagttctgtatgatgacgcacagatctctagagttctgcgagacgcgttc

SEQ ID NO: 13916 - DNA, 60 bp, Artificial Sequence
  Description of Artificial Sequence: Synthetic probe
cagtcttccgtgatgcgcctcaaaagtcttaacccggtcagcgcggtcaacgagttctgt

SEQ ID NO: 13917 - DNA, 60 bp, Artificial Sequence
  Description of Artificial Sequence: Synthetic probe
gacatcatgactcagtcttccgtgatacgcctcaaaagtcttaacccggtcagcgcggtc

SEQ ID NO: 13918 - DNA, 60 bp, Artificial Sequence
  Description of Artificial Sequence: Synthetic probe
tacgtgggaagcgcctcgcttactggcggctcgctggccaccattaaaaacctgggcgtg

SEQ ID NO: 13919 - DNA, 60 bp, Artificial Sequence
  Description of Artificial Sequence: Synthetic probe
caccatcgagagcagcgagaggtcgatgctgttcttggcgttctcgatgcggtgcagcac

SEQ ID NO: 13920 - DNA, 60 bp, Artificial Sequence
  Description of Artificial Sequence: Synthetic probe
acgccgctccacttggcggcggcgtccaacccgcgcgcgtgccgccggctgatcgcgctt

SEQ ID NO: 13921 - DNA, 60 bp, Artificial Sequence
  Description of Artificial Sequence: Synthetic probe
tacgtgggaagcgcctcgcttaccggcggctcgctagccaccattaaaaacttgggcgtg

SEQ ID NO: 13922 - DNA, 59 bp, Artificial Sequence
  Description of Artificial Sequence: Synthetic probe
cgcctggtagagacgacgtacaacctcggcacgccggcagatgtacgtgtacatggact

SEQ ID NO: 13923 - DNA, 60 bp, Artificial Sequence
  Description of Artificial Sequence: Synthetic probe
cgaagtgcactactggccgctgatcatggacgcgttgctgcgcgccgctattaaccgcag

SEQ ID NO: 13924 - DNA, 51 bp, Artificial Sequence
  Description of Artificial Sequence: Synthetic probe
catggactcctgggacccatgggcgctcgacgacccccagccgctcttcac

SEQ ID NO: 13925 - DNA, 60 bp, Artificial Sequence
  Description of Artificial Sequence: Synthetic probe
actggccatccagatagggtgcgacaaccaaaaatttcccgaagaacccacaactaccca

SEQ ID NO: 13926 - DNA, 60 bp, Artificial Sequence
  Description of Artificial Sequence: Synthetic probe
aggtcccaggccagtgcttgttggtggaataggcccgaggttcttgatggtggacacgga

SEQ ID NO: 13927 - DNA, 60 bp, Artificial Sequence
  Description of Artificial Sequence: Synthetic probe
cggtcatgaggtcccaggccagtgcttgttggtggaataggcccgaggttcttgatggtg

SEQ ID NO: 13928 - DNA, 60 bp, Artificial Sequence
  Description of Artificial Sequence: Synthetic probe
gcgtgaacggcaccttcggctccacgatcatggagtagaaggtgttgttgcggtcatgag

SEQ ID NO: 13929 - DNA, 60 bp, Artificial Sequence
  Description of Artificial Sequence: Synthetic probe
tggaagttagtggccgtgggcgtgacgaccgcgcaacagagccgcgtgaacggcaccttc

SEQ ID NO: 13930 - DNA, 58 bp, Artificial Sequence
  Description of Artificial Sequence: Synthetic probe
cctgccgctaagcccgtcttcctacagcaatcattgccgccgccccagtacccggcgt

SEQ ID NO: 13931 - DNA, 60 bp, Artificial Sequence
  Description of Artificial Sequence: Synthetic probe
tacgggtcgtactcctgcccgtagatgaggatggtgcagtaccgcgagatcatgagcatg

SEQ ID NO: 13932 - DNA, 56 bp, Artificial Sequence
  Description of Artificial Sequence: Synthetic probe
atgtacgggtcgtactcctgcccgtagatgaggatggtgccgtaccgcgagatcat

SEQ ID NO: 13933 - DNA, 60 bp, Artificial Sequence
  Description of Artificial Sequence: Synthetic probe
gcacatgttgcgcgaggacatgtacgggtcgtactcctgcccgtagatgaggatggtgcc

SEQ ID NO: 13934 - DNA, 60 bp, Artificial Sequence
  Description of Artificial Sequence: Synthetic probe
cggctccacggatcatggagtagaaggtgtttgtagccggttcatgaaggtccccagggc

SEQ ID NO: 13935 - DNA, 60 bp, Artificial Sequence
  Description of Artificial Sequence: Synthetic probe
gtggaacggcaccttcggctccacggatcatggagtagaaggtgtttgtagccggttcat

SEQ ID NO: 13936 - DNA, 60 bp, Artificial Sequence
  Description of Artificial Sequence: Synthetic probe
tggaagttcgtggccgtgggcgtgacgacgcgcagcagagccgcgtggaacggcaccttc

SEQ ID NO: 13937 - DNA, 60 bp, Artificial Sequence
  Description of Artificial Sequence: Synthetic probe
gtcgagtggaagttcgtggccgtgggcgtgacgacgcgcagcagagccgcgtggaacggc

SEQ ID NO: 13938 - DNA, 60 bp, Artificial Sequence
  Description of Artificial Sequence: Synthetic probe
gcgattgtaaaccacgattcacaaccacgccaccgacgaccacaaggccgcccagaagac

SEQ ID NO: 13939 - DNA, 60 bp, Artificial Sequence
  Description of Artificial Sequence: Synthetic probe
gttgttgcggcgccgtcccggccgggtaccgcgtaacttgcgcacggacatgtccacgct

SEQ ID NO: 13940 - DNA, 60 bp, Artificial Sequence
  Description of Artificial Sequence: Synthetic probe
cggggacaggatcgggtgtgggcattaggtctccgcttacttgaacgtcgtccatcatcc

SEQ ID NO: 13941 - DNA, 60 bp, Artificial Sequence
  Description of Artificial Sequence: Synthetic probe
gggtgtgggcattaggtctccgcttacttgaacgtcgtccatcatcctgtcgatgaggtc

SEQ ID NO: 13942 - DNA, 60 bp, Artificial Sequence
  Description of Artificial Sequence: Synthetic probe
gtcgaagacctcatcgacaggatgatggacgacgttcaagtaagcggagacctaatgccc

SEQ ID NO: 13943 - DNA, 60 bp, Artificial Sequence
  Description of Artificial Sequence: Synthetic probe
tgatgaagcgcgtgaggttcagcgagcaccgcgtgcagcgccgcggcgggtcgagctcga

SEQ ID NO: 13944 - DNA, 60 bp, Artificial Sequence
  Description of Artificial Sequence: Synthetic probe
tgatgaagcgcgtgaggttcagcgagcaccgcgtgcagcgccgcggcgggtcgagatcga

SEQ ID NO: 13945 - DNA, 60 bp, Artificial Sequence
  Description of Artificial Sequence: Synthetic probe
aagggcgactgcaaggacggtggcgacaagggcgacgtcgactctgacggcggcaattaa

SEQ ID NO: 13946 - DNA, 60 bp, Artificial Sequence
  Description of Artificial Sequence: Synthetic probe
ccaagggcgactgcaaggacggtggcgacaagggcgacgtcgactctgacggcggcaatt

SEQ ID NO: 13947 - DNA, 60 bp, Artificial Sequence
  Description of Artificial Sequence: Synthetic probe
gtctagaagtcaacgacctcattgacaggatgatggacgacgttcaagtaagcggagacc

SEQ ID NO: 13948 - DNA, 60 bp, Artificial Sequence
  Description of Artificial Sequence: Synthetic probe
gtctagaagtcgaagacctcatcgacaggatgatggacgacgttcaagtaagcggagacc

SEQ ID NO: 13949 - DNA, 60 bp, Artificial Sequence
  Description of Artificial Sequence: Synthetic probe
gcaccggcgacccagagctcatggtctaccccggcgggtacgacgtctcgctagacgcct

SEQ ID NO: 13950 - DNA, 60 bp, Artificial Sequence
  Description of Artificial Sequence: Synthetic probe
acaacgtacaacacggcacgccggcagatgtacgtgtacatggactcctggggacccatg

SEQ ID NO: 13951 - DNA, 55 bp, Artificial Sequence
  Description of Artificial Sequence: Synthetic probe
gagagaaccgcgccttcgacgagaacgtcaccgagcgagtgatgcacgttcttgt

SEQ ID NO: 13952 - DNA, 60 bp, Artificial Sequence
  Description of Artificial Sequence: Synthetic probe
agacgacgtacaacacggcacgccggcagatgtacgtgtacatggactcctgggaccttg

SEQ ID NO: 13953 - DNA, 59 bp, Artificial Sequence
  Description of Artificial Sequence: Synthetic probe
ttgaccgcactgaccgggttaagacttttgaggcgcatcacggcagactgagtcatgat

SEQ ID NO: 13954 - DNA, 55 bp, Artificial Sequence
  Description of Artificial Sequence: Synthetic probe
aaaagcttatgaaaggcgcaaagacagctgtggaccgaaacattttcgactctat

SEQ ID NO: 13955 - DNA, 60 bp, Artificial Sequence
  Description of Artificial Sequence: Synthetic probe
ctaagtacaaaaagcttatgaaaggcgcaaagacagctgtggaccgaaacattttcgact

SEQ ID NO: 13956 - DNA, 60 bp, Artificial Sequence
  Description of Artificial Sequence: Synthetic probe
agctgatggcatcattccaatgctgttgcgatcgtttttagacgcgcgcgctaagtacaa

SEQ ID NO: 13957 - DNA, 60 bp, Artificial Sequence
  Description of Artificial Sequence: Synthetic probe
gagccgcggtcaccagagtttgtttctgaagtagccatttttgaccgcgaagctgatggc

SEQ ID NO: 13958 - DNA, 59 bp, Artificial Sequence
  Description of Artificial Sequence: Synthetic probe
atcggctggacgcagaagtagcagctgttgaaatcaggcagcgatatcccgcgccgcgc

SEQ ID NO: 13959 - DNA, 60 bp, Artificial Sequence
  Description of Artificial Sequence: Synthetic probe
ccctgaaacgctagttggtgtagttgtttcacgcaatcggctggacgcagaagtagcagc

SEQ ID NO: 13960 - DNA, 60 bp, Artificial Sequence
  Description of Artificial Sequence: Synthetic probe
ttacgcaaacttgtcccctgaaacgctagttggtgtagttgtttcacgcaatcggctgga

SEQ ID NO: 13961 - DNA, 60 bp, Artificial Sequence
  Description of Artificial Sequence: Synthetic probe
gctagtcttcgactacaatagtttgtaccctaatgtatgcatttacgcaaacttgtcccc

SEQ ID NO: 13962 - DNA, 60 bp, Artificial Sequence
  Description of Artificial Sequence: Synthetic probe
aagcacgtgctagtcttcgactacaatagtttgtaccctaatgtatgcatttacgcaaac

SEQ ID NO: 13963 - DNA, 60 bp, Artificial Sequence
  Description of Artificial Sequence: Synthetic probe
tggtgcgtgcggacactaagtcaaagttcttctacgagggaggacgtgtgcttgcaccta

SEQ ID NO: 13964 - DNA, 60 bp, Artificial Sequence
  Description of Artificial Sequence: Synthetic probe
aacagttatggtgcgtgcggacactaagtcaaagttcttctacgagggaggacgtgtgct

SEQ ID NO: 13965 - DNA, 60 bp, Artificial Sequence
  Description of Artificial Sequence: Synthetic probe
caagggtccgctcatgaagctgctactagctcacaaaacagttatggtgcgtgcggacac

SEQ ID NO: 13966 - DNA, 60 bp, Artificial Sequence
  Description of Artificial Sequence: Synthetic probe
gcgagcacctgcatcaagggtccgctcatgaagctgctactagctcacaaaacagttatg

SEQ ID NO: 13967 - DNA, 60 bp, Artificial Sequence
  Description of Artificial Sequence: Synthetic probe
gtgcgcctgcgagtttaccgcacatgctcagagaactcagggccgcgttcggaaaggtaa

SEQ ID NO: 13968 - DNA, 60 bp, Artificial Sequence
  Description of Artificial Sequence: Synthetic probe
gatctacggacctcgtctagaagtcgaagacctcatcgacaggatgatggacgacgttca

SEQ ID NO: 13969 - DNA, 60 bp, Artificial Sequence
  Description of Artificial Sequence: Synthetic probe
caagtaagcggagacctaatgcccacacccgatcctgtccccgaagaggtggagcagtgc

SEQ ID NO: 13970 - DNA, 60 bp, Artificial Sequence
  Description of Artificial Sequence: Synthetic probe
aagtaagcggagacctaatgcccacacccgatcctgtccccgaagaggtggagcagtgct

SEQ ID NO: 13971 - DNA, 60 bp, Artificial Sequence
  Description of Artificial Sequence: Synthetic probe
ctgtccgcgcttcacctgcaccatcacgatatccggaaaggtcgttgccgtggccgacgg

SEQ ID NO: 13972 - DNA, 60 bp, Artificial Sequence
  Description of Artificial Sequence: Synthetic probe
ctgcaccatcacgatatccggaaaggtcgttgccgtggccgacggggccagcaagaagct

SEQ ID NO: 13973 - DNA, 60 bp, Artificial Sequence
  Description of Artificial Sequence: Synthetic probe
cctggtgcgcctgagcggctgctatttacccggctcagcgagcgccgcgtgtatgcgttc

SEQ ID NO: 13974 - DNA, 60 bp, Artificial Sequence
  Description of Artificial Sequence: Synthetic probe
cggcgcttgtgggaccctggtgcgcctgagcggctgctatttacccggctcagcgagcgc

SEQ ID NO: 13975 - DNA, 60 bp, Artificial Sequence
  Description of Artificial Sequence: Synthetic probe
gcagagggtggcgaggaaatccgcgtgaagtttgtgggtaaagacaaggttgctcacgag

SEQ ID NO: 13976 - DNA, 60 bp, Artificial Sequence
  Description of Artificial Sequence: Synthetic probe
ggcagagggtggcgaggaaatccgcgtgaagtttgtgggtaaagacaaggttgctcacga

SEQ ID NO: 13977 - DNA, 60 bp, Artificial Sequence
  Description of Artificial Sequence: Synthetic probe
cgagcttcttcatccgcatcggtaagtcgcggtacgaaagagagagcggcactgtgggct

SEQ ID NO: 13978 - DNA, 60 bp, Artificial Sequence
  Description of Artificial Sequence: Synthetic probe
tcatggagacgagcttcttcatccgcatcggtaagtcgcggtacgaaagagagagcggca

SEQ ID NO: 13979 - DNA, 60 bp, Artificial Sequence
  Description of Artificial Sequence: Synthetic probe
tcgcaccttaaactacctccatccaccaatatgctgatctacggacctcgtctagaagtc

SEQ ID NO: 13980 - DNA, 60 bp, Artificial Sequence
  Description of Artificial Sequence: Synthetic probe
gcgtgaacggcaccttcggctccacgatcatggagtagaaggtgttgtagcggttcatga

SEQ ID NO: 13981 - DNA, 60 bp, Artificial Sequence
  Description of Artificial Sequence: Synthetic probe
cgctgaaacagcggtagaccgtgaaatatttaactctatgcagtacacgtacaagatcac

SEQ ID NO: 13982 - DNA, 60 bp, Artificial Sequence
  Description of Artificial Sequence: Synthetic probe
aaccgctgaaacagcggtagaccgtgaaatatttaactctatgcagtacacgtacaagat

SEQ ID NO: 13983 - DNA, 60 bp, Artificial Sequence
  Description of Artificial Sequence: Synthetic probe
ttggatgcgcgcgccaagtacaagaagctgatgaaaaccgctgaaacagcggtagaccgt

SEQ ID NO: 13984 - DNA, 60 bp, Artificial Sequence
  Description of Artificial Sequence: Synthetic probe
ctgctgcgctcctttttggatgcgcgcgccaagtacaagaagctgatgaaaaccgctgaa

SEQ ID NO: 13985 - DNA, 50 bp, Artificial Sequence
  Description of Artificial Sequence: Synthetic probe
ttttgaccgcgaggctaacggcattattccaatgctgctgcgctcctttt

SEQ ID NO: 13986 - DNA, 60 bp, Artificial Sequence
  Description of Artificial Sequence: Synthetic probe
tgtcagaagtggctatttttgaccgcgaggctaacggcattattccaatgctgctgcgct

SEQ ID NO: 13987 - DNA, 60 bp, Artificial Sequence
  Description of Artificial Sequence: Synthetic probe
cgctttatcgcagtgccctgcgagccacgctcgccagagctagtgtcagaagtggctatt

SEQ ID NO: 13988 - DNA, 60 bp, Artificial Sequence
  Description of Artificial Sequence: Synthetic probe
tgcgccgcgctttatcgcagtgccctgcgagccacgctcgccagagctagtgtcagaagt

SEQ ID NO: 13989 - DNA, 60 bp, Artificial Sequence
  Description of Artificial Sequence: Synthetic probe
tccagaaacgctagtgggcgtagtagtagcaaacaaccgcctcgacgcggaaattgctgc

SEQ ID NO: 13990 - DNA, 60 bp, Artificial Sequence
  Description of Artificial Sequence: Synthetic probe
ctacgcaaacttgtctccagaaacgctagtgggcgtagtagtagcaaacaaccgcctcga

SEQ ID NO: 13991 - DNA, 60 bp, Artificial Sequence
  Description of Artificial Sequence: Synthetic probe
tttgactacaatagcttgtacccaaacgtgtgcatctacgcaaacttgtctccagaaacg

SEQ ID NO: 13992 - DNA, 60 bp, Artificial Sequence
  Description of Artificial Sequence: Synthetic probe
aagcacgtgctcatttttgactacaatagcttgtacccaaacgtgtgcatctacgcaaac

SEQ ID NO: 13993 - DNA, 58 bp, Artificial Sequence
  Description of Artificial Sequence: Synthetic probe
acctgcatcaagggcccgctgatgaagctgttgctagcaaaccgcactgtgatggttc

SEQ ID NO: 13994 - DNA, 53 bp, Artificial Sequence
  Description of Artificial Sequence: Synthetic probe
ggcgcccgccgcagcccttgccccggaccaggcgccacggagcaaagtgaaaa

SEQ ID NO: 13995 - DNA, 60 bp, Artificial Sequence
  Description of Artificial Sequence: Synthetic probe
ggcgcccgccgcagcccttgccccggaccaggcgccacggagcaaagtgaaaaaggaccg

SEQ ID NO: 13996 - DNA, 54 bp, Artificial Sequence
  Description of Artificial Sequence: Synthetic probe
ccccacacccgccttccacccgccagacgccaacaccacagccaacaagcatgc

SEQ ID NO: 13997 - DNA, 60 bp, Artificial Sequence
  Description of Artificial Sequence: Synthetic probe
ggcacataacacgttcgaaaacgatagcgagtcggcagctaacaaccagtacgtggcgtc

SEQ ID NO: 13998 - DNA, 60 bp, Artificial Sequence
  Description of Artificial Sequence: Synthetic probe
ggcacataacacgttcgaaaacgatagcgagtcggctaacaaccagtacgtggcgtcagt

SEQ ID NO: 13999 - DNA, 52 bp, Artificial Sequence
  Description of Artificial Sequence: Synthetic probe
catggactcctgggacccctgggtgctcgacgacccccagccgctcttcacg

SEQ ID NO: 14000 - DNA, 60 bp, Artificial Sequence
  Description of Artificial Sequence: Synthetic probe
ggtacatgatgccgttgagcgtcatgtcctgggcgacctcgatggggatgtcgctgatca

SEQ ID NO: 14001 - DNA, 60 bp, Artificial Sequence
  Description of Artificial Sequence: Synthetic probe
catgagccggtacatgatgccgttgagcgtcatgtcctgggcgacctcgatggggatgtc

SEQ ID NO: 14002 - DNA, 60 bp, Artificial Sequence
  Description of Artificial Sequence: Synthetic probe
gacgcgtcgcgggagcccatttggttagcacaaaacgtcgcacatgctcctcgaggacat

SEQ ID NO: 14003 - DNA, 60 bp, Artificial Sequence
  Description of Artificial Sequence: Synthetic probe
taccacgacgcgtcgcgggagcccgccatttggttagcacaaaacgtcgcacatgctcct

SEQ ID NO: 14004 - DNA, 60 bp, Artificial Sequence
  Description of Artificial Sequence: Synthetic probe
aagttcagcgagcaccgggtgcatcgccggggcgggtccagcgtgacggagtacgcggcg

SEQ ID NO: 14005 - DNA, 54 bp, Artificial Sequence
  Description of Artificial Sequence: Synthetic probe
tgtcccggtcttcgttcacgaagcgggtcaagttcagcgagcaccgggtgcatc

SEQ ID NO: 14006 - DNA, 60 bp, Artificial Sequence
  Description of Artificial Sequence: Synthetic probe
acgcgatgagcatcatcgcgttgtcccggtcttcgttcacgaagcgggtcaagttcagcg

SEQ ID NO: 14007 - DNA, 50 bp, Artificial Sequence
  Description of Artificial Sequence: Synthetic probe
gtgtccatgctcttgtttctacagaagacgagaaactcgccgaggatccg

SEQ ID NO: 14008 - DNA, 60 bp, Artificial Sequence
  Description of Artificial Sequence: Synthetic probe
actcggacgacgtttgctgcgaggacggaaacccgccccgctggttcgtagagtgcgcgc

SEQ ID NO: 14009 - DNA, 60 bp, Artificial Sequence
  Description of Artificial Sequence: Synthetic probe
acgtacaacacggcacgccggcagatgtacgtgtacatggactcctgggaccttgggtga

SEQ ID NO: 14010 - DNA, 53 bp, Artificial Sequence
  Description of Artificial Sequence: Synthetic probe
catggactcctgggacccctgggcgctcggacgacccccagccgctcttcacg

SEQ ID NO: 14011 - DNA, 60 bp, Artificial Sequence
  Description of Artificial Sequence: Synthetic probe
gcgtggataataccggcacctcataaaaactcccggtataaatggaatcgcccgcgtgcg

SEQ ID NO: 14012 - DNA, 60 bp, Artificial Sequence
  Description of Artificial Sequence: Synthetic probe
agtaagcggagacctaatgcccaaacccgatcccatccccgaagatgtggcgcagtgctc

SEQ ID NO: 14013 - DNA, 60 bp, Artificial Sequence
  Description of Artificial Sequence: Synthetic probe
tgttcctttggtgatagcgctgtgcgggagcgtgcactcgacgcaatggtatcggcgagc

SEQ ID NO: 14014 - DNA, 60 bp, Artificial Sequence
  Description of Artificial Sequence: Synthetic probe
ctggggtgttcctttggtgatagcgctgtgcgggagcgtgcactcgacgcaatggtatcg

SEQ ID NO: 14015 - DNA, 60 bp, Artificial Sequence
  Description of Artificial Sequence: Synthetic probe
aaccgcagcgtgcgcgtgcgcatcatcgtcagccagtggcgtaacgcggatccactgtct

SEQ ID NO: 14016 - DNA, 60 bp, Artificial Sequence
  Description of Artificial Sequence: Synthetic probe
tcaaccgcagcgtgcgcgtgcgcatcatcgtcagccagtggcgtaacgcggatccactgt

SEQ ID NO: 14017 - DNA, 60 bp, Artificial Sequence
  Description of Artificial Sequence: Synthetic probe
tgacctctctctgctgtctatggtgccagtggtgcgctctggcagcgaggtgtactactg

SEQ ID NO: 14018 - DNA, 60 bp, Artificial Sequence
  Description of Artificial Sequence: Synthetic probe
agcattgacctctctctgctgtctatggtgccagtggtgcgctctggcagcgaggtgtac

SEQ ID NO: 14019 - DNA, 60 bp, Artificial Sequence
  Description of Artificial Sequence: Synthetic probe
atggttgtggaccccaagcagccgtttacgcgcttctgctgcgccatgataacgcccaca

SEQ ID NO: 14020 - DNA, 60 bp, Artificial Sequence
  Description of Artificial Sequence: Synthetic probe
atcaagaacctcgggctctactccaccaacaagcacctggccgcggacctcatgaaccgc

SEQ ID NO: 14021 - DNA, 61 bp, Artificial Sequence
  Description of Artificial Sequence: Synthetic probe
gaagttatcttttatgtcactcccttgtcttagatgagttatacatgacatgatgtatgtg

SEQ ID NO: 14022 - DNA, 61 bp, Artificial Sequence
  Description of Artificial Sequence: Synthetic probe
gagtttatgacgcatatgtaactgtgttctttatgtagaagttatcttttatgtcactccc

SEQ ID NO: 14023 - DNA, 60 bp, Artificial Sequence
  Description of Artificial Sequence: Synthetic probe
ccgatcttagaacagagtttatgacgcatatgtaactgtgttctttatgtagaagttatc

SEQ ID NO: 14024 - DNA, 60 bp, Artificial Sequence
  Description of Artificial Sequence: Synthetic probe
gccgcatgtggaagaattcaccgtcgagacacacaccataattaaacaagatcagtgcat

SEQ ID NO: 14025 - DNA, 60 bp, Artificial Sequence
  Description of Artificial Sequence: Synthetic probe
tgccgcatgtggaagaattcaccgtcgagacacacaccataattaaacaagatcagtgca

SEQ ID NO: 14026 - DNA, 60 bp, Artificial Sequence
  Description of Artificial Sequence: Synthetic probe
cgacattgtgaccgtcgcaaagcacacattcaaagtgccgcatgtggaagaattcaccgt

SEQ ID NO: 14027 - DNA, 60 bp, Artificial Sequence
  Description of Artificial Sequence: Synthetic probe
tgtgttcatctcacacgacattgtgaccgtcgcaaagcacacattcaaagtgccgcatgt

SEQ ID NO: 14028 - DNA, 60 bp, Artificial Sequence
  Description of Artificial Sequence: Synthetic probe
caaccgctcaaggacatctctagcgctaacggctgtttgtcattcccccgtgtgttcatc

SEQ ID NO: 14029 - DNA, 60 bp, Artificial Sequence
  Description of Artificial Sequence: Synthetic probe
ggcaaacgggaacgcaggcgcgacataatcactgagaatctccgcagcaaccgctcaagg

SEQ ID NO: 14030 - DNA, 60 bp, Artificial Sequence
  Description of Artificial Sequence: Synthetic probe
ggcggcaaacgggaacgcaggcgcgacataatcactgagaatctccgcagcaaccgctca

SEQ ID NO: 14031 - DNA, 60 bp, Artificial Sequence
  Description of Artificial Sequence: Synthetic probe
catcaacgcatcagagcagtctgagtctgactaatggcggcaaacgggaacgcaggcgcg

SEQ ID NO: 14032 - DNA, 60 bp, Artificial Sequence
  Description of Artificial Sequence: Synthetic probe
acactctatgctgtacatcaacgcatcagagcagtctgagtctgactaatggcggcaaac

SEQ ID NO: 14033 - DNA, 60 bp, Artificial Sequence
  Description of Artificial Sequence: Synthetic probe
acacgcatgagaattaatattcttacttatccgtaacactctatgctgtacatcaacgca

SEQ ID NO: 14034 - DNA, 60 bp, Artificial Sequence
  Description of Artificial Sequence: Synthetic probe
cacaaccacaaccaaacacgcatgagaattaatattcttacttatccgtaacactctatg

SEQ ID NO: 14035 - DNA, 60 bp, Artificial Sequence
  Description of Artificial Sequence: Synthetic probe
tgtgcgtgtccgagtgttaaccgtacgtcaaactaacatcttacctgtccgtgacaagaa

SEQ ID NO: 14036 - DNA, 60 bp, Artificial Sequence
  Description of Artificial Sequence: Synthetic probe
cactgcgtattcgattcaagttcactaacgccactaaactagttgtgcgtgtccgagtgt

SEQ ID NO: 14037 - DNA, 60 bp, Artificial Sequence
  Description of Artificial Sequence: Synthetic probe
tgtcacacactgcgtattcgattcaagttcactaacgccactaaactagttgtgcgtgtc

SEQ ID NO: 14038 - DNA, 60 bp, Artificial Sequence
  Description of Artificial Sequence: Synthetic probe
cagtttcagtaaccggcgtgtctagttcgtctggtactaatagtggtgtatctactaacc

SEQ ID NO: 14039 - DNA, 60 bp, Artificial Sequence
  Description of Artificial Sequence: Synthetic probe
ctgtaacagtttcagtaaccggcgtgtctagttcgtctggtactaatagtggtgtatcta

SEQ ID NO: 14040 - DNA, 60 bp, Artificial Sequence
  Description of Artificial Sequence: Synthetic probe
gcgtgtctcagagtaatgattcacctccttcaaccaatgactggatgcgtacactagaca

SEQ ID NO: 14041 - DNA, 60 bp, Artificial Sequence
  Description of Artificial Sequence: Synthetic probe
cagaatgcgtgtctcagagtaatgattcacctccttcaaccaatgactggatgcgtacac

SEQ ID NO: 14042 - DNA, 60 bp, Artificial Sequence
  Description of Artificial Sequence: Synthetic probe
gctcggcgtggtggcaatttcgctgctgcgccgcgcgctaagaatacggtttagatactc

SEQ ID NO: 14043 - DNA, 60 bp, Artificial Sequence
  Description of Artificial Sequence: Synthetic probe
gcggttcatgaggtcccaggccaggtgcttgttggtggagtagagcccgaggttcttgtt

SEQ ID NO: 14044 - DNA, 60 bp, Artificial Sequence
  Description of Artificial Sequence: Synthetic probe
cgccaggtagagaccacctacgacacggcacgccggcagatgtacgtgtccatggacacc

SEQ ID NO: 14045 - DNA, 58 bp, Artificial Sequence
  Description of Artificial Sequence: Synthetic probe
cgccaggtagagaccacctacgacacggcacgccggcagatgtacgtgtccatggaca

SEQ ID NO: 14046 - DNA, 60 bp, Artificial Sequence
  Description of Artificial Sequence: Synthetic probe
cgccgccgagcaacttcgacgcggacgtctacgtcgctgcggccggcataaacgtcagcg

SEQ ID NO: 14047 - DNA, 60 bp, Artificial Sequence
  Description of Artificial Sequence: Synthetic probe
tacgtgggaagcgcctcgcttaccggcggctcgctagctaccattaaaaacctgggcgtg

SEQ ID NO: 14048 - DNA, 60 bp, Artificial Sequence
  Description of Artificial Sequence: Synthetic probe
catttgatattcgtagagcataagaaatgcgattgtaaaccacgactcacaaccacgcca

SEQ ID NO: 14049 - DNA, 60 bp, Artificial Sequence
  Description of Artificial Sequence: Synthetic probe
catctgagcttcgtagagcataagaaatgcgattgtaaaccaccactcacgaccacgcca

SEQ ID NO: 14050 - DNA, 60 bp, Artificial Sequence
  Description of Artificial Sequence: Synthetic probe
acacagaacgtcgcacatgttgcgcgaggacatgtacgggtcgtactcctgcccgtagat

SEQ ID NO: 14051 - DNA, 60 bp, Artificial Sequence
  Description of Artificial Sequence: Synthetic probe
gcgtatttattaacacagaacgtcgcacatgttgcgcgaggacatgtacgggtcgtactc

SEQ ID NO: 14052 - DNA, 50 bp, Artificial Sequence
  Description of Artificial Sequence: Synthetic probe
catgaaccgctacaacaccttctactccatgatcgtggagccgaaggtgc

SEQ ID NO: 14053 - DNA, 57 bp, Artificial Sequence
  Description of Artificial Sequence: Synthetic probe
gcaggcggaaaatcacgggccggacatcaaagagcacgttaactcgctgggagaaaa

SEQ ID NO: 14054 - DNA, 60 bp, Artificial Sequence
  Description of Artificial Sequence: Synthetic probe
acgcgttctggcggagaggatcactgtccgcgcttcacctgcaccatcacgatatccgga

SEQ ID NO: 14055 - DNA, 60 bp, Artificial Sequence
  Description of Artificial Sequence: Synthetic probe
tttccggatatcgtgatggtgcaggtgaagcgcggacagtgatcctctccgccagaacgc

SEQ ID NO: 14056 - DNA, 60 bp, Artificial Sequence
  Description of Artificial Sequence: Synthetic probe
cgaggtgtactactggccgctgatcatggacgcgttgctgcgagccgctgtcgaccgcag

SEQ ID NO: 14057 - DNA, 60 bp, Artificial Sequence
  Description of Artificial Sequence: Synthetic probe
agacgacgtacaacacggcacgccggcagatgtacgtgtacatggactcctgggacccat

SEQ ID NO: 14058 - DNA, 60 bp, Artificial Sequence
  Description of Artificial Sequence: Synthetic probe
agacgacgtacaacacggcacgccggcagatgtacgtgtacatggactcctgggaccctt

SEQ ID NO: 14059 - DNA, 60 bp, Artificial Sequence
  Description of Artificial Sequence: Synthetic probe
gacgagcactgcgtactgccgcatggtctctatgtgatgctccaagtgcttgcccgcctt

SEQ ID NO: 14060 - DNA, 60 bp, Artificial Sequence
  Description of Artificial Sequence: Synthetic probe
tagagacgagcactgcgtactgccgcatggtctctatgtgatgctccaggtgcttgcccg

SEQ ID NO: 14061 - DNA, 60 bp, Artificial Sequence
  Description of Artificial Sequence: Synthetic probe
ttggagacgagcaccgcgtactgccgcatggtctctatgtgatgctccaagtgcttgccc

SEQ ID NO: 14062 - DNA, 60 bp, Artificial Sequence
  Description of Artificial Sequence: Synthetic probe
tgttggagacgagcaccgcgtactgccgcatggtctctatgtgatgctccaggtgcttgc

SEQ ID NO: 14063 - DNA, 51 bp, Artificial Sequence
  Description of Artificial Sequence: Synthetic probe
gctcgtctgcgagaactgcggcgacatcgcggcgcggcttaacggcacgca

SEQ ID NO: 14064 - DNA, 54 bp, Artificial Sequence
  Description of Artificial Sequence: Synthetic probe
ctcgacctccatcttctcgcggaagacgctctccatgctcatggaggtcatcct

SEQ ID NO: 14065 - DNA, 54 bp, Artificial Sequence
  Description of Artificial Sequence: Synthetic probe
catcgcgctcatgtccttccgcggcatgaaccaggaggacggcatcatactgaa

SEQ ID NO: 14066 - DNA, 54 bp, Artificial Sequence
  Description of Artificial Sequence: Synthetic probe
catcgcgctcatgtccttccgcggcatgaaccaggaggacggcatcatcctgaa

SEQ ID NO: 14067 - DNA, 60 bp, Artificial Sequence
  Description of Artificial Sequence: Synthetic probe
tcccggccgagttccgcgacgggtacgtggcctcctcgctcgtgggcatcaaccacaact

SEQ ID NO: 14068 - DNA, 60 bp, Artificial Sequence
  Description of Artificial Sequence: Synthetic probe
ggctcatctcgcagctctccgtgctcgcctccatctcgaacatccgcaccgcggacttcg

SEQ ID NO: 14069 - DNA, 60 bp, Artificial Sequence
  Description of Artificial Sequence: Synthetic probe
tcgggctcatctcgcagctctccgtgctcgcctccatatcgaacatgccaccgcggactt

SEQ ID NO: 14070 - DNA, 60 bp, Artificial Sequence
  Description of Artificial Sequence: Synthetic probe
accagccagtacggcttcttctgcgcctcggacgtgcccgagcgcggggccgcaggtcgg

SEQ ID NO: 14071 - DNA, 60 bp, Artificial Sequence
  Description of Artificial Sequence: Synthetic probe
agacctacatcgggaacatccgcaacgacatcctcgcgaaccacaagaaccgcggcacct

SEQ ID NO: 14072 - DNA, 60 bp, Artificial Sequence
  Description of Artificial Sequence: Synthetic probe
cgcgcggtaccgacactacaagatcctgctcgacgtgaaccagcccgacaacttcgtgat

SEQ ID NO: 14073 - DNA, 60 bp, Artificial Sequence
  Description of Artificial Sequence: Synthetic probe
acccctccaagttcgtggtcccgaacgccatcggcggcgtcttcatcaacaagcagtcca

SEQ ID NO: 14074 - DNA, 60 bp, Artificial Sequence
  Description of Artificial Sequence: Synthetic probe
caagctcccgctgctcatcggctacgggaacaagaacgcgctggacccctccaagttcgt

SEQ ID NO: 14075 - DNA, 60 bp, Artificial Sequence
  Description of Artificial Sequence: Synthetic probe
tcgtcaagctcccgctgctcatcggctacgggaacaagaacgcgcttggacccctccaag

SEQ ID NO: 14076 - DNA, 60 bp, Artificial Sequence
  Description of Artificial Sequence: Synthetic probe
caccttcacggtgaacatctaccggcacgtgatgaccaaggacggcctcaccgtgaccaa

SEQ ID NO: 14077 - DNA, 60 bp, Artificial Sequence
  Description of Artificial Sequence: Synthetic probe
agtccatcgtgctcgagatcgacgacgtgaagatctcggcgccggagttctcgcccatcg

SEQ ID NO: 14078 - DNA, 60 bp, Artificial Sequence
  Description of Artificial Sequence: Synthetic probe
tgttgcccgaccccaaggacgacgtctactaccgcccgctccacttccagtatgagtcat

SEQ ID NO: 14079 - DNA, 60 bp, Artificial Sequence
  Description of Artificial Sequence: Synthetic probe
tttgttgcccgaccccaaggacgacgtctactaccgcccgctccacttccagtatgagtc

SEQ ID NO: 14080 - DNA, 60 bp, Artificial Sequence
  Description of Artificial Sequence: Synthetic probe
ggggcatagtgaaataatactgatttcttaaatatggagcaggcgctcggatacaagttt

SEQ ID NO: 14081 - DNA, 60 bp, Artificial Sequence
  Description of Artificial Sequence: Synthetic probe
ctgggaccatagtgaaataatactgatttcttaaatatggagcaggcgctcggatacaag

SEQ ID NO: 14082 - DNA, 60 bp, Artificial Sequence
  Description of Artificial Sequence: Synthetic probe
ctggggccatagtgaaataatactgatttcttaaatatggagcaggcgctcggatacaag

SEQ ID NO: 14083 - DNA, 60 bp, Artificial Sequence
  Description of Artificial Sequence: Synthetic probe
tttcctcgaaaatattcaactcaagtccgagctccagttgctgacttccgaagaaatagg

SEQ ID NO: 14084 - DNA, 60 bp, Artificial Sequence
  Description of Artificial Sequence: Synthetic probe
gcagcggcctgcttaccgaggtgttcacgctggagaagcggctctctctggcgcgcgtgg

SEQ ID NO: 14085 - DNA, 60 bp, Artificial Sequence
  Description of Artificial Sequence: Synthetic probe
gcgcgtccagcaacttcagagatataagcattagcgaagacaagaaatgcgagtgccggg

SEQ ID NO: 14086 - DNA, 60 bp, Artificial Sequence
  Description of Artificial Sequence: Synthetic probe
ggaaacggcgcgtccagcaacttcagagatataagcattagcgaagacaagaaatgcgag

SEQ ID NO: 14087 - DNA, 60 bp, Artificial Sequence
  Description of Artificial Sequence: Synthetic probe
cgacggtaacggttatggttacgggagtgtcgtctagttcaggaaacggcgcgtccagca

SEQ ID NO: 14088 - DNA, 60 bp, Artificial Sequence
  Description of Artificial Sequence: Synthetic probe
cggcgaatacgacggtaacggttatggttacgggagtgtcgtctagttcaggaaacggcg

SEQ ID NO: 14089 - DNA, 60 bp, Artificial Sequence
  Description of Artificial Sequence: Synthetic probe
gttgtaacggagataataaagtatgcacctctacggaaacggcgaatacgacggtaacgg

SEQ ID NO: 14090 - DNA, 60 bp, Artificial Sequence
  Description of Artificial Sequence: Synthetic probe
atgcggaggttgttgtaacggagataataaagtatgcacctctacggaaacggcgaatac

SEQ ID NO: 14091 - DNA, 60 bp, Artificial Sequence
  Description of Artificial Sequence: Synthetic probe
ccaggaagtgtcggcgagcggtataatcctcaatgtgttaccgtcaagaaatgcggaggt

SEQ ID NO: 14092 - DNA, 60 bp, Artificial Sequence
  Description of Artificial Sequence: Synthetic probe
tagctgattggatgcagacgtcggataaaagtaagtgcatgcccagagataccgtggtat

SEQ ID NO: 14093 - DNA, 60 bp, Artificial Sequence
  Description of Artificial Sequence: Synthetic probe
atttagctgattggatgcagacgtcggataaaagtaagtgcatgcccagagataccgtgg

SEQ ID NO: 14094 - DNA, 60 bp, Artificial Sequence
  Description of Artificial Sequence: Synthetic probe
aatacattggatttatgcatcgtccggaggtagtagtaactcgggggggaatttagctga

SEQ ID NO: 14095 - DNA, 60 bp, Artificial Sequence
  Description of Artificial Sequence: Synthetic probe
cagtgtagcgtagtgcttatactgtgtctaatccaaatacattggatttatgcatcgtcc

SEQ ID NO: 14096 - DNA, 60 bp, Artificial Sequence
  Description of Artificial Sequence: Synthetic probe
atgagacttctaatacagtgtagcgtagtgcttatactgtgtctaatccaaatacattgg

SEQ ID NO: 14097 - DNA, 60 bp, Artificial Sequence
  Description of Artificial Sequence: Synthetic probe
ttaaaaagtgttgtagcggttcatgaggtcccaggccaggtgcttgttggtggagtagag

SEQ ID NO: 14098 - DNA, 60 bp, Artificial Sequence
  Description of Artificial Sequence: Synthetic probe
gcacgtcctcgaccgagcgcagccgcatctctccctccgacaccagacagccaagcgact

SEQ ID NO: 14099 - DNA, 60 bp, Artificial Sequence
  Description of Artificial Sequence: Synthetic probe
acatctcgtccatggcctcgcgcagacagtcgtccagcacgtccgcgttgtgcgcccact

SEQ ID NO: 14100 - DNA, 60 bp, Artificial Sequence
  Description of Artificial Sequence: Synthetic probe
ttcccacgtaccagtgcccggcgtccgagagccagaagctgccgagaaggttgccgacgc

SEQ ID NO: 14101 - DNA, 60 bp, Artificial Sequence
  Description of Artificial Sequence: Synthetic probe
cttcgtgcgcctgatctcgtacttctacccctcggccgtgcagagcaacgtgaacctgat

SEQ ID NO: 14102 - DNA, 60 bp, Artificial Sequence
  Description of Artificial Sequence: Synthetic probe
aaacacgcccctgcacagcctcgccaccttctgctcgtgccggcgctcggtgctcgacca

SEQ ID NO: 14103 - DNA, 60 bp, Artificial Sequence
  Description of Artificial Sequence: Synthetic probe
acctcgtcgcagcggccccactccagcgcgcagaccacgcggatctcgtaccccttgagc

SEQ ID NO: 14104 - DNA, 60 bp, Artificial Sequence
  Description of Artificial Sequence: Synthetic probe
gaaattgaggccaagcccagcagctccaagtaccccgatttcatccacccggttgacagc

SEQ ID NO: 14105 - DNA, 60 bp, Artificial Sequence
  Description of Artificial Sequence: Synthetic probe
acgggtccagtactactacttcgagagcggccagggcatgatcggcgacaacgcgggcat

SEQ ID NO: 14106 - DNA, 60 bp, Artificial Sequence
  Description of Artificial Sequence: Synthetic probe
cggtcgccagtctcgtcaccattctctccctagtcaccagcctcggtgcgatagtcagat

SEQ ID NO: 14107 - DNA, 60 bp, Artificial Sequence
  Description of Artificial Sequence: Synthetic probe
tgaagagcacgcagcgccacttcttgcgcacgtcgaaggcctcgtcgttggggtcgaaca

SEQ ID NO: 14108 - DNA, 60 bp, Artificial Sequence
  Description of Artificial Sequence: Synthetic probe
acctccaagatcgcggacaactgcttcgggcaccacgtcaccatcgcgctcatgtccttc

SEQ ID NO: 14109 - DNA, 60 bp, Artificial Sequence
  Description of Artificial Sequence: Synthetic probe
tccacggcgggcggcagacctacttctcggggcggcgctcggacgacttcctgagcacca

SEQ ID NO: 14110 - DNA, 60 bp, Artificial Sequence
  Description of Artificial Sequence: Synthetic probe
tgagccggctgcacttcggactcacgcacgcctgggtgcgcggcgccgccttcaactcgg

SEQ ID NO: 14111 - DNA, 60 bp, Artificial Sequence
  Description of Artificial Sequence: Synthetic probe
gcagaagttcgcggccagcgccatacagaagatgaacacgagcaccgccgggtcgtagtc

SEQ ID NO: 14112 - DNA, 60 bp, Artificial Sequence
  Description of Artificial Sequence: Synthetic probe
tcgtaggccttctgcatctccgcaacgccgatctccgcgtcgcccacgtaccggccgctg

SEQ ID NO: 14113 - DNA, 60 bp, Artificial Sequence
  Description of Artificial Sequence: Synthetic probe
agctcctgcacgcacagcagcgcggcctccgagcgtcggaacacgtggccccattgctcg

SEQ ID NO: 14114 - DNA, 60 bp, Artificial Sequence
  Description of Artificial Sequence: Synthetic probe
atgctgacgagcgtgtccacgtccgtgtcgaagtccaggcagtccacgcagagcccggtg

SEQ ID NO: 14115 - DNA, 60 bp, Artificial Sequence
  Description of Artificial Sequence: Synthetic probe
agcagttcgagacgatcaccatgtcctccagcaggcgctccacgaaggccatcacgaagt

SEQ ID NO: 14116 - DNA, 60 bp, Artificial Sequence
  Description of Artificial Sequence: Synthetic probe
gcagcctggtcatccgcaacgtgatgctcagcaacgggtactcggagttcggcggctcgc

SEQ ID NO: 14117 - DNA, 60 bp, Artificial Sequence
  Description of Artificial Sequence: Synthetic probe
tggccaacgacgccttccgcctgaacccggacacgccctacttcaccaaccgacgcacgc

SEQ ID NO: 14118 - DNA, 60 bp, Artificial Sequence
  Description of Artificial Sequence: Synthetic probe
actccgcgaccgcgggctgctcctccgcaaagttgttcgggtagaccttgtccgtggccg

SEQ ID NO: 14119 - DNA, 60 bp, Artificial Sequence
  Description of Artificial Sequence: Synthetic probe
acgtgctcgtgaaggagtggggcagcgacatgaccgtggagggcgaccgcgtcacgtaca

SEQ ID NO: 14120 - DNA, 60 bp, Artificial Sequence
  Description of Artificial Sequence: Synthetic probe
ccaggagtacgacttctttcacatgttctgtctgctctcgtcggtggtgtgctcgtgcga

SEQ ID NO: 14121 - DNA, 60 bp, Artificial Sequence
  Description of Artificial Sequence: Synthetic probe
acatgttcgtgcgcgattgccaaaacgacgccgcccggcctcactgcgtggcctggatcc

SEQ ID NO: 14122 - DNA, 60 bp, Artificial Sequence
  Description of Artificial Sequence: Synthetic probe
tcgtgagcgagcgaagggcggcggacaagggcgcgggatgctggtctaatctactaaggc

SEQ ID NO: 14123 - DNA, 60 bp, Artificial Sequence
  Description of Artificial Sequence: Synthetic probe
tgcaccagaagctcatgtagttgcgcgaggtggaggcgttcgccaggaagaagcggtggt

SEQ ID NO: 14124 - DNA, 60 bp, Artificial Sequence
  Description of Artificial Sequence: Synthetic probe
cgttgcagttggtcttgaagttggacacgtccaggtgcgcgctgagccccaccaccgagt

SEQ ID NO: 14125 - DNA, 60 bp, Artificial Sequence
  Description of Artificial Sequence: Synthetic probe
actggcgctcacgggcttgaggcgaccgaagtacccgctgtcgttctgccgctgcatgtc

SEQ ID NO: 14126 - DNA, 60 bp, Artificial Sequence
  Description of Artificial Sequence: Synthetic probe
atcttggtctccacgccgtagtgcgaccagaggtagaggcagaggcaggcgtcgtgcagg

SEQ ID NO: 14127 - DNA, 60 bp, Artificial Sequence
  Description of Artificial Sequence: Synthetic probe
tgtgctgcggtacttcctggacgcgaagctgggcacgctcgggctggtgctcgaggacta

SEQ ID NO: 14128 - DNA, 60 bp, Artificial Sequence
  Description of Artificial Sequence: Synthetic probe
tggagacgctgcccgccgaggtggcgtccctggcgcagggcaacatgagcaccctcgact

SEQ ID NO: 14129 - DNA, 60 bp, Artificial Sequence
  Description of Artificial Sequence: Synthetic probe
agaggtggcgtccctggcgcagggcaacatgagcaccctcgactgcttcaccgccatcac

SEQ ID NO: 14130 - DNA, 60 bp, Artificial Sequence
  Description of Artificial Sequence: Synthetic probe
ccgcggccaggtgcttgttgggtggagtagagaccgcaggttcttgatgttggagatgga

SEQ ID NO: 14131 - DNA, 60 bp, Artificial Sequence
  Description of Artificial Sequence: Synthetic probe
gcgtggaaaggcaccttcggctccacgatccatagagtagaaggtgttgtagcggttcat

SEQ ID NO: 14132 - DNA, 60 bp, Artificial Sequence
  Description of Artificial Sequence: Synthetic probe
tccttagcgtaaacggcgagcacccggagctaacttctcagcggttcaacccgccatgtg

SEQ ID NO: 14133 - DNA, 60 bp, Artificial Sequence
  Description of Artificial Sequence: Synthetic probe
agtgctggaaggcagtaagtgcaagccaaggccgacggtccttagcgtaaacggcgagca

SEQ ID NO: 14134 - DNA, 60 bp, Artificial Sequence
  Description of Artificial Sequence: Synthetic probe
aaaatggcccgaagtgctggaaggcagtaagtgcaagccaaggccgacggtccttagcgt

SEQ ID NO: 14135 - DNA, 60 bp, Artificial Sequence
  Description of Artificial Sequence: Synthetic probe
gcaccatgaggttgctcgtctgcatactagtagttgtgtgcttgcaccagcatctgctga

SEQ ID NO: 14136 - DNA, 60 bp, Artificial Sequence
  Description of Artificial Sequence: Synthetic probe
gcgtataagtgacgaatatccaagtttaacatctcagcgtttcagtcctccttgtgtatc

SEQ ID NO: 14137 - DNA, 60 bp, Artificial Sequence
  Description of Artificial Sequence: Synthetic probe
gtgcgtataagtgacgaatatccaagtttaacatctcagcgtttcagtcctccttgtgta

SEQ ID NO: 14138 - DNA, 60 bp, Artificial Sequence
  Description of Artificial Sequence: Synthetic probe
actcaaattcccagcacgacccctagaagatggacggatgtactaggtagtggatcatgc

SEQ ID NO: 14139 - DNA, 60 bp, Artificial Sequence
  Description of Artificial Sequence: Synthetic probe
gaggatcactgtccgcgcttcacctgcaccatcacgatatccggaaaggtcgttgctgcg

SEQ ID NO: 14140 - DNA, 60 bp, Artificial Sequence
  Description of Artificial Sequence: Synthetic probe
cgatgaagatgaacggctggtacatgacgcagctcaaggagacctacatgaccggcgcgc

SEQ ID NO: 14141 - DNA, 60 bp, Artificial Sequence
  Description of Artificial Sequence: Synthetic probe
ccggtcatgtaggtctccttgagctgcgtcatgtaccagccgttcgtcttcatcgcctcg

SEQ ID NO: 14142 - DNA, 60 bp, Artificial Sequence
  Description of Artificial Sequence: Synthetic probe
ccgctcatcgaggcgatgaagatgaacggctggtacatgacgcagctcaaggagacctac

SEQ ID NO: 14143 - DNA, 60 bp, Artificial Sequence
  Description of Artificial Sequence: Synthetic probe
gcaccggcgaccccgagctcatggtctaccccggcgggtacgacgtctcgctagacgcct

SEQ ID NO: 14144 - DNA, 60 bp, Artificial Sequence
  Description of Artificial Sequence: Synthetic probe
agacgtggactccaaagactacccgcacttcttcacggacatgtgcaagtccacgtgtcc

SEQ ID NO: 14145 - DNA, 60 bp, Artificial Sequence
  Description of Artificial Sequence: Synthetic probe
atggaaagacgtggactccaaagactacccgcacttcttcacggacatgtgcaagtccac

SEQ ID NO: 14146 - DNA, 60 bp, Artificial Sequence
  Description of Artificial Sequence: Synthetic probe
gcggtggaatggaaagacgtggactccaaagactacccgcacttcttcacggacatgtgc

SEQ ID NO: 14147 - DNA, 60 bp, Artificial Sequence
  Description of Artificial Sequence: Synthetic probe
agtgcgggtagtctttggagtccacgtctttccattccaccgccttgagcacgtggtcgc

SEQ ID NO: 14148 - DNA, 60 bp, Artificial Sequence
  Description of Artificial Sequence: Synthetic probe
gtagccgtgtgcttgcaccagtatctgctgaacgcggacagcacgaaaacatggtccgag

SEQ ID NO: 14149 - DNA, 60 bp, Artificial Sequence
  Description of Artificial Sequence: Synthetic probe
agtctttggagtccacgtctttccattccaccgccttgagcacgtggtcgcccttggggt

SEQ ID NO: 14150 - DNA, 60 bp, Artificial Sequence
  Description of Artificial Sequence: Synthetic probe
caccccaaaggcgaccacgtgctcaaggcggtggaatggaaagacgtggactccaaagac

SEQ ID NO: 14151 - DNA, 60 bp, Artificial Sequence
  Description of Artificial Sequence: Synthetic probe
tctcctcccgcgccgcaccccaaaggcgaccacgtgctcaaggcggtggaatggaaagac

SEQ ID NO: 14152 - DNA, 60 bp, Artificial Sequence
  Description of Artificial Sequence: Synthetic probe
atctcctcccgcgccgcaccccaagggcgaccacgtgctcaaggcggtggaatggaaaga

SEQ ID NO: 14153 - DNA, 60 bp, Artificial Sequence
  Description of Artificial Sequence: Synthetic probe
tcaactcaagtccgagctccagttgctgacttccgaagaaataggaagaactcctaagcg

SEQ ID NO: 14154 - DNA, 60 bp, Artificial Sequence
  Description of Artificial Sequence: Synthetic probe
agtaagcggagacctaatgccctcacccaatcctatccccgaagaggtggcgcagtgctc

SEQ ID NO: 14155 - DNA, 60 bp, Artificial Sequence
  Description of Artificial Sequence: Synthetic probe
acgacgttcaagtaagcggagacctaatgccctcacccaatcctatccccgaagaggtgg

SEQ ID NO: 14156 - DNA, 60 bp, Artificial Sequence
  Description of Artificial Sequence: Synthetic probe
gatctacggacctcgtctagaagtcaacgacctcattgacaggatgatggacgacgttca

SEQ ID NO: 14157 - DNA, 51 bp, Artificial Sequence
  Description of Artificial Sequence: Synthetic probe
catggactcctgggaccttgggtgatcgacgacccccagccgctcttcacg

SEQ ID NO: 14158 - DNA, 60 bp, Artificial Sequence
  Description of Artificial Sequence: Synthetic probe
tagccgcagttcgtgcgctggacaactttggggtggggcatattgacatcactgcgcgct

SEQ ID NO: 14159 - DNA, 60 bp, Artificial Sequence
  Description of Artificial Sequence: Synthetic probe
tgtctgtagccgcagttcgtgcgctggacaactttggggtggggcacgttgacgttactg

SEQ ID NO: 14160 - DNA, 60 bp, Artificial Sequence
  Description of Artificial Sequence: Synthetic probe
gatccgctgtctgtagccgcagttcgtgcgctggacaactttggggtggggcacgttgac

SEQ ID NO: 14161 - DNA, 60 bp, Artificial Sequence
  Description of Artificial Sequence: Synthetic probe
gatccgctgtctgtagccgcagttcgtgcgctggacaactttggggtggggcatattgac

SEQ ID NO: 14162 - DNA, 60 bp, Artificial Sequence
  Description of Artificial Sequence: Synthetic probe
agtgcactactggccgctggtcatggacgcgttgctgcgcgccgctattaaccgcagcgt

SEQ ID NO: 14163 - DNA, 60 bp, Artificial Sequence
  Description of Artificial Sequence: Synthetic probe
cgaagtgcactactggccgctggtcatggacgcgttgctgcgcgccgctattaaccgcag

SEQ ID NO: 14164 - DNA, 60 bp, Artificial Sequence
  Description of Artificial Sequence: Synthetic probe
atcgacctctcgctgctgtctatgctgccagtggtgcgctctggcagcgaagtgcactac

SEQ ID NO: 14165 - DNA, 60 bp, Artificial Sequence
  Description of Artificial Sequence: Synthetic probe
attgacctctcgctgctgtctatgctgccagtggtgcgctctggcagcgaagtgcactac

SEQ ID NO: 14166 - DNA, 60 bp, Artificial Sequence
  Description of Artificial Sequence: Synthetic probe
agcattgacctctcgctgctgtctatgctgccagtggtgcgctctggcagcgaagtgcac

SEQ ID NO: 14167 - DNA, 59 bp, Artificial Sequence
  Description of Artificial Sequence: Synthetic probe
catgaaccgctacaacaccttctactccatgatcgtggagccgaaggtaccgttcactc

SEQ ID NO: 14168 - DNA, 60 bp, Artificial Sequence
  Description of Artificial Sequence: Synthetic probe
gtgtatgccacaggcggaaaatcacgggccggacatcaaagagcacgttaactcgctggg

SEQ ID NO: 14169 - DNA, 60 bp, Artificial Sequence
  Description of Artificial Sequence: Synthetic probe
tttacttggaagaggtgtatgccacaggcggaaaatcacgggccggacatcaaagagcac

SEQ ID NO: 14170 - DNA, 60 bp, Artificial Sequence
  Description of Artificial Sequence: Synthetic probe
agcttccgcacgcacccgcactactcctggatgcagagcatctccatcccgcgcagcgtg

SEQ ID NO: 14171 - DNA, 52 bp, Artificial Sequence
  Description of Artificial Sequence: Synthetic probe
catggactcctgggacccctgggcgctcgacgacccccagccgctcttcacg

SEQ ID NO: 14172 - DNA, 60 bp, Artificial Sequence
  Description of Artificial Sequence: Synthetic probe
ggtgttgtccacgtagctgtactcgaggttgttcttgtgcgagtacacgatgatgtcctc

SEQ ID NO: 14173 - DNA, 60 bp, Artificial Sequence
  Description of Artificial Sequence: Synthetic probe
cgtgttgtccacgtagctgtactcgaggttgttcttgtgcgagtagatgatgatctcctc

SEQ ID NO: 14174 - DNA, 60 bp, Artificial Sequence
  Description of Artificial Sequence: Synthetic probe
cgcaccttaaactacctccatcaccaatatgctgatctacggacctcgtctagaagtcga

SEQ ID NO: 14175 - DNA, 60 bp, Artificial Sequence
  Description of Artificial Sequence: Synthetic probe
gagcataagaaatgcgattgtaaaccacgactcacaaccacgccaccgacgaccacaagg

SEQ ID NO: 14176 - DNA, 60 bp, Artificial Sequence
  Description of Artificial Sequence: Synthetic probe
cgtaggcgaggcgcacccagagctaacttctcagcggttcaacccgcagtgtgtcacagt

SEQ ID NO: 14177 - DNA, 60 bp, Artificial Sequence
  Description of Artificial Sequence: Synthetic probe
ttcccgtaggcgaggcgcacccagagctaacttctcagcggttcaacccgcagtgtgtca

SEQ ID NO: 14178 - DNA, 60 bp, Artificial Sequence
  Description of Artificial Sequence: Synthetic probe
tttgaaagcagtaagtgcaagccaaggccaacggtcgttcccgtaggcgaggcgcaccca

SEQ ID NO: 14179 - DNA, 60 bp, Artificial Sequence
  Description of Artificial Sequence: Synthetic probe
atggtccgaggtgtttgaaagcagtaagtgcaagccaaggccaacggtcgttcccgtagg

SEQ ID NO: 14180 - DNA, 60 bp, Artificial Sequence
  Description of Artificial Sequence: Synthetic probe
attcgcgttaaagaccttcgtacgtacggtgtaaactacaccttcttgtacaacttctgg

SEQ ID NO: 14181 - DNA, 60 bp, Artificial Sequence
  Description of Artificial Sequence: Synthetic probe
gctttggtattcgcgttaaagaccttcgtacgtacggtgtaaactacaccttcttgtaca

SEQ ID NO: 14182 - DNA, 60 bp, Artificial Sequence
  Description of Artificial Sequence: Synthetic probe
gacttggagaaaagcgcgtttatgcggccatgcgccgctttggtattcgcgttaaagacc

SEQ ID NO: 14183 - DNA, 60 bp, Artificial Sequence
  Description of Artificial Sequence: Synthetic probe
gttactctttcatcgacttggagaaaagcgcgtttatgcggccatgcgccgctttggtat

SEQ ID NO: 14184 - DNA, 60 bp, Artificial Sequence
  Description of Artificial Sequence: Synthetic probe
taggcaaagaccgcgttacacacgagttcgctgttcgtgacgggcagaggctctttgctg

SEQ ID NO: 14185 - DNA, 60 bp, Artificial Sequence
  Description of Artificial Sequence: Synthetic probe
tccttgttagatttgtaggcaaagaccgcgttacacacgagttcgctgttcgtgacgggc

SEQ ID NO: 14186 - DNA, 60 bp, Artificial Sequence
  Description of Artificial Sequence: Synthetic probe
gcttcttcatccgcatcggcaaagcgcgctacgaacgcgagagcggaacagttggtttgc

SEQ ID NO: 14187 - DNA, 60 bp, Artificial Sequence
  Description of Artificial Sequence: Synthetic probe
tcatggagacgagcttcttcatccgcatcggcaaagcgcgctacgaacgcgagagcggaa

SEQ ID NO: 14188 - DNA, 60 bp, Artificial Sequence
  Description of Artificial Sequence: Synthetic probe
tagagacgacgtacaacacggcacgccggcagatgtacgtgtacatggactcctggggac

SEQ ID NO: 14189 - DNA, 60 bp, Artificial Sequence
  Description of Artificial Sequence: Synthetic probe
gagcagcacatgcgcgtgaaggggatcttgggctccacgatcatggagaagaaggtgttg

SEQ ID NO: 14190 - DNA, 60 bp, Artificial Sequence
  Description of Artificial Sequence: Synthetic probe
gggcgtgatcatcgagcagcacatgcgcgtgaaggggatcttgggctccacgatcatgga

SEQ ID NO: 14191 - DNA, 60 bp, Artificial Sequence
  Description of Artificial Sequence: Synthetic probe
aagaagatgccgcctcccgcgtggttgaggtggaaatcggtggcggtgggcgtgatcatc

SEQ ID NO: 14192 - DNA, 60 bp, Artificial Sequence
  Description of Artificial Sequence: Synthetic probe
gagaagaagatgccgcctcccgcgtggttgaggtggaaatcggtggcggtgggcgtgatc

SEQ ID NO: 14193 - DNA, 53 bp, Artificial Sequence
  Description of Artificial Sequence: Synthetic probe
ggtcctcgtccagagtgcggtagaatcccaggaacttctcgggcgcgtccgag

SEQ ID NO: 14194 - DNA, 60 bp, Artificial Sequence
  Description of Artificial Sequence: Synthetic probe
gctgttgacggcagagttgatgcggtgcagcaccaggtcctcgtccagagtgcggtagaa

SEQ ID NO: 14195 - DNA, 60 bp, Artificial Sequence
  Description of Artificial Sequence: Synthetic probe
cagagagaggtcgatgctgttgacggcagagttgatgcggtgcagcaccaggtcctcgtc

SEQ ID NO: 14196 - DNA, 60 bp, Artificial Sequence
  Description of Artificial Sequence: Synthetic probe
tgctgctggcgtgccggatgacgggcacgatcgacagcagagagaggtcgatgctgttga

SEQ ID NO: 14197 - DNA, 60 bp, Artificial Sequence
  Description of Artificial Sequence: Synthetic probe
ggccagtactccatgctgctggcgtgccggatgacgggcacgatcgacagcagagagagg

SEQ ID NO: 14198 - DNA, 56 bp, Artificial Sequence
  Description of Artificial Sequence: Synthetic probe
gttgagcgtgcgcgcggcggccaccgagagcgggtccgcattcttccattcggtca

SEQ ID NO: 14199 - DNA, 60 bp, Artificial Sequence
  Description of Artificial Sequence: Synthetic probe
gatggagaacagccgcgcggagatgtcgatgctgcccacgccaaagtcgttgagcgtgcg

SEQ ID NO: 14200 - DNA, 60 bp, Artificial Sequence
  Description of Artificial Sequence: Synthetic probe
gggatggagaacagccgcgcggagatgtcgatgctgcccacgccaaagtcgttgagcgtg

SEQ ID NO: 14201 - DNA, 58 bp, Artificial Sequence
  Description of Artificial Sequence: Synthetic probe
cgtcccggccgggtaccgcgaacttgcgcacggacatgtccacgctgccgacgccaaa

SEQ ID NO: 14202 - DNA, 60 bp, Artificial Sequence
  Description of Artificial Sequence: Synthetic probe
gcgtcgtcccggccgggtaccgcgaacttgcgcacggacatgtccacgctgccgacgcca

SEQ ID NO: 14203 - DNA, 60 bp, Artificial Sequence
  Description of Artificial Sequence: Synthetic probe
gccgagatgctcgactgacaccgaccttattccttgcccgccgccctctcacgccctttt

SEQ ID NO: 14204 - DNA, 60 bp, Artificial Sequence
  Description of Artificial Sequence: Synthetic probe
tgtctgacgttggacttccggcagggctcccgcataccctcgcgatgcttcatccccacg

SEQ ID NO: 14205 - DNA, 60 bp, Artificial Sequence
  Description of Artificial Sequence: Synthetic probe
ggcctcgcggttctcctcgcagcaggtcttggcggtggctatcgtttcctccaggggctt

SEQ ID NO: 14206 - DNA, 60 bp, Artificial Sequence
  Description of Artificial Sequence: Synthetic probe
tcgtacgccttctgcatctcggccacgcctatctcggagtcgcccacgtagcgcccgctg

SEQ ID NO: 14207 - DNA, 60 bp, Artificial Sequence
  Description of Artificial Sequence: Synthetic probe
agcagcgggttgtgggcctccatgggcgccgtgttgatgcggatggtgagcttgtccttg

SEQ ID NO: 14208 - DNA, 60 bp, Artificial Sequence
  Description of Artificial Sequence: Synthetic probe
gaagaggtggcgcagtgctccccggaagacatgtcaaacatgctagacgatttcctcgaa

SEQ ID NO: 14209 - DNA, 60 bp, Artificial Sequence
  Description of Artificial Sequence: Synthetic probe
acgcgctcaaccaccccaagatccgcccctccgccacgctggagttcgaggtggtgccca

SEQ ID NO: 14210 - DNA, 60 bp, Artificial Sequence
  Description of Artificial Sequence: Synthetic probe
ttcaggttcctgcgcatccccgccatctccacgcccggacttcgcgcgcccgacgatgaa

SEQ ID NO: 14211 - DNA, 60 bp, Artificial Sequence
  Description of Artificial Sequence: Synthetic probe
ccctggcgctgcatgtcggtcttcttgctggtgtggatcttgaactcgcccttgagcatg

SEQ ID NO: 14212 - DNA, 60 bp, Artificial Sequence
  Description of Artificial Sequence: Synthetic probe
tgctccttcatcagccgcttcaccacgtccacgaggtcggagtgcttgtgccgcgccatt

SEQ ID NO: 14213 - DNA, 60 bp, Artificial Sequence
  Description of Artificial Sequence: Synthetic probe
accgctcggtgcgcacgcccgtggacccgaatccgcctgcgcctctttccgtatcgtcca

SEQ ID NO: 14214 - DNA, 60 bp, Artificial Sequence
  Description of Artificial Sequence: Synthetic probe
agttttacttggaagaggtgatgccacaggcggaaaatcacgggccggtatttcaaagag

SEQ ID NO: 14215 - DNA, 60 bp, Artificial Sequence
  Description of Artificial Sequence: Synthetic probe
gacgagagcttggaatgcgtccccacggaagaggcaaacgtgacgatgcaactcatgggg

SEQ ID NO: 14216 - DNA, 60 bp, Artificial Sequence
  Description of Artificial Sequence: Synthetic probe
ctgtctaacaagcttacgaggcgctcttccacactttctttagttggagctccagccgcg

SEQ ID NO: 14217 - DNA, 60 bp, Artificial Sequence
  Description of Artificial Sequence: Synthetic probe
aactgattgctgcagagaaacaggtaaccggttagacagactagaaagacacttggagag

SEQ ID NO: 14218 - DNA, 59 bp, Artificial Sequence
  Description of Artificial Sequence: Synthetic probe
ttgaccgcgctgaccgggttaagacttttgaggcgtatcacggcagactgagtcatgat

SEQ ID NO: 14219 - DNA, 59 bp, Artificial Sequence
  Description of Artificial Sequence: Synthetic probe
atcatgactcagtctgccgtgatacgcctcaaaagtcttaacccggtcagcgcggtcaa

SEQ ID NO: 14220 - DNA, 60 bp, Artificial Sequence
  Description of Artificial Sequence: Synthetic probe
cgccaggtagagacgacgtacaacacggcacgccggcagatgtacgtgtacatggactcc

SEQ ID NO: 14221 - DNA, 60 bp, Artificial Sequence
  Description of Artificial Sequence: Synthetic probe
cgccaggtagagaccacgtacaacacggcacgccggcagatgtacgtgtacatggactcc

SEQ ID NO: 14222 - DNA, 60 bp, Artificial Sequence
  Description of Artificial Sequence: Synthetic probe
atgatgaccatggcttactcgtgcgcggacgaagacgagttccgcgcggccgtcgaggag

SEQ ID NO: 14223 - DNA, 60 bp, Artificial Sequence
  Description of Artificial Sequence: Synthetic probe
gcgtcatgatgaccatggcttactcgtgcgcggacgaagacgagttccgcgcggccgtcg

SEQ ID NO: 14224 - DNA, 60 bp, Artificial Sequence
  Description of Artificial Sequence: Synthetic probe
agaggtgatgccgcaggcggaaaatcacgggccggacgtcaaagagcacgttaactcgct

SEQ ID NO: 14225 - DNA, 60 bp, Artificial Sequence
  Description of Artificial Sequence: Synthetic probe
tctgcacgagggctttgtcgccgactgcgagcgcgaagtcgcgctgctttctcaaaccat

SEQ ID NO: 14226 - DNA, 60 bp, Artificial Sequence
  Description of Artificial Sequence: Synthetic probe
gacaagctgccggccaagcagatcgcgaaggagctcggcatatccaaacacgagacaaac

SEQ ID NO: 14227 - DNA, 59 bp, Artificial Sequence
  Description of Artificial Sequence: Synthetic probe
acgcttgtgagcaggtcgaagagctccgagcggtcgcggccccggatgcccagcttgct

SEQ ID NO: 14228 - DNA, 60 bp, Artificial Sequence
  Description of Artificial Sequence: Synthetic probe
tggagaggttgtacaggctctcgagctccttcatctgcctgttcacgcgctgcgagttcc

SEQ ID NO: 14229 - DNA, 60 bp, Artificial Sequence
  Description of Artificial Sequence: Synthetic probe
gttctggtagctggagaggttgtacaggctctcgagctccttcatctgcctgttcacgcg

SEQ ID NO: 14230 - DNA, 51 bp, Artificial Sequence
  Description of Artificial Sequence: Synthetic probe
gagcgccatgacgatggggtgcacgcagctcacggagtcgcaggacttgaa

SEQ ID NO: 14231 - DNA, 60 bp, Artificial Sequence
  Description of Artificial Sequence: Synthetic probe
tcacgaaggcggcctccagtgcgggcaggcgcacgccgaagagcgccatgacgatggggt

SEQ ID NO: 14232 - DNA, 60 bp, Artificial Sequence
  Description of Artificial Sequence: Synthetic probe
ctgtccccgatcacgaaggcggcctccagtgcgggcaggcgcacgccgaagagcgccatg

SEQ ID NO: 14233 - DNA, 60 bp, Artificial Sequence
  Description of Artificial Sequence: Synthetic probe
gctgcagagaaacaggtaaccggttagacagactagaaagacacttggagagtctacgta

SEQ ID NO: 14234 - DNA, 54 bp, Artificial Sequence
  Description of Artificial Sequence: Synthetic probe
gagctctacgtagactctccaagtgtctttctagtctgtctaaccggttacctg

SEQ ID NO: 14235 - DNA, 60 bp, Artificial Sequence
  Description of Artificial Sequence: Synthetic probe
caagaagagctttacgtagactctccaagtgtctttctagtctgtctaaccggttacctg

SEQ ID NO: 14236 - DNA, 60 bp, Artificial Sequence
  Description of Artificial Sequence: Synthetic probe
gggcagagagggagcggccagccagacacaagtgctggcaacagcatgttaaatgtcctg

SEQ ID NO: 14237 - DNA, 60 bp, Artificial Sequence
  Description of Artificial Sequence: Synthetic probe
cgccagcgacaaccaaaactcggtgaagatcgggttggatgagggtaattacccagggcc

SEQ ID NO: 14238 - DNA, 60 bp, Artificial Sequence
  Description of Artificial Sequence: Synthetic probe
gtgggcccctgcaccctttagttgtgactggacccctagtgacgagaggatcagattgcc

SEQ ID NO: 14239 - DNA, 60 bp, Artificial Sequence
  Description of Artificial Sequence: Synthetic probe
ggcgcagcgtaggggcagagtaggtagagtgaaacccgggaggtattataggagccagga

SEQ ID NO: 14240 - DNA, 60 bp, Artificial Sequence
  Description of Artificial Sequence: Synthetic probe
gccagacaaggaaccgctaaactgacaacctggttaggcaagcagctcgggatactagga

SEQ ID NO: 14241 - DNA, 60 bp, Artificial Sequence
  Description of Artificial Sequence: Synthetic probe
ccgcggtgtgcactcgtggagtggctaaagcggtggactttatccctgtggagaacctag

SEQ ID NO: 14242 - DNA, 60 bp, Artificial Sequence
  Description of Artificial Sequence: Synthetic probe
cccagagccaatccaacttgcatacaacagctatgaagtccaggtcccggtcctgttccc

SEQ ID NO: 14243 - DNA, 60 bp, Artificial Sequence
  Description of Artificial Sequence: Synthetic probe
ggggcatatgcagcctctccctactgtgaggtagaacggaggctcggttacatctggtat

SEQ ID NO: 14244 - DNA, 60 bp, Artificial Sequence
  Description of Artificial Sequence: Synthetic probe
ggaccactgctacaaccactgcattcttggtttgtctggtgaaggtggtgagaggccaag

SEQ ID NO: 14245 - DNA, 60 bp, Artificial Sequence
  Description of Artificial Sequence: Synthetic probe
tgatagcaggggtagcctgctttcgccccgacccatttcctacttgaaaggctcctcggg

SEQ ID NO: 14246 - DNA, 60 bp, Artificial Sequence
  Description of Artificial Sequence: Synthetic probe
ggcaagcaggggacatggtgagtgaaaagaggccaagagtcatccaataccccgaggcta

SEQ ID NO: 14247 - DNA, 60 bp, Artificial Sequence
  Description of Artificial Sequence: Synthetic probe
ggtgagcaagcccagcgtaggggcagagtaggcagggtgaaaccagggagatactatagg

SEQ ID NO: 14248 - DNA, 60 bp, Artificial Sequence
  Description of Artificial Sequence: Synthetic probe
gacgacacaagcgggtgctagtgcttataccactgagagcggcagcagagtcagtctatc

SEQ ID NO: 14249 - DNA, 60 bp, Artificial Sequence
  Description of Artificial Sequence: Synthetic probe
gcccaacccagtctaagacacacctacggcgaagtgacatgggagcaacttgaggcaggg

SEQ ID NO: 14250 - DNA, 60 bp, Artificial Sequence
  Description of Artificial Sequence: Synthetic probe
ccagatctggtcacggtcgtggacaggggtgtgaaatgtgaaaagagggtgagggtgtca

SEQ ID NO: 14251 - DNA, 60 bp, Artificial Sequence
  Description of Artificial Sequence: Synthetic probe
atcattggggaagacctctacgactgtgccctgaggaggaattggacttgtgtgccgggg

SEQ ID NO: 14252 - DNA, 60 bp, Artificial Sequence
  Description of Artificial Sequence: Synthetic probe
tagcccaacccagcctaagacacacctacagtgacgtgacgtgggagcaacttgaggcag

SEQ ID NO: 14253 - DNA, 60 bp, Artificial Sequence
  Description of Artificial Sequence: Synthetic probe
accatcggggaagacctctacgactgtgccttaggagggaattggacttgtgtgccgggg

SEQ ID NO: 14254 - DNA, 60 bp, Artificial Sequence
  Description of Artificial Sequence: Synthetic probe
gactgcaggtcgggtaacagcaaggggcctgtgagtggaatctacttaaaaccagggccg

SEQ ID NO: 14255 - DNA, 60 bp, Artificial Sequence
  Description of Artificial Sequence: Synthetic probe
ggaggatctctatgactgtgccctcggaggaaactggacttgcgtgactggggaccagtc

SEQ ID NO: 14256 - DNA, 60 bp, Artificial Sequence
  Description of Artificial Sequence: Synthetic probe
cccaagccaatctcactgagggtcaaccaccaagagaatgtgcagtcacgtgcaggtatg

SEQ ID NO: 14257 - DNA, 60 bp, Artificial Sequence
  Description of Artificial Sequence: Synthetic probe
ccgaccctgggaaccagcaggtagtggagagtgggaaagcactgaagcaagtggaagggt

SEQ ID NO: 14258 - DNA, 60 bp, Artificial Sequence
  Description of Artificial Sequence: Synthetic probe
gccccaatccttttgctggtcgccacctatgggccgacttcctgacccttgttctgatcc

SEQ ID NO: 14259 - DNA, 60 bp, Artificial Sequence
  Description of Artificial Sequence: Synthetic probe
gggccagccttccagatggtttgccccataggatggacagggactgtgaatctgtgccaa

SEQ ID NO: 14260 - DNA, 60 bp, Artificial Sequence
  Description of Artificial Sequence: Synthetic probe
cgggactaggctttgggcccggagtggatgttgctatggcagtcctaaccttgaccctac

SEQ ID NO: 14261 - DNA, 60 bp, Artificial Sequence
  Description of Artificial Sequence: Synthetic probe
caggtgtcccctcccacctggccactgacacagaactgaaagcaattcatggtatgatgg

SEQ ID NO: 14262 - DNA, 60 bp, Artificial Sequence
  Description of Artificial Sequence: Synthetic probe
caatagggttgcaaggatccacgtctgtggggatgacggcttcctgataacagagagggg

SEQ ID NO: 14263 - DNA, 60 bp, Artificial Sequence
  Description of Artificial Sequence: Synthetic probe
ccaacccgccctgaaacacacttacggtgaggtgacgtgggagcaacttgaggcagggat

SEQ ID NO: 14264 - DNA, 60 bp, Artificial Sequence
  Description of Artificial Sequence: Synthetic probe
ggcccaagcaggtaaccacagccacagttagggagctgctagagcaggaggaacaagtcg

SEQ ID NO: 14265 - DNA, 60 bp, Artificial Sequence
  Description of Artificial Sequence: Synthetic probe
gtcactgtgggcgaacaggctcagcgaagagggagggttggtagagtaaagcccggtaga

SEQ ID NO: 14266 - DNA, 60 bp, Artificial Sequence
  Description of Artificial Sequence: Synthetic probe
ggctcactatctcgtagacgggatgaccaactccctagaaagtgccaggcaagggaccgc

SEQ ID NO: 14267 - DNA, 60 bp, Artificial Sequence
  Description of Artificial Sequence: Synthetic probe
cggggccgggtcgaggaccatcgcatcacccaagggtcctgtaatccagatgtataccaa

SEQ ID NO: 14268 - DNA, 60 bp, Artificial Sequence
  Description of Artificial Sequence: Synthetic probe
ctgcaggtcaggtaacagcaaagggcccgtgagtgggatctatctgaaaccggggccgtt

SEQ ID NO: 14269 - DNA, 60 bp, Artificial Sequence
  Description of Artificial Sequence: Synthetic probe
ctgtgggcgaacaggctcagcggagaggcagggtaggtagagtgaaacccggtaggtatt

SEQ ID NO: 14270 - DNA, 60 bp, Artificial Sequence
  Description of Artificial Sequence: Synthetic probe
gatgggcttacacacaccaaggagggatcagctcggtagaccacgtcacagccggaaagg

SEQ ID NO: 14271 - DNA, 60 bp, Artificial Sequence
  Description of Artificial Sequence: Synthetic probe
gtgactgtgggtgagcaggctcagcgtaggggcagagtaggtagaatgaaacccgggaga

SEQ ID NO: 14272 - DNA, 60 bp, Artificial Sequence
  Description of Artificial Sequence: Synthetic probe
cggtccctgttagatggtctgataacaccagtagctacatggccggcagagacactgccg

SEQ ID NO: 14273 - DNA, 60 bp, Artificial Sequence
  Description of Artificial Sequence: Synthetic probe
cctgcgcccttcagttgtgactggacccctggcgatgagaggatcagattgccaacggat

SEQ ID NO: 14274 - DNA, 60 bp, Artificial Sequence
  Description of Artificial Sequence: Synthetic probe
gggtgggagccatcgctgcgcataacgccattgaatccagcgaacagaaaaggaccctac

SEQ ID NO: 14275 - DNA, 60 bp, Artificial Sequence
  Description of Artificial Sequence: Synthetic probe
cgtcactgtgggtgaacaggctcaacgtagaggcagagtaggtagagtgaagcccgggag

SEQ ID NO: 14276 - DNA, 60 bp, Artificial Sequence
  Description of Artificial Sequence: Synthetic probe
ccagtgaggttccctacgagtctgttaaaggtgaggagaggcctggagactggctgggct

SEQ ID NO: 14277 - DNA, 60 bp, Artificial Sequence
  Description of Artificial Sequence: Synthetic probe
ccggattgacctacggacctggggtggacgtagctatagcggtcatgaccacaaccttgc

SEQ ID NO: 14278 - DNA, 60 bp, Artificial Sequence
  Description of Artificial Sequence: Synthetic probe
ggggccagatggtacagggcatcctatggctactactgataacaggagtgcaggggcacc

SEQ ID NO: 14279 - DNA, 60 bp, Artificial Sequence
  Description of Artificial Sequence: Synthetic probe
cccacaggggtggactggtagaatagaatgcaccctagcgaaccaagacaccttggacac

SEQ ID NO: 14280 - DNA, 60 bp, Artificial Sequence
  Description of Artificial Sequence: Synthetic probe
catgaatagaacccaagccaatctcactgagggacaaccaccaagggagtgcgcagtcac

SEQ ID NO: 14281 - DNA, 60 bp, Artificial Sequence
  Description of Artificial Sequence: Synthetic probe
ggagaccgggaaagcactgaagcaagtggtaggactgtcctctgccgagaatgccctgct

SEQ ID NO: 14282 - DNA, 60 bp, Artificial Sequence
  Description of Artificial Sequence: Synthetic probe
gatgggcttacacgcaccaaggagggatcagctcggtagaccatgtcacagccggaaagg

SEQ ID NO: 14283 - DNA, 60 bp, Artificial Sequence
  Description of Artificial Sequence: Synthetic probe
gtgacagtgaggaagcagtgtacctatttccatcaaggcataagagtggaagcaggccag

SEQ ID NO: 14284 - DNA, 60 bp, Artificial Sequence
  Description of Artificial Sequence: Synthetic probe
gcccctgtggctatgagatgaaagcactaaggaacgttagtggcagtcttaccaaagtgg

SEQ ID NO: 14285 - DNA, 60 bp, Artificial Sequence
  Description of Artificial Sequence: Synthetic probe
ctacaggcctcaccactcagtggtacgaatactcggatgggatgcggctgcaggactcag

SEQ ID NO: 14286 - DNA, 60 bp, Artificial Sequence
  Description of Artificial Sequence: Synthetic probe
ggctgaaggcctcaccactcagtggtatgaatactcggatgggatgcggctgcaggactc

SEQ ID NO: 14287 - DNA, 60 bp, Artificial Sequence
  Description of Artificial Sequence: Synthetic probe
gcccgctgggacggtgaccactacagggcagaagcacccgatagaggaatttatagctcc

SEQ ID NO: 14288 - DNA, 60 bp, Artificial Sequence
  Description of Artificial Sequence: Synthetic probe
ctcctggaatcctcttgtgaggaggatctgtctactggtcctttcacagcagccagagac

SEQ ID NO: 14289 - DNA, 60 bp, Artificial Sequence
  Description of Artificial Sequence: Synthetic probe
gctcactacctcgtagacgggatgaccaactccctagagagtgctaggcaagggaccgca

SEQ ID NO: 14290 - DNA, 60 bp, Artificial Sequence
  Description of Artificial Sequence: Synthetic probe
ctgggcacggggatcagtgcagccatggaaatcctgtcacaaaacccagtgtcggtgggt

SEQ ID NO: 14291 - DNA, 60 bp, Artificial Sequence
  Description of Artificial Sequence: Synthetic probe
catgactgccacgccggcagggtcggtgaccacaacaggtcaaaagcacccaatagagga

SEQ ID NO: 14292 - DNA, 60 bp, Artificial Sequence
  Description of Artificial Sequence: Synthetic probe
gactgcctgggcttacacacaccaaggcgggataagttcagtcgaccatgtaaccgccgg

SEQ ID NO: 14293 - DNA, 60 bp, Artificial Sequence
  Description of Artificial Sequence: Synthetic probe
gactggctgggcttacacacaccaaggcgggataagttcagtcgaccatgtaaccgccgg

SEQ ID NO: 14294 - DNA, 60 bp, Artificial Sequence
  Description of Artificial Sequence: Synthetic probe
gcacctgcccaaaatgtggacgccatgggaagccgataatgtgtgggatgtcgctagcgg

SEQ ID NO: 14295 - DNA, 60 bp, Artificial Sequence
  Description of Artificial Sequence: Synthetic probe
catgaatagaacccaagccaatcttactgagggacaaccaccaagggagtgcgcagtcac

SEQ ID NO: 14296 - DNA, 60 bp, Artificial Sequence
  Description of Artificial Sequence: Synthetic probe
gcccaacccagcctaaagcacacctacggcgaagtgacatgggaacaacttgaggcaggg

SEQ ID NO: 14297 - DNA, 60 bp, Artificial Sequence
  Description of Artificial Sequence: Synthetic probe
ggagctacgggcctcaccactcaatggtatgaatactcggatgggatgcggctgcaggac

SEQ ID NO: 14298 - DNA, 60 bp, Artificial Sequence
  Description of Artificial Sequence: Synthetic probe
gtgatcctgggatgggctcccgcaccttttagttgtgactggacccctagtgatgagaga

SEQ ID NO: 14299 - DNA, 60 bp, Artificial Sequence
  Description of Artificial Sequence: Synthetic probe
ttatgcatccggagggttggagttcgtaaggtcccaggcagaaaaggtaagatctgcccc

SEQ ID NO: 14300 - DNA, 60 bp, Artificial Sequence
  Description of Artificial Sequence: Synthetic probe
cgcaatccccgtatgtggtagtaagcaccaatgccatagagtcaggtgtgacattgccag

SEQ ID NO: 14301 - DNA, 60 bp, Artificial Sequence
  Description of Artificial Sequence: Synthetic probe
gtgacaatgaagaagcagtgtacctgtttccatcaaggcataagagtggaagcagaccgg

SEQ ID NO: 14302 - DNA, 60 bp, Artificial Sequence
  Description of Artificial Sequence: Synthetic probe
gggctattgtggctgatgctaataacaggagcgcagggcttccctgaatgcaaagagggc

SEQ ID NO: 14303 - DNA, 60 bp, Artificial Sequence
  Description of Artificial Sequence: Synthetic probe
agctgtatgaggatacacccgacgtctatagttggactagggaagacctctaacagcccc

SEQ ID NO: 14304 - DNA, 60 bp, Artificial Sequence
  Description of Artificial Sequence: Synthetic probe
tctcagcgaaggccgaaaagaggctagccatgcccttagtaggactagcataatgagggg

SEQ ID NO: 14305 - DNA, 60 bp, Artificial Sequence
  Description of Artificial Sequence: Synthetic probe
cccctcagcgaaggccgaaaagaggctagccatgcccttagtaggactagcataaagagg

SEQ ID NO: 14306 - DNA, 54 bp, Artificial Sequence
  Description of Artificial Sequence: Synthetic probe
cgagatgctacgtggacgagggcatgcccaagacacaccttaaccctagcgggg

SEQ ID NO: 14307 - DNA, 60 bp, Artificial Sequence
  Description of Artificial Sequence: Synthetic probe
ttggtcagggatctgaaggccgggagaaagataaaatattatgaaactgcaataccaaaa

SEQ ID NO: 14308 - DNA, 60 bp, Artificial Sequence
  Description of Artificial Sequence: Synthetic probe
caatgataacagacatatataccatcgaggaccagagactagaagacaccacccacctcc

SEQ ID NO: 14309 - DNA, 60 bp, Artificial Sequence
  Description of Artificial Sequence: Synthetic probe
ggacatggcaacggggataacctatgcatcatacgggtacttctgccaaatgccccaacc

SEQ ID NO: 14310 - DNA, 60 bp, Artificial Sequence
  Description of Artificial Sequence: Synthetic probe
ggggcctggagactggctgggcttacacacaccaaggtgggataagttcagtcgaccatg

SEQ ID NO: 14311 - DNA, 60 bp, Artificial Sequence
  Description of Artificial Sequence: Synthetic probe
agtcgtcagtggttcgacgcctcggtataaaggtctcgagatgccacgtggacgagggca

SEQ ID NO: 14312 - DNA, 59 bp, Artificial Sequence
  Description of Artificial Sequence: Synthetic probe
ttagtaggactagcaaaataaggggggtagcaacagtggtgagttcgttggatggctga

SEQ ID NO: 14313 - DNA, 60 bp, Artificial Sequence
  Description of Artificial Sequence: Synthetic probe
ggaaggagtgggatttgttcaatgaaccagtagctgtgagttttgatactaaggcctggg

SEQ ID NO: 14314 - DNA, 60 bp, Artificial Sequence
  Description of Artificial Sequence: Synthetic probe
catggccaggactgatcacccagaaccaatccagcttgcatataacagttatgaggtcca

SEQ ID NO: 14315 - DNA, 60 bp, Artificial Sequence
  Description of Artificial Sequence: Synthetic probe
ggcgagagctgaaccaggcgcccaggggtacctagagcaggtagaccttagttttacgat

SEQ ID NO: 14316 - DNA, 60 bp, Artificial Sequence
  Description of Artificial Sequence: Synthetic probe
ggcaagggaccgcgaaactaacaacttggctgggcaggcagcttgggatactaggaaaga

SEQ ID NO: 14317 - DNA, 60 bp, Artificial Sequence
  Description of Artificial Sequence: Synthetic probe
cacagcactttagctgtatgagggtacacccgacgtctatagttggactagggaagaccc

SEQ ID NO: 14318 - DNA, 60 bp, Artificial Sequence
  Description of Artificial Sequence: Synthetic probe
gccggcagggtcggtgaccacaacaggtcaaaagcacccaatagaggaattcatagcccc

SEQ ID NO: 14319 - DNA, 60 bp, Artificial Sequence
  Description of Artificial Sequence: Synthetic probe
gccagcagggtcggtgaccacaacaggtcaaaagcacccaatagaggaattcatagcccc

SEQ ID NO: 14320 - DNA, 60 bp, Artificial Sequence
  Description of Artificial Sequence: Synthetic probe
aatataatggccaggactgaccacccagaaccaattcagctggcatacaacagctatgaa

SEQ ID NO: 14321 - DNA, 60 bp, Artificial Sequence
  Description of Artificial Sequence: Synthetic probe
gtgaatacttggatattgcagggttgaagataccgactgaagagatgaaaggcaacatgc

SEQ ID NO: 14322 - DNA, 60 bp, Artificial Sequence
  Description of Artificial Sequence: Synthetic probe
gactgagtatggcatcaagaccgactcagggtgtcccgaaggtgcgaggtgttacgtgct

SEQ ID NO: 14323 - DNA, 60 bp, Artificial Sequence
  Description of Artificial Sequence: Synthetic probe
aacctcggcgcagaaattggcgacctggaacatctaggatgggtactgagagggccagcc

SEQ ID NO: 14324 - DNA, 60 bp, Artificial Sequence
  Description of Artificial Sequence: Synthetic probe
aaattgggccatagatgatgaggaatgtaaagggctgaagaaactgtatctcctgtcagg

SEQ ID NO: 14325 - DNA, 60 bp, Artificial Sequence
  Description of Artificial Sequence: Synthetic probe
gggtgctggagtgaatactgaagagatagtcatgataggcaacttgctgacacacggtga

SEQ ID NO: 14326 - DNA, 60 bp, Artificial Sequence
  Description of Artificial Sequence: Synthetic probe
ctggtgaccatagcaggttgaaagacggacctatcaagaagtgtaagtggtgtggctatg

SEQ ID NO: 14327 - DNA, 60 bp, Artificial Sequence
  Description of Artificial Sequence: Synthetic probe
ggctgtgcacgagagagccctatcaaccagtgctgagtttatgcagatcagtgatgggac

SEQ ID NO: 14328 - DNA, 60 bp, Artificial Sequence
  Description of Artificial Sequence: Synthetic probe
ccgaaaagaggctagccatgcccttagtaggactagcaaaaggaggggactagcggtagc

SEQ ID NO: 14329 - DNA, 60 bp, Artificial Sequence
  Description of Artificial Sequence: Synthetic probe
ggggcagtcgtacacctccaaaagacaggtggggaattcacgtgtgtcactgcatcaggc

SEQ ID NO: 14330 - DNA, 60 bp, Artificial Sequence
  Description of Artificial Sequence: Synthetic probe
ggtagagcaattggtcagggatctgaaggccgggagaaagataaggtattatgaaacagc

SEQ ID NO: 14331 - DNA, 60 bp, Artificial Sequence
  Description of Artificial Sequence: Synthetic probe
ggctggagaaattgccaatagtgagggcccaaaccgacaccaaaacctttcatgaggcaa

SEQ ID NO: 14332 - DNA, 60 bp, Artificial Sequence
  Description of Artificial Sequence: Synthetic probe
gcagccatggaaatcctgtcacaaaacccagtatcggtaggtatatctgtgatgttgggg

SEQ ID NO: 14333 - DNA, 60 bp, Artificial Sequence
  Description of Artificial Sequence: Synthetic probe
gccggccgctgtcaagaacataatggccaggactgatcacccagagccgatccaacttgc

SEQ ID NO: 14334 - DNA, 60 bp, Artificial Sequence
  Description of Artificial Sequence: Synthetic probe
atcatgaatagaacccaagccaatctcactgagggtcaaccaccaagagaatgtgcagtc

SEQ ID NO: 14335 - DNA, 60 bp, Artificial Sequence
  Description of Artificial Sequence: Synthetic probe
caatgataacagacatatacaccatagaagatcaaagactagaggacacaacccacctcc

SEQ ID NO: 14336 - DNA, 60 bp, Artificial Sequence
  Description of Artificial Sequence: Synthetic probe
caatgatcacagacatatataccatagaagatcaaagactagaggacacaacccacctcc

SEQ ID NO: 14337 - DNA, 60 bp, Artificial Sequence
  Description of Artificial Sequence: Synthetic probe
cccaatgataacagacatatacaccatagaagatcaaagactagaggacacaacccacct

SEQ ID NO: 14338 - DNA, 58 bp, Artificial Sequence
  Description of Artificial Sequence: Synthetic probe
tcaacagggtggcaaggatccacgtctgtggggatgatggcttcttaataactgaaaa

SEQ ID NO: 14339 - DNA, 60 bp, Artificial Sequence
  Description of Artificial Sequence: Synthetic probe
gagtttcaacagggtggcaaggatccatgtctgtggggatgatggcttcttaataactga

SEQ ID NO: 14340 - DNA, 60 bp, Artificial Sequence
  Description of Artificial Sequence: Synthetic probe
ggtaccgtaccagccagaagggtgaagatacacccatatgaagcttacctaaagctaaaa

SEQ ID NO: 14341 - DNA, 60 bp, Artificial Sequence
  Description of Artificial Sequence: Synthetic probe
aaggggcacatggcatcagcttaccaattggcacagggtaactgggagcccctcggttgc

SEQ ID NO: 14342 - DNA, 60 bp, Artificial Sequence
  Description of Artificial Sequence: Synthetic probe
ccacctgcaactaagagcagtaaggggcacatggcatcagcttaccaattggcacagggc

SEQ ID NO: 14343 - DNA, 60 bp, Artificial Sequence
  Description of Artificial Sequence: Synthetic probe
ggggaacacacacagcactatacaaaagcatagctgcaagactggggcatgaaacagcgt

SEQ ID NO: 14344 - DNA, 60 bp, Artificial Sequence
  Description of Artificial Sequence: Synthetic probe
tggccaggacagatcacccagagccaatccaacttgcatacaacagctatgaagtccagg

SEQ ID NO: 14345 - DNA, 60 bp, Artificial Sequence
  Description of Artificial Sequence: Synthetic probe
taatggccaggactgatcacccagagccaatccaacttgcatacaacagctatgaagtcc

SEQ ID NO: 14346 - DNA, 60 bp, Artificial Sequence
  Description of Artificial Sequence: Synthetic probe
ataatggccaggactgatcacccagagccaatccaacttgcatacaacagctacgaggtc

SEQ ID NO: 14347 - DNA, 60 bp, Artificial Sequence
  Description of Artificial Sequence: Synthetic probe
gctccagaagtgatgaagggtgaagatcttggctctgagttcctggagattgcaggcctg

SEQ ID NO: 14348 - DNA, 60 bp, Artificial Sequence
  Description of Artificial Sequence: Synthetic probe
ttgccttgagatgctacgtggacgagggcatgcccaagacacactttaaccctggcgggg

SEQ ID NO: 14349 - DNA, 60 bp, Artificial Sequence
  Description of Artificial Sequence: Synthetic probe
ccaccctcaatcgacgctaaagctcccacacaagagaggggaacgcaatgtccccaccag

SEQ ID NO: 14350 - DNA, 60 bp, Artificial Sequence
  Description of Artificial Sequence: Synthetic probe
gtgaaaacggtttaaccaaccgctacgaatacagcctgatagggtgctgcagaggcccac

SEQ ID NO: 14351 - DNA, 60 bp, Artificial Sequence
  Description of Artificial Sequence: Synthetic probe
ggtcagccagacacaagtgcaggcaacagcatgctaaatgtgttaacaatgatgtatgcc

SEQ ID NO: 14352 - DNA, 55 bp, Artificial Sequence
  Description of Artificial Sequence: Synthetic probe
gtaggactagcaaacaaggagggtagcaacagtggtgagttcgttggatggctga

SEQ ID NO: 14353 - DNA, 60 bp, Artificial Sequence
  Description of Artificial Sequence: Synthetic probe
ggacaaatcctccttagcgaaggccgaaaagaggctagccatgcccttagtaggactagc

SEQ ID NO: 14354 - DNA, 60 bp, Artificial Sequence
  Description of Artificial Sequence: Synthetic probe
ccaaccgctacgaatacagcctgatagggtgctgcagaggcccactgtattgctactgaa

SEQ ID NO: 14355 - DNA, 59 bp, Artificial Sequence
  Description of Artificial Sequence: Synthetic probe
aacagggttgcaaggatccacgtctgtggggatgacggcttcctaataacagagagggg

SEQ ID NO: 14356 - DNA, 60 bp, Artificial Sequence
  Description of Artificial Sequence: Synthetic probe
tcaatacaaagaaaatcctcaaccctggaaagctatcagagcagctagatagagaagggc

SEQ ID NO: 14357 - DNA, 60 bp, Artificial Sequence
  Description of Artificial Sequence: Synthetic probe
ggccggcagagacactgccgttatattatcaaagatggcaacaagattggattcaagtgg

SEQ ID NO: 14358 - DNA, 60 bp, Artificial Sequence
  Description of Artificial Sequence: Synthetic probe
cactttagctgtatgaggatatacccgacgtctatagttggactagggaagacctctaac

SEQ ID NO: 14359 - DNA, 56 bp, Artificial Sequence
  Description of Artificial Sequence: Synthetic probe
gcagggtcagtaaccacaacaggacaaaagcacccaatagaggaattcatagcccc

SEQ ID NO: 14360 - DNA, 60 bp, Artificial Sequence
  Description of Artificial Sequence: Synthetic probe
gatagaagatgggatcaacgtaacaaagtcctttagggagatgaattacgattggagcct

SEQ ID NO: 14361 - DNA, 60 bp, Artificial Sequence
  Description of Artificial Sequence: Synthetic probe
gtagggaatcttccccttagcgaaggccgaaaagaggctagccatgcccttagtaggact

SEQ ID NO: 14362 - DNA, 54 bp, Artificial Sequence
  Description of Artificial Sequence: Synthetic probe
cgagatgctacgtggacgagggcatgcccaagacacaccttaactctagcgggg

SEQ ID NO: 14363 - DNA, 60 bp, Artificial Sequence
  Description of Artificial Sequence: Synthetic probe
ggacaaatcctcctcagcgaaggccgaaaagaggctagccatgcccttagtaggactagc

SEQ ID NO: 14364 - DNA, 60 bp, Artificial Sequence
  Description of Artificial Sequence: Synthetic probe
ccgactgttacgaatacagcctgatagggtgctgcagaggcccactgtattgctactaaa

SEQ ID NO: 14365 - DNA, 60 bp, Artificial Sequence
  Description of Artificial Sequence: Synthetic probe
cagaaaaggggctgcgggctttctagagaagaagaatgttggagaagtactggactcaga

SEQ ID NO: 14366 - DNA, 59 bp, Artificial Sequence
  Description of Artificial Sequence: Synthetic probe
ggccctttcacggcagccagagacagcgccatcatccaataccacttactactacagtg

SEQ ID NO: 14367 - DNA, 60 bp, Artificial Sequence
  Description of Artificial Sequence: Synthetic probe
actgagaaagggttgggactaaggtttgccagcaaagggaagcagatcttacacgaggca

SEQ ID NO: 14368 - DNA, 60 bp, Artificial Sequence
  Description of Artificial Sequence: Synthetic probe
cgaaaagagggatgtcagcgacgattggcaagcaggggacatggtgagtgaaaagaggcc

SEQ ID NO: 14369 - DNA, 60 bp, Artificial Sequence
  Description of Artificial Sequence: Synthetic probe
gaggcaatcagggacaagatagataaagacgagaaccaacaaaaccaagaattacacggc

SEQ ID NO: 14370 - DNA, 60 bp, Artificial Sequence
  Description of Artificial Sequence: Synthetic probe
tggcttcagcttaccaactggctcaaggaaactgggagcctctcgattgtggggtgtacc

SEQ ID NO: 14371 - DNA, 60 bp, Artificial Sequence
  Description of Artificial Sequence: Synthetic probe
ccggccagcagacccacaccctggttgaagaaatacacgagagggacagtaggccctttg

SEQ ID NO: 14372 - DNA, 60 bp, Artificial Sequence
  Description of Artificial Sequence: Synthetic probe
agggagcgtacctaggcgatgagcccaatcaccgtgatctagtagagagggactgtgcga

SEQ ID NO: 14373 - DNA, 60 bp, Artificial Sequence
  Description of Artificial Sequence: Synthetic probe
ccctgcacccttcagttgtgactggacccctagtgatgagaggatcaggctgcccactga

SEQ ID NO: 14374 - DNA, 60 bp, Artificial Sequence
  Description of Artificial Sequence: Synthetic probe
ccagccctggcatacctcccatatgctaccagtgcattgaaaatgttcaccccaacaaga

SEQ ID NO: 14375 - DNA, 60 bp, Artificial Sequence
  Description of Artificial Sequence: Synthetic probe
aggtggccggcttgtcatcagctgaaaatgccctgctcatagctttattcgggtatgtgg

SEQ ID NO: 14376 - DNA, 60 bp, Artificial Sequence
  Description of Artificial Sequence: Synthetic probe
atggctgttactgtgggtgagcaagcccagcgtaggggcagagtaggcagggtgaaacca

SEQ ID NO: 14377 - DNA, 60 bp, Artificial Sequence
  Description of Artificial Sequence: Synthetic probe
cccggcagggacggtaaccacaacagggcagaagcacccaatagaggaatttatagcccc

SEQ ID NO: 14378 - DNA, 60 bp, Artificial Sequence
  Description of Artificial Sequence: Synthetic probe
ggacttcaaacaaataacactagcaacaggggcaggcaaaaccacggagctcccaaaagc

SEQ ID NO: 14379 - DNA, 60 bp, Artificial Sequence
  Description of Artificial Sequence: Synthetic probe
ctgggcatatacgcaccaaggaggcataagctcagtggaccatgtgactgctggtaagga

SEQ ID NO: 14380 - DNA, 60 bp, Artificial Sequence
  Description of Artificial Sequence: Synthetic probe
gcggacgccacgggaaacccataacatgcgggatgtcactagctgattttgaggaaaggc

SEQ ID NO: 14381 - DNA, 60 bp, Artificial Sequence
  Description of Artificial Sequence: Synthetic probe
gagggtcaacaccgtctacgacgtggatgaaagcggcgagggagtttatctattcccgtc

SEQ ID NO: 14382 - DNA, 60 bp, Artificial Sequence
  Description of Artificial Sequence: Synthetic probe
ggctggaccttggacccgggttggacgcggctatgacagtcttgaccctaaccctactga

SEQ ID NO: 14383 - DNA, 60 bp, Artificial Sequence
  Description of Artificial Sequence: Synthetic probe
catcctagtgatagtggtggctctcctgggcggcaggtacgtactctggttactggtcac

SEQ ID NO: 14384 - DNA, 60 bp, Artificial Sequence
  Description of Artificial Sequence: Synthetic probe
gatgaggctaaaggacacaatggtcaaggtttggtgcaaagaaggtcagttcacgcacta

SEQ ID NO: 14385 - DNA, 60 bp, Artificial Sequence
  Description of Artificial Sequence: Synthetic probe
ctgacttcgccccggagactgctagtgtggcgtatttggctctgcattttggcataccac

SEQ ID NO: 14386 - DNA, 60 bp, Artificial Sequence
  Description of Artificial Sequence: Synthetic probe
ggagaacaaaagcaagacatggttcggggcatacgcggcatctccttactgtgaagtcga

SEQ ID NO: 14387 - DNA, 60 bp, Artificial Sequence
  Description of Artificial Sequence: Synthetic probe
gagtccaacgggcgatgttccaaagaaacgtgagtaggagcctgcacgggatttggcctg

SEQ ID NO: 14388 - DNA, 60 bp, Artificial Sequence
  Description of Artificial Sequence: Synthetic probe
ggcttgcttgccaaggagaggtgactgtagatcaggtaacagcaaagggccggtgagtgg

SEQ ID NO: 14389 - DNA, 60 bp, Artificial Sequence
  Description of Artificial Sequence: Synthetic probe
gggaaaatcctcctcagcgaaggccgaaaagaggctagccatgcccttagtaggactagc

SEQ ID NO: 14390 - DNA, 60 bp, Artificial Sequence
  Description of Artificial Sequence: Synthetic probe
cataagaaatggacaaaggggtagtggccagccagacagcagtgcaggcaacagcatgct

SEQ ID NO: 14391 - DNA, 60 bp, Artificial Sequence
  Description of Artificial Sequence: Synthetic probe
tcgtcagtggttcgacgcttcggaggacaagcctcgagatgccacgtggacgagggcatg

SEQ ID NO: 14392 - DNA, 58 bp, Artificial Sequence
  Description of Artificial Sequence: Synthetic probe
ttatcacatcccatttggttcacggatgccaggtaccagcgaccagagagaggaatgt

SEQ ID NO: 14393 - DNA, 60 bp, Artificial Sequence
  Description of Artificial Sequence: Synthetic probe
ctgagttgtctgaactagttgatttcaaggggactttcttggacagggaagtcttggaag

SEQ ID NO: 14394 - DNA, 60 bp, Artificial Sequence
  Description of Artificial Sequence: Synthetic probe
ccctgagttgtctgaactagttgatttcaaggggactttcttagacagggaagccttgga

SEQ ID NO: 14395 - DNA, 60 bp, Artificial Sequence
  Description of Artificial Sequence: Synthetic probe
cccgtgcgatgctaaacccttggtaaaaggaaaatttaatacaacacttctaaatgggcc

SEQ ID NO: 14396 - DNA, 60 bp, Artificial Sequence
  Description of Artificial Sequence: Synthetic probe
cccgtgtgatgctaaacccttggtaaggggaaaatttaatacaacacttctaaatgggcc

SEQ ID NO: 14397 - DNA, 54 bp, Artificial Sequence
  Description of Artificial Sequence: Synthetic probe
cgagatgctatgtggacgagggcatgcccaagacacaccttaaccctggcgggg

SEQ ID NO: 14398 - DNA, 60 bp, Artificial Sequence
  Description of Artificial Sequence: Synthetic probe
ggtgaggtatacataagaaatggacaaaggggtagtggccagccagacacaagtgcaggc

SEQ ID NO: 14399 - DNA, 60 bp, Artificial Sequence
  Description of Artificial Sequence: Synthetic probe
atggtgaagtatacataagaaatggacaaaggggtagtggtcagccagacacaagtgcag

SEQ ID NO: 14400 - DNA, 60 bp, Artificial Sequence
  Description of Artificial Sequence: Synthetic probe
gatggtgaagtatacataagaaatggacaaaggggtagtggccagccagacacaagtgca

SEQ ID NO: 14401 - DNA, 60 bp, Artificial Sequence
  Description of Artificial Sequence: Synthetic probe
agaaaaggggctgcaggctttctagagaagaagaatgttggagaagtactggactcagag

SEQ ID NO: 14402 - DNA, 60 bp, Artificial Sequence
  Description of Artificial Sequence: Synthetic probe
gggaaaatttaatacaacacttctaaatgggccagccttccagatggtttgccctatagg

SEQ ID NO: 14403 - DNA, 60 bp, Artificial Sequence
  Description of Artificial Sequence: Synthetic probe
cccttggtaaaaggaaaatttaatacaacacttctaaatgggccagccttccagatggtt

SEQ ID NO: 14404 - DNA, 60 bp, Artificial Sequence
  Description of Artificial Sequence: Synthetic probe
gctggaaaacaagagtaagacatggtttggggcatatgcagcctctccctactgtgaggt

SEQ ID NO: 14405 - DNA, 56 bp, Artificial Sequence
  Description of Artificial Sequence: Synthetic probe
ctcgagatgccacgtggacgagggcatgcccacagcacatcttaacctgagcgggg

SEQ ID NO: 14406 - DNA, 60 bp, Artificial Sequence
  Description of Artificial Sequence: Synthetic probe
ctaatcagagatttgaaggcaggaaggaagataagatattatgagacagcaataccaaaa

SEQ ID NO: 14407 - DNA, 60 bp, Artificial Sequence
  Description of Artificial Sequence: Synthetic probe
ccaggtgctatgtattaaatccagaggcagtaaatatatcagggtccaagggagctgtcg

SEQ ID NO: 14408 - DNA, 60 bp, Artificial Sequence
  Description of Artificial Sequence: Synthetic probe
ataagagtaagacatggtttggggcatatgcagcctcaccctactgtgaggtggagcgga

SEQ ID NO: 14409 - DNA, 59 bp, Artificial Sequence
  Description of Artificial Sequence: Synthetic probe
tagaggaccagagactagaagacaccacccacctccagtatgcacccaacgctataaaa

SEQ ID NO: 14410 - DNA, 60 bp, Artificial Sequence
  Description of Artificial Sequence: Synthetic probe
catcgaggaccagagactagaagacaccacccacctccagtatgcacccaacgccataaa

SEQ ID NO: 14411 - DNA, 60 bp, Artificial Sequence
  Description of Artificial Sequence: Synthetic probe
caccatagaggaccagagactagaagacaccacccacctccagtatgcacccaacgccat

SEQ ID NO: 14412 - DNA, 58 bp, Artificial Sequence
  Description of Artificial Sequence: Synthetic probe
tcgtccacctccaaaagacaggtggggaattcacgtgtgtcaccgcatcaggcacacc

SEQ ID NO: 14413 - DNA, 60 bp, Artificial Sequence
  Description of Artificial Sequence: Synthetic probe
caacgccatgagtggaacaagcatggttggtgcaactggtacaatattgagccttggatt

SEQ ID NO: 14414 - DNA, 60 bp, Artificial Sequence
  Description of Artificial Sequence: Synthetic probe
caacgccatgagtggaacaagcatggttggtgcaactggtacaatatcgaaccttggatt

SEQ ID NO: 14415 - DNA, 60 bp, Artificial Sequence
  Description of Artificial Sequence: Synthetic probe
cttcaacgccatgagtggaacaagcatggttggtgcaactggtacaatattgaaccctgg

SEQ ID NO: 14416 - DNA, 60 bp, Artificial Sequence
  Description of Artificial Sequence: Synthetic probe
cacgtgttgcagacttcaacgccatgagtggaacaagcatggttggtgcaactggtacaa

SEQ ID NO: 14417 - DNA, 60 bp, Artificial Sequence
  Description of Artificial Sequence: Synthetic probe
cacgtgttgcagacttcaacgccatgaatggaacaagcatggttggtgcaactggtacaa

SEQ ID NO: 14418 - DNA, 59 bp, Artificial Sequence
  Description of Artificial Sequence: Synthetic probe
gtgagttttgatactaaggcctgggacacccaagtgactagtagggatctacggcttat

SEQ ID NO: 14419 - DNA, 60 bp, Artificial Sequence
  Description of Artificial Sequence: Synthetic probe
gggtttgtacaatacaccgctaggggacaattgttcctgaggaatttacccatattggca

SEQ ID NO: 14420 - DNA, 60 bp, Artificial Sequence
  Description of Artificial Sequence: Synthetic probe
gagtaaggcatggtttggggcatatgcagcctctccctactgtgaggtaggacggaagct

SEQ ID NO: 14421 - DNA, 55 bp, Artificial Sequence
  Description of Artificial Sequence: Synthetic probe
aaaatataatggccaggactgaccacccagaaccaattcagctggcgtacaacag

SEQ ID NO: 14422 - DNA, 51 bp, Artificial Sequence
  Description of Artificial Sequence: Synthetic probe
ttccctgaatgcaaagagggcttccaatatgccatatcaaaagacagaaaa

SEQ ID NO: 14423 - DNA, 60 bp, Artificial Sequence
  Description of Artificial Sequence: Synthetic probe
ttccctgaatgcaaagagggcttccaatatgccatatcaaaagacagaaaaatagggcca

SEQ ID NO: 14424 - DNA, 60 bp, Artificial Sequence
  Description of Artificial Sequence: Synthetic probe
ggcctgtcgagtcttgcaagtggtgtggttacaagtttcataaaagtgagggactgccac

SEQ ID NO: 14425 - DNA, 60 bp, Artificial Sequence
  Description of Artificial Sequence: Synthetic probe
ggcctgtcgagtcttgcaagtggtgtggttacaagtttcataaaagtgagggtctgccac

SEQ ID NO: 14426 - DNA, 60 bp, Artificial Sequence
  Description of Artificial Sequence: Synthetic probe
ggcctgtcgagtcttgcaagtggtgtggttacaaattttataaaagtgagggtctgccac

SEQ ID NO: 14427 - DNA, 60 bp, Artificial Sequence
  Description of Artificial Sequence: Synthetic probe
cgctgaagttggcgacctggagcatctgggatgggtgctgagagggccagccgtgtgcaa

SEQ ID NO: 14428 - DNA, 60 bp, Artificial Sequence
  Description of Artificial Sequence: Synthetic probe
cagagggtacttaggtgggtccacaacaggctcaactgccctttatgggtcacaagctgc

SEQ ID NO: 14429 - DNA, 60 bp, Artificial Sequence
  Description of Artificial Sequence: Synthetic probe
acaagaagtcaccagagggtacttaggtgggtccacaacaggctcaactgccctttatgg

SEQ ID NO: 14430 - DNA, 60 bp, Artificial Sequence
  Description of Artificial Sequence: Synthetic probe
tttatgtgtgaaacaactaaacggatagggagagtaactggcagtgacggaaagctgtac

SEQ ID NO: 14431 - DNA, 60 bp, Artificial Sequence
  Description of Artificial Sequence: Synthetic probe
tacaaaacatacaaacaaaaacccgttggggtggaggaacctgtttacgatcaggcaggt

SEQ ID NO: 14432 - DNA, 60 bp, Artificial Sequence
  Description of Artificial Sequence: Synthetic probe
atgcaagataggggaaacagtggtgcaagtcacagcaatggatgataaattagggcctat

SEQ ID NO: 14433 - DNA, 60 bp, Artificial Sequence
  Description of Artificial Sequence: Synthetic probe
gacggcgtggctatagtaccatctggcctggtcaaatgcaagataggggaaacagtggtg

SEQ ID NO: 14434 - DNA, 60 bp, Artificial Sequence
  Description of Artificial Sequence: Synthetic probe
acttcttgcaacagagacggcgtggctatagtaccatctggcctggtcaaatgcaagata

SEQ ID NO: 14435 - DNA, 60 bp, Artificial Sequence
  Description of Artificial Sequence: Synthetic probe
gtggtgtggctacaaatttttaaaaagtgagggtctgccgcatttcccaattggcaaatg

SEQ ID NO: 14436 - DNA, 60 bp, Artificial Sequence
  Description of Artificial Sequence: Synthetic probe
gggacaggccttttccgtataggcagggctgtgtcacccacaaaaccattggggaagacc

SEQ ID NO: 14437 - DNA, 60 bp, Artificial Sequence
  Description of Artificial Sequence: Synthetic probe
caagagggacaggccttttccgtataggcagggctgtgtcacccacaaaaccattgggga

SEQ ID NO: 14438 - DNA, 60 bp, Artificial Sequence
  Description of Artificial Sequence: Synthetic probe
tgtgcactggccaataaggacacgttagccacaaccattgtgcgaacgtacaagagggac

SEQ ID NO: 14439 - DNA, 60 bp, Artificial Sequence
  Description of Artificial Sequence: Synthetic probe
agagtccactctgcacctggtcctccgcctcagaggtggggggccagccgtgtgcaagaa

SEQ ID NO: 14440 - DNA, 60 bp, Artificial Sequence
  Description of Artificial Sequence: Synthetic probe
agagtccactctgcacctggtcctccgcctcagaggtggggggcctgccgtgtgcaagaa

SEQ ID NO: 14441 - DNA, 60 bp, Artificial Sequence
  Description of Artificial Sequence: Synthetic probe
gacgagggcatgcccacagcacatcttaacctgagcgggggtcgttcaggtaaaaacggt

SEQ ID NO: 14442 - DNA, 60 bp, Artificial Sequence
  Description of Artificial Sequence: Synthetic probe
gacgagggcatgcccacagcacatcttaacctgagcgggggtcgtccaggtgaaaacggt

SEQ ID NO: 14443 - DNA, 60 bp, Artificial Sequence
  Description of Artificial Sequence: Synthetic probe
tgaacaggggagacttcaagcagataaccttagcgacaggagcaggaaaaaccacagaac

SEQ ID NO: 14444 - DNA, 60 bp, Artificial Sequence
  Description of Artificial Sequence: Synthetic probe
acgtggacgagggcatgcccacagcacatcttagcctgagcgggggtcgctcgggtgaaa

SEQ ID NO: 14445 - DNA, 60 bp, Artificial Sequence
  Description of Artificial Sequence: Synthetic probe
ttcgacgctctggcaacaagagagcctcgagatgccatgtggacgagggcatgcccacgg

SEQ ID NO: 14446 - DNA, 60 bp, Artificial Sequence
  Description of Artificial Sequence: Synthetic probe
ttcgacgctctgacaacgaaagggcctcgagatgccatgtggacgagggcatgcccacgg

SEQ ID NO: 14447 - DNA, 60 bp, Artificial Sequence
  Description of Artificial Sequence: Synthetic probe
ggttcgacgctctggcaacaagagagcctcgagatgccatgtggacgagggcatgcccac

SEQ ID NO: 14448 - DNA, 60 bp, Artificial Sequence
  Description of Artificial Sequence: Synthetic probe
ggttcgacgctctggcaatggaagagcctcgagatgccatgtggacgagggcatgcccac

SEQ ID NO: 14449 - DNA, 60 bp, Artificial Sequence
  Description of Artificial Sequence: Synthetic probe
ggttcgacgctctgacaacgaaagggcctcgagatgccatgtggacgagggcatgcccac

SEQ ID NO: 14450 - DNA, 60 bp, Artificial Sequence
  Description of Artificial Sequence: Synthetic probe
cgaaaacggtctaaccaaccgctacgaatacagcctgatagggcgctgcagaggcccact

SEQ ID NO: 14451 - DNA, 57 bp, Artificial Sequence
  Description of Artificial Sequence: Synthetic probe
atacagcctgatagggtgctgcaaaggcccactgtttcgctactaaaaatctctgct

SEQ ID NO: 14452 - DNA, 60 bp, Artificial Sequence
  Description of Artificial Sequence: Synthetic probe
cgaatacagcctgatagggtgctgcaaaggcccactgtatcgccactaaaaatctctgct

SEQ ID NO: 14453 - DNA, 51 bp, Artificial Sequence
  Description of Artificial Sequence: Synthetic probe
cgaatacagcctgatagggtgctgcaaaggcccactgtatcgccactaaaa

SEQ ID NO: 14454 - DNA, 60 bp, Artificial Sequence
  Description of Artificial Sequence: Synthetic probe
ccaactgctacgaatacagcctgatagggtgctgcagaggcccactgtattgctactaaa

SEQ ID NO: 14455 - DNA, 60 bp, Artificial Sequence
  Description of Artificial Sequence: Synthetic probe
ggtctaaccaaccgctacgaatacagcctgatagggtgctgcaggggcccactgtattgc

SEQ ID NO: 14456 - DNA, 60 bp, Artificial Sequence
  Description of Artificial Sequence: Synthetic probe
taaaaacggtctaaccaaccgctacgaatacagcctgatagggtgctgcaggggcccact

SEQ ID NO: 14457 - DNA, 60 bp, Artificial Sequence
  Description of Artificial Sequence: Synthetic probe
ggggtggtgtagcaatagtgccaacagggactgtgaagtgtaaaattggagacagagtgg

SEQ ID NO: 14458 - DNA, 60 bp, Artificial Sequence
  Description of Artificial Sequence: Synthetic probe
acctcttgcaataggggtggtgtagcaatagtgccaacagggactgtgaagtgtaaaatt

SEQ ID NO: 14459 - DNA, 60 bp, Artificial Sequence
  Description of Artificial Sequence: Synthetic probe
gtagctacaagtttctgaagagtgaagggctaccacattatccaattggcaagtgcaggt

SEQ ID NO: 14460 - DNA, 60 bp, Artificial Sequence
  Description of Artificial Sequence: Synthetic probe
gtggtgtagctacaagtttctgaagagtgaagggctaccacattatccaattggcaagtg

SEQ ID NO: 14461 - DNA, 60 bp, Artificial Sequence
  Description of Artificial Sequence: Synthetic probe
gtagaaggggaacaactacgttacacagggggtgtcgttgaatcctgcaagtggtgtagc

SEQ ID NO: 14462 - DNA, 60 bp, Artificial Sequence
  Description of Artificial Sequence: Synthetic probe
ctctatgcctgtgccttaggtggaaactggacttgtgtagaaggggaacaactacgttac

SEQ ID NO: 14463 - DNA, 60 bp, Artificial Sequence
  Description of Artificial Sequence: Synthetic probe
ttataggtgaagatctctatgcctgtgccttaggtggaaactggacttgtgtagaagggg

SEQ ID NO: 14464 - DNA, 60 bp, Artificial Sequence
  Description of Artificial Sequence: Synthetic probe
caataaccacaccctaggcacggccatagtgcgaacgtataagagggttagcccattccc

SEQ ID NO: 14465 - DNA, 60 bp, Artificial Sequence
  Description of Artificial Sequence: Synthetic probe
tgtaccctagtcaataaccacaccctaggcacggccatagtgcgaacgtataagagggtt

SEQ ID NO: 14466 - DNA, 60 bp, Artificial Sequence
  Description of Artificial Sequence: Synthetic probe
gacgagggcatgcccaaagcacatcttaacctgagcgggggtcgctcaggcgaaaacagt

SEQ ID NO: 14467 - DNA, 60 bp, Artificial Sequence
  Description of Artificial Sequence: Synthetic probe
gacgagggcatgcccaaagcacatcttaacctgagcgggggtcgctcaggtgaaaacagt

SEQ ID NO: 14468 - DNA, 60 bp, Artificial Sequence
  Description of Artificial Sequence: Synthetic probe
tgcaccctagccaataaggacaccctagatacggccgtagtgcggacgtataagagggtt

SEQ ID NO: 14469 - DNA, 50 bp, Artificial Sequence
  Description of Artificial Sequence: Synthetic probe
tgcaccctagccaataaggacaccctagatacggccgtagtgcggacgta

SEQ ID NO: 14470 - DNA, 60 bp, Artificial Sequence
  Description of Artificial Sequence: Synthetic probe
tgcaagataggggacacagtggtgcaagtcatagcaatggatgataagctagggcctatg

SEQ ID NO: 14471 - DNA, 60 bp, Artificial Sequence
  Description of Artificial Sequence: Synthetic probe
taataggggaagatatccatgaatgcattcttggtggaaactggacatgcataattggcg

SEQ ID NO: 14472 - DNA, 57 bp, Artificial Sequence
  Description of Artificial Sequence: Synthetic probe
ggaacctaggtgcggaagttggcgacctggagcatctgggatgggtactgagaggca

SEQ ID NO: 14473 - DNA, 60 bp, Artificial Sequence
  Description of Artificial Sequence: Synthetic probe
cactttagctgtatgaggatatacccgacgtctacagttggactagggaagacctctaac

SEQ ID NO: 14474 - DNA, 60 bp, Artificial Sequence
  Description of Artificial Sequence: Synthetic probe
agcactttagctgtatgaggatatacccgacgtctacagttggactagggaagacctcta

SEQ ID NO: 14475 - DNA, 60 bp, Artificial Sequence
  Description of Artificial Sequence: Synthetic probe
aagataatatacccaacataaacagctaaacagtagttgagattatctacctcaagataa

SEQ ID NO: 14476 - DNA, 60 bp, Artificial Sequence
  Description of Artificial Sequence: Synthetic probe
tgacccttgtacatattgtatataaatatagttgggatcatctacctcaaaagataatat

SEQ ID NO: 14477 - DNA, 60 bp, Artificial Sequence
  Description of Artificial Sequence: Synthetic probe
gaaagcgggtaaaccaaccgttacggacacaacctgatagggtgctgcagaggcccactg

SEQ ID NO: 14478 - DNA, 60 bp, Artificial Sequence
  Description of Artificial Sequence: Synthetic probe
tgaaagcgggtaaaccaaccgttacggacacaacctgatagggtgctgcagaggcccact

SEQ ID NO: 14479 - DNA, 60 bp, Artificial Sequence
  Description of Artificial Sequence: Synthetic probe
ccacagcacatcctagcctggacaggggtcgtccaggtgaaagcgggtaaaccaaccgtt

SEQ ID NO: 14480 - DNA, 60 bp, Artificial Sequence
  Description of Artificial Sequence: Synthetic probe
gacgcgggcacgcccacagcacatcctagcctggacaggggtcgtccaggtgaaagcggg

SEQ ID NO: 14481 - DNA, 60 bp, Artificial Sequence
  Description of Artificial Sequence: Synthetic probe
tcgtcagtggttcgacgccttagaatttaggtctcgagatgccacgtggacgcgggcacg

SEQ ID NO: 14482 - DNA, 60 bp, Artificial Sequence
  Description of Artificial Sequence: Synthetic probe
agtcgtcagtggttcgacgccttagaatttaggtctcgagatgccacgtggacgcgggca

SEQ ID NO: 14483 - DNA, 60 bp, Artificial Sequence
  Description of Artificial Sequence: Synthetic probe
ttggaattatgcctagaggcacaacccctagggcacccgtgaggttccccacagcattac

SEQ ID NO: 14484 - DNA, 60 bp, Artificial Sequence
  Description of Artificial Sequence: Synthetic probe
ggttcaacactcgaggcagtgaaagagtcttgagatgccatgtggacgagggcatgccca

SEQ ID NO: 14485 - DNA, 60 bp, Artificial Sequence
  Description of Artificial Sequence: Synthetic probe
ggttcaacactctggcagaaaaagagtcttgagatgccatgtggacgagggcatgcccac

SEQ ID NO: 14486 - DNA, 60 bp, Artificial Sequence
  Description of Artificial Sequence: Synthetic probe
gtggtagacaggggaagcccataacatgtggaatgacactcgcagactttgaggagaaac

SEQ ID NO: 14487 - DNA, 60 bp, Artificial Sequence
  Description of Artificial Sequence: Synthetic probe
aagtgtggtagacaggggaagcccataacatgtggaatgacactcgcagactttgaggag

SEQ ID NO: 14488 - DNA, 60 bp, Artificial Sequence
  Description of Artificial Sequence: Synthetic probe
attggaatggagccaactgcccaaagtgtggtagacaggggaagcccataacatgtggaa

SEQ ID NO: 14489 - DNA, 60 bp, Artificial Sequence
  Description of Artificial Sequence: Synthetic probe
tagtttgcacaatctgtgaagggaaagattggaatggagccaactgcccaaagtgtggta

SEQ ID NO: 14490 - DNA, 60 bp, Artificial Sequence
  Description of Artificial Sequence: Synthetic probe
atagtttgcacaatctgtgaagggaaagattggaatggagccaactgcccaaagtgtggt

SEQ ID NO: 14491 - DNA, 60 bp, Artificial Sequence
  Description of Artificial Sequence: Synthetic probe
gaaaacaccttatggtgttggggttacagcctgatagggtgctgcagaggcccacgatag

SEQ ID NO: 14492 - DNA, 60 bp, Artificial Sequence
  Description of Artificial Sequence: Synthetic probe
atgaaaacaccttacggtgttggggttacagcctgatagggtgctgcagaggcccactta

SEQ ID NO: 14493 - DNA, 60 bp, Artificial Sequence
  Description of Artificial Sequence: Synthetic probe
ctctaccagcagaggctgatctttgccgggaaacagctggaagatggccgcaccctgtct

SEQ ID NO: 14494 - DNA, 57 bp, Artificial Sequence
  Description of Artificial Sequence: Synthetic probe
ccccagaccagcagaggctgatctttgccgggaaacagctggaagatggccgcaccc

SEQ ID NO: 14495 - DNA, 60 bp, Artificial Sequence
  Description of Artificial Sequence: Synthetic probe
ccagaccagcggaggctgatctttgccgggaaacagctggaagatggccgcaccctgtct

SEQ ID NO: 14496 - DNA, 60 bp, Artificial Sequence
  Description of Artificial Sequence: Synthetic probe
ccagaccagcagaggctgatctttgccgggaaacagctggaagatggccgtaccctgtct

SEQ ID NO: 14497 - DNA, 60 bp, Artificial Sequence
  Description of Artificial Sequence: Synthetic probe
ccagaccagcagaggctgatctttgccgggaaacagctggaagatggccgcaccctgtct

SEQ ID NO: 14498 - DNA, 60 bp, Artificial Sequence
  Description of Artificial Sequence: Synthetic probe
tggctacagacaagtagatgagacctcttgcaacagagacggtgtggctatagtaccaac

SEQ ID NO: 14499 - DNA, 60 bp, Artificial Sequence
  Description of Artificial Sequence: Synthetic probe
gccaactggtcgggtgaaatgcaggataggggacacagtggtgcaagtcttggcaatgga

SEQ ID NO: 14500 - DNA, 60 bp, Artificial Sequence
  Description of Artificial Sequence: Synthetic probe
gctaactggtcgggtgaaatgcaggataggggacacagtggtgcaagtcgtagcaatgga

SEQ ID NO: 14501 - DNA, 54 bp, Artificial Sequence
  Description of Artificial Sequence: Synthetic probe
aaaggaggggactagcggtagcagtgagttcattggatggccgaatccctgagt

SEQ ID NO: 14502 - DNA, 54 bp, Artificial Sequence
  Description of Artificial Sequence: Synthetic probe
aaaagaggggactagcggtagcagtgagttcattggatggccgaatccctgagt

SEQ ID NO: 14503 - DNA, 60 bp, Artificial Sequence
  Description of Artificial Sequence: Synthetic probe
atactgtggctgatactcataacaggggcgcaagggtacctagattgcaaacccgaactc

SEQ ID NO: 14504 - DNA, 60 bp, Artificial Sequence
  Description of Artificial Sequence: Synthetic probe
gataaactgctacggatacagcctgatagggtgctgcagaggcccactgcattgctacta

SEQ ID NO: 14505 - DNA, 60 bp, Artificial Sequence
  Description of Artificial Sequence: Synthetic probe
ggatgggatcaacgtgacaaagtcctttagggaaatgaactacgattggagtctgtatga

SEQ ID NO: 14506 - DNA, 60 bp, Artificial Sequence
  Description of Artificial Sequence: Synthetic probe
gtagcaggggaacagctacattacacagggggtgccatagaatcctgtaagtggtgtggc

SEQ ID NO: 14507 - DNA, 60 bp, Artificial Sequence
  Description of Artificial Sequence: Synthetic probe
tgtatagtaggggaacagctacattacacagggggtgccatagaatcgtgcaagtggtgc

SEQ ID NO: 14508 - DNA, 60 bp, Artificial Sequence
  Description of Artificial Sequence: Synthetic probe
tctactatcaggactatgcagggcccgtatatcatagagccccactggaactatgtagag

SEQ ID NO: 14509 - DNA, 60 bp, Artificial Sequence
  Description of Artificial Sequence: Synthetic probe
ggctgacaacttcgaatttggcctttgtccgtgtgatgctaagaccgtggtaaaggggaa

SEQ ID NO: 14510 - DNA, 60 bp, Artificial Sequence
  Description of Artificial Sequence: Synthetic probe
tagatatggctgacaacttcgaatttggcctttgtccgtgtgatgctaagaccgtggtaa

SEQ ID NO: 14511 - DNA, 60 bp, Artificial Sequence
  Description of Artificial Sequence: Synthetic probe
gcgtagccaggtatctggctgtgctacatacaagaggcttgccgacatctgcagcgttca

SEQ ID NO: 14512 - DNA, 60 bp, Artificial Sequence
  Description of Artificial Sequence: Synthetic probe
ggtggggatgcggctacaggacacagatgtggttgtttggtgcaaagatggtgagttcag

SEQ ID NO: 14513 - DNA, 60 bp, Artificial Sequence
  Description of Artificial Sequence: Synthetic probe
cggtggggatgcggctacaggacacagatgtggttgtttggtgcaaagatggtgagttca

SEQ ID NO: 14514 - DNA, 60 bp, Artificial Sequence
  Description of Artificial Sequence: Synthetic probe
acttggagctacggggctcaccacccagtggtatgaattctcggtggggatgcggctaca

SEQ ID NO: 14515 - DNA, 60 bp, Artificial Sequence
  Description of Artificial Sequence: Synthetic probe
gatggggccacttggagctacggggctcaccacccagtggtatgaattctcggtggggat

SEQ ID NO: 14516 - DNA, 60 bp, Artificial Sequence
  Description of Artificial Sequence: Synthetic probe
tacccagactgcaaacccgacttttcatacgctatagccaaaaatgatgagatggggcca

SEQ ID NO: 14517 - DNA, 60 bp, Artificial Sequence
  Description of Artificial Sequence: Synthetic probe
gtaccactgtgccacacctgaacaattagcaataattggaaagatacacagattcgctga

SEQ ID NO: 14518 - DNA, 60 bp, Artificial Sequence
  Description of Artificial Sequence: Synthetic probe
ttcttagatgagtaccactgtgccacacctgaacaattagcaataattggaaagatacac

SEQ ID NO: 14519 - DNA, 60 bp, Artificial Sequence
  Description of Artificial Sequence: Synthetic probe
aactcccccaacccaaactgagagctgccatggtagagtattcatatatattcttagatg

SEQ ID NO: 14520 - DNA, 60 bp, Artificial Sequence
  Description of Artificial Sequence: Synthetic probe
aggtgacatggctactggtatcacttatgcctcatatgggtacttttgccaactccccca

SEQ ID NO: 14521 - DNA, 58 bp, Artificial Sequence
  Description of Artificial Sequence: Synthetic probe
aggtgacatggctactggtatcacttatgcctcatatgggtacttttgccaactcccc

SEQ ID NO: 14522 - DNA, 60 bp, Artificial Sequence
  Description of Artificial Sequence: Synthetic probe
ccattgagagctgcagcagagtcagtgtaccaatacatgagagtaaaatacccaagcata

SEQ ID NO: 14523 - DNA, 60 bp, Artificial Sequence
  Description of Artificial Sequence: Synthetic probe
accattgagagctgcagcagagtcagtgtaccaatacatgagagtaaaatacccaagcat

SEQ ID NO: 14524 - DNA, 60 bp, Artificial Sequence
  Description of Artificial Sequence: Synthetic probe
ggcaaatttaatgctagcttactgaatggaccagctttccagatggtatgcccacagggg

SEQ ID NO: 14525 - DNA, 58 bp, Artificial Sequence
  Description of Artificial Sequence: Synthetic probe
ggggaagttcaatgccagcttattgaatggaccagctttccagatggtatgcccacag

SEQ ID NO: 14526 - DNA, 60 bp, Artificial Sequence
  Description of Artificial Sequence: Synthetic probe
gcggtctaagtcctgagtacaggacagtcgtcagtggttcgacgcggtcatcgcatcgtc

SEQ ID NO: 14527 - DNA, 60 bp, Artificial Sequence
  Description of Artificial Sequence: Synthetic probe
tgtagatggatgtatattggtaaaaagcgccacaagataccaccaaaaagtgcttagatg

SEQ ID NO: 14528 - DNA, 60 bp, Artificial Sequence
  Description of Artificial Sequence: Synthetic probe
ggagttcttcgaagaagggtctatgtgtgaaacaactaaaaggattgggaggacaactgg

SEQ ID NO: 14529 - DNA, 60 bp, Artificial Sequence
  Description of Artificial Sequence: Synthetic probe
ccccattggagttcttcgaagaagggtctatgtgtgaaacaactaaaaggattgggagga

SEQ ID NO: 14530 - DNA, 59 bp, Artificial Sequence
  Description of Artificial Sequence: Synthetic probe
atctggcatccctaccaaggaaaggtgactgcaggtcaggcaatagtagggggactgta

SEQ ID NO: 14531 - DNA, 52 bp, Artificial Sequence
  Description of Artificial Sequence: Synthetic probe
atctggcatccctaccaaggaaaggtgactgcaggtcaggcaatagtagggg

SEQ ID NO: 14532 - DNA, 60 bp, Artificial Sequence
  Description of Artificial Sequence: Synthetic probe
cgttggagtggaggagccagtctacgaccggacaggcaaccccttgtttggcgaaagggg

SEQ ID NO: 14533 - DNA, 60 bp, Artificial Sequence
  Description of Artificial Sequence: Synthetic probe
ggtcgtccaggtgaaaacggtttaaccaaccgctacgaatacagcctgatagggtgttgc

SEQ ID NO: 14534 - DNA, 60 bp, Artificial Sequence
  Description of Artificial Sequence: Synthetic probe
ccaaaagaatcgggagagtgactggtagtgacagcaaattatatcacatttatgtgtgtg

SEQ ID NO: 14535 - DNA, 60 bp, Artificial Sequence
  Description of Artificial Sequence: Synthetic probe
aatgtgtgaaataaccaaaagaatcgggagagtgactggtagtgacagcaaattatatca

SEQ ID NO: 14536 - DNA, 60 bp, Artificial Sequence
  Description of Artificial Sequence: Synthetic probe
aaaggaccggtctatcatagagccccattggagtttttcgaggaagcatcaatgtgtgaa

SEQ ID NO: 14537 - DNA, 60 bp, Artificial Sequence
  Description of Artificial Sequence: Synthetic probe
gggaacacagtggtgcaagttatagcaatggatgataagctagggcctatgccttgcaga

SEQ ID NO: 14538 - DNA, 60 bp, Artificial Sequence
  Description of Artificial Sequence: Synthetic probe
atagggaatacagtggtgcaagttatagcaatggatgataagctagggcctatgccttgc

SEQ ID NO: 14539 - DNA, 60 bp, Artificial Sequence
  Description of Artificial Sequence: Synthetic probe
gtgtgtatagatgggtgtataatagtgaagagtgccacaagaagtcaccagagggtactt

SEQ ID NO: 14540 - DNA, 60 bp, Artificial Sequence
  Description of Artificial Sequence: Synthetic probe
tgtgtgtatagatggatgtataatagtgaagagtgccacaagaagtcaccagagggtact

SEQ ID NO: 14541 - DNA, 60 bp, Artificial Sequence
  Description of Artificial Sequence: Synthetic probe
tgtactctggccaataaagatacgttagccacaaccgttgtacgaacatacaagaggcat

SEQ ID NO: 14542 - DNA, 60 bp, Artificial Sequence
  Description of Artificial Sequence: Synthetic probe
aggtccctgccgcagaaaggtgactgccggaaaggcaatgtgaatggagcagtgagtggc

SEQ ID NO: 14543 - DNA, 60 bp, Artificial Sequence
  Description of Artificial Sequence: Synthetic probe
cgacatcaacgggcgtcctctgttcggagagagcagtgaggtacacccgcaatccacact

SEQ ID NO: 14544 - DNA, 60 bp, Artificial Sequence
  Description of Artificial Sequence: Synthetic probe
ccttgcgataggggtggcgtagccatagttccaacaggcaccgttaagtgtaggataggc

SEQ ID NO: 14545 - DNA, 60 bp, Artificial Sequence
  Description of Artificial Sequence: Synthetic probe
gcaatgagagtgggtacagacatgtagatgacaccccttgcgataggggtggcgtagcca

SEQ ID NO: 14546 - DNA, 60 bp, Artificial Sequence
  Description of Artificial Sequence: Synthetic probe
gtaagtgcatgcttagcaatgagagtgggtacagacatgtagatgacaccccttgcgata

SEQ ID NO: 14547 - DNA, 60 bp, Artificial Sequence
  Description of Artificial Sequence: Synthetic probe
atagctggtgaccatagcaagttgaaagatgggcctatcaaaaagtgtaagtggtgtgga

SEQ ID NO: 14548 - DNA, 60 bp, Artificial Sequence
  Description of Artificial Sequence: Synthetic probe
tgataggggaagacatccatgaatgcattctaggtggaaactggacatgcatagctggtg

SEQ ID NO: 14549 - DNA, 60 bp, Artificial Sequence
  Description of Artificial Sequence: Synthetic probe
tagaagaactaccccattccagcggagaagatggtgtgtctacgaaaaagtgatagggga

SEQ ID NO: 14550 - DNA, 60 bp, Artificial Sequence
  Description of Artificial Sequence: Synthetic probe
atacaacgagcaatgttcctaagaggggtgaacaggagcctacacggaatttggccagag

SEQ ID NO: 14551 - DNA, 60 bp, Artificial Sequence
  Description of Artificial Sequence: Synthetic probe
caagagggctagcccattccctaataggcaaggttgtgtcacccaaaaacttctggggga

SEQ ID NO: 14552 - DNA, 60 bp, Artificial Sequence
  Description of Artificial Sequence: Synthetic probe
taacagggctagcccattccctaataggcaaggttgtgtcacacaaaaacttctggggga

SEQ ID NO: 14553 - DNA, 60 bp, Artificial Sequence
  Description of Artificial Sequence: Synthetic probe
ctaactgctacgaatacggcctgatagggtgctgcagaggcccactgtattgctactaaa

SEQ ID NO: 14554 - DNA, 51 bp, Artificial Sequence
  Description of Artificial Sequence: Synthetic probe
gacacctcttgcaatagggatggtgtagcgatagtgccgaccggaactgtg

SEQ ID NO: 14555 - DNA, 60 bp, Artificial Sequence
  Description of Artificial Sequence: Synthetic probe
gcggctacagatttctgaagagtgagggactaccacactacccaattggcaagtgcaggt

SEQ ID NO: 14556 - DNA, 60 bp, Artificial Sequence
  Description of Artificial Sequence: Synthetic probe
caagtggtgcggctacagatttctgaagagtgagggactaccacactacccaattggcaa

SEQ ID NO: 14557 - DNA, 60 bp, Artificial Sequence
  Description of Artificial Sequence: Synthetic probe
tgtaccctagccaataaggacaccctccgcacaaccgtggtgcggacgtatgtgagggct

SEQ ID NO: 14558 - DNA, 60 bp, Artificial Sequence
  Description of Artificial Sequence: Synthetic probe
agaacaaggcctcgagatgccacgtggacgagggcatgcccaaagcacatcttaacccgg

SEQ ID NO: 14559 - DNA, 60 bp, Artificial Sequence
  Description of Artificial Sequence: Synthetic probe
gaacgagactggctacaggctggtagacgacacctcttgcaatgtgggtggtgtagcgat

SEQ ID NO: 14560 - DNA, 57 bp, Artificial Sequence
  Description of Artificial Sequence: Synthetic probe
attagacaagctgacggcattttttgggattatgccaagaggaactacacccagagc

SEQ ID NO: 14561 - DNA, 59 bp, Artificial Sequence
  Description of Artificial Sequence: Synthetic probe
aaaagataaccgaacacgaaaagtgccacgtcagcatattagacaagctgacggcattt

SEQ ID NO: 14562 - DNA, 60 bp, Artificial Sequence
  Description of Artificial Sequence: Synthetic probe
cctgccgtgtgcaaaaagataaccgaacacgaaaagtgccacgtcagcatattagacaag

SEQ ID NO: 14563 - DNA, 60 bp, Artificial Sequence
  Description of Artificial Sequence: Synthetic probe
aaacttacctatactggcaaccaaagtaaagatgctcatggtaggcaatctaggagagga

SEQ ID NO: 14564 - DNA, 56 bp, Artificial Sequence
  Description of Artificial Sequence: Synthetic probe
cactggcagattttgaagaaaggcactacaagaagatttttataagagaagggaac

SEQ ID NO: 14565 - DNA, 60 bp, Artificial Sequence
  Description of Artificial Sequence: Synthetic probe
cagctgtcccaaatgtgggcgccacggaaagcccataacatgtggaatgtcactggcaga

SEQ ID NO: 14566 - DNA, 59 bp, Artificial Sequence
  Description of Artificial Sequence: Synthetic probe
tcaaagctagcacgctgaataaaaataaacactgcataatatgcacagtatgtgagggc

SEQ ID NO: 14567 - DNA, 58 bp, Artificial Sequence
  Description of Artificial Sequence: Synthetic probe
aaggtgaagaaagcaagggtttaaagaaattctttttactgtctgggaggttgaagaa

SEQ ID NO: 14568 - DNA, 60 bp, Artificial Sequence
  Description of Artificial Sequence: Synthetic probe
caggatagtagcagcactcatagaactaaactggtccatggaaggtgaagaaagcaaggg

SEQ ID NO: 14569 - DNA, 60 bp, Artificial Sequence
  Description of Artificial Sequence: Synthetic probe
catggtttccaggatagtagcagcactcatagaactaaactggtccatggaaggtgaaga

SEQ ID NO: 14570 - DNA, 60 bp, Artificial Sequence
  Description of Artificial Sequence: Synthetic probe
caggaagatcattgaagagatctcaggaggcaccaacatggtttccaggatagtagcagc

SEQ ID NO: 14571 - DNA, 60 bp, Artificial Sequence
  Description of Artificial Sequence: Synthetic probe
acgtactatatgcacaggaagatcattgaagagatctcaggaggcaccaacatggtttcc

SEQ ID NO: 14572 - DNA, 60 bp, Artificial Sequence
  Description of Artificial Sequence: Synthetic probe
aggtccctgccgcggaaaggtgactgccggaaaggcaacatcaatggagcagtgagtggt

SEQ ID NO: 14573 - DNA, 60 bp, Artificial Sequence
  Description of Artificial Sequence: Synthetic probe
ccacatttatgtgtgtattgatggatgcataatagttaagagtgctacaagagatcgcca

SEQ ID NO: 14574 - DNA, 60 bp, Artificial Sequence
  Description of Artificial Sequence: Synthetic probe
atagcaaattataccacatttatgtgtgtattgatggatgcataatagttaagagtgcta

SEQ ID NO: 14575 - DNA, 60 bp, Artificial Sequence
  Description of Artificial Sequence: Synthetic probe
ttggagacacagtggtgcaagtcatagcgatggacacaaaacttgggcctatgccatgca

SEQ ID NO: 14576 - DNA, 60 bp, Artificial Sequence
  Description of Artificial Sequence: Synthetic probe
gtggctacagacaagtggatgagacctcctgcaacagagacggtgtggctatagtgccac

SEQ ID NO: 14577 - DNA, 60 bp, Artificial Sequence
  Description of Artificial Sequence: Synthetic probe
gctgaagaatgaaagtggctacagacaagtggatgagacctcctgcaacagagacggtgt

SEQ ID NO: 14578 - DNA, 60 bp, Artificial Sequence
  Description of Artificial Sequence: Synthetic probe
aaggatacgttagccttgaccattgtacgaacatacacgaggtacaagcctttcccctat

SEQ ID NO: 14579 - DNA, 60 bp, Artificial Sequence
  Description of Artificial Sequence: Synthetic probe
tgtgcactggctaataaggatacgttagccttgaccattgtacgaacatacacgaggtac

SEQ ID NO: 14580 - DNA, 60 bp, Artificial Sequence
  Description of Artificial Sequence: Synthetic probe
gactgatgagactgagtatggcatcaagaccgactctgggtgtcccgaaggtgcaaggtg

SEQ ID NO: 14581 - DNA, 60 bp, Artificial Sequence
  Description of Artificial Sequence: Synthetic probe
gaccgatgagactgagtatggcatcaagaccgactcagggtgtcccgaaggtgcgaggtg

SEQ ID NO: 14582 - DNA, 60 bp, Artificial Sequence
  Description of Artificial Sequence: Synthetic probe
atgaccgatgagactgagtatggcatcaagaccgactcagggtgccccgaaggtgcaagg

SEQ ID NO: 14583 - DNA, 60 bp, Artificial Sequence
  Description of Artificial Sequence: Synthetic probe
aataagatgactgatgagactgagtatggcatcaagaccgactcagggtgtcccgaaggt

SEQ ID NO: 14584 - DNA, 60 bp, Artificial Sequence
  Description of Artificial Sequence: Synthetic probe
ccctataggatggacagggactgtgagctgtatgctagctaatagggataccttaagcac

SEQ ID NO: 14585 - DNA, 60 bp, Artificial Sequence
  Description of Artificial Sequence: Synthetic probe
gtatgccctataggatggacagggactgtgagctgtatgctagctaatagggatacctta

SEQ ID NO: 14586 - DNA, 60 bp, Artificial Sequence
  Description of Artificial Sequence: Synthetic probe
ggacgataactttgagtttggactttgcccatgcgatgccagacccgtagtaagagggaa

SEQ ID NO: 14587 - DNA, 60 bp, Artificial Sequence
  Description of Artificial Sequence: Synthetic probe
ctggaagacacaatggtcatagcttggtgcaaagatggtaagtttacatacctcccaagg

SEQ ID NO: 14588 - DNA, 60 bp, Artificial Sequence
  Description of Artificial Sequence: Synthetic probe
cacctgaaatgatgctggaagacacaatggtcatagcttggtgcaaagatggtaagttta

SEQ ID NO: 14589 - DNA, 60 bp, Artificial Sequence
  Description of Artificial Sequence: Synthetic probe
cctgaatactcatatgccatagctaaggatgaaagaatcggcgcactgggagccgaaggc

SEQ ID NO: 14590 - DNA, 60 bp, Artificial Sequence
  Description of Artificial Sequence: Synthetic probe
gacctagattgcaaacctgaatactcatatgccatagctaaggatgaaagaatcggcgca

SEQ ID NO: 14591 - DNA, 60 bp, Artificial Sequence
  Description of Artificial Sequence: Synthetic probe
gggttacagcctgatagggtgctgcagaggcccactcataggctagtataaaaaatctct

SEQ ID NO: 14592 - DNA, 53 bp, Artificial Sequence
  Description of Artificial Sequence: Synthetic probe
gggttacagcctgatagggtgctgcagaggcccactcataggctagtataaaa

SEQ ID NO: 14593 - DNA, 60 bp, Artificial Sequence
  Description of Artificial Sequence: Synthetic probe
ctatgtctgcatagatgggtgtgtcctcctaaagagggcgagtagggaacaaccagaggt

SEQ ID NO: 14594 - DNA, 60 bp, Artificial Sequence
  Description of Artificial Sequence: Synthetic probe
gttaagagcgctacgagagatcgccaaaaagtactcaaatgggtccacaacaagctaaac

SEQ ID NO: 14595 - DNA, 56 bp, Artificial Sequence
  Description of Artificial Sequence: Synthetic probe
aatacatgttaaaagggaagtggcaatattggtttgacctggattctgcagaccac

SEQ ID NO: 14596 - DNA, 60 bp, Artificial Sequence
  Description of Artificial Sequence: Synthetic probe
gggaccggtacttccaacaatacatgttaaaagggaagtggcaatattggtttgacctgg

SEQ ID NO: 14597 - DNA, 60 bp, Artificial Sequence
  Description of Artificial Sequence: Synthetic probe
atgagccaagggaccggtacttccaacaatacatgttaaaagggaagtggcaatattggt

SEQ ID NO: 14598 - DNA, 60 bp, Artificial Sequence
  Description of Artificial Sequence: Synthetic probe
ggactagcaaaaggaggggactagcggtagcagtgagttcattggatggccgaacccctg

SEQ ID NO: 14599 - DNA, 60 bp, Artificial Sequence
  Description of Artificial Sequence: Synthetic probe
ggactagcaaaaggaggggactagcggtagcagtgagttcattggatggcctaatccctg

SEQ ID NO: 14600 - DNA, 60 bp, Artificial Sequence
  Description of Artificial Sequence: Synthetic probe
ttagattgcccattatgggttaccagctgctccgatgaagggggcaaaggtgccacaaat

SEQ ID NO: 14601 - DNA, 60 bp, Artificial Sequence
  Description of Artificial Sequence: Synthetic probe
actatcaggactatgcagggcccgtctatcatagagtcccactggaactatgtagagaga

SEQ ID NO: 14602 - DNA, 60 bp, Artificial Sequence
  Description of Artificial Sequence: Synthetic probe
atcctaaccaacgctaggtccttgccgcagaaaggtgactgccggaaaggcaacgtgaat

SEQ ID NO: 14603 - DNA, 60 bp, Artificial Sequence
  Description of Artificial Sequence: Synthetic probe
atgcataataattaagagtgccacaaaagatcgtcaaagggtactcaaatgggtccacaa

SEQ ID NO: 14604 - DNA, 60 bp, Artificial Sequence
  Description of Artificial Sequence: Synthetic probe
ggatgcataataattaagagtgccacaaaagatcgtcaaagggtacttaaatgggtccac

SEQ ID NO: 14605 - DNA, 60 bp, Artificial Sequence
  Description of Artificial Sequence: Synthetic probe
ggatgcataataattaagagtgccacaaaagatcgtcaaaaggtgctcaaatgggtccac

SEQ ID NO: 14606 - DNA, 60 bp, Artificial Sequence
  Description of Artificial Sequence: Synthetic probe
tggatgcataataattaagagtgccacaaaagatcgtcaaaaggtgctcaaatgggtcca

SEQ ID NO: 14607 - DNA, 60 bp, Artificial Sequence
  Description of Artificial Sequence: Synthetic probe
atgtgtgcatagatggatgcataataattaagagtgccacaaaagatcgtcaaagggtac

SEQ ID NO: 14608 - DNA, 60 bp, Artificial Sequence
  Description of Artificial Sequence: Synthetic probe
gtaacagcaaggggcccgtgagtgggatctatctgaaaccagggccattattctaccagg

SEQ ID NO: 14609 - DNA, 60 bp, Artificial Sequence
  Description of Artificial Sequence: Synthetic probe
cctgatactgcatttttccatcccgcaaagtcacacagaaacaacggattgtgataagac

SEQ ID NO: 14610 - DNA, 60 bp, Artificial Sequence
  Description of Artificial Sequence: Synthetic probe
ttcggggcatatgcagcctccccatactgtgatgttgaacgaaaacttggctacatctgg

SEQ ID NO: 14611 - DNA, 60 bp, Artificial Sequence
  Description of Artificial Sequence: Synthetic probe
cgaggtacaagccttttccctataggcaaggctgcatcacccagaaaaccatcggggaag

SEQ ID NO: 14612 - DNA, 60 bp, Artificial Sequence
  Description of Artificial Sequence: Synthetic probe
cacgaggtacaagccttttccctataggcaaggctgcatcacccagaaaaccatcgggga

SEQ ID NO: 14613 - DNA, 60 bp, Artificial Sequence
  Description of Artificial Sequence: Synthetic probe
cccttgcaatagagatggtgtagcgatagtgccacaaggaagattaaaatgcaggattgg

SEQ ID NO: 14614 - DNA, 60 bp, Artificial Sequence
  Description of Artificial Sequence: Synthetic probe
agatgataccccttgcaatagagatggtgtagcgatagtgccacaaggaagattaaaatg

SEQ ID NO: 14615 - DNA, 50 bp, Artificial Sequence
  Description of Artificial Sequence: Synthetic probe
aaaacgagactggctacaggctagtagatgataccccttgcaatagagat

SEQ ID NO: 14616 - DNA, 60 bp, Artificial Sequence
  Description of Artificial Sequence: Synthetic probe
tatccaattggcaaatgcaggctaaaaaacgagactggctacaggctagtagatgatacc

SEQ ID NO: 14617 - DNA, 60 bp, Artificial Sequence
  Description of Artificial Sequence: Synthetic probe
agggacaccctagacacggttgtagtgcggacgtataagaggactgtcccattccctaac

SEQ ID NO: 14618 - DNA, 60 bp, Artificial Sequence
  Description of Artificial Sequence: Synthetic probe
tgcgttctagccaatagggacaccctagacacggttgtagtgcggacgtataagaggact

SEQ ID NO: 14619 - DNA, 60 bp, Artificial Sequence
  Description of Artificial Sequence: Synthetic probe
ggtggaaactggacatgcatagctggtgaccatagtaagttgaaagatgggcctatcaag

SEQ ID NO: 14620 - DNA, 60 bp, Artificial Sequence
  Description of Artificial Sequence: Synthetic probe
ctaggtggaaactggacatgcatagctggtgaccatagtaagttgaaagatgggcctatc

SEQ ID NO: 14621 - DNA, 60 bp, Artificial Sequence
  Description of Artificial Sequence: Synthetic probe
agaactggcattgggcgatgtggacaaactcatgggggctatcactgattatgcatctgg

SEQ ID NO: 14622 - DNA, 60 bp, Artificial Sequence
  Description of Artificial Sequence: Synthetic probe
aagaactggcattgggcgatgtggacaaactcatgggggctatcactgattatgcatctg

SEQ ID NO: 14623 - DNA, 60 bp, Artificial Sequence
  Description of Artificial Sequence: Synthetic probe
gctataagaacagaggggacagaaactgaactaaaagaactggcattgggcgatgtggac

SEQ ID NO: 14624 - DNA, 60 bp, Artificial Sequence
  Description of Artificial Sequence: Synthetic probe
cacccaatgctataagaacagaggggacagaaactgaactaaaagaactggcattgggcg

SEQ ID NO: 14625 - DNA, 60 bp, Artificial Sequence
  Description of Artificial Sequence: Synthetic probe
caatacgcacccaatgctataagaacagaggggacagaaactgaactaaaagaactggca

SEQ ID NO: 14626 - DNA, 60 bp, Artificial Sequence
  Description of Artificial Sequence: Synthetic probe
ccaatacgcacccaatgctataagaacagaggggacagaaactgaactaaaagaactggc

SEQ ID NO: 14627 - DNA, 60 bp, Artificial Sequence
  Description of Artificial Sequence: Synthetic probe
gacccgtggatatggctgatgaacaaaacccaggccaatctgacggaaggtccaccagac

SEQ ID NO: 14628 - DNA, 60 bp, Artificial Sequence
  Description of Artificial Sequence: Synthetic probe
cagagggtactgagatgggtctataacaagctcaactgtcctctatgggttacaagctgc

SEQ ID NO: 14629 - DNA, 60 bp, Artificial Sequence
  Description of Artificial Sequence: Synthetic probe
ccacaagaagtcaccagagggtactgagatgggtctataacaagctcaactgtcctctat

SEQ ID NO: 14630 - DNA, 60 bp, Artificial Sequence
  Description of Artificial Sequence: Synthetic probe
gttgtaccacatctatgtgtgtatagatggatgtataatagtgaagagtgccacaagaag

SEQ ID NO: 14631 - DNA, 54 bp, Artificial Sequence
  Description of Artificial Sequence: Synthetic probe
gagttattcgaggaagggtctatgtgtgaaacgactaaacggatagggagagtg

SEQ ID NO: 14632 - DNA, 60 bp, Artificial Sequence
  Description of Artificial Sequence: Synthetic probe
cgggcaacagtaagggtcccgtcagccggatttacctaaagccagggccacaattctacc

SEQ ID NO: 14633 - DNA, 60 bp, Artificial Sequence
  Description of Artificial Sequence: Synthetic probe
gtcgggcaacagtaagggtcccgtcagccggatttacctaaagccagggccacaattcta

SEQ ID NO: 14634 - DNA, 60 bp, Artificial Sequence
  Description of Artificial Sequence: Synthetic probe
ccaatttggcgtccttaccaaagagaggtgactgcaggtcgggcaacagtaagggtcccg

SEQ ID NO: 14635 - DNA, 60 bp, Artificial Sequence
  Description of Artificial Sequence: Synthetic probe
cgcgaagtccctaccaatttggcgtccttaccaaagagaggtgactgcaggtcgggcaac

SEQ ID NO: 14636 - DNA, 60 bp, Artificial Sequence
  Description of Artificial Sequence: Synthetic probe
ccaccaccaagcgacgctaaagcttccacataggagaggggaccgcgaagtccctaccaa

SEQ ID NO: 14637 - DNA, 60 bp, Artificial Sequence
  Description of Artificial Sequence: Synthetic probe
gggcagtccaccaccaagcgacgctaaagcttccacataggagaggggaccgcgaagtcc

SEQ ID NO: 14638 - DNA, 60 bp, Artificial Sequence
  Description of Artificial Sequence: Synthetic probe
ccgttggagtggaggaaccagtatatgaccaagcaggtaaccctttgtttggcgagagag

SEQ ID NO: 14639 - DNA, 60 bp, Artificial Sequence
  Description of Artificial Sequence: Synthetic probe
ctggagtggaggaaccagtatatgaccaagcaggttaccctttgtttggcgagagagggg

SEQ ID NO: 14640 - DNA, 60 bp, Artificial Sequence
  Description of Artificial Sequence: Synthetic probe
ataaacaaaaacccgttggagtggaggaaccagtatatgaccaagcaggtaaccctttgt

SEQ ID NO: 14641 - DNA, 60 bp, Artificial Sequence
  Description of Artificial Sequence: Synthetic probe
acaaacaaaaacccactggagtggaggaaccagtatatgaccaagcaggttaccctttgt

SEQ ID NO: 14642 - DNA, 60 bp, Artificial Sequence
  Description of Artificial Sequence: Synthetic probe
caccttggatacaactgttgttaggacatatagaagaactactccattccagcggagaag

SEQ ID NO: 14643 - DNA, 60 bp, Artificial Sequence
  Description of Artificial Sequence: Synthetic probe
caagacaccttggatacaactgttgttaggacatatagaagaactaccccattccagcgg

SEQ ID NO: 14644 - DNA, 60 bp, Artificial Sequence
  Description of Artificial Sequence: Synthetic probe
caaaccaagacaccttggatacaactgttgttaggacatatagaagaactactccattcc

SEQ ID NO: 14645 - DNA, 60 bp, Artificial Sequence
  Description of Artificial Sequence: Synthetic probe
tgcaccttggtaaaccaagacaccttggatacaactgttgttaggacatatagaagaact

SEQ ID NO: 14646 - DNA, 60 bp, Artificial Sequence
  Description of Artificial Sequence: Synthetic probe
gtgtaaaattggagatacagtggtgcaggtcatagcaatggacacaaaacttgggcctat

SEQ ID NO: 14647 - DNA, 60 bp, Artificial Sequence
  Description of Artificial Sequence: Synthetic probe
tccgcaggcaacgctaaaactgccacataaaagaggggagtgtgaagtccctactaattt

SEQ ID NO: 14648 - DNA, 60 bp, Artificial Sequence
  Description of Artificial Sequence: Synthetic probe
gaccaagcaggtaaccccttgtttggcgagagaggggtggttcatccgcaggcaacgcta

SEQ ID NO: 14649 - DNA, 60 bp, Artificial Sequence
  Description of Artificial Sequence: Synthetic probe
gcacagctgtagtgcgaacatataagagggttagcccattccctaataggcaaggttgtg

SEQ ID NO: 14650 - DNA, 60 bp, Artificial Sequence
  Description of Artificial Sequence: Synthetic probe
gatgccacgtggacgagggcatgcccacagcacatcttagcctgagcgggggtcgcccag

SEQ ID NO: 14651 - DNA, 60 bp, Artificial Sequence
  Description of Artificial Sequence: Synthetic probe
agcgccacaagaagcaaccaacgagtgcttagatgggtttacaacaaactcgactgcccc

SEQ ID NO: 14652 - DNA, 60 bp, Artificial Sequence
  Description of Artificial Sequence: Synthetic probe
aaagcgccacaagaagcaaccaacgagtgcttagatgggtttacaacaaactcgactgcc

SEQ ID NO: 14653 - DNA, 60 bp, Artificial Sequence
  Description of Artificial Sequence: Synthetic probe
catttatgtgtgcatagatgggtgcatattggtgaaaagcgccacaagaagcaaccaacg

SEQ ID NO: 14654 - DNA, 60 bp, Artificial Sequence
  Description of Artificial Sequence: Synthetic probe
tggtaagttgtaccacatttatgtgtgcatagatgggtgcatattggtgaaaagcgccac

SEQ ID NO: 14655 - DNA, 60 bp, Artificial Sequence
  Description of Artificial Sequence: Synthetic probe
gggtctatgtgtgaaacgactaagaggatagggaggacaactggtagtgatggtaagttg

SEQ ID NO: 14656 - DNA, 60 bp, Artificial Sequence
  Description of Artificial Sequence: Synthetic probe
ctatgtaaagccaggacctctgttttaccaggactatatcgggcctgtctaccatagggc

SEQ ID NO: 14657 - DNA, 60 bp, Artificial Sequence
  Description of Artificial Sequence: Synthetic probe
gcctgtgagtggtatctatgtaaagccaggacctctgttttaccaggactatatcgggcc

SEQ ID NO: 14658 - DNA, 60 bp, Artificial Sequence
  Description of Artificial Sequence: Synthetic probe
ggcatccctaccaagaaaaggcgactgcaggtcaggcaatagtagagggcctgtgagtgg

SEQ ID NO: 14659 - DNA, 60 bp, Artificial Sequence
  Description of Artificial Sequence: Synthetic probe
ttggcatccctaccaagaaaaggcgactgcaggtcaggcaatagtagagggcctgtgagt

SEQ ID NO: 14660 - DNA, 60 bp, Artificial Sequence
  Description of Artificial Sequence: Synthetic probe
cacacaatagaggagaaaatgaagttcccactaatttggcatccctaccaagaaaaggcg

SEQ ID NO: 14661 - DNA, 60 bp, Artificial Sequence
  Description of Artificial Sequence: Synthetic probe
caacattgaaactaccacacaatagaggagaaaatgaagttcccactaatttggcatccc

SEQ ID NO: 14662 - DNA, 60 bp, Artificial Sequence
  Description of Artificial Sequence: Synthetic probe
ccgaccaggtgagcccttgtttggtgaaagagagtcaatacaccctcaatcaacattgaa

SEQ ID NO: 14663 - DNA, 58 bp, Artificial Sequence
  Description of Artificial Sequence: Synthetic probe
aaaacccgctggagtggaggaaccggtctacgaccgaccaggtgagcccttgtttggt

SEQ ID NO: 14664 - DNA, 60 bp, Artificial Sequence
  Description of Artificial Sequence: Synthetic probe
aaccaatgctaggtccctgccgcggaaaggtgactgccggagaggcaatgtgtatggacc

SEQ ID NO: 14665 - DNA, 60 bp, Artificial Sequence
  Description of Artificial Sequence: Synthetic probe
ctgccgcggaaaggtgactgccggaaaggcaatgtgaatggagcagtgagcggcatctac

SEQ ID NO: 14666 - DNA, 60 bp, Artificial Sequence
  Description of Artificial Sequence: Synthetic probe
ttgaagagtgaagggctaccacattatccaattggcaaatgcaggttaaaaaacgaaact

SEQ ID NO: 14667 - DNA, 60 bp, Artificial Sequence
  Description of Artificial Sequence: Synthetic probe
cagctcggtagaccatgtcacagccggaaaggatttactagtgtgtgacagcatgggcag

SEQ ID NO: 14668 - DNA, 60 bp, Artificial Sequence
  Description of Artificial Sequence: Synthetic probe
ggagggatcagctcagtagatcacgtcacagccggaaaggatttactagtgtgtgacagt

SEQ ID NO: 14669 - DNA, 60 bp, Artificial Sequence
  Description of Artificial Sequence: Synthetic probe
gaggtacaacccctagggcacctgtgaggttccccacagcactactgaaagtgagaaggg

SEQ ID NO: 14670 - DNA, 60 bp, Artificial Sequence
  Description of Artificial Sequence: Synthetic probe
gaggcacaacccctagggcacctgtgaggttccccacagcactactgaaagtgagaaggg

SEQ ID NO: 14671 - DNA, 50 bp, Artificial Sequence
  Description of Artificial Sequence: Synthetic probe
ggggcccagtatggagcaggggaaatagtgatgatgggaaacttgctgac

SEQ ID NO: 14672 - DNA, 55 bp, Artificial Sequence
  Description of Artificial Sequence: Synthetic probe
ggggcccagtatggagcaggggaaatagtgatgatgggaaacttgctgacgcatg

SEQ ID NO: 14673 - DNA, 60 bp, Artificial Sequence
  Description of Artificial Sequence: Synthetic probe
aaaggcctcgggggcccagtatggagcaggggaaatagtgatgatgggaaacttgctgac

SEQ ID NO: 14674 - DNA, 60 bp, Artificial Sequence
  Description of Artificial Sequence: Synthetic probe
aagagcctcgggggcccagtatggagcaggggaaatagtgatgatgggaaacttgctgac

SEQ ID NO: 14675 - DNA, 57 bp, Artificial Sequence
  Description of Artificial Sequence: Synthetic probe
taatcttacagagggtcaaccaccaagagagtgcgccgtcacgtgcaggtatgatag

SEQ ID NO: 14676 - DNA, 60 bp, Artificial Sequence
  Description of Artificial Sequence: Synthetic probe
ggtttaaccaaccgctacgaatacagcctgatagggtgctgcagaggcccactgtattgc

SEQ ID NO: 14677 - DNA, 60 bp, Artificial Sequence
  Description of Artificial Sequence: Synthetic probe
aaactagggccaatgccttgcaaaccacatgaaatcatatccagtgaggggcctgtggaa

SEQ ID NO: 14678 - DNA, 60 bp, Artificial Sequence
  Description of Artificial Sequence: Synthetic probe
ccagcttttcagttggtatgcccgcaggggtggactggtacaatagaatgcaccctggcg

SEQ ID NO: 14679 - DNA, 60 bp, Artificial Sequence
  Description of Artificial Sequence: Synthetic probe
gggccatagatgatgaggaatgtaaaggactgaagaaactgtatctcctatcagggagag

SEQ ID NO: 14680 - DNA, 56 bp, Artificial Sequence
  Description of Artificial Sequence: Synthetic probe
ccgtgttgataagctgcatcagtagccagtggcagttggtctacatttcttacctg

SEQ ID NO: 14681 - DNA, 60 bp, Artificial Sequence
  Description of Artificial Sequence: Synthetic probe
cattcttggtggaaactggacatgcatagctggtgaccatagtaagttgaaagacgggcc

SEQ ID NO: 14682 - DNA, 60 bp, Artificial Sequence
  Description of Artificial Sequence: Synthetic probe
tatctatgactgcattcttggtggaaactggacatgcatagctggtgaccatagtaagtt

SEQ ID NO: 14683 - DNA, 60 bp, Artificial Sequence
  Description of Artificial Sequence: Synthetic probe
agaacaaggcctcgagatgccacgtggacgagggcatgcccaaagcacatcttaacctgg

SEQ ID NO: 14684 - DNA, 60 bp, Artificial Sequence
  Description of Artificial Sequence: Synthetic probe
ggtgaaaacgccatttgtggcgctatgaacacagcctgatagggtgtagcagagacctgc

SEQ ID NO: 14685 - DNA, 60 bp, Artificial Sequence
  Description of Artificial Sequence: Synthetic probe
atagtgccatctggcctggtcaaatgcaagataggggacacagtggtgcaagtcattgca

SEQ ID NO: 14686 - DNA, 60 bp, Artificial Sequence
  Description of Artificial Sequence: Synthetic probe
agcgacgaagatgaagctactaatggtggggaacctcggcgcagaaattggcgatctgga

SEQ ID NO: 14687 - DNA, 60 bp, Artificial Sequence
  Description of Artificial Sequence: Synthetic probe
ggtttaatcaaccgctacgaatacagcctgatagggtgctgcagaggcccactgtattgc

SEQ ID NO: 14688 - DNA, 60 bp, Artificial Sequence
  Description of Artificial Sequence: Synthetic probe
cgcgatgttcccaccaatttggcatctttaccaaaaagaggtgactgcaggtcgggtaat

SEQ ID NO: 14689 - DNA, 60 bp, Artificial Sequence
  Description of Artificial Sequence: Synthetic probe
aaaaagaggtgactgcaggtcaggtaacagcaagggacctgtgagtggaatctatttaaa

SEQ ID NO: 14690 - DNA, 60 bp, Artificial Sequence
  Description of Artificial Sequence: Synthetic probe
ggcctttgttctaccaggattacaaaggacccgtctatcatagagctccattggagtttt

SEQ ID NO: 14691 - DNA, 57 bp, Artificial Sequence
  Description of Artificial Sequence: Synthetic probe
ctgttatggacacagcctgatagggtgctgcagaggcccactgtattgctactaaaa

SEQ ID NO: 14692 - DNA, 60 bp, Artificial Sequence
  Description of Artificial Sequence: Synthetic probe
cgaatcatatgtgagagggaagccaggtatctggccattctacacacaagagccctgccg

SEQ ID NO: 14693 - DNA, 55 bp, Artificial Sequence
  Description of Artificial Sequence: Synthetic probe
aaaaagaggggactagcggtagcagtgagttcattggatggccgaatccctgagt

SEQ ID NO: 14694 - DNA, 59 bp, Artificial Sequence
  Description of Artificial Sequence: Synthetic probe
cgacacctaggatggtaggtctcgagatgccacgtggacgagggcatgcccacagcaca

SEQ ID NO: 14695 - DNA, 60 bp, Artificial Sequence
  Description of Artificial Sequence: Synthetic probe
gggaggacgactggtagtgatggtaagttgtaccacatttatgtgtgtatagatggatgc

SEQ ID NO: 14696 - DNA, 60 bp, Artificial Sequence
  Description of Artificial Sequence: Synthetic probe
gggaggacaactggtagtgatggtaagttgtaccacatttacgtgtgtgtagatggatgt

SEQ ID NO: 14697 - DNA, 60 bp, Artificial Sequence
  Description of Artificial Sequence: Synthetic probe
acgagggcatgcccacagcacatcttaacctggacgggggtcgcccaggtaaaagcagtc

SEQ ID NO: 14698 - DNA, 60 bp, Artificial Sequence
  Description of Artificial Sequence: Synthetic probe
ctgctacgaatacggcctgatagggtgctgcagaggcccactgtattgctactaaaaatc

SEQ ID NO: 14699 - DNA, 60 bp, Artificial Sequence
  Description of Artificial Sequence: Synthetic probe
cgagtacagcctgatagggtgctgcagaggcccactgtatcgctactaaaaatctctgct

SEQ ID NO: 14700 - DNA, 60 bp, Artificial Sequence
  Description of Artificial Sequence: Synthetic probe
ggtagacaggggaagcccataacatgtggaatgacacttgcagactttgaggagaaacac

SEQ ID NO: 14701 - DNA, 60 bp, Artificial Sequence
  Description of Artificial Sequence: Synthetic probe
gtggtagacaggggaagcccataacatgtggaatgacgcttgcagactttgaggagaaac

SEQ ID NO: 14702 - DNA, 60 bp, Artificial Sequence
  Description of Artificial Sequence: Synthetic probe
tgtggtagacaggggaagcccataacatgtggaatgacgcttgcagactttgaggagaaa

SEQ ID NO: 14703 - DNA, 60 bp, Artificial Sequence
  Description of Artificial Sequence: Synthetic probe
aaagtgtggtagacaggggaagcccataacatgtggaatgacacttgcagactttgagga

SEQ ID NO: 14704 - DNA, 60 bp, Artificial Sequence
  Description of Artificial Sequence: Synthetic probe
ccaactgcccaaagtgtggtagacaggggaagcccataacatgtggaatgacactcgcag

SEQ ID NO: 14705 - DNA, 60 bp, Artificial Sequence
  Description of Artificial Sequence: Synthetic probe
ccctaagcacagctgtagtgcgaacatataagagggttagcccattccctaataggcaag

SEQ ID NO: 14706 - DNA, 60 bp, Artificial Sequence
  Description of Artificial Sequence: Synthetic probe
gacgagggcatgcccaaagcacatcttaacctgggcgggggtcgcccaggcaaaagcagt

SEQ ID NO: 14707 - DNA, 60 bp, Artificial Sequence
  Description of Artificial Sequence: Synthetic probe
cgaccaactgttacggacacagcctgatagggtgctgcagaggcccactgtattgctact

SEQ ID NO: 14708 - DNA, 60 bp, Artificial Sequence
  Description of Artificial Sequence: Synthetic probe
ctgcattttttggaatcatgcctagaggcacaacccctagggcacccgtgagattcccca

SEQ ID NO: 14709 - DNA, 60 bp, Artificial Sequence
  Description of Artificial Sequence: Synthetic probe
gacgagggcatgcccacagcacatcttaacctgggcgggggtcgctcaggtgaaaacggt

SEQ ID NO: 14710 - DNA, 60 bp, Artificial Sequence
  Description of Artificial Sequence: Synthetic probe
actaccaggactacgcggggccagtctatcatagagccccactggaactatgtagagagg

SEQ ID NO: 14711 - DNA, 60 bp, Artificial Sequence
  Description of Artificial Sequence: Synthetic probe
tacccaattggcaaatgcaggttagaaaacgaaactggctacaggctggtagacgacacc

SEQ ID NO: 14712 - DNA, 60 bp, Artificial Sequence
  Description of Artificial Sequence: Synthetic probe
ctgaggaacctaccaattctagcgacgaagatgaagctactaatggtggggaaccttggc

SEQ ID NO: 14713 - DNA, 60 bp, Artificial Sequence
  Description of Artificial Sequence: Synthetic probe
tcgagatgccacgtggacgagggcatgcccaaagcacatcttaacctgagcgggggtcgc

SEQ ID NO: 14714 - DNA, 60 bp, Artificial Sequence
  Description of Artificial Sequence: Synthetic probe
taaaagcagtttaactaactgttatggacacagcctgatagggtgctgcagaggcccact

SEQ ID NO: 14715 - DNA, 60 bp, Artificial Sequence
  Description of Artificial Sequence: Synthetic probe
ggcataagccttttccctataggcagggctgtattacccagaaaaccattggggaagacc

SEQ ID NO: 14716 - DNA, 60 bp, Artificial Sequence
  Description of Artificial Sequence: Synthetic probe
tgaaaacagtttaaccaactgctacgaatacagcctgatagggtgctgcagaggcccact

SEQ ID NO: 14717 - DNA, 60 bp, Artificial Sequence
  Description of Artificial Sequence: Synthetic probe
aaactgggccatagatgatgaggaatgtaaaggactgaagaaactgtatctcctatcagg

SEQ ID NO: 14718 - DNA, 60 bp, Artificial Sequence
  Description of Artificial Sequence: Synthetic probe
taggtccctgccgcagaaaggtgactgccggaaaggcaacatcaatggagcagtgagtgg

SEQ ID NO: 14719 - DNA, 60 bp, Artificial Sequence
  Description of Artificial Sequence: Synthetic probe
ctaactgctacgaatacagcctgatagggtgctgcaaaggcccactgtattgctactaaa

SEQ ID NO: 14720 - DNA, 60 bp, Artificial Sequence
  Description of Artificial Sequence: Synthetic probe
aagagtgctacaagagatcgccaaaaagtactcaaatgggtccacaacaagctaaactgc

SEQ ID NO: 14721 - DNA, 60 bp, Artificial Sequence
  Description of Artificial Sequence: Synthetic probe
cagaccgactgctacggatacagcctgatagggtgctgcagaggcccactgtattgctac

SEQ ID NO: 14722 - DNA, 60 bp, Artificial Sequence
  Description of Artificial Sequence: Synthetic probe
gctagagaatgagactggctacaggttagtggatgacacttcttgcaatagggacggtgt

SEQ ID NO: 14723 - DNA, 60 bp, Artificial Sequence
  Description of Artificial Sequence: Synthetic probe
ggtgaaagcgccattcatggtgctatgaacacagcctgatagggtgtagcagagacctgc

SEQ ID NO: 14724 - DNA, 60 bp, Artificial Sequence
  Description of Artificial Sequence: Synthetic probe
acgtaacaaaatcctttagggagatgaactatgattggagtctgtatgaggaggatagcc

SEQ ID NO: 14725 - DNA, 60 bp, Artificial Sequence
  Description of Artificial Sequence: Synthetic probe
tagtgccatctggccgggtcaaatgcaagataggggacacagtggtgcaagtcatcgcaa

SEQ ID NO: 14726 - DNA, 60 bp, Artificial Sequence
  Description of Artificial Sequence: Synthetic probe
caagaggtacaagccttttccctataggcaaggctgtattacccagaaaaccatcgggga

SEQ ID NO: 14727 - DNA, 50 bp, Artificial Sequence
  Description of Artificial Sequence: Synthetic probe
ccacaagagtcacgcaagaaactagagaaagccctgttggcgtgggcgat

SEQ ID NO: 14728 - DNA, 60 bp, Artificial Sequence
  Description of Artificial Sequence: Synthetic probe
gacactccatcagttgaggagtctcgagatgccatgtggacgagggcatgcccacggcac

SEQ ID NO: 14729 - DNA, 60 bp, Artificial Sequence
  Description of Artificial Sequence: Synthetic probe
gtcagtggttcgacaccttagaaaaggaggtctcgagatgccacgtggacgagggcatgc

SEQ ID NO: 14730 - DNA, 60 bp, Artificial Sequence
  Description of Artificial Sequence: Synthetic probe
gacgagggcatgcccaaagcacatcttaacctgagcgggggtcgcccaggtgaaaacagt

SEQ ID NO: 14731 - DNA, 60 bp, Artificial Sequence
  Description of Artificial Sequence: Synthetic probe
aatggtgtgcctatgaaaaaataataggggaagatatctatgaatgcatcctaggtggaa

SEQ ID NO: 14732 - DNA, 51 bp, Artificial Sequence
  Description of Artificial Sequence: Synthetic probe
aggttatcgccactaacaaggacctgggacccatgccctgcagcccatatg

SEQ ID NO: 14733 - DNA, 56 bp, Artificial Sequence
  Description of Artificial Sequence: Synthetic probe
gtaagtgcatgctcagtaatgagagtgggtacaggtatgtagatgacactccttgt

SEQ ID NO: 14734 - DNA, 57 bp, Artificial Sequence
  Description of Artificial Sequence: Synthetic probe
tgggcctatcaagaagtgtaagtggtgtggctacgacttttccaacgcagaggggct

SEQ ID NO: 14735 - DNA, 60 bp, Artificial Sequence
  Description of Artificial Sequence: Synthetic probe
ggagacacaacggtacaggtcattgcaatggacacaaaacttggacctatgccttgcaga

SEQ ID NO: 14736 - DNA, 60 bp, Artificial Sequence
  Description of Artificial Sequence: Synthetic probe
atgtaaaattggagacacaacggtacaggtcattgcaatggacacaaaacttggacctat

SEQ ID NO: 14737 - DNA, 60 bp, Artificial Sequence
  Description of Artificial Sequence: Synthetic probe
gggtggtgtagcgatagtgccgactggaactgtgaaatgtaaaattggagacacaacggt

SEQ ID NO: 14738 - DNA, 59 bp, Artificial Sequence
  Description of Artificial Sequence: Synthetic probe
ctgtgtcttaggaggaaactggacttgtgtagcaggggaacagctacgttacacagggg

SEQ ID NO: 14739 - DNA, 60 bp, Artificial Sequence
  Description of Artificial Sequence: Synthetic probe
ctgtgtcttaggaggaaactggacttgtgtagcaggggaacagctacgttacacaggggg

SEQ ID NO: 14740 - DNA, 52 bp, Artificial Sequence
  Description of Artificial Sequence: Synthetic probe
aaaacttgtaggggaagatctctatgactgtgtcttaggaggaaactggact

SEQ ID NO: 14741 - DNA, 60 bp, Artificial Sequence
  Description of Artificial Sequence: Synthetic probe
aataggcaaggttgtgttacccaaaaacttgtaggggaagatctctatgactgtgtctta

SEQ ID NO: 14742 - DNA, 60 bp, Artificial Sequence
  Description of Artificial Sequence: Synthetic probe
tgcaggattggagacacagtggtgcaggtcatagcaatggacacaaaacttgggcctatg

SEQ ID NO: 14743 - DNA, 60 bp, Artificial Sequence
  Description of Artificial Sequence: Synthetic probe
taaaggtctcgagatgccacgtggacgagggcgtgcccagagcacatcttaacctgagcg

SEQ ID NO: 14744 - DNA, 55 bp, Artificial Sequence
  Description of Artificial Sequence: Synthetic probe
taataagtattatgagccaagggaccggtacttccaacaatacatgttaaaaggg

SEQ ID NO: 14745 - DNA, 60 bp, Artificial Sequence
  Description of Artificial Sequence: Synthetic probe
agagacattacctaataagtattatgagccaagggaccggtacttccaacaatacatgtt

SEQ ID NO: 14746 - DNA, 60 bp, Artificial Sequence
  Description of Artificial Sequence: Synthetic probe
ctgttatggacacagcctgatagggtgctgcagaggcccactgtattgctactaaaaatc

SEQ ID NO: 14747 - DNA, 60 bp, Artificial Sequence
  Description of Artificial Sequence: Synthetic probe
ccaccttgtggtgttgtgaacacagcctgatagggtgtagcagagacctgctatcccgct

SEQ ID NO: 14748 - DNA, 60 bp, Artificial Sequence
  Description of Artificial Sequence: Synthetic probe
caacatggaactgtgaagtgtagaattggagacacagtggtgcaggtcattgcaatggac

SEQ ID NO: 14749 - DNA, 60 bp, Artificial Sequence
  Description of Artificial Sequence: Synthetic probe
atctcatttggttcacggatgccaggcaccagtgggcggcagagagctactccagatgcc

SEQ ID NO: 14750 - DNA, 60 bp, Artificial Sequence
  Description of Artificial Sequence: Synthetic probe
catctcatttggttcacggatgccaggcaccagtgggcggcagagagctactccagatgc

SEQ ID NO: 14751 - DNA, 60 bp, Artificial Sequence
  Description of Artificial Sequence: Synthetic probe
cataaaggtctcgagatgccacgtggacgagggcgtgcccagagcacatcttaacctgag

SEQ ID NO: 14752 - DNA, 60 bp, Artificial Sequence
  Description of Artificial Sequence: Synthetic probe
tgaaagcggtttaaccaaccgctacgaatacagcctgatagggtgctgcagaggcccact

SEQ ID NO: 14753 - DNA, 60 bp, Artificial Sequence
  Description of Artificial Sequence: Synthetic probe
tcgcatcgtctcgagatgccacgtggacgagggcatgcccaagacacgctttaatcctgg

SEQ ID NO: 14754 - DNA, 60 bp, Artificial Sequence
  Description of Artificial Sequence: Synthetic probe
cgcggtcatcgcatcgtctcgagatgccacgtggacgagggcatgcccaagacacgcttt

SEQ ID NO: 14755 - DNA, 60 bp, Artificial Sequence
  Description of Artificial Sequence: Synthetic probe
caataggcacaagccttttccctataggcagggctgtattacccagacaaccattgggga

SEQ ID NO: 14756 - DNA, 60 bp, Artificial Sequence
  Description of Artificial Sequence: Synthetic probe
accactcacggtgttatggacacagcctgatagggtgtagcagagacctgctattccgct

SEQ ID NO: 14757 - DNA, 60 bp, Artificial Sequence
  Description of Artificial Sequence: Synthetic probe
gcacaagccttttccctataggcagggctgtattacccagaaaaccattggggaagacct

SEQ ID NO: 14758 - DNA, 56 bp, Artificial Sequence
  Description of Artificial Sequence: Synthetic probe
ttggggaagacctctacaactgtgtcttgggagggaattggacttgtgtgccgggg

SEQ ID NO: 14759 - DNA, 59 bp, Artificial Sequence
  Description of Artificial Sequence: Synthetic probe
ccattggggaagacctctacgactgtgtcttgggagggaattggacttgtgtgccgggg

SEQ ID NO: 14760 - DNA, 60 bp, Artificial Sequence
  Description of Artificial Sequence: Synthetic probe
ggtgaaaacggtttaatcaaccgctacgaatacagcctgatagggtgctgcagaggccca

SEQ ID NO: 14761 - DNA, 60 bp, Artificial Sequence
  Description of Artificial Sequence: Synthetic probe
cgagatgccatgttgactgagggcatgcccacggcacatcttaacctatgcgggggctgt

SEQ ID NO: 14762 - DNA, 60 bp, Artificial Sequence
  Description of Artificial Sequence: Synthetic probe
cgacacaaacgtggttttgtctcgagatgctacgtggacgagggcatgcccatgacacgc

SEQ ID NO: 14763 - DNA, 60 bp, Artificial Sequence
  Description of Artificial Sequence: Synthetic probe
gggaagatctctatgactgtacccatggaggaaactggacttgtatagcaggggaacagc

SEQ ID NO: 14764 - DNA, 60 bp, Artificial Sequence
  Description of Artificial Sequence: Synthetic probe
cgaaaacagtcagaccgactgctacggatacagcctgatagggtgctgcagaggcccact

SEQ ID NO: 14765 - DNA, 60 bp, Artificial Sequence
  Description of Artificial Sequence: Synthetic probe
cgagatgccatgtggacgagggcatgcccacggcacatctcaacctatgcgggggctgca

SEQ ID NO: 14766 - DNA, 60 bp, Artificial Sequence
  Description of Artificial Sequence: Synthetic probe
ccctagggcacccgtgaggttccccacagcactactgaaagtgagaagagggttggagac

SEQ ID NO: 14767 - DNA, 60 bp, Artificial Sequence
  Description of Artificial Sequence: Synthetic probe
gaaagcggtttaaccaaccgctacgaatacagcctgatagggtgctgcagaggcccactg

SEQ ID NO: 14768 - DNA, 56 bp, Artificial Sequence
  Description of Artificial Sequence: Synthetic probe
gaatcagcaagtagtggagactgggaaagcactgaagcaagtggtcggactgtcct

SEQ ID NO: 14769 - DNA, 60 bp, Artificial Sequence
  Description of Artificial Sequence: Synthetic probe
gcccgacccagggaaccagcaagtagtggagactgggaaagcactgaagcaagtggtagg

SEQ ID NO: 14770 - DNA, 60 bp, Artificial Sequence
  Description of Artificial Sequence: Synthetic probe
aggcttggactggcccgacccagggaaccagcaagtagtggagactgggaaagcactgaa

SEQ ID NO: 14771 - DNA, 60 bp, Artificial Sequence
  Description of Artificial Sequence: Synthetic probe
ctgatgagacagaatatggtgtcaagacggactccggatgtccagacggtgccagatgct

SEQ ID NO: 14772 - DNA, 60 bp, Artificial Sequence
  Description of Artificial Sequence: Synthetic probe
ttaactgatgagacagaatatggtgtcaagacggactccgggtgtccagacggtgccaga

SEQ ID NO: 14773 - DNA, 60 bp, Artificial Sequence
  Description of Artificial Sequence: Synthetic probe
ctggccaataaggatacgttagccacaaccgttgtacggacatacaagaggcacaagcct

SEQ ID NO: 14774 - DNA, 60 bp, Artificial Sequence
  Description of Artificial Sequence: Synthetic probe
acaccaaggagggatcagctcggtagaccatgtcacagccggaaaggatttactagtgtg

SEQ ID NO: 14775 - DNA, 60 bp, Artificial Sequence
  Description of Artificial Sequence: Synthetic probe
tgaaggatgaaagtggctacagacaagtagatgagacctcttgtaacagagacggtgtgg

SEQ ID NO: 14776 - DNA, 60 bp, Artificial Sequence
  Description of Artificial Sequence: Synthetic probe
caggactatgcggggcccgtctatcatagagccccactggaattatgtagagaggcgagc

SEQ ID NO: 14777 - DNA, 59 bp, Artificial Sequence
  Description of Artificial Sequence: Synthetic probe
gggacacggtggtgcaagtcattgcaatggatgataggctagggcctatgccttgcaga

SEQ ID NO: 14778 - DNA, 60 bp, Artificial Sequence
  Description of Artificial Sequence: Synthetic probe
atgcaagataggggacacagtggtgcaagtcatagcaatggatgacaaattagggcctat

SEQ ID NO: 14779 - DNA, 60 bp, Artificial Sequence
  Description of Artificial Sequence: Synthetic probe
cgagggcatgcccacagcacatcttaacctgagcaggggtcgttcaggtgaaagcgggta

SEQ ID NO: 14780 - DNA, 60 bp, Artificial Sequence
  Description of Artificial Sequence: Synthetic probe
tgaaaacagtttaactaactgctacgaatacagcctgatagggtgctgcaaaggcccact

SEQ ID NO: 14781 - DNA, 60 bp, Artificial Sequence
  Description of Artificial Sequence: Synthetic probe
cataaaggtctcgagatgccatgtggacgagggcatgcccaaagcacatcttaacctggg

SEQ ID NO: 14782 - DNA, 60 bp, Artificial Sequence
  Description of Artificial Sequence: Synthetic probe
aaagtggtcaaacagactactacgaatacagcctgatagggtgctgcagaggcccactgc

SEQ ID NO: 14783 - DNA, 60 bp, Artificial Sequence
  Description of Artificial Sequence: Synthetic probe
cgggtgaaagtggtcagcagactactacgaatacagcctgatagggtgctgcagaggccc

SEQ ID NO: 14784 - DNA, 60 bp, Artificial Sequence
  Description of Artificial Sequence: Synthetic probe
tcgggtgaaagtggtcagcagactactacgaatacagcctgatagggtgctgcagaggcc

SEQ ID NO: 14785 - DNA, 60 bp, Artificial Sequence
  Description of Artificial Sequence: Synthetic probe
cgagggcacgcccacagcacatcttagcctgagcgggggtcgttcgggtgaaagtggtca

SEQ ID NO: 14786 - DNA, 60 bp, Artificial Sequence
  Description of Artificial Sequence: Synthetic probe
ccatcggggaagacctctacaactgtaacttgggagggaattggacttgtgtgccggggg

SEQ ID NO: 14787 - DNA, 54 bp, Artificial Sequence
  Description of Artificial Sequence: Synthetic probe
cgagatgctacgtggacgagggcatgcccaagacacaccttaaccctggcgggg

SEQ ID NO: 14788 - DNA, 60 bp, Artificial Sequence
  Description of Artificial Sequence: Synthetic probe
gagagagaggcggttcatccacaggcaacgctaaaactgccacataaaagaggggagcgc

SEQ ID NO: 14789 - DNA, 60 bp, Artificial Sequence
  Description of Artificial Sequence: Synthetic probe
tctcgagatgccatgtggacgagggcatgcccacggcacatcttaacctatgcgggggtt

SEQ ID NO: 14790 - DNA, 60 bp, Artificial Sequence
  Description of Artificial Sequence: Synthetic probe
gatcccagagctgaaggaatcgtatgatgaagtttcatgggaacaattagaagccgggat

SEQ ID NO: 14791 - DNA, 60 bp, Artificial Sequence
  Description of Artificial Sequence: Synthetic probe
catgcccacggcacatcttaacctatgcgggggttgcgtaggtgaaagcaccatttatat

SEQ ID NO: 14792 - DNA, 60 bp, Artificial Sequence
  Description of Artificial Sequence: Synthetic probe
acatataggaggctcaaacctttcccttacagacaaggctgtatcacccaaaaaatcgta

SEQ ID NO: 14793 - DNA, 60 bp, Artificial Sequence
  Description of Artificial Sequence: Synthetic probe
cggtgtggctatagtgccaactggtcgggtgaaatgcaagataggggacacagtggtgca

SEQ ID NO: 14794 - DNA, 60 bp, Artificial Sequence
  Description of Artificial Sequence: Synthetic probe
ggtgaaagcgccattcgtggcgttatggacacagcctgatagggtgtagcagagacctgc

SEQ ID NO: 14795 - DNA, 60 bp, Artificial Sequence
  Description of Artificial Sequence: Synthetic probe
ctggccaataaggatacgttagccacaaccgttgtacgaacatacaagaggcacaagcct

SEQ ID NO: 14796 - DNA, 60 bp, Artificial Sequence
  Description of Artificial Sequence: Synthetic probe
aagtgagggtttaccacatttcccaatcggcaaatgcaggcttgagaatgagagtggcta

SEQ ID NO: 14797 - DNA, 60 bp, Artificial Sequence
  Description of Artificial Sequence: Synthetic probe
aagacctctacgactgtgccctcggagggaattggacttgtgtgctgggggacgtactac

SEQ ID NO: 14798 - DNA, 60 bp, Artificial Sequence
  Description of Artificial Sequence: Synthetic probe
gccaatagggataccttagacacggccgtggtgcgagtgtataagagatccaggcctttc

SEQ ID NO: 14799 - DNA, 60 bp, Artificial Sequence
  Description of Artificial Sequence: Synthetic probe
aaggtctcgagatgccatgtggacgagggcatgcccaaagcacatcttaacctgggcggg

SEQ ID NO: 14800 - DNA, 60 bp, Artificial Sequence
  Description of Artificial Sequence: Synthetic probe
atggagttgatcacaaatgaacttttatacaaaacatacaaacaaaaacccgctggagtg

SEQ ID NO: 14801 - DNA, 60 bp, Artificial Sequence
  Description of Artificial Sequence: Synthetic probe
gttggggttacagcctgatagggcgctgcagaggcccacgtataggctagtataaaaaat

SEQ ID NO: 14802 - DNA, 57 bp, Artificial Sequence
  Description of Artificial Sequence: Synthetic probe
gttggggttacagcctgatagggcgctgcagaggcccacgtataggctagtataaaa

SEQ ID NO: 14803 - DNA, 60 bp, Artificial Sequence
  Description of Artificial Sequence: Synthetic probe
caaaaggtctcgagatgccacgtggacgagggcatgcccaaagcacatcttaacctgagc

SEQ ID NO: 14804 - DNA, 60 bp, Artificial Sequence
  Description of Artificial Sequence: Synthetic probe
acggggaggtgacagacagttatgagaattacacatacctcaatgcaagaaaactaggag

SEQ ID NO: 14805 - DNA, 60 bp, Artificial Sequence
  Description of Artificial Sequence: Synthetic probe
tgcacgctggccaataaggatacgttagccacaaccgttgtgcgaacgtacaagagggat

SEQ ID NO: 14806 - DNA, 60 bp, Artificial Sequence
  Description of Artificial Sequence: Synthetic probe
gcgagggtctgcctcacttcccgattggcaagtgcaagctgaagaatgaaagtggctaca

SEQ ID NO: 14807 - DNA, 60 bp, Artificial Sequence
  Description of Artificial Sequence: Synthetic probe
gtgagggtctgcctcacttcccgattggcaagtgcaagctgaagaatgaaagtggctaca

SEQ ID NO: 14808 - DNA, 59 bp, Artificial Sequence
  Description of Artificial Sequence: Synthetic probe
tacagcctgatagggtgttgcagagacccacttgtaggctagtataaaaaaactctgct

SEQ ID NO: 14809 - DNA, 60 bp, Artificial Sequence
  Description of Artificial Sequence: Synthetic probe
tcagtagttcgacactaacgtgggtttagtctcgagatgctacgtggacgagggcatgcc

SEQ ID NO: 14810 - DNA, 60 bp, Artificial Sequence
  Description of Artificial Sequence: Synthetic probe
ggccttttccatataggcggggctgcgtcacccagaaaaccattggggaagacctctacg

SEQ ID NO: 14811 - DNA, 60 bp, Artificial Sequence
  Description of Artificial Sequence: Synthetic probe
accattagcggtgttatggacacagcctgatagggtgtagcagagacctgctattccgct

SEQ ID NO: 14812 - DNA, 60 bp, Artificial Sequence
  Description of Artificial Sequence: Synthetic probe
aactgctacgaatacagcctgatagggtgctgcagaggcccactgtattgctactaaaaa

SEQ ID NO: 14813 - DNA, 60 bp, Artificial Sequence
  Description of Artificial Sequence: Synthetic probe
tcgtcagtggttcgacgccttggaggataggcctcgagatgccacgtggacgagggcatg

SEQ ID NO: 14814 - DNA, 50 bp, Artificial Sequence
  Description of Artificial Sequence: Synthetic probe
aaaagaggtgactgcaggtcgggtaatagcaaagggcctgtgagtggaat

SEQ ID NO: 14815 - DNA, 60 bp, Artificial Sequence
  Description of Artificial Sequence: Synthetic probe
cgggtgaaatgcaagatagggaacacagtggtgcaagtcatagcaatggatgataagctg

SEQ ID NO: 14816 - DNA, 56 bp, Artificial Sequence
  Description of Artificial Sequence: Synthetic probe
ctctggcagtgacagagtcctgagatgccatgtggacgagggcatgcccacggcac

SEQ ID NO: 14817 - DNA, 60 bp, Artificial Sequence
  Description of Artificial Sequence: Synthetic probe
acaaggtctcgagatgccacgtggacgagggcatgcccagagcacatcttaacttgggcg

SEQ ID NO: 14818 - DNA, 59 bp, Artificial Sequence
  Description of Artificial Sequence: Synthetic probe
tagcgaaaggaggggactaacggtagcagtgagttcattggatggccgaatccctgagt

SEQ ID NO: 14819 - DNA, 60 bp, Artificial Sequence
  Description of Artificial Sequence: Synthetic probe
ccagtaataaagggcaaatttaatgctagcttactgaatggaccagctttccagatggta

SEQ ID NO: 14820 - DNA, 60 bp, Artificial Sequence
  Description of Artificial Sequence: Synthetic probe
cttgtgatgttatggacacagcctgatagggtgtagcagagacctgctattccgctagta

SEQ ID NO: 14821 - DNA, 60 bp, Artificial Sequence
  Description of Artificial Sequence: Synthetic probe
cgggtgaaatgcaagataggggacacagtggtgcaagtcatagcaatggatgataggcta

SEQ ID NO: 14822 - DNA, 60 bp, Artificial Sequence
  Description of Artificial Sequence: Synthetic probe
aggacgtgcacaaaggaagagaggtacttagtggctgtacacgaaagagccctatcaacc

SEQ ID NO: 14823 - DNA, 60 bp, Artificial Sequence
  Description of Artificial Sequence: Synthetic probe
cgtggacgagggcatgcccaaagcacatcttaacctgagcgggggtcgctcaggcgaaaa

SEQ ID NO: 14824 - DNA, 60 bp, Artificial Sequence
  Description of Artificial Sequence: Synthetic probe
cgacacctcaaaagaaggtctcgagatgccacgtggacgagggcatgcccacagcacatc

SEQ ID NO: 14825 - DNA, 60 bp, Artificial Sequence
  Description of Artificial Sequence: Synthetic probe
taggagaggaaatcggggatttggaacaccttggttggattctgagggggcctgccgtgt

SEQ ID NO: 14826 - DNA, 60 bp, Artificial Sequence
  Description of Artificial Sequence: Synthetic probe
ggcaaccaaagtaaagatgctcatggtaggcaatctaggagaggaaatcggggatttgga

SEQ ID NO: 14827 - DNA, 50 bp, Artificial Sequence
  Description of Artificial Sequence: Synthetic probe
ggacacagcctgatagggtgctgcagaggcccactgcattgctactaaaa

SEQ ID NO: 14828 - DNA, 60 bp, Artificial Sequence
  Description of Artificial Sequence: Synthetic probe
agtaagaagcagcctaagccagataggatagaaaaaggcaagatgaaaatagccccaaaa

SEQ ID NO: 14829 - DNA, 60 bp, Artificial Sequence
  Description of Artificial Sequence: Synthetic probe
ataccatagaggatcagaggctagaagacaccacccaccttcaatatgcacccaatgcca

SEQ ID NO: 14830 - DNA, 60 bp, Artificial Sequence
  Description of Artificial Sequence: Synthetic probe
gccactgaagacgaagatttggcagtagaccttctgggtctagactggcccgaccccgga

SEQ ID NO: 14831 - DNA, 60 bp, Artificial Sequence
  Description of Artificial Sequence: Synthetic probe
cgaccatccggaaccaatccaacttgcatacaatagctatgaggttcaggtcccagtcct

SEQ ID NO: 14832 - DNA, 60 bp, Artificial Sequence
  Description of Artificial Sequence: Synthetic probe
ggcctcaaaagaatggctgtcaccattggagagcaggctcaacgcagaggcagggtaggt

SEQ ID NO: 14833 - DNA, 60 bp, Artificial Sequence
  Description of Artificial Sequence: Synthetic probe
gggtgacgttgccagacctagacacggtagtggacactgggttgaaatgtgaaaagaggg

SEQ ID NO: 14834 - DNA, 60 bp, Artificial Sequence
  Description of Artificial Sequence: Synthetic probe
cggctactactacagtggagaagacccagcaaatctgagggtcgtcacatcacagtcccc

SEQ ID NO: 14835 - DNA, 60 bp, Artificial Sequence
  Description of Artificial Sequence: Synthetic probe
gcacccaatagaggaattcatagctccagaggtgatgaaaggggaagatcttggcagcca

SEQ ID NO: 14836 - DNA, 60 bp, Artificial Sequence
  Description of Artificial Sequence: Synthetic probe
tgatagaggagatagggcgacacaagcgggtgttggtacttataccactgagggcagcgg

SEQ ID NO: 14837 - DNA, 60 bp, Artificial Sequence
  Description of Artificial Sequence: Synthetic probe
aagcttccagtgggagggtggtcggtagagtcaaggtagggaagaacgaagagtccaaac

SEQ ID NO: 14838 - DNA, 60 bp, Artificial Sequence
  Description of Artificial Sequence: Synthetic probe
ggggtctagagactggttgggcatacacgcaccagggtggcataagttcagttgaccacg

SEQ ID NO: 14839 - DNA, 60 bp, Artificial Sequence
  Description of Artificial Sequence: Synthetic probe
gtgtgagggacgaaagtggaaaggtggtacctgccctaaatgtggacgccacgggaaacc

SEQ ID NO: 14840 - DNA, 60 bp, Artificial Sequence
  Description of Artificial Sequence: Synthetic probe
tcaggaggtaccaacttggtgtccagggtagtggcagcacttatagagttgaactggtcc

SEQ ID NO: 14841 - DNA, 60 bp, Artificial Sequence
  Description of Artificial Sequence: Synthetic probe
ggggtgccaatcctactactgatcatgaccttgtgggctgacttcctgaccattatactg

SEQ ID NO: 14842 - DNA, 60 bp, Artificial Sequence
  Description of Artificial Sequence: Synthetic probe
tagggtcactgagagtcaccgggctagtcttcgggcctagggttgatgtagctatggcag

SEQ ID NO: 14843 - DNA, 60 bp, Artificial Sequence
  Description of Artificial Sequence: Synthetic probe
tgctcatgattggaggtgcagttaaggccgaaccaggagtccaggggagcatggaacagc

SEQ ID NO: 14844 - DNA, 60 bp, Artificial Sequence
  Description of Artificial Sequence: Synthetic probe
atactggtgatagtggtagccttactaggcggtagatacgtgctttggctgctggttacc

SEQ ID NO: 14845 - DNA, 60 bp, Artificial Sequence
  Description of Artificial Sequence: Synthetic probe
ctgggaccttaaaatgcaagataggggatacagtggtgcaggtcatagcaatggatacca

SEQ ID NO: 14846 - DNA, 60 bp, Artificial Sequence
  Description of Artificial Sequence: Synthetic probe
gccaaacccttggtgaaagggaagtttaacacaacactgttaaatgggcctgccttccag

SEQ ID NO: 14847 - DNA, 60 bp, Artificial Sequence
  Description of Artificial Sequence: Synthetic probe
ggcaatcagggatctgacacgcatatggaacgctgcaacatctactgcgttcttagtgtg

SEQ ID NO: 14848 - DNA, 60 bp, Artificial Sequence
  Description of Artificial Sequence: Synthetic probe
gccccggagacagccagtgcaatatatctaattcttcacttttccatccctcagagtcac

SEQ ID NO: 14849 - DNA, 60 bp, Artificial Sequence
  Description of Artificial Sequence: Synthetic probe
ccagcctcccagatggtttgccctatagggtggacagggactgtaagctgtacactggcc

SEQ ID NO: 14850 - DNA, 60 bp, Artificial Sequence
  Description of Artificial Sequence: Synthetic probe
gccagcctcccagatggtttgccctatagggtggacagggactgtaagctgtacactggc

SEQ ID NO: 14851 - DNA, 60 bp, Artificial Sequence
  Description of Artificial Sequence: Synthetic probe
gaaagcgggaaaaccaaccgttacggacacagcctgatagggtgctgcagaggcccactg

SEQ ID NO: 14852 - DNA, 60 bp, Artificial Sequence
  Description of Artificial Sequence: Synthetic probe
ctccagatgcccctcctgctgaccttcaggatttcttgagccggatctttcaagtacccc

SEQ ID NO: 14853 - DNA, 60 bp, Artificial Sequence
  Description of Artificial Sequence: Synthetic probe
gagctactccagatgcccctcctgctgaccttcaggatttcttgagccggatctttcaag

SEQ ID NO: 14854 - DNA, 60 bp, Artificial Sequence
  Description of Artificial Sequence: Synthetic probe
gccccaaggaagagaggtacctagtggctgtgcacgagagagccctatcaaccagtgctg

SEQ ID NO: 14855 - DNA, 60 bp, Artificial Sequence
  Description of Artificial Sequence: Synthetic probe
acgtgcacaaaggaagagaggtacctagtggctgtgcacgagagagccctatcaaccagt

SEQ ID NO: 14856 - DNA, 60 bp, Artificial Sequence
  Description of Artificial Sequence: Synthetic probe
ttctttggaatcatgcctagaggcacaacccctagggcacccgtgaggttccccacagca

SEQ ID NO: 14857 - DNA, 60 bp, Artificial Sequence
  Description of Artificial Sequence: Synthetic probe
cgtggtggtgagatccctgagcggtctaagccctgagtacagggcagtcgtcagtagttc

SEQ ID NO: 14858 - DNA, 60 bp, Artificial Sequence
  Description of Artificial Sequence: Synthetic probe
gctgtcgtggtgagatccctgagcggtctaagccctgagtacagggcagtcgtcagtagt

SEQ ID NO: 14859 - DNA, 60 bp, Artificial Sequence
  Description of Artificial Sequence: Synthetic probe
atctaagccctgagtacagggcagtcgtcagtagttcgacacaggtggggacctgtctcg

SEQ ID NO: 14860 - DNA, 57 bp, Artificial Sequence
  Description of Artificial Sequence: Synthetic probe
aaaatgaaagtggctacagacaagtagatgagacctcttgcaacagagacggtgtgg

SEQ ID NO: 14861 - DNA, 60 bp, Artificial Sequence
  Description of Artificial Sequence: Synthetic probe
ggttagaaaacgaaactggctacaggctggtagacgacacctcttgcaatagagaaggtg

SEQ ID NO: 14862 - DNA, 58 bp, Artificial Sequence
  Description of Artificial Sequence: Synthetic probe
gtgggaatgatggacgcgagtgagaagaccaactacacatgttgcaggttgcaaaggc

SEQ ID NO: 14863 - DNA, 57 bp, Artificial Sequence
  Description of Artificial Sequence: Synthetic probe
gcaaaaggaggggactagcagtagcagtgagttcattggatggccgaatccctgagt

SEQ ID NO: 14864 - DNA, 60 bp, Artificial Sequence
  Description of Artificial Sequence: Synthetic probe
gtgtaagaccagattggtggccttatgagacagccacggtcctggtgtttgaagaggtgg

SEQ ID NO: 14865 - DNA, 60 bp, Artificial Sequence
  Description of Artificial Sequence: Synthetic probe
gcttgcccacggcacatcttaacctatgtgggggttgcatgggtgaaagcgccattcgtg

SEQ ID NO: 14866 - DNA, 55 bp, Artificial Sequence
  Description of Artificial Sequence: Synthetic probe
cgagatgccatgttgactgagggcatgcccacggcacatcttaacctatgcgggg

SEQ ID NO: 14867 - DNA, 59 bp, Artificial Sequence
  Description of Artificial Sequence: Synthetic probe
gcctttgttctaccaggattacaaaggacccgtctatcatagagctccattggagtttt

SEQ ID NO: 14868 - DNA, 60 bp, Artificial Sequence
  Description of Artificial Sequence: Synthetic probe
aagacgtgcacaaaggaagagaggtacttagtggctgtgcacgaaagagccctatcaact

SEQ ID NO: 14869 - DNA, 60 bp, Artificial Sequence
  Description of Artificial Sequence: Synthetic probe
aagaggacatagtagaaatggatgacaactttgagtttggtctctgcccgtgtgatgcta

SEQ ID NO: 14870 - DNA, 60 bp, Artificial Sequence
  Description of Artificial Sequence: Synthetic probe
ccgaccgctacgaatacagcctgatagggtgctgcagaggcccactgtattgctactgaa

SEQ ID NO: 14871 - DNA, 60 bp, Artificial Sequence
  Description of Artificial Sequence: Synthetic probe
caggattggagacacagtggtgcaggtcatagcaatggacacaaaacttgggcctatgcc

SEQ ID NO: 14872 - DNA, 60 bp, Artificial Sequence
  Description of Artificial Sequence: Synthetic probe
agaatggctgtcactgtgggcgaacaggctcagcggagaggcagggtaggtagagtgaag

SEQ ID NO: 14873 - DNA, 60 bp, Artificial Sequence
  Description of Artificial Sequence: Synthetic probe
ggtgacagacagttatgagaattacacatacctcaatgcaagaaaactaggagaggacgt

SEQ ID NO: 14874 - DNA, 58 bp, Artificial Sequence
  Description of Artificial Sequence: Synthetic probe
aaaacggggaggtgacagacagttacgagaattacacatacctcaatgcaagaaaact

SEQ ID NO: 14875 - DNA, 60 bp, Artificial Sequence
  Description of Artificial Sequence: Synthetic probe
ggcaagtgtaaactagagaatgagactggctacaggtttgtagatgacacttcttgcaac

SEQ ID NO: 14876 - DNA, 60 bp, Artificial Sequence
  Description of Artificial Sequence: Synthetic probe
ccgattggcaagtgtaaactagagaatgagactggctacagatttgtggatgacacttcc

SEQ ID NO: 14877 - DNA, 60 bp, Artificial Sequence
  Description of Artificial Sequence: Synthetic probe
ctaccacattacccgattggcaagtgtaaactagagaatgagactggctacagatttgtg

SEQ ID NO: 14878 - DNA, 60 bp, Artificial Sequence
  Description of Artificial Sequence: Synthetic probe
gacactccatcaatcgaggagtctcgagatgccatgtggacgagggcatgcccacggcac

SEQ ID NO: 14879 - DNA, 60 bp, Artificial Sequence
  Description of Artificial Sequence: Synthetic probe
cgaaaacagtttgatcaactgctacgaatacagcctgatagggtgctgcagaggcccact

SEQ ID NO: 14880 - DNA, 60 bp, Artificial Sequence
  Description of Artificial Sequence: Synthetic probe
aggttaaaaaacgagactggctacaggctggtagactctacctcttgcaacgtgggtggt

SEQ ID NO: 14881 - DNA, 60 bp, Artificial Sequence
  Description of Artificial Sequence: Synthetic probe
tcgtcagtggttcgacgcctagcacgataggcctcgagatgccacgtggacgagggcacg

SEQ ID NO: 14882 - DNA, 60 bp, Artificial Sequence
  Description of Artificial Sequence: Synthetic probe
ggttcaacaccttggtttaaaggtcttgagatgccacgtggacgagggcatgcccaaagc

SEQ ID NO: 14883 - DNA, 60 bp, Artificial Sequence
  Description of Artificial Sequence: Synthetic probe
gaagtgtagaattggagacacagtggtgcaggtcattgcaatggacacaaaacttgggcc

SEQ ID NO: 14884 - DNA, 60 bp, Artificial Sequence
  Description of Artificial Sequence: Synthetic probe
ccagccttccagatggtttgccctataggatggacagggactgtgagctgtacactggcc

SEQ ID NO: 14885 - DNA, 60 bp, Artificial Sequence
  Description of Artificial Sequence: Synthetic probe
tgggccagccttccagatggtttgccctataggatggacggggaccgtgagctgtacact

SEQ ID NO: 14886 - DNA, 60 bp, Artificial Sequence
  Description of Artificial Sequence: Synthetic probe
tacagactagtagatgaaacctcttgcaacagagacggtgtggctatagtgccaactggt

SEQ ID NO: 14887 - DNA, 60 bp, Artificial Sequence
  Description of Artificial Sequence: Synthetic probe
ccaggggaccaattacgatatgtagacgggcctgtcgagtcctgcaagtggtgtggttac

SEQ ID NO: 14888 - DNA, 60 bp, Artificial Sequence
  Description of Artificial Sequence: Synthetic probe
ataccaggggaccaattacgatatgtagacgggcctgtcgagtcctgcaagtggtgtggt

SEQ ID NO: 14889 - DNA, 60 bp, Artificial Sequence
  Description of Artificial Sequence: Synthetic probe
ccatcggggaggacctctacgactgtgtcttaggggggaactggacctgtataccagggg

SEQ ID NO: 14890 - DNA, 60 bp, Artificial Sequence
  Description of Artificial Sequence: Synthetic probe
caagaggcacaagccttttccctataggcaaagctgtattacccagaaaaccatcgggga

SEQ ID NO: 14891 - DNA, 60 bp, Artificial Sequence
  Description of Artificial Sequence: Synthetic probe
ggccaataaggatacattagacatgaccattgtacgaacatacaagaggcacaagccttt

SEQ ID NO: 14892 - DNA, 60 bp, Artificial Sequence
  Description of Artificial Sequence: Synthetic probe
tgtgcattggccaataaggatacattagacatgaccattgtacgaacatacaagaggcac

SEQ ID NO: 14893 - DNA, 60 bp, Artificial Sequence
  Description of Artificial Sequence: Synthetic probe
agtcgtcagtggttcgacacctcaaaagaaggtctcgagatgccacgtggacgagggcat

SEQ ID NO: 14894 - DNA, 60 bp, Artificial Sequence
  Description of Artificial Sequence: Synthetic probe
gcatgcccacggcacatcttaacctatgcgggggttgcatgggtgaaagcaccattagcg

SEQ ID NO: 14895 - DNA, 51 bp, Artificial Sequence
  Description of Artificial Sequence: Synthetic probe
ttggggaagacctctacgactgtgccttaggagggaattggacttgtgtgc

SEQ ID NO: 14896 - DNA, 60 bp, Artificial Sequence
  Description of Artificial Sequence: Synthetic probe
tggagaggaagatcggttacatctggtatacaaaaaactgcactccagcttgcctaccga

SEQ ID NO: 14897 - DNA, 60 bp, Artificial Sequence
  Description of Artificial Sequence: Synthetic probe
cgacacctcttgcaacagagatggtgtagcaatagtgccaaatggattagtgaagtgtag

SEQ ID NO: 14898 - DNA, 60 bp, Artificial Sequence
  Description of Artificial Sequence: Synthetic probe
agacgacacctcttgcaacagagatggtgtagcaatagtgccaaatggattagtgaagtg

SEQ ID NO: 14899 - DNA, 51 bp, Artificial Sequence
  Description of Artificial Sequence: Synthetic probe
cagggggtgccatagattcctgtaagtggtgcggctacaagtttctgaaga

SEQ ID NO: 14900 - DNA, 50 bp, Artificial Sequence
  Description of Artificial Sequence: Synthetic probe
acaaacaaaaacccactggagtggaggaaccagtatacgaccaagctggt

SEQ ID NO: 14901 - DNA, 60 bp, Artificial Sequence
  Description of Artificial Sequence: Synthetic probe
ggcacaagccttttccctataggcagggctgtattacccagaaaaccattggggaagacc

SEQ ID NO: 14902 - DNA, 60 bp, Artificial Sequence
  Description of Artificial Sequence: Synthetic probe
caagaggcacaagccttttccctataggcagggctgtattacccagaaaaccattgggga

SEQ ID NO: 14903 - DNA, 60 bp, Artificial Sequence
  Description of Artificial Sequence: Synthetic probe
aaggacacgttagccacaaccgttgtacgaacatacaagaggcacaagcctttcccgtat

SEQ ID NO: 14904 - DNA, 60 bp, Artificial Sequence
  Description of Artificial Sequence: Synthetic probe
gcatgcccacggcacatcttaacctatgcgggggttgcgtaggtgaaagcatcatcttgt

SEQ ID NO: 14905 - DNA, 60 bp, Artificial Sequence
  Description of Artificial Sequence: Synthetic probe
gccattcgtggcgttatggacacaacctgatagggtgtagcagagacctgctattccgct

SEQ ID NO: 14906 - DNA, 60 bp, Artificial Sequence
  Description of Artificial Sequence: Synthetic probe
caggattacaaaggacccgtctatcatagagccccgctagagttttttgaggaggcgtct

SEQ ID NO: 14907 - DNA, 65 bp, Artificial Sequence
  Description of Artificial Sequence: Synthetic probe
gtagtgatggcaaattatatcacatttatgtgtgtattgatggatgcataatagttaagagtgcc

SEQ ID NO: 14908 - DNA, 60 bp, Artificial Sequence
  Description of Artificial Sequence: Synthetic probe
ggggacacagtggtgcaagtcatagcaatggatgacaaattagggcctatgccttgcaaa

SEQ ID NO: 14909 - DNA, 60 bp, Artificial Sequence
  Description of Artificial Sequence: Synthetic probe
atggagttgatcacaaatgaacttttatacaaaacatataaacaaaaacctactggagtg

SEQ ID NO: 14910 - DNA, 60 bp, Artificial Sequence
  Description of Artificial Sequence: Synthetic probe
cagctcggtagaccatgtcacagccggaaaggatttactagtgtgtgacagtatgggtag

SEQ ID NO: 14911 - DNA, 60 bp, Artificial Sequence
  Description of Artificial Sequence: Synthetic probe
ggggaagacatccatgaatgcattctaggtggaaactggacatgcatagctggtgaccat

SEQ ID NO: 14912 - DNA, 60 bp, Artificial Sequence
  Description of Artificial Sequence: Synthetic probe
cttaaaggtctcgagatgccacgtggacgagggcatgcccaaagcacatcttaacctgag

SEQ ID NO: 14913 - DNA, 60 bp, Artificial Sequence
  Description of Artificial Sequence: Synthetic probe
atagcaggggaacagctacgttacacagggggtgacatagaatcctgtaagtggtgcggc

SEQ ID NO: 14914 - DNA, 60 bp, Artificial Sequence
  Description of Artificial Sequence: Synthetic probe
aagagtgctacaagagatcgccaaaaaatactcaaatgggtccacaacaagctaaactgc

SEQ ID NO: 14915 - DNA, 60 bp, Artificial Sequence
  Description of Artificial Sequence: Synthetic probe
gaaacctcttgcaacagagacggtgtggctatagtgccaactggtcgggtgaaatgcagg

SEQ ID NO: 14916 - DNA, 58 bp, Artificial Sequence
  Description of Artificial Sequence: Synthetic probe
agatttagacacagttgtggacactgggttgaaatgtgaaaagagggtgagggtttca

SEQ ID NO: 14917 - DNA, 58 bp, Artificial Sequence
  Description of Artificial Sequence: Synthetic probe
ggggaagatctctatgactgcatccttggaggaaactggacttgtatagcaggggatc

SEQ ID NO: 14918 - DNA, 60 bp, Artificial Sequence
  Description of Artificial Sequence: Synthetic probe
ggggttgcatgggtgaaagcgccattcgtggcgttatggacacagcctgatagggtgtag

SEQ ID NO: 14919 - DNA, 60 bp, Artificial Sequence
  Description of Artificial Sequence: Synthetic probe
attgggaggacaactggtagtgatggtaagttgtaccacatttacgtgtgtgtagatgga

SEQ ID NO: 14920 - DNA, 60 bp, Artificial Sequence
  Description of Artificial Sequence: Synthetic probe
gttaatggtttgacactccttcagttgagtgagtctcgagatgccatgttgactgagggc

SEQ ID NO: 14921 - DNA, 60 bp, Artificial Sequence
  Description of Artificial Sequence: Synthetic probe
agtacaggggagtcgttaatggtttgacactccttcagttgagtgagtctcgagatgcca

SEQ ID NO: 14922 - DNA, 60 bp, Artificial Sequence
  Description of Artificial Sequence: Synthetic probe
ggggattagcggtagtagttagttcatttgatggccgaacccctgagtacaggggagtcg

SEQ ID NO: 14923 - DNA, 60 bp, Artificial Sequence
  Description of Artificial Sequence: Synthetic probe
aaataggggattagcggtagtagttagttcatttgatggccgaacccctgagtacagggg

SEQ ID NO: 14924 - DNA, 60 bp, Artificial Sequence
  Description of Artificial Sequence: Synthetic probe
cactccttcagttgaggagtctcgagatgccatgtggacgagggcatgcccacggcacat

SEQ ID NO: 14925 - DNA, 60 bp, Artificial Sequence
  Description of Artificial Sequence: Synthetic probe
gacgagggcatgcccacagcacatcttaacctgagcgggggtcgctcaggcgaaaacggt

SEQ ID NO: 14926 - DNA, 60 bp, Artificial Sequence
  Description of Artificial Sequence: Synthetic probe
taatcacatctcatttggttcacggatgccaggcaccagtgggcggcagagagctactcc

SEQ ID NO: 14927 - DNA, 60 bp, Artificial Sequence
  Description of Artificial Sequence: Synthetic probe
atcacatcccatttggttcacggatgccaggcaccagtgggcggcagagagctactccca

SEQ ID NO: 14928 - DNA, 60 bp, Artificial Sequence
  Description of Artificial Sequence: Synthetic probe
ttatcacatctcatttggttcacggatgccaggcaccagtgggcggcagagagctactcc

SEQ ID NO: 14929 - DNA, 60 bp, Artificial Sequence
  Description of Artificial Sequence: Synthetic probe
ttgtcacatctcatttggttcacggatgccaggcaccagtgggcggcagagagctactcc

SEQ ID NO: 14930 - DNA, 60 bp, Artificial Sequence
  Description of Artificial Sequence: Synthetic probe
ttatcacatctcatttggttcacggatgccaggcaccagtgggcggcagagagctacaaa

SEQ ID NO: 14931 - DNA, 60 bp, Artificial Sequence
  Description of Artificial Sequence: Synthetic probe
ttatcacatctcatttggttcacggatgccaggcaccagtgggcggcagagagctactct

SEQ ID NO: 14932 - DNA, 60 bp, Artificial Sequence
  Description of Artificial Sequence: Synthetic probe
atagggtgtagcagagacctgctactccgctagtaaaaactctgctgtacatggcacatg

SEQ ID NO: 14933 - DNA, 60 bp, Artificial Sequence
  Description of Artificial Sequence: Synthetic probe
ccatcggggaagatctctacgactgtgtcttaggagggaattggacttgtgtgccggggg

SEQ ID NO: 14934 - DNA, 60 bp, Artificial Sequence
  Description of Artificial Sequence: Synthetic probe
ccattggggaagacctctacgaatgtgtcttaggagggaattggacttgtgtgccggggg

SEQ ID NO: 14935 - DNA, 60 bp, Artificial Sequence
  Description of Artificial Sequence: Synthetic probe
ccatcggggaagacctctacaactgtgccttaggagggaattggacttgtgtgccggggg

SEQ ID NO: 14936 - DNA, 60 bp, Artificial Sequence
  Description of Artificial Sequence: Synthetic probe
gctggccaataaggatacgttagccacaaccgttgtacgaacatacaataggcacaagcc

SEQ ID NO: 14937 - DNA, 60 bp, Artificial Sequence
  Description of Artificial Sequence: Synthetic probe
ccaaacttgggcctatgccctgcaagccatatgagatcatttcaagtgaggggcccgtag

SEQ ID NO: 14938 - DNA, 50 bp, Artificial Sequence
  Description of Artificial Sequence: Synthetic probe
gaatacagcctgatagggtgctgcagaggcccactgcatcgctactaaaa

SEQ ID NO: 14939 - DNA, 60 bp, Artificial Sequence
  Description of Artificial Sequence: Synthetic probe
ctgtgagtggaatctacctgaagccggggccactattttatcaggactataagggtcccg

SEQ ID NO: 14940 - DNA, 60 bp, Artificial Sequence
  Description of Artificial Sequence: Synthetic probe
ccaccaacctggcgtctttaccaaaaagaggtgactgcaggtcgggtaatagtaaaggac

SEQ ID NO: 14941 - DNA, 60 bp, Artificial Sequence
  Description of Artificial Sequence: Synthetic probe
agctttccagatggtatgcccacaggggtggactggtacaatagaatgcatcctggcaaa

SEQ ID NO: 14942 - DNA, 60 bp, Artificial Sequence
  Description of Artificial Sequence: Synthetic probe
ctcaaggagatagtagggatgatggacgcgagtgagaagaccaactacacgtgttgcagg

SEQ ID NO: 14943 - DNA, 60 bp, Artificial Sequence
  Description of Artificial Sequence: Synthetic probe
ggaatcatgcctagaggcacaacccctagggcacccgtgagattccccacagcactactg

SEQ ID NO: 14944 - DNA, 60 bp, Artificial Sequence
  Description of Artificial Sequence: Synthetic probe
cgtccacagatggtttggtgaggaggaaatatatggggcacccaaggtgatcaccatcat

SEQ ID NO: 14945 - DNA, 60 bp, Artificial Sequence
  Description of Artificial Sequence: Synthetic probe
gggcatgcccaagacactttctccagcctgggcgggggtcgcccaggcgaaagcacctga

SEQ ID NO: 14946 - DNA, 60 bp, Artificial Sequence
  Description of Artificial Sequence: Synthetic probe
ggacacagcctgatagggtgtagcagagacctgctattccgctagtaaaaactctgctgt

SEQ ID NO: 14947 - DNA, 60 bp, Artificial Sequence
  Description of Artificial Sequence: Synthetic probe
ttggcaagtgtaagctgaaggatgaaagtggctacagacaagtagatgagacctcttgta

SEQ ID NO: 14948 - DNA, 60 bp, Artificial Sequence
  Description of Artificial Sequence: Synthetic probe
ggggatgaactacgatatcaaggtgggcccgtcgagtcttgtaagtggtgtggctacaaa

SEQ ID NO: 14949 - DNA, 60 bp, Artificial Sequence
  Description of Artificial Sequence: Synthetic probe
gtgccgggggatgaactacgatatcaaggtgggcccgtcgagtcttgtaagtggtgtggc

SEQ ID NO: 14950 - DNA, 60 bp, Artificial Sequence
  Description of Artificial Sequence: Synthetic probe
gtgccgggggctgagctacggtatgcaggtgggcccgtcgagtcttgtaagtggtgtggt

SEQ ID NO: 14951 - DNA, 60 bp, Artificial Sequence
  Description of Artificial Sequence: Synthetic probe
gtgccgggggatggactacgatatgtaggtgggcccgtcgagtcttgtaagtggtgtggc

SEQ ID NO: 14952 - DNA, 60 bp, Artificial Sequence
  Description of Artificial Sequence: Synthetic probe
gttacatccaatacacagccagaggacaactctttctgaggaacctaccaattctagcga

SEQ ID NO: 14953 - DNA, 60 bp, Artificial Sequence
  Description of Artificial Sequence: Synthetic probe
gggttatatccaatacgcagccagagggcaactctttctgaggaacctaccaattctagc

SEQ ID NO: 14954 - DNA, 50 bp, Artificial Sequence
  Description of Artificial Sequence: Synthetic probe
aaaacgaaactggctacaggctggtagatgacaccccttgcaatagagat

SEQ ID NO: 14955 - DNA, 60 bp, Artificial Sequence
  Description of Artificial Sequence: Synthetic probe
gaacacagcctgatagggtgtagcagagacctgctatcccgctagtaaaaactctgctgt

SEQ ID NO: 14956 - DNA, 53 bp, Artificial Sequence
  Description of Artificial Sequence: Synthetic probe
ccccaggccagatgtccagggaagagtataagggttacgtccaatacatagcc

SEQ ID NO: 14957 - DNA, 60 bp, Artificial Sequence
  Description of Artificial Sequence: Synthetic probe
atctttcaagtacccccaggccagatgtccagggaagagtataagggttacgtccaatac

SEQ ID NO: 14958 - DNA, 60 bp, Artificial Sequence
  Description of Artificial Sequence: Synthetic probe
gagaaggacgccaagaagcaatgaatacgatgatgtgcagccgatgccagggaaagcata

SEQ ID NO: 14959 - DNA, 60 bp, Artificial Sequence
  Description of Artificial Sequence: Synthetic probe
aaaagatatttataagagaaggacgccaagaagcaatgaatacgatgatgtgcagccgat

SEQ ID NO: 14960 - DNA, 60 bp, Artificial Sequence
  Description of Artificial Sequence: Synthetic probe
tcaccatcataaaagctagtaccctaagtaaaaacaggcactgcataatctgcacgatct

SEQ ID NO: 14961 - DNA, 60 bp, Artificial Sequence
  Description of Artificial Sequence: Synthetic probe
tggacgagggcatgcccacagcacatcttagcctgagcgggggtcgcccaggtgaaagcg

SEQ ID NO: 14962 - DNA, 60 bp, Artificial Sequence
  Description of Artificial Sequence: Synthetic probe
gcagagtgaccggtagcaatgggaaattataccacatttatgtctgcatagatgggtgtg

SEQ ID NO: 14963 - DNA, 60 bp, Artificial Sequence
  Description of Artificial Sequence: Synthetic probe
ggacaagaggacatagtagaaatggatgacaactttgatttcggtctttgcccatgcgat

SEQ ID NO: 14964 - DNA, 60 bp, Artificial Sequence
  Description of Artificial Sequence: Synthetic probe
tacccagactgcaaacccggcttttcatacgccatagccagaaatgaagatatcggccca

SEQ ID NO: 14965 - DNA, 60 bp, Artificial Sequence
  Description of Artificial Sequence: Synthetic probe
ggagagtatcaatactggtttgacctcgaggtcacagaccaccaccgggattacctcgct

SEQ ID NO: 14966 - DNA, 60 bp, Artificial Sequence
  Description of Artificial Sequence: Synthetic probe
ggagagtatcaatactggtttgacctcgaggtcacagatcaccaccgggattacttcgcc

SEQ ID NO: 14967 - DNA, 60 bp, Artificial Sequence
  Description of Artificial Sequence: Synthetic probe
tgaaaacacctcgctgtgttggggttacagcctgatagggtgctgcagaggcccacgcat

SEQ ID NO: 14968 - DNA, 60 bp, Artificial Sequence
  Description of Artificial Sequence: Synthetic probe
gccattcgtggtgctatggacacagcctgatagggtgtagcagagacctgctatcccgct

SEQ ID NO: 14969 - DNA, 60 bp, Artificial Sequence
  Description of Artificial Sequence: Synthetic probe
taggactagcaaaaagaggggactagcggtagcagtgagttcattggatggccgaatccc

SEQ ID NO: 14970 - DNA, 60 bp, Artificial Sequence
  Description of Artificial Sequence: Synthetic probe
gagtgccacaaaagatcgtcaaagggtactcaaatgggtccacaacaaactaaattgccc

SEQ ID NO: 14971 - DNA, 60 bp, Artificial Sequence
  Description of Artificial Sequence: Synthetic probe
aaaggtctcgagatgccacgtggacgagggcatgcccagagcacatcttaacctgagcgg

SEQ ID NO: 14972 - DNA, 60 bp, Artificial Sequence
  Description of Artificial Sequence: Synthetic probe
ggtttaaccgaccgctacgagcacagcctgatagggtgctgcagaggcccactgtattgc

SEQ ID NO: 14973 - DNA, 60 bp, Artificial Sequence
  Description of Artificial Sequence: Synthetic probe
aagcgctattcgtggcgttatggacacagcctgatagggtgtagcagagacctgctactc

SEQ ID NO: 14974 - DNA, 60 bp, Artificial Sequence
  Description of Artificial Sequence: Synthetic probe
aggtccttgccgcagaaaggtgactgccggaaaggcaacgtgaatggagcggtgagtggt

SEQ ID NO: 14975 - DNA, 60 bp, Artificial Sequence
  Description of Artificial Sequence: Synthetic probe
ccagggccgttattctaccaggattacaaaggacccgtctatcatagagccccgctagag

SEQ ID NO: 14976 - DNA, 51 bp, Artificial Sequence
  Description of Artificial Sequence: Synthetic probe
cgagtacagcctgatagggtgctgcagaggcccactgtatcgctactaaaa

SEQ ID NO: 14977 - DNA, 60 bp, Artificial Sequence
  Description of Artificial Sequence: Synthetic probe
gccgaacccctgagtacaggggagtcgtcaatggttcgacactccattagtcgaggagtc

SEQ ID NO: 14978 - DNA, 60 bp, Artificial Sequence
  Description of Artificial Sequence: Synthetic probe
cggtgtggctatagtaccaactggttcggtgaaatgcaagataggggacacagtggtgca

SEQ ID NO: 14979 - DNA, 60 bp, Artificial Sequence
  Description of Artificial Sequence: Synthetic probe
acggtgtggctatagtaccaactggtttggtgaaatgcaagataggggacacagtggtgc

SEQ ID NO: 14980 - DNA, 60 bp, Artificial Sequence
  Description of Artificial Sequence: Synthetic probe
aggaatccttggtaagaagttggagaataaaagcaatgcatggtttggtgcacatgcagc

SEQ ID NO: 14981 - DNA, 60 bp, Artificial Sequence
  Description of Artificial Sequence: Synthetic probe
cgcctagcacgataggcctcgagatgccacgtggacgagggcacgcccacagcacatctt

SEQ ID NO: 14982 - DNA, 60 bp, Artificial Sequence
  Description of Artificial Sequence: Synthetic probe
ccaggtgaaagcacctgataggtgttgggagtacagcctgatagggtgctgcagaggccc

SEQ ID NO: 14983 - DNA, 60 bp, Artificial Sequence
  Description of Artificial Sequence: Synthetic probe
cctcttgcaacagagacggtgtggctatagtaccaactggtttggtgaaatgcaagatag

SEQ ID NO: 14984 - DNA, 60 bp, Artificial Sequence
  Description of Artificial Sequence: Synthetic probe
gaccaactgttacgaatacagcctgatagggtgctgcagaggcccactgtattgctacta

SEQ ID NO: 14985 - DNA, 60 bp, Artificial Sequence
  Description of Artificial Sequence: Synthetic probe
caacatagacggtgtggctatagtgccaactggtcgggtgaaatgcaagataggggacac

SEQ ID NO: 14986 - DNA, 60 bp, Artificial Sequence
  Description of Artificial Sequence: Synthetic probe
ggcacaagccttttccctataggcaaagctgtattacccagaaaaccatcggggaggacc

SEQ ID NO: 14987 - DNA, 60 bp, Artificial Sequence
  Description of Artificial Sequence: Synthetic probe
gggtgaaaacacctaacggtgttggggttacagcctgatagggtgctgcagaggcccacg

SEQ ID NO: 14988 - DNA, 60 bp, Artificial Sequence
  Description of Artificial Sequence: Synthetic probe
aaaggtctcgagatgccacgtggacgagggcatgcccaaagcacatcttaacctgggcgg

SEQ ID NO: 14989 - DNA, 60 bp, Artificial Sequence
  Description of Artificial Sequence: Synthetic probe
taaaaacggttttaccaaccgctacgaatacagcctgatagggtgctgcagaggcccact

SEQ ID NO: 14990 - DNA, 60 bp, Artificial Sequence
  Description of Artificial Sequence: Synthetic probe
gatcaactgctacgaatacagcctgatagggtgctgcagaggcccactgtattgctacta

SEQ ID NO: 14991 - DNA, 60 bp, Artificial Sequence
  Description of Artificial Sequence: Synthetic probe
ctccattaaccgaggagtctcgagatgccatgtggacgagggcatgcccacggcacttct

SEQ ID NO: 14992 - DNA, 52 bp, Artificial Sequence
  Description of Artificial Sequence: Synthetic probe
acgaatacagcctgatagggtgctgcagaggcccactgtattgctactaaaa

SEQ ID NO: 14993 - DNA, 60 bp, Artificial Sequence
  Description of Artificial Sequence: Synthetic probe
ctagcatgaagaggggactagcggtagcagtgagttcattggatggccgaatccctgagt

SEQ ID NO: 14994 - DNA, 60 bp, Artificial Sequence
  Description of Artificial Sequence: Synthetic probe
cggtgccagatgctatgtattgaatccagaggcagtaaatatatcagggtccaagggagc

SEQ ID NO: 14995 - DNA, 60 bp, Artificial Sequence
  Description of Artificial Sequence: Synthetic probe
acggtgccagatgctatgtattgaatccagaggcagtaaatatatcagggtccaagggag

SEQ ID NO: 14996 - DNA, 60 bp, Artificial Sequence
  Description of Artificial Sequence: Synthetic probe
ggcatgcccacggcacatcttaacctatgcagggggttgcgtaggtgaaagcaccattta

SEQ ID NO: 14997 - DNA, 60 bp, Artificial Sequence
  Description of Artificial Sequence: Synthetic probe
cagtcgaggagtctcgagatgccatgtggacgagggcttgcccacggcacatcttaacct

SEQ ID NO: 14998 - DNA, 60 bp, Artificial Sequence
  Description of Artificial Sequence: Synthetic probe
gtggcgttatggacacagcctgatagggtgtagcagagacctgctatcccgctagtaaaa

SEQ ID NO: 14999 - DNA, 60 bp, Artificial Sequence
  Description of Artificial Sequence: Synthetic probe
ccagctttccagatggtatgcccacaggggtggactggtacaatagaatgcaccctggcg

SEQ ID NO: 15000 - DNA, 60 bp, Artificial Sequence
  Description of Artificial Sequence: Synthetic probe
gtctcatgggaacaattagaagccgggataaaccgtaagggagcagccggttatctagag

SEQ ID NO: 15001 - DNA, 60 bp, Artificial Sequence
  Description of Artificial Sequence: Synthetic probe
ctggctaataaggatacattagccatgaccattgtacgaacatacaagaggcaaaagcct

SEQ ID NO: 15002 - DNA, 60 bp, Artificial Sequence
  Description of Artificial Sequence: Synthetic probe
ctggccaataaggatacattagccatgaccattgtacggacatacaagaggtacaagcct

SEQ ID NO: 15003 - DNA, 60 bp, Artificial Sequence
  Description of Artificial Sequence: Synthetic probe
atagggaacacagtggtgcaagtcatagcaatggatgataagctggggcctatgccttgc

SEQ ID NO: 15004 - DNA, 60 bp, Artificial Sequence
  Description of Artificial Sequence: Synthetic probe
gacgccttggcataaaggtctcgagatgccacgtggacgagggcatgcccaaagcacatc

SEQ ID NO: 15005 - DNA, 60 bp, Artificial Sequence
  Description of Artificial Sequence: Synthetic probe
caggtgaaatgcaagatagggaacacagtggtgcaagtaatagcaatggatgataggctt

SEQ ID NO: 15006 - DNA, 60 bp, Artificial Sequence
  Description of Artificial Sequence: Synthetic probe
actggacctgtgtagcaggggaacagctacgttacacagggggtgccatagagtcctgta

SEQ ID NO: 15007 - DNA, 60 bp, Artificial Sequence
  Description of Artificial Sequence: Synthetic probe
gaaggtgtagcgatagtgccacatgggactgtgaagtgtaaaattggagatacagtggtg

SEQ ID NO: 15008 - DNA, 60 bp, Artificial Sequence
  Description of Artificial Sequence: Synthetic probe
acctcttgcaatagagaaggtgtagcgatagtgccacatgggactgtgaagtgtaaaatt

SEQ ID NO: 15009 - DNA, 58 bp, Artificial Sequence
  Description of Artificial Sequence: Synthetic probe
ttttgaggagtgaagggctgccacactatccaattggcaaatgcaggttagaaaacga

SEQ ID NO: 15010 - DNA, 60 bp, Artificial Sequence
  Description of Artificial Sequence: Synthetic probe
gtggtgcggctataagtttttgaggagtgaagggctgccacactatccaattggcaaatg

SEQ ID NO: 15011 - DNA, 60 bp, Artificial Sequence
  Description of Artificial Sequence: Synthetic probe
gggaagatctccataactgtatctacggaggaaactggacttgtgtagcaggggatcagc

SEQ ID NO: 15012 - DNA, 60 bp, Artificial Sequence
  Description of Artificial Sequence: Synthetic probe
tcctgggggaagatctccataactgtatctacggaggaaactggacttgtgtagcagggg

SEQ ID NO: 15013 - DNA, 60 bp, Artificial Sequence
  Description of Artificial Sequence: Synthetic probe
taagagggctagcccattccctaataggcaaggatgtgtcactcaaaaactcctggggga

SEQ ID NO: 15014 - DNA, 60 bp, Artificial Sequence
  Description of Artificial Sequence: Synthetic probe
caataaggacaccttagacgtggttgtagtgcggacgtataagagggctagcccattccc

SEQ ID NO: 15015 - DNA, 60 bp, Artificial Sequence
  Description of Artificial Sequence: Synthetic probe
tgcgtcctaaccaataaggacaccttagacgtggttgtagtgcggacgtataagagggct

SEQ ID NO: 15016 - DNA, 60 bp, Artificial Sequence
  Description of Artificial Sequence: Synthetic probe
gaaagcgggtaaactactcgttacggacacagcctgatagggtgctgcagaggcccgctg

SEQ ID NO: 15017 - DNA, 60 bp, Artificial Sequence
  Description of Artificial Sequence: Synthetic probe
tgaaagcgggaaaaccaaccgttacggacacagcctgatagggtgctgcagaggcccact

SEQ ID NO: 15018 - DNA, 60 bp, Artificial Sequence
  Description of Artificial Sequence: Synthetic probe
gtgaaagcgggtaaactacccgttacggacacagcctgatagggtgctgcagaggcccac

SEQ ID NO: 15019 - DNA, 60 bp, Artificial Sequence
  Description of Artificial Sequence: Synthetic probe
tcaggtgaaagcgggtaaactactcgttacggacacagcctgatagggtgctgcagaggc

SEQ ID NO: 15020 - DNA, 60 bp, Artificial Sequence
  Description of Artificial Sequence: Synthetic probe
caaaaacggtttaaccaaccgctacgaatacagcctgatagggtgctgcagaggcccact

SEQ ID NO: 15021 - DNA, 60 bp, Artificial Sequence
  Description of Artificial Sequence: Synthetic probe
gggaagatctctatgactgtgcccttggaggaaactggacttgtatagcaggggaacagc

SEQ ID NO: 15022 - DNA, 60 bp, Artificial Sequence
  Description of Artificial Sequence: Synthetic probe
ccaggattacacagggccagtctaccacagagcaccattggagttattcgaggaagggtc

SEQ ID NO: 15023 - DNA, 60 bp, Artificial Sequence
  Description of Artificial Sequence: Synthetic probe
cacaattctaccaggattacacagggccagtctaccacagagcaccattggagttattcg

SEQ ID NO: 15024 - DNA, 60 bp, Artificial Sequence
  Description of Artificial Sequence: Synthetic probe
ctaaccaactgctacggatacagcctgatagggtgctgcagaggcccactgtattgctac

SEQ ID NO: 15025 - DNA, 52 bp, Artificial Sequence
  Description of Artificial Sequence: Synthetic probe
aaaacgagactggctacaggctggtagacgacacctcttgcaataggggtgg

SEQ ID NO: 15026 - DNA, 60 bp, Artificial Sequence
  Description of Artificial Sequence: Synthetic probe
gacactccatcagttgaggagtctcgagatgccatgtagacgagggcatgcccaaggcac

SEQ ID NO: 15027 - DNA, 60 bp, Artificial Sequence
  Description of Artificial Sequence: Synthetic probe
ggttcgacactccatcagttgaggagtctcgagatgccatgtagacgagggcatgcccaa

SEQ ID NO: 15028 - DNA, 60 bp, Artificial Sequence
  Description of Artificial Sequence: Synthetic probe
ttggcaaatgcaggttaaaaaacgaaactggctacaggctggtggatggcaccccttgca

SEQ ID NO: 15029 - DNA, 60 bp, Artificial Sequence
  Description of Artificial Sequence: Synthetic probe
ttggcaaatgcaggttaaaaaacgaaactggctacaggctggtggatgacacctcttgca

SEQ ID NO: 15030 - DNA, 60 bp, Artificial Sequence
  Description of Artificial Sequence: Synthetic probe
ggcgaaagaggagagatacatccgcagtcaacactaaaactaccacataaaagaggggag

SEQ ID NO: 15031 - DNA, 60 bp, Artificial Sequence
  Description of Artificial Sequence: Synthetic probe
agtaaaggacctgtgagtggaatctacctgaagccggggccactattttatcaggactat

SEQ ID NO: 15032 - DNA, 50 bp, Artificial Sequence
  Description of Artificial Sequence: Synthetic probe
gaaaggggggcaatccaccctcaatcgacgctaaagctcccacacaagag

SEQ ID NO: 15033 - DNA, 55 bp, Artificial Sequence
  Description of Artificial Sequence: Synthetic probe
ggcaaaagccttttccctataggcaaggctgtattacccagaaaaccatcgggga

SEQ ID NO: 15034 - DNA, 60 bp, Artificial Sequence
  Description of Artificial Sequence: Synthetic probe
caagaggcaaaagccttttccctataggcaaggctgtattacccagaaaaccatcgggga

SEQ ID NO: 15035 - DNA, 60 bp, Artificial Sequence
  Description of Artificial Sequence: Synthetic probe
caagaggcacaagccttttccctataggcaaggctgtattacccagaaaaccatcgggga

SEQ ID NO: 15036 - DNA, 60 bp, Artificial Sequence
  Description of Artificial Sequence: Synthetic probe
ggttcgacgccttgacataaaggtctcgagatgccacgtggacgagggcatgcccaaagc

SEQ ID NO: 15037 - DNA, 50 bp, Artificial Sequence
  Description of Artificial Sequence: Synthetic probe
cgacacgcgcaagtcgcacgtctcgagatgctatgtggacgagggcatgc

SEQ ID NO: 15038 - DNA, 60 bp, Artificial Sequence
  Description of Artificial Sequence: Synthetic probe
gatgctatgtggacgagggcatgcccacggcacatcttaacctatgcgggggttgcatgg

SEQ ID NO: 15039 - DNA, 60 bp, Artificial Sequence
  Description of Artificial Sequence: Synthetic probe
ttgtgaagtgtagaattggagacacagtggtgcaagtcatagcaatggacacaaaacttg

SEQ ID NO: 15040 - DNA, 60 bp, Artificial Sequence
  Description of Artificial Sequence: Synthetic probe
ctgtgaagtgtagaattggagacacagtggtgcaagtcatagcgatggacacaaaacttg

SEQ ID NO: 15041 - DNA, 60 bp, Artificial Sequence
  Description of Artificial Sequence: Synthetic probe
gccaagtggtcgtgtaaaatgcaagattggggacacggtggtgcaagttatagcaatgga

SEQ ID NO: 15042 - DNA, 60 bp, Artificial Sequence
  Description of Artificial Sequence: Synthetic probe
tatagtgccaagtggtcgtgtaaaatgcaagattggggacacggtggtgcaagttatagc

SEQ ID NO: 15043 - DNA, 60 bp, Artificial Sequence
  Description of Artificial Sequence: Synthetic probe
tacagacaagtagatgagacctcttgcaatagagacggtgtggctatagtgccaagtggt

SEQ ID NO: 15044 - DNA, 60 bp, Artificial Sequence
  Description of Artificial Sequence: Synthetic probe
agtggttacagacaagtagatgagacctcttgcaatagagacggtgtggctatagtgcca

SEQ ID NO: 15045 - DNA, 59 bp, Artificial Sequence
  Description of Artificial Sequence: Synthetic probe
cttcccaattggcaagtgtaagctgaagaatgaaagtggttacagacaagtagatgaga

SEQ ID NO: 15046 - DNA, 60 bp, Artificial Sequence
  Description of Artificial Sequence: Synthetic probe
gtgaggacctgccacacttcccaattggcaagtgtaagctgaagaatgaaagtggttaca

SEQ ID NO: 15047 - DNA, 50 bp, Artificial Sequence
  Description of Artificial Sequence: Synthetic probe
gaccagctacgatatgtagatgggcccgtcgagtcttgcaagtggtgtgg

SEQ ID NO: 15048 - DNA, 59 bp, Artificial Sequence
  Description of Artificial Sequence: Synthetic probe
gtaccgggggaccagctacgatatgtagatgggcccgtcgagtcttgcaagtggtgtgg

SEQ ID NO: 15049 - DNA, 60 bp, Artificial Sequence
  Description of Artificial Sequence: Synthetic probe
ccatcggggaagatctctacaactgtgacatgggagggaactggacttgtgtaccggggg

SEQ ID NO: 15050 - DNA, 59 bp, Artificial Sequence
  Description of Artificial Sequence: Synthetic probe
ccatcggggaagatctctacaactgtgacatgggagggaactggacttgtgtaccgggg

SEQ ID NO: 15051 - DNA, 60 bp, Artificial Sequence
  Description of Artificial Sequence: Synthetic probe
ctggctaataaggatactttagccaccaccgttgtacggaaatacacgaggtacaagcct

SEQ ID NO: 15052 - DNA, 60 bp, Artificial Sequence
  Description of Artificial Sequence: Synthetic probe
tgtgcactggctaataaggatactttagccaccaccgttgtacggaaatacacgaggtac

SEQ ID NO: 15053 - DNA, 60 bp, Artificial Sequence
  Description of Artificial Sequence: Synthetic probe
catttcatggtgttatgaacacagcctgatagggtgtagcagagacctgctatcccgtag

SEQ ID NO: 15054 - DNA, 60 bp, Artificial Sequence
  Description of Artificial Sequence: Synthetic probe
gcatgcccacggcacatcttaacctacgcgggggttgcgtaggcgaaaacaccatttcat

SEQ ID NO: 15055 - DNA, 60 bp, Artificial Sequence
  Description of Artificial Sequence: Synthetic probe
acgaacacagcctgatagggcgctgcagaggcccactgtattgctactaaaaatctctgc

SEQ ID NO: 15056 - DNA, 57 bp, Artificial Sequence
  Description of Artificial Sequence: Synthetic probe
aaaacgaaactggctacaggctggtggatggcaccccttgcaatagagatggtgtag

SEQ ID NO: 15057 - DNA, 60 bp, Artificial Sequence
  Description of Artificial Sequence: Synthetic probe
ttctgggggaagatctctatgactgtacccatggaggaaactggacttgtatagcagggg

SEQ ID NO: 15058 - DNA, 60 bp, Artificial Sequence
  Description of Artificial Sequence: Synthetic probe
taggagggctagccccttccctaataggcaaggttgtgtcacacagaaacttctggggga

SEQ ID NO: 15059 - DNA, 60 bp, Artificial Sequence
  Description of Artificial Sequence: Synthetic probe
tgcgtcctagccaataaggacaccctaaatacggtcgtagtgcggacgtataggagggct

SEQ ID NO: 15060 - DNA, 60 bp, Artificial Sequence
  Description of Artificial Sequence: Synthetic probe
cttaaaggtctcgagatgccacgtggacgagggcatgcccagagcacatcttaacctgag

SEQ ID NO: 15061 - DNA, 60 bp, Artificial Sequence
  Description of Artificial Sequence: Synthetic probe
gcagtcaacactaaaattaccacataaaagaggggagtgtgaagtccccactaatttggc

SEQ ID NO: 15062 - DNA, 60 bp, Artificial Sequence
  Description of Artificial Sequence: Synthetic probe
ccgcagtcaacactaaaattaccacataaaagaggggagtgtgaagtccccactaatttg

SEQ ID NO: 15063 - DNA, 60 bp, Artificial Sequence
  Description of Artificial Sequence: Synthetic probe
gccttaaaagaatggctgtcactgtgggcgaacaggctcagcggagaggcagggtaggta

SEQ ID NO: 15064 - DNA, 60 bp, Artificial Sequence
  Description of Artificial Sequence: Synthetic probe
aggggaagaccttggaagccagttccttgacatagcggggttaaagatccctgtagagga

SEQ ID NO: 15065 - DNA, 60 bp, Artificial Sequence
  Description of Artificial Sequence: Synthetic probe
aggggaggaccttggaagccagttccttgacatagcggggctaaagatcccggtagagat

SEQ ID NO: 15066 - DNA, 60 bp, Artificial Sequence
  Description of Artificial Sequence: Synthetic probe
aggggaggaccttggaagccagttccttgacatagcggggttaaagatccctgtagagga

SEQ ID NO: 15067 - DNA, 60 bp, Artificial Sequence
  Description of Artificial Sequence: Synthetic probe
ccctgaggtgatgaaaggggaggaccttggaagccagttccttgacatagcggggctaaa

SEQ ID NO: 15068 - DNA, 60 bp, Artificial Sequence
  Description of Artificial Sequence: Synthetic probe
cctgaggtgatgaaaggggaagaccttggaagccagttccttgacatagcggggctaaaa

SEQ ID NO: 15069 - DNA, 60 bp, Artificial Sequence
  Description of Artificial Sequence: Synthetic probe
acgtggacgagggcatgcccacagcacatcttaacctgagcaggggtcgttcaggtgaaa

SEQ ID NO: 15070 - DNA, 60 bp, Artificial Sequence
  Description of Artificial Sequence: Synthetic probe
tcgtcagtggttcgacgcctcggaaagaaggtctcgagatgccacgtggacgagggcatg

SEQ ID NO: 15071 - DNA, 60 bp, Artificial Sequence
  Description of Artificial Sequence: Synthetic probe
cgggagtcctctgttcggagagagcagtgaggtacacccgcaatccacactaaagctacc

SEQ ID NO: 15072 - DNA, 60 bp, Artificial Sequence
  Description of Artificial Sequence: Synthetic probe
caacgggtgcccattgtttggggagagcagtgaggtacacccgcaatccacactaaagct

SEQ ID NO: 15073 - DNA, 60 bp, Artificial Sequence
  Description of Artificial Sequence: Synthetic probe
gcaagtggtgcggttacagattcctaaagggtgagggactaccacattacccgattggca

SEQ ID NO: 15074 - DNA, 60 bp, Artificial Sequence
  Description of Artificial Sequence: Synthetic probe
acatcgaatcatgcaagtggtgcggttacagattcctaaagggtgagggactaccacatt

SEQ ID NO: 15075 - DNA, 60 bp, Artificial Sequence
  Description of Artificial Sequence: Synthetic probe
tgtgtagtgggggagcaactacgatacacagggggtcacatcgaatcatgcaagtggtgc

SEQ ID NO: 15076 - DNA, 58 bp, Artificial Sequence
  Description of Artificial Sequence: Synthetic probe
tgcgtcctagctaataaggacaccctagacacggttgtagtgcggacgtataagaggg

SEQ ID NO: 15077 - DNA, 60 bp, Artificial Sequence
  Description of Artificial Sequence: Synthetic probe
gactggctacaggctggtagacgacacctcttgcaatgtgggtggtgtagcgatagtgcc

SEQ ID NO: 15078 - DNA, 60 bp, Artificial Sequence
  Description of Artificial Sequence: Synthetic probe
gcccaagctgagagctgctatggtagagtattcatatatattcttagatgagtaccactg

SEQ ID NO: 15079 - DNA, 60 bp, Artificial Sequence
  Description of Artificial Sequence: Synthetic probe
cccaacccaaactgagagctgccatggtagagtattcatatatattcttagatgagtacc

SEQ ID NO: 15080 - DNA, 60 bp, Artificial Sequence
  Description of Artificial Sequence: Synthetic probe
ggcacaagccctttccctataggcagggctgtattacccagaaaaccatcggggaagatc

SEQ ID NO: 15081 - DNA, 60 bp, Artificial Sequence
  Description of Artificial Sequence: Synthetic probe
tgtacattggccaataaggacacgttagccacaaccgttgtacgaacatacaagaggcac

SEQ ID NO: 15082 - DNA, 60 bp, Artificial Sequence
  Description of Artificial Sequence: Synthetic probe
gacctaggcggaaactggacatgcataactggtgaccatagtaaattgaaagatgggcct

SEQ ID NO: 15083 - DNA, 60 bp, Artificial Sequence
  Description of Artificial Sequence: Synthetic probe
gtgtgacctaggcggaaactggacatgcataactggtgaccatagtaaattgaaagatgg

SEQ ID NO: 15084 - DNA, 60 bp, Artificial Sequence
  Description of Artificial Sequence: Synthetic probe
ccagtctactgaacgggccagcttttcagttggtatgcccacaagggtggactggtacag

SEQ ID NO: 15085 - DNA, 54 bp, Artificial Sequence
  Description of Artificial Sequence: Synthetic probe
cgtggcgttatggacacagcctgatagggtgtagcagagacctgctattccgct

SEQ ID NO: 15086 - DNA, 60 bp, Artificial Sequence
  Description of Artificial Sequence: Synthetic probe
gagcataagagtggttgccatgacagctaccccagcagggtcagtaaccacaacagggca

SEQ ID NO: 15087 - DNA, 60 bp, Artificial Sequence
  Description of Artificial Sequence: Synthetic probe
gagcataagagtggttgccatgactgccaccccagcagggtcagtaaccacaacagggca

SEQ ID NO: 15088 - DNA, 60 bp, Artificial Sequence
  Description of Artificial Sequence: Synthetic probe
ctcctgagcagttggctgttataggaaaaattcacagattttctgagagcataagggtgg

SEQ ID NO: 15089 - DNA, 60 bp, Artificial Sequence
  Description of Artificial Sequence: Synthetic probe
ctggccaatgaggatacgttagccacgaccgttgtacgaacatacaagaggcacaagccc

SEQ ID NO: 15090 - DNA, 60 bp, Artificial Sequence
  Description of Artificial Sequence: Synthetic probe
ctgatagggtgtagcagagacctgctattccgctagtaaaaactctgctgtacatggcat

SEQ ID NO: 15091 - DNA, 60 bp, Artificial Sequence
  Description of Artificial Sequence: Synthetic probe
gagatgccatgtggacgagggcatgcccacggcacatcttaacctatgcgggggttgcat

SEQ ID NO: 15092 - DNA, 60 bp, Artificial Sequence
  Description of Artificial Sequence: Synthetic probe
ggggacacagtggtgcaagtcattgcaatggatgataaattagggcctatgccttgcaaa

SEQ ID NO: 15093 - DNA, 60 bp, Artificial Sequence
  Description of Artificial Sequence: Synthetic probe
ttcattggatggccgaacccctgagtacaggggagtcgtcaatggttcgacactccttca

SEQ ID NO: 15094 - DNA, 60 bp, Artificial Sequence
  Description of Artificial Sequence: Synthetic probe
ggccgagtccatattagtggtggtggtagctctcctgggtggtagatacgtgctctggtt

SEQ ID NO: 15095 - DNA, 60 bp, Artificial Sequence
  Description of Artificial Sequence: Synthetic probe
ttacttggccgagtccatattagtggtggtggtagctctcctgggtggtagatacgtgct

SEQ ID NO: 15096 - DNA, 60 bp, Artificial Sequence
  Description of Artificial Sequence: Synthetic probe
tggtttgacctggaggtaactgaccatcaccgggattacttggccgagtccatattagtg

SEQ ID NO: 15097 - DNA, 60 bp, Artificial Sequence
  Description of Artificial Sequence: Synthetic probe
ggagagtatcaatactggtttgacctggaggtaactgaccatcaccgggattacttggcc

SEQ ID NO: 15098 - DNA, 55 bp, Artificial Sequence
  Description of Artificial Sequence: Synthetic probe
tcatttcaagtgaggggcccgtagaaaagacggcatgtaccttcaactacacgag

SEQ ID NO: 15099 - DNA, 60 bp, Artificial Sequence
  Description of Artificial Sequence: Synthetic probe
catagctcttgacaccaaacttgggcctatgccctgcaagccatatgagatcatttcaag

SEQ ID NO: 15100 - DNA, 60 bp, Artificial Sequence
  Description of Artificial Sequence: Synthetic probe
caggggatggtaaagtgtaagataggagacacaattgtacaggtcatagctcttgacacc

SEQ ID NO: 15101 - DNA, 60 bp, Artificial Sequence
  Description of Artificial Sequence: Synthetic probe
gtaccacaggggatggtaaagtgtaagataggagacacaattgtacaggtcatagctctt

SEQ ID NO: 15102 - DNA, 60 bp, Artificial Sequence
  Description of Artificial Sequence: Synthetic probe
gacgacacctcttgcaatataggaggtgtggcgatagtaccacaggggatggtaaagtgt

SEQ ID NO: 15103 - DNA, 60 bp, Artificial Sequence
  Description of Artificial Sequence: Synthetic probe
gctacagattagtagacgacacctcttgcaatataggaggtgtggcgatagtaccacagg

SEQ ID NO: 15104 - DNA, 60 bp, Artificial Sequence
  Description of Artificial Sequence: Synthetic probe
ccccattggcaagtgtaggctgaagaatgagactggctacagattagtagacgacacctc

SEQ ID NO: 15105 - DNA, 60 bp, Artificial Sequence
  Description of Artificial Sequence: Synthetic probe
ggggttaccacactaccccattggcaagtgtaggctgaagaatgagactggctacagatt

SEQ ID NO: 15106 - DNA, 60 bp, Artificial Sequence
  Description of Artificial Sequence: Synthetic probe
taactggggaccaactacaatactcaggaggctctattgaatcctgtaagtggtgtggtt

SEQ ID NO: 15107 - DNA, 60 bp, Artificial Sequence
  Description of Artificial Sequence: Synthetic probe
ggacctgtataactggggaccaactacaatactcaggaggctctattgaatcctgtaagt

SEQ ID NO: 15108 - DNA, 60 bp, Artificial Sequence
  Description of Artificial Sequence: Synthetic probe
gtagtgcggacgtataggaggtatagaccattcccttacaggcaagactgcatcacccaa

SEQ ID NO: 15109 - DNA, 60 bp, Artificial Sequence
  Description of Artificial Sequence: Synthetic probe
ctgctaaatggaccggctttccagatggtatgccccttagggtggacagggaccgtgagc

SEQ ID NO: 15110 - DNA, 60 bp, Artificial Sequence
  Description of Artificial Sequence: Synthetic probe
actttcaatacaacactgctaaatggaccggctttccagatggtatgccccttagggtgg

SEQ ID NO: 15111 - DNA, 60 bp, Artificial Sequence
  Description of Artificial Sequence: Synthetic probe
ggactctgcccatgcgacgccaagcccgtagtaaaggggactttcaatacaacactgcta

SEQ ID NO: 15112 - DNA, 60 bp, Artificial Sequence
  Description of Artificial Sequence: Synthetic probe
acttcgaatttggactctgcccatgcgacgccaagcccgtagtaaaggggactttcaata

SEQ ID NO: 15113 - DNA, 60 bp, Artificial Sequence
  Description of Artificial Sequence: Synthetic probe
ggtaagtttacataccgctcaaggtgcacaagggaagctagatatcttgcaattttgcat

SEQ ID NO: 15114 - DNA, 60 bp, Artificial Sequence
  Description of Artificial Sequence: Synthetic probe
gacgctggaagacacaatggtcatagcctcgtgcagagaaggtaagtttacataccgctc

SEQ ID NO: 15115 - DNA, 60 bp, Artificial Sequence
  Description of Artificial Sequence: Synthetic probe
cacctgaaatgacgctggaagacacaatggtcatagcctcgtgcagagaaggtaagttta

SEQ ID NO: 15116 - DNA, 60 bp, Artificial Sequence
  Description of Artificial Sequence: Synthetic probe
ggagctgaaggccttaccactgtttggaaggaatactcacctgaaatgacgctggaagac

SEQ ID NO: 15117 - DNA, 60 bp, Artificial Sequence
  Description of Artificial Sequence: Synthetic probe
agtcggcctactaggagctgaaggccttaccactgtttggaaggaatactcacctgaaat

SEQ ID NO: 15118 - DNA, 60 bp, Artificial Sequence
  Description of Artificial Sequence: Synthetic probe
cctgaatactactatgccatagccaagaatgatagagtcggcctactaggagctgaaggc

SEQ ID NO: 15119 - DNA, 60 bp, Artificial Sequence
  Description of Artificial Sequence: Synthetic probe
cacttagactgcaaacctgaatactactatgccatagccaagaatgatagagtcggccta

SEQ ID NO: 15120 - DNA, 60 bp, Artificial Sequence
  Description of Artificial Sequence: Synthetic probe
ggtctaaccaaccgctacgaatacagcctgatagggcgctgcagaggcccactgtattgc

SEQ ID NO: 15121 - DNA, 59 bp, Artificial Sequence
  Description of Artificial Sequence: Synthetic probe
acactccattagtcgaggagtctcgagatgccatgtggacgagggcatgcccacggcac

SEQ ID NO: 15122 - DNA, 60 bp, Artificial Sequence
  Description of Artificial Sequence: Synthetic probe
caattggcaagtgcaggttaaaaaatgagactggctacaggctggtagacgacacctctt

SEQ ID NO: 15123 - DNA, 60 bp, Artificial Sequence
  Description of Artificial Sequence: Synthetic probe
caattggcaaatgcaggttgaaaaatgagactggctacaggctggtagacgacacctctt

SEQ ID NO: 15124 - DNA, 54 bp, Artificial Sequence
  Description of Artificial Sequence: Synthetic probe
tattcgtggcgttatggacacagcctgatagggtgtagcagagacctgctactc

SEQ ID NO: 15125 - DNA, 60 bp, Artificial Sequence
  Description of Artificial Sequence: Synthetic probe
gtagttcgacacaaacgtggttttgtctcgagatgctacgtggacgagggcatgcccaag

SEQ ID NO: 15126 - DNA, 60 bp, Artificial Sequence
  Description of Artificial Sequence: Synthetic probe
caaagggtactcaaatgggtccacaacaaactaaattgccctctatgggttacgagctgc

SEQ ID NO: 15127 - DNA, 60 bp, Artificial Sequence
  Description of Artificial Sequence: Synthetic probe
gatcgtcaaagggtactcaaatgggtccacaacaaactaaattgccctctatgggttacg

SEQ ID NO: 15128 - DNA, 60 bp, Artificial Sequence
  Description of Artificial Sequence: Synthetic probe
aggtcaggtaacagcaaggggcccgtgagtgggatctatctgaaaccagggccattattc

SEQ ID NO: 15129 - DNA, 60 bp, Artificial Sequence
  Description of Artificial Sequence: Synthetic probe
gcaggtcaggtaacagcaaggggcccgtgagtgggatctatctgaaaccggggccgttat

SEQ ID NO: 15130 - DNA, 60 bp, Artificial Sequence
  Description of Artificial Sequence: Synthetic probe
agtcgtcagtggttcgacgccttggaggataggcctcgagatgccacgtggacgagggca

SEQ ID NO: 15131 - DNA, 60 bp, Artificial Sequence
  Description of Artificial Sequence: Synthetic probe
ggttcgacactccaccagtcgaggagtctcgagatgccatgtggacgagggcttgcccac

SEQ ID NO: 15132 - DNA, 60 bp, Artificial Sequence
  Description of Artificial Sequence: Synthetic probe
cggtgttggggttacagcctgatagggcgctgcaggggcccacgtatgggctagtataaa

SEQ ID NO: 15133 - DNA, 60 bp, Artificial Sequence
  Description of Artificial Sequence: Synthetic probe
atggaattgttaaactttgaacttttatacaaaacatacaaacaaaaaccagccggggtc

SEQ ID NO: 15134 - DNA, 60 bp, Artificial Sequence
  Description of Artificial Sequence: Synthetic probe
gagatacatccgcagtcaacactaaaactaccacataaaagaggggagagtgaagtcccc

SEQ ID NO: 15135 - DNA, 60 bp, Artificial Sequence
  Description of Artificial Sequence: Synthetic probe
ttggcgaaagaagcgagatacatccgcagtcaacactaaaactaccacataaaagagggg

SEQ ID NO: 15136 - DNA, 60 bp, Artificial Sequence
  Description of Artificial Sequence: Synthetic probe
tacagacaagtagatgagacctcttgcaacagagacggcgtggctatagtgctaactggt

SEQ ID NO: 15137 - DNA, 60 bp, Artificial Sequence
  Description of Artificial Sequence: Synthetic probe
ctggccaataaagatacgttagccacaaccgttgtacgaacatacaagaggcataagcct

SEQ ID NO: 15138 - DNA, 60 bp, Artificial Sequence
  Description of Artificial Sequence: Synthetic probe
ggatgcatattggtgaaaagtgccacaagaaacaacccacgagtacttaggtgggtccac

SEQ ID NO: 15139 - DNA, 60 bp, Artificial Sequence
  Description of Artificial Sequence: Synthetic probe
gtatgtatagatggatgcatattggtgaaaagtgccacaagaaacaacccacgagtactt

SEQ ID NO: 15140 - DNA, 60 bp, Artificial Sequence
  Description of Artificial Sequence: Synthetic probe
gggcctctgttttaccaggactatattggacctgtctaccatagagccccattggagttc

SEQ ID NO: 15141 - DNA, 60 bp, Artificial Sequence
  Description of Artificial Sequence: Synthetic probe
acctgggcctctgttttaccaggactatattggacctgtctaccatagagccccattgga

SEQ ID NO: 15142 - DNA, 60 bp, Artificial Sequence
  Description of Artificial Sequence: Synthetic probe
aggggaaggtgaagttcccaccaacttggcatctctaccaaggaaaggcgattgcaggtc

SEQ ID NO: 15143 - DNA, 60 bp, Artificial Sequence
  Description of Artificial Sequence: Synthetic probe
actaccacacaagagaggggaaggtgaagttcccaccaacttggcatctctaccaaggaa

SEQ ID NO: 15144 - DNA, 60 bp, Artificial Sequence
  Description of Artificial Sequence: Synthetic probe
ccactggagtggaggaaccagtttacgaccgaacaggaaaccccttgtttggcgaaagag

SEQ ID NO: 15145 - DNA, 60 bp, Artificial Sequence
  Description of Artificial Sequence: Synthetic probe
acaaacaaaaacccactggagtggaggaaccagtttacgaccgaacaggaaaccccttgt

SEQ ID NO: 15146 - DNA, 60 bp, Artificial Sequence
  Description of Artificial Sequence: Synthetic probe
gtgagtggaatctatttaaaaccagggccgttattctaccaggattacaaaggacccgtc

SEQ ID NO: 15147 - DNA, 52 bp, Artificial Sequence
  Description of Artificial Sequence: Synthetic probe
acgaacacagcctgatagggcgctgcagaggcccactgtattgctactaaaa

SEQ ID NO: 15148 - DNA, 60 bp, Artificial Sequence
  Description of Artificial Sequence: Synthetic probe
caaccgttacggatacagcctgatagggcgctgcagaggcccactgttttgctactaaaa

SEQ ID NO: 15149 - DNA, 60 bp, Artificial Sequence
  Description of Artificial Sequence: Synthetic probe
caggactatgcagggcccgtatatcatagagccccactggaactatgtagagaggcgagc

SEQ ID NO: 15150 - DNA, 60 bp, Artificial Sequence
  Description of Artificial Sequence: Synthetic probe
gtagaaggggaacagctatattacacagggggtgacatagaatcctgtaagtggtgcggc

SEQ ID NO: 15151 - DNA, 60 bp, Artificial Sequence
  Description of Artificial Sequence: Synthetic probe
cactaatttggcttctttaccaaaaagaggtgactgcaggtcgggcaatagcaaaggacc

SEQ ID NO: 15152 - DNA, 60 bp, Artificial Sequence
  Description of Artificial Sequence: Synthetic probe
catctggtctggtaaaatgcaagataggggacacagtggtgcaagtcatagctctggatg

SEQ ID NO: 15153 - DNA, 60 bp, Artificial Sequence
  Description of Artificial Sequence: Synthetic probe
caccttacggtgttggggttacagcctgatagggtgctgcagaggcccacttataggcta

SEQ ID NO: 15154 - DNA, 60 bp, Artificial Sequence
  Description of Artificial Sequence: Synthetic probe
cacctcgctgtgttggggttacagcctgatagggtgctgcagaggcccacgcataagcta

SEQ ID NO: 15155 - DNA, 60 bp, Artificial Sequence
  Description of Artificial Sequence: Synthetic probe
acacctgacggtgttggggttacagcctgatagggtgctgcagaggcccacgtataggct

SEQ ID NO: 15156 - DNA, 60 bp, Artificial Sequence
  Description of Artificial Sequence: Synthetic probe
caagataggagacacgattgtacaggtcatagctcttgacactagacttggacctagtgc

SEQ ID NO: 15157 - DNA, 60 bp, Artificial Sequence
  Description of Artificial Sequence: Synthetic probe
gtgcaagataggagacacgattgtacaggtcatagctcttgacactagacttggacctag

SEQ ID NO: 15158 - DNA, 60 bp, Artificial Sequence
  Description of Artificial Sequence: Synthetic probe
cgcaacagagaaggtgtagccatagtaccacaagggcaggtaaagtgcaagataggagac

SEQ ID NO: 15159 - DNA, 60 bp, Artificial Sequence
  Description of Artificial Sequence: Synthetic probe
acttctcgcaacagagaaggtgtagccatagtaccacaagggcaggtaaagtgcaagata

SEQ ID NO: 15160 - DNA, 54 bp, Artificial Sequence
  Description of Artificial Sequence: Synthetic probe
tgagggattaccacactaccctattggcaagtgtaggttggagaatgagactgg

SEQ ID NO: 15161 - DNA, 60 bp, Artificial Sequence
  Description of Artificial Sequence: Synthetic probe
cggagggaattggacttgtgtgaccggggaccagctacaatacacaggaggttctattga

SEQ ID NO: 15162 - DNA, 60 bp, Artificial Sequence
  Description of Artificial Sequence: Synthetic probe
ctcggagggaattggacttgtgtgaccggggaccagctacaatacacaggaggttctatt

SEQ ID NO: 15163 - DNA, 60 bp, Artificial Sequence
  Description of Artificial Sequence: Synthetic probe
cagtggtacgggtgtataggaggtccagaccattcccctataggcaaggctgtatcaccc

SEQ ID NO: 15164 - DNA, 60 bp, Artificial Sequence
  Description of Artificial Sequence: Synthetic probe
gcagtggtacgggtgtataggaggtccagaccattcccctataggcaaggctgtatcacc

SEQ ID NO: 15165 - DNA, 60 bp, Artificial Sequence
  Description of Artificial Sequence: Synthetic probe
gggactgtaagctgcatgttagctaatagggataccctagatacggcagtggtacgggtg

SEQ ID NO: 15166 - DNA, 60 bp, Artificial Sequence
  Description of Artificial Sequence: Synthetic probe
ggacagggactgtaagctgcatgttagctaatagggataccctagatacggcagtggtac

SEQ ID NO: 15167 - DNA, 60 bp, Artificial Sequence
  Description of Artificial Sequence: Synthetic probe
cggaccggccttccagatggtgtgccccataggttggacagggactgtaagctgcatgtt

SEQ ID NO: 15168 - DNA, 60 bp, Artificial Sequence
  Description of Artificial Sequence: Synthetic probe
cactacactactaaacggaccggccttccagatggtgtgccccataggttggacagggac

SEQ ID NO: 15169 - DNA, 60 bp, Artificial Sequence
  Description of Artificial Sequence: Synthetic probe
tgcgatgccaaacctatagtgagagggaaatacaacactacactactaaacggaccggcc

SEQ ID NO: 15170 - DNA, 60 bp, Artificial Sequence
  Description of Artificial Sequence: Synthetic probe
ttcggactctgcccatgcgatgccaaacctatagtgagagggaaatacaacactacacta

SEQ ID NO: 15171 - DNA, 60 bp, Artificial Sequence
  Description of Artificial Sequence: Synthetic probe
caagagccctgccaaccagtgtggaattcattaaacttttcgaagggctaaggcaagagg

SEQ ID NO: 15172 - DNA, 60 bp, Artificial Sequence
  Description of Artificial Sequence: Synthetic probe
ctcgcctgtaatgatgctggaagacacaatggtcatagtttggtgcaaagatggcaagtt

SEQ ID NO: 15173 - DNA, 60 bp, Artificial Sequence
  Description of Artificial Sequence: Synthetic probe
gattactcgcctgtaatgatgctggaagacacaatggtcatagtttggtgcaaagatggc

SEQ ID NO: 15174 - DNA, 60 bp, Artificial Sequence
  Description of Artificial Sequence: Synthetic probe
gcctactaggggctgaaggtcttaccactgtctggaaggattactcgcctgtaatgatgc

SEQ ID NO: 15175 - DNA, 60 bp, Artificial Sequence
  Description of Artificial Sequence: Synthetic probe
gtgataaaatcggcctactaggggctgaaggtcttaccactgtctggaaggattactcgc

SEQ ID NO: 15176 - DNA, 59 bp, Artificial Sequence
  Description of Artificial Sequence: Synthetic probe
ggacacagcctgatagggtgctgcagaggcccactgcattgctactaaaaatctctgct

SEQ ID NO: 15177 - DNA, 54 bp, Artificial Sequence
  Description of Artificial Sequence: Synthetic probe
aaaatgagactggctacaggctggtagacgacacctcttgtaatagggatggtg

SEQ ID NO: 15178 - DNA, 54 bp, Artificial Sequence
  Description of Artificial Sequence: Synthetic probe
aaaatgagactggctacaggctggtagacgacacctcttgcaatagggatggtg

SEQ ID NO: 15179 - DNA, 60 bp, Artificial Sequence
  Description of Artificial Sequence: Synthetic probe
taatgctaggtccctgccgcggaaaggtgactgccggaaaggcaatgtgaacggagcggt

SEQ ID NO: 15180 - DNA, 60 bp, Artificial Sequence
  Description of Artificial Sequence: Synthetic probe
atacaactctgctaaacggggcggccttccaaatggtatgtcccataggatggacggggt

SEQ ID NO: 15181 - DNA, 60 bp, Artificial Sequence
  Description of Artificial Sequence: Synthetic probe
ctggctacaggttagtggatgacacttcttgcaatagggacggtgtggccatagtgccgc

SEQ ID NO: 15182 - DNA, 60 bp, Artificial Sequence
  Description of Artificial Sequence: Synthetic probe
agctagagaatgagactggctacaggctagtggatgacacttcttgcaatagggacggtg

SEQ ID NO: 15183 - DNA, 60 bp, Artificial Sequence
  Description of Artificial Sequence: Synthetic probe
tcgtcagtggttcgacgcttagtattacgagcctcgagatgccacgtggacgagggcacg

SEQ ID NO: 15184 - DNA, 60 bp, Artificial Sequence
  Description of Artificial Sequence: Synthetic probe
agtcgtcagtggttcgacgcttagtattacgagcctcgagatgccacgtggacgagggca

SEQ ID NO: 15185 - DNA, 60 bp, Artificial Sequence
  Description of Artificial Sequence: Synthetic probe
cagcgctaacatcctaactaatgctaggtccctgccgcggaaaggtgactgccggaaagg

SEQ ID NO: 15186 - DNA, 60 bp, Artificial Sequence
  Description of Artificial Sequence: Synthetic probe
atggagttgttttcaaatgaacttttatacaaaacatataaacaaaaaccagtaggcatc

SEQ ID NO: 15187 - DNA, 55 bp, Artificial Sequence
  Description of Artificial Sequence: Synthetic probe
gcccttggaggaaactggacttgtgtagtaggggatcagctacattatacagggg

SEQ ID NO: 15188 - DNA, 60 bp, Artificial Sequence
  Description of Artificial Sequence: Synthetic probe
gcccttggaggaaactggacttgtgtagtaggggatcagctacattatacagggggtgcc

SEQ ID NO: 15189 - DNA, 59 bp, Artificial Sequence
  Description of Artificial Sequence: Synthetic probe
tgcgtcctagccaacaaggacaccctaaaaatggttacagtgcggacatataagaggaa

SEQ ID NO: 15190 - DNA, 50 bp, Artificial Sequence
  Description of Artificial Sequence: Synthetic probe
ggacacagcctgatagggtgtagcagagacctgctattccgctagtaaaa

SEQ ID NO: 15191 - DNA, 50 bp, Artificial Sequence
  Description of Artificial Sequence: Synthetic probe
ctagcattttgaggggggtagcaacagtggtgagttcgttggatggctga

SEQ ID NO: 15192 - DNA, 60 bp, Artificial Sequence
  Description of Artificial Sequence: Synthetic probe
tcgtcagtggttcgacacgatcatggtatcgcctcgagatgccacgtggacgagggcatg

SEQ ID NO: 15193 - DNA, 60 bp, Artificial Sequence
  Description of Artificial Sequence: Synthetic probe
agtacaggacagtcgtcagtggttcgacacgatcatggtatcgcctcgagatgccacgtg

SEQ ID NO: 15194 - DNA, 60 bp, Artificial Sequence
  Description of Artificial Sequence: Synthetic probe
ttctcatatgccatagcaaaggatgaaaagattggcccattaggtgctgaaagccttacc

SEQ ID NO: 15195 - DNA, 60 bp, Artificial Sequence
  Description of Artificial Sequence: Synthetic probe
gcagacctgatttctcatatgccatagcaaaggatgaaaagattggcccattgggtgctg

SEQ ID NO: 15196 - DNA, 60 bp, Artificial Sequence
  Description of Artificial Sequence: Synthetic probe
tacccggagtgcagacctgatttctcatatgccatagcaaaggatgaaaagattggccca

SEQ ID NO: 15197 - DNA, 60 bp, Artificial Sequence
  Description of Artificial Sequence: Synthetic probe
caggataggagacacagtggtacaagtcattgcaatggatgataaattaggacctatgcc

SEQ ID NO: 15198 - DNA, 60 bp, Artificial Sequence
  Description of Artificial Sequence: Synthetic probe
gtgcaggataggagacacagtggtacaagtcattgcaatggatgataaattaggacctat

SEQ ID NO: 15199 - DNA, 60 bp, Artificial Sequence
  Description of Artificial Sequence: Synthetic probe
tgaagaatgagagtggctatagacaagtggatgacacttcttgcaacagagacggcgtgg

SEQ ID NO: 15200 - DNA, 60 bp, Artificial Sequence
  Description of Artificial Sequence: Synthetic probe
ttggcaaatgtaagctgaagaatgagagtggctatagacaagtggatgacacttcttgca

SEQ ID NO: 15201 - DNA, 60 bp, Artificial Sequence
  Description of Artificial Sequence: Synthetic probe
gtggtgtggttacaaattttttaaaagtgagggtctgccacatttcccaattggcaaatg

SEQ ID NO: 15202 - DNA, 59 bp, Artificial Sequence
  Description of Artificial Sequence: Synthetic probe
ccatcggggaagacctctacaactgtgccttaggagggaattggacttgtgtgccgggg

SEQ ID NO: 15203 - DNA, 60 bp, Artificial Sequence
  Description of Artificial Sequence: Synthetic probe
gggataggccttttccatataggcaaggatgtgtcacccagaaaaccatcggggaagacc

SEQ ID NO: 15204 - DNA, 60 bp, Artificial Sequence
  Description of Artificial Sequence: Synthetic probe
caagagggataggccttttccatataggcaaggatgtgtcacccagaaaaccatcgggga

SEQ ID NO: 15205 - DNA, 51 bp, Artificial Sequence
  Description of Artificial Sequence: Synthetic probe
ttagccacaaccgttgtgcgaacgtacaagagggataggccttttccatat

SEQ ID NO: 15206 - DNA, 60 bp, Artificial Sequence
  Description of Artificial Sequence: Synthetic probe
caaagggtactcaggtgggtccacaataggcttgactgccctctatgggttacaagctgc

SEQ ID NO: 15207 - DNA, 60 bp, Artificial Sequence
  Description of Artificial Sequence: Synthetic probe
acaagaagtcaccaaagggtactcaggtgggtccacaataggcttgactgccctctatgg

SEQ ID NO: 15208 - DNA, 60 bp, Artificial Sequence
  Description of Artificial Sequence: Synthetic probe
gtgtgtatagaaggctgtataatagtgaggagtgccacaagaagtcaccaaagggtactc

SEQ ID NO: 15209 - DNA, 60 bp, Artificial Sequence
  Description of Artificial Sequence: Synthetic probe
tgtaccacatttatgtgtgtatagaaggctgtataatagtgaggagtgccacaagaagtc

SEQ ID NO: 15210 - DNA, 59 bp, Artificial Sequence
  Description of Artificial Sequence: Synthetic probe
ctagagctgtttgaggagggatatatgtgtgaaacaaccaaacggatagggagagtaac

SEQ ID NO: 15211 - DNA, 52 bp, Artificial Sequence
  Description of Artificial Sequence: Synthetic probe
aaaagaggtgactgcaggtcgggtaatagtaaaggacctgtgagtggaatct

SEQ ID NO: 15212 - DNA, 60 bp, Artificial Sequence
  Description of Artificial Sequence: Synthetic probe
aaccaaaagaatcgggagagtaactggtagtgacagtaaattatatcacatttacgtgtg

SEQ ID NO: 15213 - DNA, 60 bp, Artificial Sequence
  Description of Artificial Sequence: Synthetic probe
gaggaagcatcaatgtgtgagataactaaaagaatcgggagagtaactggtagtgacagc

SEQ ID NO: 15214 - DNA, 60 bp, Artificial Sequence
  Description of Artificial Sequence: Synthetic probe
ggtgcggttacaaattcctaaagggtgaggggctaccacattacccaattggcaagtgta

SEQ ID NO: 15215 - DNA, 60 bp, Artificial Sequence
  Description of Artificial Sequence: Synthetic probe
agaggggagcgtgaagtcccaaccaatttggcttctttaccaaaaagaggtgactgcagg

SEQ ID NO: 15216 - DNA, 60 bp, Artificial Sequence
  Description of Artificial Sequence: Synthetic probe
aaaagaggggagagtgaagtccccacaaatttggcttctttaccaaaaagaggtgactgc

SEQ ID NO: 15217 - DNA, 60 bp, Artificial Sequence
  Description of Artificial Sequence: Synthetic probe
tacgtccagaagtttattgattctcttatagaaaataaagaaaccataatcagatatggt

SEQ ID NO: 15218 - DNA, 60 bp, Artificial Sequence
  Description of Artificial Sequence: Synthetic probe
acagaggtacgggatcgaagatgggatcaacgtaacaaagtcctttagggagatgaatta

SEQ ID NO: 15219 - DNA, 60 bp, Artificial Sequence
  Description of Artificial Sequence: Synthetic probe
gggtgacgctgccggacttagatacagttgttgacacaggtctgaaatgtgagaagaggg

SEQ ID NO: 15220 - DNA, 60 bp, Artificial Sequence
  Description of Artificial Sequence: Synthetic probe
tcaggggtgacgctgccggacttagatacagttgttgacacaggtctgaaatgtgagaag

SEQ ID NO: 15221 - DNA, 60 bp, Artificial Sequence
  Description of Artificial Sequence: Synthetic probe
ccctgtagaggagatgaagggcaacatgttggtctttgtgcccacgaggaacatggcggt

SEQ ID NO: 15222 - DNA, 60 bp, Artificial Sequence
  Description of Artificial Sequence: Synthetic probe
ccctgtagaggagatgaagggcaacatgttggttttcgtgcccacgaggaacatggcagt

SEQ ID NO: 15223 - DNA, 60 bp, Artificial Sequence
  Description of Artificial Sequence: Synthetic probe
ggggctgaagatccctgtagaggagatgaagggcaacatgttggttttcgtgcccacgag

SEQ ID NO: 15224 - DNA, 60 bp, Artificial Sequence
  Description of Artificial Sequence: Synthetic probe
ctcagtagaccatgtgaccgctggcaaggatctgttggtttgtgatagcatgggcaggac

SEQ ID NO: 15225 - DNA, 60 bp, Artificial Sequence
  Description of Artificial Sequence: Synthetic probe
gggcttacacgcatcaaggtggcataagctcagtagaccatgtgaccgctggcaaggatc

SEQ ID NO: 15226 - DNA, 60 bp, Artificial Sequence
  Description of Artificial Sequence: Synthetic probe
ccggttgggcttacacacatcaaggtggcataagctcagtagaccatgtgaccgctggca

SEQ ID NO: 15227 - DNA, 60 bp, Artificial Sequence
  Description of Artificial Sequence: Synthetic probe
cacgaggtacaagcctttcccctataggcaaggctgcatcacccagaaaaccattgggga

SEQ ID NO: 15228 - DNA, 59 bp, Artificial Sequence
  Description of Artificial Sequence: Synthetic probe
agggtgtagcagagaccttctatcccctagtaaaaactctgctgtacattgcacatgga

SEQ ID NO: 15229 - DNA, 60 bp, Artificial Sequence
  Description of Artificial Sequence: Synthetic probe
cctgataggtgttgggagtacagcctgatagggtgctgcagaggcccatgcataggccag

SEQ ID NO: 15230 - DNA, 60 bp, Artificial Sequence
  Description of Artificial Sequence: Synthetic probe
aaagcacctgataggtgttgggagtacagcctgatagggtgctgcagaggcccatgcata

SEQ ID NO: 15231 - DNA, 60 bp, Artificial Sequence
  Description of Artificial Sequence: Synthetic probe
agggcatgcccaagacactttctctagcctgggcgggggtcgcccaggtgaaagcacctg

SEQ ID NO: 15232 - DNA, 60 bp, Artificial Sequence
  Description of Artificial Sequence: Synthetic probe
tcgggaggagcaaacttcctgtcaagactcatagcagccatcctagaattgaactgggcc

SEQ ID NO: 15233 - DNA, 60 bp, Artificial Sequence
  Description of Artificial Sequence: Synthetic probe
ggaatctatctaaaaccagggccgttattctaccaggattacaaaggacccgtctatcat

SEQ ID NO: 15234 - DNA, 60 bp, Artificial Sequence
  Description of Artificial Sequence: Synthetic probe
gacactccatcagttgaggagtctcgagatgccatgtggacgagggcatgcccaaggcac

SEQ ID NO: 15235 - DNA, 60 bp, Artificial Sequence
  Description of Artificial Sequence: Synthetic probe
ggttcgacactccatcagttgaggagtctcgagatgccatgtggacgagggcatgcccaa

SEQ ID NO: 15236 - DNA, 60 bp, Artificial Sequence
  Description of Artificial Sequence: Synthetic probe
ggttcgacactccatcagttgaggagtctcgagatgccatgtggacgagggcatgcccac

SEQ ID NO: 15237 - DNA, 60 bp, Artificial Sequence
  Description of Artificial Sequence: Synthetic probe
ccctataggcagggctgtattacccagaaaaccattggggaagacctctacgactgtgcc

SEQ ID NO: 15238 - DNA, 60 bp, Artificial Sequence
  Description of Artificial Sequence: Synthetic probe
tgaccaactgttacggatacagcctgatagggtgctgcagaggcccactgcattgctact

SEQ ID NO: 15239 - DNA, 60 bp, Artificial Sequence
  Description of Artificial Sequence: Synthetic probe
gccactgaagatgaagatctggcagtggacctcctaggtttagactggcctgaccctggg

SEQ ID NO: 15240 - DNA, 60 bp, Artificial Sequence
  Description of Artificial Sequence: Synthetic probe
gggaggacgtgcccgtgtacatatatgccactgaagatgaagatctggcagtggacctcc

SEQ ID NO: 15241 - DNA, 60 bp, Artificial Sequence
  Description of Artificial Sequence: Synthetic probe
cgtagaggcagagtaggtagggtaaagccagggagatattatagaagccaggaaactgcg

SEQ ID NO: 15242 - DNA, 60 bp, Artificial Sequence
  Description of Artificial Sequence: Synthetic probe
gacaggcctcaaaagaatggctgttaccgtgggtgagcaggcccaacgtagaggcagagt

SEQ ID NO: 15243 - DNA, 60 bp, Artificial Sequence
  Description of Artificial Sequence: Synthetic probe
tcgtgacaggcctcaaaagaatggctgttaccgtgggcgagcaggcccagcgtagaggca

SEQ ID NO: 15244 - DNA, 60 bp, Artificial Sequence
  Description of Artificial Sequence: Synthetic probe
cactaccggacttagatacagttgtggacaccggacttaaatgtgagaagagggtgaggg

SEQ ID NO: 15245 - DNA, 60 bp, Artificial Sequence
  Description of Artificial Sequence: Synthetic probe
tcaggagtgacactaccggacttagacacagttgtggacaccggacttaaatgtgagaag

SEQ ID NO: 15246 - DNA, 60 bp, Artificial Sequence
  Description of Artificial Sequence: Synthetic probe
gggctacaactcaggatattactacagtggagaggacccagccaatttgagggtggtaac

SEQ ID NO: 15247 - DNA, 60 bp, Artificial Sequence
  Description of Artificial Sequence: Synthetic probe
taagggctacaactcaggatattactacagtggagaggacccagccaatttgagggtggt

SEQ ID NO: 15248 - DNA, 53 bp, Artificial Sequence
  Description of Artificial Sequence: Synthetic probe
ccccgaagtgatgaaaggggaagaccttggtagtcagtttcttgatatagcag

SEQ ID NO: 15249 - DNA, 60 bp, Artificial Sequence
  Description of Artificial Sequence: Synthetic probe
atcactgtgccaccccagaacaattagcaataattggaaaaatccacagattctcagaaa

SEQ ID NO: 15250 - DNA, 53 bp, Artificial Sequence
  Description of Artificial Sequence: Synthetic probe
ttttgccagatgcctcaaccaaaacttagagcggcaatggtggagtactcata

SEQ ID NO: 15251 - DNA, 60 bp, Artificial Sequence
  Description of Artificial Sequence: Synthetic probe
tatgggtatttttgccagatgcctcaaccaaaacttagagcggcaatggtggagtactca

SEQ ID NO: 15252 - DNA, 60 bp, Artificial Sequence
  Description of Artificial Sequence: Synthetic probe
ggagacatgaaagagggtgatatggcaaccgggataacctacgcatcatatgggtatttt

SEQ ID NO: 15253 - DNA, 60 bp, Artificial Sequence
  Description of Artificial Sequence: Synthetic probe
caaaccaacaaagataatgagtggcatccagacagtttcaaagagtaatgctgacctaac

SEQ ID NO: 15254 - DNA, 60 bp, Artificial Sequence
  Description of Artificial Sequence: Synthetic probe
aggtaggaaagaatgaagaggccaaaccaacaaagataatgagtggcatccagacagtct

SEQ ID NO: 15255 - DNA, 60 bp, Artificial Sequence
  Description of Artificial Sequence: Synthetic probe
tcgagcggaagggtagtaggcagagttaaggtaggaaagaatgaggaggccaaaccaaca

SEQ ID NO: 15256 - DNA, 55 bp, Artificial Sequence
  Description of Artificial Sequence: Synthetic probe
ttattgaaggtgaggaggggtctggagaccggttgggcctacacacaccaagggg

SEQ ID NO: 15257 - DNA, 60 bp, Artificial Sequence
  Description of Artificial Sequence: Synthetic probe
agcattattgaaggtgaggaggggtctggagaccggttgggcctacacacaccaaggagg

SEQ ID NO: 15258 - DNA, 52 bp, Artificial Sequence
  Description of Artificial Sequence: Synthetic probe
actgagcatgagaagtgccatgtcagcatattggataaactgaccgcctttt

SEQ ID NO: 15259 - DNA, 60 bp, Artificial Sequence
  Description of Artificial Sequence: Synthetic probe
cctcgggtggattctgagggggcccgctgtatgcaaaaagatcactgagcatgagaagtg

SEQ ID NO: 15260 - DNA, 60 bp, Artificial Sequence
  Description of Artificial Sequence: Synthetic probe
tggaacacctcgggtggatcctgagggggcccgctgtatgcaaaaagatcactgagcatg

SEQ ID NO: 15261 - DNA, 60 bp, Artificial Sequence
  Description of Artificial Sequence: Synthetic probe
tacgccgctagaggacagctgtttctgagaaatctgccaatactggcaaccaaagtaaaa

SEQ ID NO: 15262 - DNA, 60 bp, Artificial Sequence
  Description of Artificial Sequence: Synthetic probe
ctccgtctacgacgtggatgagagtggagaaggtgtatatctctttccatctaggcagaa

SEQ ID NO: 15263 - DNA, 60 bp, Artificial Sequence
  Description of Artificial Sequence: Synthetic probe
gagggttaactctgtttatgacgtggatgagagtggagaaggtgtatatctcttcccatc

SEQ ID NO: 15264 - DNA, 60 bp, Artificial Sequence
  Description of Artificial Sequence: Synthetic probe
tcacaagagggttaactccgtctacgacgtggatgagagtggagaaggtgtatatctctt

SEQ ID NO: 15265 - DNA, 60 bp, Artificial Sequence
  Description of Artificial Sequence: Synthetic probe
ggtgagatagaaacaccagaattagtgatcccgagctggaggccgctgtcactcatactg

SEQ ID NO: 15266 - DNA, 60 bp, Artificial Sequence
  Description of Artificial Sequence: Synthetic probe
cctgggtgagattgaaacaccagaattagtgatcccgagctggaggccgctgtcactcat

SEQ ID NO: 15267 - DNA, 55 bp, Artificial Sequence
  Description of Artificial Sequence: Synthetic probe
tcaggtacaagaagtggctacaatgcatccttagcttggcagcaggagtgttctt

SEQ ID NO: 15268 - DNA, 60 bp, Artificial Sequence
  Description of Artificial Sequence: Synthetic probe
cgtagctaaacgtgacccaactgtggtgccattggtaacgatagtggcatcactgagagt

SEQ ID NO: 15269 - DNA, 60 bp, Artificial Sequence
  Description of Artificial Sequence: Synthetic probe
ggcacaagccttttccctataggcaaggctgtattacccagaaaaccatcggggaggacc

SEQ ID NO: 15270 - DNA, 60 bp, Artificial Sequence
  Description of Artificial Sequence: Synthetic probe
tgatggtaaattgtaccacatttatgtgtgcatagatggatgcataatagttaagagcgc

SEQ ID NO: 15271 - DNA, 60 bp, Artificial Sequence
  Description of Artificial Sequence: Synthetic probe
ctagtggatgagacttcttgcaacagagacggcgtggctatagtgccatctggcctggtc

SEQ ID NO: 15272 - DNA, 60 bp, Artificial Sequence
  Description of Artificial Sequence: Synthetic probe
gagagtggctatagactagtggatgagacttcttgcaacagagacggcgtggctatagtg

SEQ ID NO: 15273 - DNA, 60 bp, Artificial Sequence
  Description of Artificial Sequence: Synthetic probe
ggtcaaacagactactacgaatacagcctgatagggtgctgcagaggcccactgcaatgc

SEQ ID NO: 15274 - DNA, 54 bp, Artificial Sequence
  Description of Artificial Sequence: Synthetic probe
aaaaggaggggactagcggtacagtgagttcattggatggcctaatccctgagt

SEQ ID NO: 15275 - DNA, 60 bp, Artificial Sequence
  Description of Artificial Sequence: Synthetic probe
atagcaaattataccacatttatgtgtgtattgatggatgtataatagttaagagtgcta

SEQ ID NO: 15276 - DNA, 60 bp, Artificial Sequence
  Description of Artificial Sequence: Synthetic probe
ggttcgacgccttggtataaaggtctcgagatgccacgtggacgagggcatgcccaaagc

SEQ ID NO: 15277 - DNA, 60 bp, Artificial Sequence
  Description of Artificial Sequence: Synthetic probe
gaaacggtgtggctatagtgccaactggtcaggtgaaatgcaagataggggacacagtgg

SEQ ID NO: 15278 - DNA, 60 bp, Artificial Sequence
  Description of Artificial Sequence: Synthetic probe
gaaagtggctacagacaagtagatgagaccccttgcaacagaaacggtgtggctatagtg

SEQ ID NO: 15279 - DNA, 60 bp, Artificial Sequence
  Description of Artificial Sequence: Synthetic probe
tgtgcactggctaataaggatacattagccatgaccattgtacgaacatacaagaggcaa

SEQ ID NO: 15280 - DNA, 60 bp, Artificial Sequence
  Description of Artificial Sequence: Synthetic probe
ccaggactacgcggggccagtctatcatagagccccactggaactatgtagagaggcaag

SEQ ID NO: 15281 - DNA, 60 bp, Artificial Sequence
  Description of Artificial Sequence: Synthetic probe
aaaattataccacatctatgtctgcatagatgggtgtgtcctcctaaagagggcgagtag

SEQ ID NO: 15282 - DNA, 60 bp, Artificial Sequence
  Description of Artificial Sequence: Synthetic probe
tgcacactggccaataaggatacgttagccacaaccgttgtacgaacatacaagaggcac

SEQ ID NO: 15283 - DNA, 60 bp, Artificial Sequence
  Description of Artificial Sequence: Synthetic probe
acgaatacagcctgatagggtgctgcagaggcccactgtattgctactaaaaatctctgc

SEQ ID NO: 15284 - DNA, 60 bp, Artificial Sequence
  Description of Artificial Sequence: Synthetic probe
cgagccatgttccaaagaggtgtgaatagaagtctacatgggatctggccagagaaaatc

SEQ ID NO: 15285 - DNA, 60 bp, Artificial Sequence
  Description of Artificial Sequence: Synthetic probe
ggaattcaacgagccatgttccaaagaggtgtgaatagaagtctacatgggatctggcca

SEQ ID NO: 15286 - DNA, 60 bp, Artificial Sequence
  Description of Artificial Sequence: Synthetic probe
atgcccacaggggtggactggtacaatagaatgcatcctggcaaaccaagacaccttgga

SEQ ID NO: 15287 - DNA, 60 bp, Artificial Sequence
  Description of Artificial Sequence: Synthetic probe
atagggaacacagtggtgcaagtaatagcaatggatgataggcttgggcctatgccttgc

SEQ ID NO: 15288 - DNA, 60 bp, Artificial Sequence
  Description of Artificial Sequence: Synthetic probe
caagaggcacaagccctttccctataggcagggctgtattacccagaaaaccatcgggga

SEQ ID NO: 15289 - DNA, 60 bp, Artificial Sequence
  Description of Artificial Sequence: Synthetic probe
gacgctctggcaatggaagagcctcgagatgccatgtggacgagggcatgcccacggcac

SEQ ID NO: 15290 - DNA, 60 bp, Artificial Sequence
  Description of Artificial Sequence: Synthetic probe
gacgctctggcaatgaaagagcctcgatatgccatgtggacgagggcatgcccacggcac

SEQ ID NO: 15291 - DNA, 60 bp, Artificial Sequence
  Description of Artificial Sequence: Synthetic probe
tagaagtctacatgggatctggccagagaaaatctgtacaggtgttccatcccacctggc

SEQ ID NO: 15292 - DNA, 60 bp, Artificial Sequence
  Description of Artificial Sequence: Synthetic probe
tagaagcctacatgggatctggccagagaaaatctgtacaggtgttccatcccacctggc

SEQ ID NO: 15293 - DNA, 60 bp, Artificial Sequence
  Description of Artificial Sequence: Synthetic probe
gtgtgaatagaagtctacatgggatctggccagagaaaatctgtacaggtgttccttccc

SEQ ID NO: 15294 - DNA, 60 bp, Artificial Sequence
  Description of Artificial Sequence: Synthetic probe
ggtgtgaatagaagtctacatgggatctggccagagaaaatctgtacaggtgttccttcc

SEQ ID NO: 15295 - DNA, 60 bp, Artificial Sequence
  Description of Artificial Sequence: Synthetic probe
tcaaagaggtgtgaatagaagcctacatgggatctggccagagaaaatctgtacaggtgt

SEQ ID NO: 15296 - DNA, 60 bp, Artificial Sequence
  Description of Artificial Sequence: Synthetic probe
ccattggggaagacctctacgactgtgccttaggagggaactggacttgtgtgccggggg

SEQ ID NO: 15297 - DNA, 60 bp, Artificial Sequence
  Description of Artificial Sequence: Synthetic probe
cagagccccttatcacatcccatttggttcacggatgccaggcaccagtgggcggcagag

SEQ ID NO: 15298 - DNA, 60 bp, Artificial Sequence
  Description of Artificial Sequence: Synthetic probe
gagagtcccttgtcacatctcatttggttcacggatgccaggcaccagtgggcggcagag

SEQ ID NO: 15299 - DNA, 60 bp, Artificial Sequence
  Description of Artificial Sequence: Synthetic probe
tatgcttggaggaaactggacttgtatagcaggggaacagctacattacacagggggtgc

SEQ ID NO: 15300 - DNA, 60 bp, Artificial Sequence
  Description of Artificial Sequence: Synthetic probe
caaaaggcacaagccttttccctataggcagggctgtatcacccagaaaaccatcgggga

SEQ ID NO: 15301 - DNA, 60 bp, Artificial Sequence
  Description of Artificial Sequence: Synthetic probe
gattaaaatgcaggattggagacacagtggtgcaggtcatagcaatggacacaaaacttg

SEQ ID NO: 15302 - DNA, 60 bp, Artificial Sequence
  Description of Artificial Sequence: Synthetic probe
cacggaactataaagtgcaggattggagacacagtggtgcaggtcatagcaatggacaca

SEQ ID NO: 15303 - DNA, 60 bp, Artificial Sequence
  Description of Artificial Sequence: Synthetic probe
gggaagatctctatgactgtgcccttggaggaaactggacttgtataacaggggaacagc

SEQ ID NO: 15304 - DNA, 60 bp, Artificial Sequence
  Description of Artificial Sequence: Synthetic probe
tgctgggggaagatctctatgactgtgcccttggaggaaactggacttgtataacagggg

SEQ ID NO: 15305 - DNA, 60 bp, Artificial Sequence
  Description of Artificial Sequence: Synthetic probe
gcactgcatagtttgcacaatctgtgaagggaaagattggaatggagccaactgcccaaa

SEQ ID NO: 15306 - DNA, 60 bp, Artificial Sequence
  Description of Artificial Sequence: Synthetic probe
gtgcactgcatagtttgcacaatctgtgaagggaaagattggaatggagccaactgccca

SEQ ID NO: 15307 - DNA, 60 bp, Artificial Sequence
  Description of Artificial Sequence: Synthetic probe
cataaaggtctcgagatgccacgtggacgagggcatgcccaaagcacatcttaacctggg

SEQ ID NO: 15308 - DNA, 60 bp, Artificial Sequence
  Description of Artificial Sequence: Synthetic probe
ggagacacagtggtgcaggtcatagcgatggacacaaaacttgggcctatgccatgcaaa

SEQ ID NO: 15309 - DNA, 60 bp, Artificial Sequence
  Description of Artificial Sequence: Synthetic probe
ggagacacagtggtgcaggtcttggcaatggacacaaaacttgggcctatgccatgcaaa

SEQ ID NO: 15310 - DNA, 60 bp, Artificial Sequence
  Description of Artificial Sequence: Synthetic probe
ggtggtagatacgtgctatggttgctggtcacgtatatggttttatcagaacaaatggcc

SEQ ID NO: 15311 - DNA, 60 bp, Artificial Sequence
  Description of Artificial Sequence: Synthetic probe
ccttgcagaccacatgagatcatatcaagtgagggacctgtggaaaagacggcgtgcacc

SEQ ID NO: 15312 - DNA, 60 bp, Artificial Sequence
  Description of Artificial Sequence: Synthetic probe
actttgcccatgtgatgccagacccgtagtgagggggaagttcaatacaacactgctaaa

SEQ ID NO: 15313 - DNA, 60 bp, Artificial Sequence
  Description of Artificial Sequence: Synthetic probe
attcggactttgcccatgtgatgccagacccgtagtgagagggaaattcaatacaactct

SEQ ID NO: 15314 - DNA, 60 bp, Artificial Sequence
  Description of Artificial Sequence: Synthetic probe
tggcttagtctcgagatgctacgtggacgagggcatgcccatgacacgctttagccccag

SEQ ID NO: 15315 - DNA, 56 bp, Artificial Sequence
  Description of Artificial Sequence: Synthetic probe
caggaaacagcaaccgggtctaaagactaccactatgacctgttacaggcacagag

SEQ ID NO: 15316 - DNA, 60 bp, Artificial Sequence
  Description of Artificial Sequence: Synthetic probe
gtgtgaagtgtagaattggagacacagtggtgcaggtcatagcaatggacacaaaactcg

SEQ ID NO: 15317 - DNA, 60 bp, Artificial Sequence
  Description of Artificial Sequence: Synthetic probe
ggatctatttaaaaccagggccgttattctaccaggattacaaaggacccgtctatcata

SEQ ID NO: 15318 - DNA, 60 bp, Artificial Sequence
  Description of Artificial Sequence: Synthetic probe
tcgtcagtggttcgacgccttggaggacaggcctcgagatgccacgtggacgagggcatg

SEQ ID NO: 15319 - DNA, 60 bp, Artificial Sequence
  Description of Artificial Sequence: Synthetic probe
gatggtgtagcgatagtgccacatggaactgtgaagtgtagaattggagacacagtggtg

SEQ ID NO: 15320 - DNA, 60 bp, Artificial Sequence
  Description of Artificial Sequence: Synthetic probe
gatggtgtagcaatagtgcaatatggaactgtgaagtgtagaattggagacacagtggtg

SEQ ID NO: 15321 - DNA, 60 bp, Artificial Sequence
  Description of Artificial Sequence: Synthetic probe
caagaggcataagccttttccctataggcagggctgtattacccaaaaaaccatcgggga

SEQ ID NO: 15322 - DNA, 60 bp, Artificial Sequence
  Description of Artificial Sequence: Synthetic probe
taatgaacttttatacaaaacatacaaacaaaaaccagctggtgtggttgaacccgttta

SEQ ID NO: 15323 - DNA, 60 bp, Artificial Sequence
  Description of Artificial Sequence: Synthetic probe
gtgcgagtcgcacgtctcgagatgctatgtggacgagggcatgcccaagacactttctcc

SEQ ID NO: 15324 - DNA, 60 bp, Artificial Sequence
  Description of Artificial Sequence: Synthetic probe
caatagttcgacacgtgcgagtcgcacgtctcgagatgctatgtggacgagggcatgccc

SEQ ID NO: 15325 - DNA, 60 bp, Artificial Sequence
  Description of Artificial Sequence: Synthetic probe
gatgaggatctggcagtggaccttctaggcttggactggccagacccagggaatcagcaa

SEQ ID NO: 15326 - DNA, 60 bp, Artificial Sequence
  Description of Artificial Sequence: Synthetic probe
gcaaccgaagatgaagatctggcagtggaccttctaggcttggactggccagacccaggg

SEQ ID NO: 15327 - DNA, 60 bp, Artificial Sequence
  Description of Artificial Sequence: Synthetic probe
gtgtacatttatgcaaccgaagatgaagatctggcagtggaccttctaggcttggactgg

SEQ ID NO: 15328 - DNA, 60 bp, Artificial Sequence
  Description of Artificial Sequence: Synthetic probe
gccaaatgcctcaaccaaagctcagggcagcaatggtagagtattcatatatattcctgg

SEQ ID NO: 15329 - DNA, 60 bp, Artificial Sequence
  Description of Artificial Sequence: Synthetic probe
ttctgccaaatgcctcaaccaaagctcagggcagcaatggtagagtattcatatatattc

SEQ ID NO: 15330 - DNA, 60 bp, Artificial Sequence
  Description of Artificial Sequence: Synthetic probe
tactccagatgcccctcctgctgaccttcaggaccaatccgacgggccttttagggagga

SEQ ID NO: 15331 - DNA, 60 bp, Artificial Sequence
  Description of Artificial Sequence: Synthetic probe
ggcggcagagagctactccagatgcccctcctgctgaccttcaggaccaatccgacgggc

SEQ ID NO: 15332 - DNA, 60 bp, Artificial Sequence
  Description of Artificial Sequence: Synthetic probe
ggctggatgccagcgtgtgggaatctccccagatacccagagagtcccttgtcacatctc

SEQ ID NO: 15333 - DNA, 60 bp, Artificial Sequence
  Description of Artificial Sequence: Synthetic probe
atcacagagtgggctggatgccagcgtgtgggaatctccccagatacccagagagtccct

SEQ ID NO: 15334 - DNA, 60 bp, Artificial Sequence
  Description of Artificial Sequence: Synthetic probe
aaacaccttatggtgttggggttacagcctgatagggtgctgcagaggcccacgataggc

SEQ ID NO: 15335 - DNA, 60 bp, Artificial Sequence
  Description of Artificial Sequence: Synthetic probe
ggggtcgctcaggtgaaagcagttctaaactgctacgaatacagcctgatagggtgctgc

SEQ ID NO: 15336 - DNA, 60 bp, Artificial Sequence
  Description of Artificial Sequence: Synthetic probe
gatatctaaaagaatcgggagagtaactggtagtgatggcaaattatatcacatttatgt

SEQ ID NO: 15337 - DNA, 60 bp, Artificial Sequence
  Description of Artificial Sequence: Synthetic probe
ggaggcgtctatgtgtgagatatctaaaagaatcgggagagtaactggtagtgatagcaa

SEQ ID NO: 15338 - DNA, 60 bp, Artificial Sequence
  Description of Artificial Sequence: Synthetic probe
ggggaaacagtggtgcaagtcacagcaatggatgataaattagggcctatgccttgcaag

SEQ ID NO: 15339 - DNA, 60 bp, Artificial Sequence
  Description of Artificial Sequence: Synthetic probe
acttcttgcaacagagacggcgtggctatagtgccatctggcctggtcaggtgcaggata

SEQ ID NO: 15340 - DNA, 60 bp, Artificial Sequence
  Description of Artificial Sequence: Synthetic probe
atgcccatagtaggactagcaaaagtaggggactagcggtagcagtgagttcattggatg

SEQ ID NO: 15341 - DNA, 60 bp, Artificial Sequence
  Description of Artificial Sequence: Synthetic probe
atgaaagcggctatagattagtagatgagacctcttgcaacagagacggtgtggctatag

SEQ ID NO: 15342 - DNA, 60 bp, Artificial Sequence
  Description of Artificial Sequence: Synthetic probe
taagagggttagcccattccctaataggcaaggttgtgtcactcaaaaacttatagggga

SEQ ID NO: 15343 - DNA, 60 bp, Artificial Sequence
  Description of Artificial Sequence: Synthetic probe
taagagggttagcccattccctaataggcaaggttgtgtcactcaaaaacttataggtga

SEQ ID NO: 15344 - DNA, 60 bp, Artificial Sequence
  Description of Artificial Sequence: Synthetic probe
ccccactaatttggcttctttaccaaaaagaggtgactgcaggtcgggtaatagcaaagg

SEQ ID NO: 15345 - DNA, 60 bp, Artificial Sequence
  Description of Artificial Sequence: Synthetic probe
ccattggggaagacctctacgactgtgccttgggggggaactggacttgtgtgccggggg

SEQ ID NO: 15346 - DNA, 60 bp, Artificial Sequence
  Description of Artificial Sequence: Synthetic probe
ccattggggaagacctctacgactgtgccttgggagggaattggacttgtgtgcctgggg

SEQ ID NO: 15347 - DNA, 59 bp, Artificial Sequence
  Description of Artificial Sequence: Synthetic probe
ccattggggaagacctctacgactgtgccttgggagggaattggacttgtgtgccgggg

SEQ ID NO: 15348 - DNA, 60 bp, Artificial Sequence
  Description of Artificial Sequence: Synthetic probe
ccattggggaagacctctacgactgtgccttgggagggaattggacttgtgtgccagggg

SEQ ID NO: 15349 - DNA, 60 bp, Artificial Sequence
  Description of Artificial Sequence: Synthetic probe
tagaagtctacatgggatctggccagagaaaatctgtacaggagtgccatcccacctggc

SEQ ID NO: 15350 - DNA, 60 bp, Artificial Sequence
  Description of Artificial Sequence: Synthetic probe
gaatacagcctgatagggtgctgcagaggcccactgtattgctactgaaaatctctgctg

SEQ ID NO: 15351 - DNA, 59 bp, Artificial Sequence
  Description of Artificial Sequence: Synthetic probe
gaatacagcctgatagggtgctgcagaggcccactgtattgccactaaaaatctctgct

SEQ ID NO: 15352 - DNA, 60 bp, Artificial Sequence
  Description of Artificial Sequence: Synthetic probe
ggagatacagtggtgcaggtcatagcaatggacacaaaacttgggcctatgccttgcaaa

SEQ ID NO: 15353 - DNA, 56 bp, Artificial Sequence
  Description of Artificial Sequence: Synthetic probe
gacgagggcacgcccacagcacatcttaacccggacgggggtcgcccgggtaaaag

SEQ ID NO: 15354 - DNA, 60 bp, Artificial Sequence
  Description of Artificial Sequence: Synthetic probe
gggatgaaaacaccttgtggtgttggggttacagcctgatagggtgctgcagaggcccac

SEQ ID NO: 15355 - DNA, 60 bp, Artificial Sequence
  Description of Artificial Sequence: Synthetic probe
gataggggacacagtggtgcaagtcatagcaatggatgataagctagggcctatgccttg

SEQ ID NO: 15356 - DNA, 60 bp, Artificial Sequence
  Description of Artificial Sequence: Synthetic probe
ctcttgcaatgtgggtggtgtagcgatagtgccaggtggaactgtgaagtgtaaaattgg

SEQ ID NO: 15357 - DNA, 60 bp, Artificial Sequence
  Description of Artificial Sequence: Synthetic probe
acctcttgcaatgtgggtggtgtagcgatagtgccgactggaactgtgaaatgtaaaatt

SEQ ID NO: 15358 - DNA, 60 bp, Artificial Sequence
  Description of Artificial Sequence: Synthetic probe
acctcttgcaatgtgggtggtgtagcgatagtgccaggtggaactgtgaagtgtaaaatt

SEQ ID NO: 15359 - DNA, 55 bp, Artificial Sequence
  Description of Artificial Sequence: Synthetic probe
tcgagatgccacgtggacgagggcatgcccaaagcacatcttaacctgagcgggg

SEQ ID NO: 15360 - DNA, 60 bp, Artificial Sequence
  Description of Artificial Sequence: Synthetic probe
gacactccttcagttgaggagtctcgagatgccatgtggacgagggcatgcccaaggcac

SEQ ID NO: 15361 - DNA, 60 bp, Artificial Sequence
  Description of Artificial Sequence: Synthetic probe
ggttcgacactccttcagttgaggagtctcgagatgccatgtggacgagggcatgcccaa

SEQ ID NO: 15362 - DNA, 60 bp, Artificial Sequence
  Description of Artificial Sequence: Synthetic probe
gacgccttggcatagaggtctcgagatgccacgtggacgagggcatgcccaaagcacatc

SEQ ID NO: 15363 - DNA, 60 bp, Artificial Sequence
  Description of Artificial Sequence: Synthetic probe
tacaagaggcataagccttttccctataggcagggctgtattacccagaaaaccattggg

SEQ ID NO: 15364 - DNA, 60 bp, Artificial Sequence
  Description of Artificial Sequence: Synthetic probe
gcaccaaggagggatcagctcggtagaccatgtcacagccggaaaggatttactagtgtg

SEQ ID NO: 15365 - DNA, 60 bp, Artificial Sequence
  Description of Artificial Sequence: Synthetic probe
cacgcatcaaggagggatcagctcggtagaccatgtcacagctggaaaggatttactagt

SEQ ID NO: 15366 - DNA, 60 bp, Artificial Sequence
  Description of Artificial Sequence: Synthetic probe
tggtgtgatgaacacagcctgatagggccgtagcagagacctgctatcccgctagtaaaa

SEQ ID NO: 15367 - DNA, 60 bp, Artificial Sequence
  Description of Artificial Sequence: Synthetic probe
acactcgaggcagtgaaagagtcttgagatgccatgtggacgagggcatgcccacggcac

SEQ ID NO: 15368 - DNA, 60 bp, Artificial Sequence
  Description of Artificial Sequence: Synthetic probe
cgactgctacgaatacagcctgatagggtgctgcagaggcccactgtattgctactaaaa

SEQ ID NO: 15369 - DNA, 60 bp, Artificial Sequence
  Description of Artificial Sequence: Synthetic probe
tattcgtggcgttatggacacagcctgatagggtgtagcagagacctgctactccgctag

SEQ ID NO: 15370 - DNA, 60 bp, Artificial Sequence
  Description of Artificial Sequence: Synthetic probe
gaaagcgctattcgtggcgttatggacacagcctgatagggtgtagcagagacctgctac

SEQ ID NO: 15371 - DNA, 60 bp, Artificial Sequence
  Description of Artificial Sequence: Synthetic probe
tgaaagcgctattcgtggcgttatggacacagcctgatagggtgtagcagagacctgcta

SEQ ID NO: 15372 - DNA, 60 bp, Artificial Sequence
  Description of Artificial Sequence: Synthetic probe
gtgaaagcgctattcgtggcgttatggacacagcctgatagggtgtagcagagacctgct

SEQ ID NO: 15373 - DNA, 60 bp, Artificial Sequence
  Description of Artificial Sequence: Synthetic probe
ggtgaaagcgctattcgtggcgttatggacacagcctgatagggtgtagcagagacctgc

SEQ ID NO: 15374 - DNA, 60 bp, Artificial Sequence
  Description of Artificial Sequence: Synthetic probe
cggcgtggctatagtgtcatctggtcgggtgaaatgcaagatcgggaacacagtggtgca

SEQ ID NO: 15375 - DNA, 60 bp, Artificial Sequence
  Description of Artificial Sequence: Synthetic probe
gagacggcgtggctatagtgtcatctggtcgggtgaaatgcaagatcgggaacacagtgg

SEQ ID NO: 15376 - DNA, 60 bp, Artificial Sequence
  Description of Artificial Sequence: Synthetic probe
tggctacagactagtagatgagaccccttgtaacagagacggcgtggctatagtgtcatc

SEQ ID NO: 15377 - DNA, 60 bp, Artificial Sequence
  Description of Artificial Sequence: Synthetic probe
tgtacactggccaatgaggatacgttagccacgaccgttgtacgaacatacaagaggcac

SEQ ID NO: 15378 - DNA, 60 bp, Artificial Sequence
  Description of Artificial Sequence: Synthetic probe
ggctggtagatgacactccttgcaatagagatggtgtagcgatagtgcaacatggaactg

SEQ ID NO: 15379 - DNA, 60 bp, Artificial Sequence
  Description of Artificial Sequence: Synthetic probe
tccagatggtgtgccccataggatggacagggaccgtgagctgtatgttagctaatagag

SEQ ID NO: 15380 - DNA, 60 bp, Artificial Sequence
  Description of Artificial Sequence: Synthetic probe
gaaaatcccagagctgaaggaatcgtatgatgaagtctcatgggaacaattagaagccgg

SEQ ID NO: 15381 - DNA, 60 bp, Artificial Sequence
  Description of Artificial Sequence: Synthetic probe
caagcagacccctgaattgcatgaagaactaatgaaggttttcgactgcttaaagatccc

SEQ ID NO: 15382 - DNA, 60 bp, Artificial Sequence
  Description of Artificial Sequence: Synthetic probe
tgcttaaaggagagtatcaatactggtttgaccttgacgtaactgatcaccacacagact

SEQ ID NO: 15383 - DNA, 60 bp, Artificial Sequence
  Description of Artificial Sequence: Synthetic probe
cctcaagaacaagtactacgaacctagagacagttacttccagcaatacatgcttaaagg

SEQ ID NO: 15384 - DNA, 60 bp, Artificial Sequence
  Description of Artificial Sequence: Synthetic probe
acctgtgagtggaatctacctgaagccagggccactattctttcaagactataagggtcc

SEQ ID NO: 15385 - DNA, 60 bp, Artificial Sequence
  Description of Artificial Sequence: Synthetic probe
aggacctgttagtggaatctacctgaagccagggccactattttatcaggactataaggg

SEQ ID NO: 15386 - DNA, 58 bp, Artificial Sequence
  Description of Artificial Sequence: Synthetic probe
aaaacccgttggggtggaggaacctgtttacgatcaggcaggtaatcctttatttggt

SEQ ID NO: 15387 - DNA, 60 bp, Artificial Sequence
  Description of Artificial Sequence: Synthetic probe
tatccaattggcaaatgtaggttaaaaaacgaaactggctacaggctggtagatgacacc

SEQ ID NO: 15388 - DNA, 60 bp, Artificial Sequence
  Description of Artificial Sequence: Synthetic probe
acacctaacggtgttggggttacagcctgatagggtgctgcagaggcccacgcataggct

SEQ ID NO: 15389 - DNA, 50 bp, Artificial Sequence
  Description of Artificial Sequence: Synthetic probe
gaacacagcctgatagggtgtagcagagacctgctatcccgctagtaaaa

SEQ ID NO: 15390 - DNA, 60 bp, Artificial Sequence
  Description of Artificial Sequence: Synthetic probe
tgccacaaataagaagcagcctaagccagataggatagaaaaaggcaagatgaaaatagc

SEQ ID NO: 15391 - DNA, 60 bp, Artificial Sequence
  Description of Artificial Sequence: Synthetic probe
cccttgcaatagggatggtgtagcgatagtgccaaatggacgtgtgaagtgtagaattgg

SEQ ID NO: 15392 - DNA, 60 bp, Artificial Sequence
  Description of Artificial Sequence: Synthetic probe
agatgaaaccccttgcaatagggatggtgtagcgatagtgccaaatggacgtgtgaagtg

SEQ ID NO: 15393 - DNA, 50 bp, Artificial Sequence
  Description of Artificial Sequence: Synthetic probe
aaaacgaaactggctacaggctggtagatgaaaccccttgcaatagggat

SEQ ID NO: 15394 - DNA, 60 bp, Artificial Sequence
  Description of Artificial Sequence: Synthetic probe
actggacttgtatagcaggggaacagctgcattacacagggggtgccatagaatcctgca

SEQ ID NO: 15395 - DNA, 60 bp, Artificial Sequence
  Description of Artificial Sequence: Synthetic probe
caataaggacaccttagacacggtcgtagtgcggacgtacaagagggctagcccattccc

SEQ ID NO: 15396 - DNA, 60 bp, Artificial Sequence
  Description of Artificial Sequence: Synthetic probe
tgcgtcctaaccaataaggacaccttagacacggtcgtagtgcggacgtacaagagggct

SEQ ID NO: 15397 - DNA, 57 bp, Artificial Sequence
  Description of Artificial Sequence: Synthetic probe
ctgctacgaatacggcctgatagggtgctgcagaggcccactgtattgctactaaaa

SEQ ID NO: 15398 - DNA, 60 bp, Artificial Sequence
  Description of Artificial Sequence: Synthetic probe
cgaaaacagtctaaccaactgctacggatacagcctgatagggtgctgcagaggcccact

SEQ ID NO: 15399 - DNA, 60 bp, Artificial Sequence
  Description of Artificial Sequence: Synthetic probe
gatcaactgctacgaatacagcctgatagggtgctgcagaggcccactgcattgctacta

SEQ ID NO: 15400 - DNA, 60 bp, Artificial Sequence
  Description of Artificial Sequence: Synthetic probe
ctaactgttatggacacagcctgatagggtgctgcagaggcccactgtattgctactaaa

SEQ ID NO: 15401 - DNA, 60 bp, Artificial Sequence
  Description of Artificial Sequence: Synthetic probe
ggggacacagtggtgcaagtcatagcaatggatgataggctagggcctatgccttgcaga

SEQ ID NO: 15402 - DNA, 60 bp, Artificial Sequence
  Description of Artificial Sequence: Synthetic probe
taggggacacagtggtgcaagtcatagcaatggatgataggctagggcctatgccttgca

SEQ ID NO: 15403 - DNA, 60 bp, Artificial Sequence
  Description of Artificial Sequence: Synthetic probe
ataggggacacagtggtgcaagtcatagcaatggatgataggctagggcctatgccttgc

SEQ ID NO: 15404 - DNA, 60 bp, Artificial Sequence
  Description of Artificial Sequence: Synthetic probe
tattatagagccccattggagttttttgaggaagcatcaatgtgtgagataaccaaaaga

SEQ ID NO: 15405 - DNA, 60 bp, Artificial Sequence
  Description of Artificial Sequence: Synthetic probe
ttctgggggaagatctctatgactgtgcccttggaggaaactggacttgtatagcagggg

SEQ ID NO: 15406 - DNA, 60 bp, Artificial Sequence
  Description of Artificial Sequence: Synthetic probe
tatccaattggcaaatgcaggttaaaaaacgaaactggctacaggctggtagatgacacc

SEQ ID NO: 15407 - DNA, 60 bp, Artificial Sequence
  Description of Artificial Sequence: Synthetic probe
tacccaattggcaaatgcaggttaaaaaacgaaactggctacaggctggtagatgaaacc

SEQ ID NO: 15408 - DNA, 60 bp, Artificial Sequence
  Description of Artificial Sequence: Synthetic probe
tacccaattggcaaatgcaggttaaaaaacgaaactggctacaggctggtagacgaaacc

SEQ ID NO: 15409 - DNA, 60 bp, Artificial Sequence
  Description of Artificial Sequence: Synthetic probe
ggtgcccgctgtttggagagagcagtgaggtacacccgcaatccacactaaagctaccgc

SEQ ID NO: 15410 - DNA, 60 bp, Artificial Sequence
  Description of Artificial Sequence: Synthetic probe
ctaacttggcttagtctcgagatgctacgtggacgagggcatgcccatgacacgctttag

SEQ ID NO: 15411 - DNA, 60 bp, Artificial Sequence
  Description of Artificial Sequence: Synthetic probe
ccataggggaagaccttttcgactgtatcttaggagggaactggacttgtgtgccggggg

SEQ ID NO: 15412 - DNA, 60 bp, Artificial Sequence
  Description of Artificial Sequence: Synthetic probe
gcctagaggcacaacccctagggcacccgtgaggttccccacagcactactgaaagtgag

SEQ ID NO: 15413 - DNA, 51 bp, Artificial Sequence
  Description of Artificial Sequence: Synthetic probe
tgcaatacaccgccagagggcagctgttcttgaggaacctgccgatattgg

SEQ ID NO: 15414 - DNA, 56 bp, Artificial Sequence
  Description of Artificial Sequence: Synthetic probe
ttttgtgcaatacaccgccagagggcagctgttcttgaggaacctgccgatattgg

SEQ ID NO: 15415 - DNA, 60 bp, Artificial Sequence
  Description of Artificial Sequence: Synthetic probe
tgaaggaccctttaggcaagaatataatggttttgtgcaatacaccgccagagggcagct

SEQ ID NO: 15416 - DNA, 60 bp, Artificial Sequence
  Description of Artificial Sequence: Synthetic probe
gactatgaaggcccatttaggcaagaatataatggttttgtgcaatacaccgccagaggg

SEQ ID NO: 15417 - DNA, 60 bp, Artificial Sequence
  Description of Artificial Sequence: Synthetic probe
acgggaaggggactatgaaggaccctttaggcaagaatataatggttttgtgcaatacac

SEQ ID NO: 15418 - DNA, 60 bp, Artificial Sequence
  Description of Artificial Sequence: Synthetic probe
gcctcacttcccgattggcaagtgcaagctgaagaatgaaagtggctacagacaagtaga

SEQ ID NO: 15419 - DNA, 60 bp, Artificial Sequence
  Description of Artificial Sequence: Synthetic probe
acctgagcggtctaagccctgagtacagggcagtcgtcagtagttcgacactaacttggc

SEQ ID NO: 15420 - DNA, 60 bp, Artificial Sequence
  Description of Artificial Sequence: Synthetic probe
cctgagcggtctaagccctgagtacagggcagtcgtcagtagttcgacactaacttggct

SEQ ID NO: 15421 - DNA, 53 bp, Artificial Sequence
  Description of Artificial Sequence: Synthetic probe
aatacggtggtgcaagtcatagcaatggatgataagctagggcctatgccttg

SEQ ID NO: 15422 - DNA, 57 bp, Artificial Sequence
  Description of Artificial Sequence: Synthetic probe
aatacggtggtgcaagtcatagcaatggatgataagctagggcctatgccttgcaga

SEQ ID NO: 15423 - DNA, 50 bp, Artificial Sequence
  Description of Artificial Sequence: Synthetic probe
ctgatagggtgctgcagaggcccactgtattgctactaaaaatctctgct

SEQ ID NO: 15424 - DNA, 60 bp, Artificial Sequence
  Description of Artificial Sequence: Synthetic probe
cgagggcatgcccacggcacatcttaacctatgcagggggttgcgtaggtgaaagcacca

SEQ ID NO: 15425 - DNA, 52 bp, Artificial Sequence
  Description of Artificial Sequence: Synthetic probe
ggggctgcatgggtgaaagcgccattcgtggcgttatggacacagcctgata

SEQ ID NO: 15426 - DNA, 60 bp, Artificial Sequence
  Description of Artificial Sequence: Synthetic probe
cacggcacatcttaacccatgcgggggctgcatgggtgaaagcgccattcgtggcgttat

SEQ ID NO: 15427 - DNA, 60 bp, Artificial Sequence
  Description of Artificial Sequence: Synthetic probe
cgagagagccctatcaaccagtgctgagtttatgcagatcagtgaagggaagataggccc

SEQ ID NO: 15428 - DNA, 60 bp, Artificial Sequence
  Description of Artificial Sequence: Synthetic probe
gcacgagagagccctatcaaccagtgctgagtttatgcagatcagtgaagggaagatagg

SEQ ID NO: 15429 - DNA, 60 bp, Artificial Sequence
  Description of Artificial Sequence: Synthetic probe
ttccctgaatgcgaagagggcttccaatatgccatatcgaaagacagaaaaatggggtta

SEQ ID NO: 15430 - DNA, 59 bp, Artificial Sequence
  Description of Artificial Sequence: Synthetic probe
ccatcggggaagacctctacagctgtgtcttgggagggaattggacttgtgtgccgggg

SEQ ID NO: 15431 - DNA, 60 bp, Artificial Sequence
  Description of Artificial Sequence: Synthetic probe
gtaagtgcatgctcagcaatgagagtgggtacaggtatgtagatgacacctcttgcgata

SEQ ID NO: 15432 - DNA, 60 bp, Artificial Sequence
  Description of Artificial Sequence: Synthetic probe
gacgccttggtataaaggcctcgagatgccacgtggacgagggcatgcccaaagcacatc

SEQ ID NO: 15433 - DNA, 60 bp, Artificial Sequence
  Description of Artificial Sequence: Synthetic probe
tcgacgctttggaagataagcctcgagatgccacgtggacgagggcatgcccacagcaca

SEQ ID NO: 15434 - DNA, 60 bp, Artificial Sequence
  Description of Artificial Sequence: Synthetic probe
ggggcccgtctatcatagagccccactggaactatgtagggaggcaagtatgtgcgaaac

SEQ ID NO: 15435 - DNA, 60 bp, Artificial Sequence
  Description of Artificial Sequence: Synthetic probe
attacaaatgaacttttatacaaaacatacaaacaaaaacccgttggggtggaggaacct

SEQ ID NO: 15436 - DNA, 60 bp, Artificial Sequence
  Description of Artificial Sequence: Synthetic probe
agtcgtcagtggttcgacgccttggcatagaggtctcgagatgccacgtggacgagggca

SEQ ID NO: 15437 - DNA, 60 bp, Artificial Sequence
  Description of Artificial Sequence: Synthetic probe
ggctagcctttggaggggagtcggtgtcagaccacgtcagacaggcagcggttgatttag

SEQ ID NO: 15438 - DNA, 60 bp, Artificial Sequence
  Description of Artificial Sequence: Synthetic probe
tctccagtacgcacccaacgccataaaaaccgacggggcagagactgaattgaaggaatt

SEQ ID NO: 15439 - DNA, 60 bp, Artificial Sequence
  Description of Artificial Sequence: Synthetic probe
cactatagaggaccagaggctagaagataccacccacctccagtacgcacccaacgccat

SEQ ID NO: 15440 - DNA, 60 bp, Artificial Sequence
  Description of Artificial Sequence: Synthetic probe
gtggccgggttgtcttcagctgagaatgccctgcttgtggctttattcgggtacgtaggt

SEQ ID NO: 15441 - DNA, 60 bp, Artificial Sequence
  Description of Artificial Sequence: Synthetic probe
cccgatcctgggaatcaacaggtcgtggagactggtaaagcactgaagcaagtggccggg

SEQ ID NO: 15442 - DNA, 60 bp, Artificial Sequence
  Description of Artificial Sequence: Synthetic probe
gaacgctagaaagttgggagaggacgtacccgtgtacatctatgccactgaagatgagga

SEQ ID NO: 15443 - DNA, 60 bp, Artificial Sequence
  Description of Artificial Sequence: Synthetic probe
ataatggccagaactgaccacccagagccgatccaacttgcatacaacagctacgaggtc

SEQ ID NO: 15444 - DNA, 60 bp, Artificial Sequence
  Description of Artificial Sequence: Synthetic probe
cgggtcaaaggactaccactatgacctcttgcaggcacaaagatacggcattgaggacgg

SEQ ID NO: 15445 - DNA, 60 bp, Artificial Sequence
  Description of Artificial Sequence: Synthetic probe
tcaagaggatggctgtcactgtgggtgagcaggctcaacgtaggggcagagtaggtagag

SEQ ID NO: 15446 - DNA, 60 bp, Artificial Sequence
  Description of Artificial Sequence: Synthetic probe
cgaacgccattgaatcaggagtgacattaccagacttggacacggtcgtggacacagggt

SEQ ID NO: 15447 - DNA, 60 bp, Artificial Sequence
  Description of Artificial Sequence: Synthetic probe
catgaccgccacccctgccggggcagtaaccacaacaggacaaaagcacccgatagaaga

SEQ ID NO: 15448 - DNA, 60 bp, Artificial Sequence
  Description of Artificial Sequence: Synthetic probe
ggacatggcaaccgggataacctatgcatcatacgggtacttctgtcagatgcctcaacc

SEQ ID NO: 15449 - DNA, 60 bp, Artificial Sequence
  Description of Artificial Sequence: Synthetic probe
ccattgagggcagcggcagaatcagtctaccagtatatgagattgaaacacccgagtatc

SEQ ID NO: 15450 - DNA, 60 bp, Artificial Sequence
  Description of Artificial Sequence: Synthetic probe
gggaagaatgaagagtccaaacccacaaagataatgagtggcatccagaccgtctcaaag

SEQ ID NO: 15451 - DNA, 60 bp, Artificial Sequence
  Description of Artificial Sequence: Synthetic probe
ggatccaaaggggcggttgtccacctccaaaagaccggtggggaattcacgtgtgtcact

SEQ ID NO: 15452 - DNA, 60 bp, Artificial Sequence
  Description of Artificial Sequence: Synthetic probe
gctggcaaagatctattggtctgcgacagcatgggaagaactagagtggtctgccagagc

SEQ ID NO: 15453 - DNA, 60 bp, Artificial Sequence
  Description of Artificial Sequence: Synthetic probe
ggtgaggttccctacgagtttgctaaaagtgaggaggggcctggagactggttgggctta

SEQ ID NO: 15454 - DNA, 60 bp, Artificial Sequence
  Description of Artificial Sequence: Synthetic probe
aaaatgccacatcaacatactagataaactaactgcattcttcgggatcatgccaagggg

SEQ ID NO: 15455 - DNA, 60 bp, Artificial Sequence
  Description of Artificial Sequence: Synthetic probe
tataaaagcatagctgcaaaactggggcacgaaacagcatttgctacactagtgctaaaa

SEQ ID NO: 15456 - DNA, 60 bp, Artificial Sequence
  Description of Artificial Sequence: Synthetic probe
aagtacccatctttgggtgctgggagtacagcctgatagggcgctgcagaggcccactga

SEQ ID NO: 15457 - DNA, 60 bp, Artificial Sequence
  Description of Artificial Sequence: Synthetic probe
tgaaagtacccatctttgggtgctgggagtacagcctgatagggcgctgcagaggcccac

SEQ ID NO: 15458 - DNA, 60 bp, Artificial Sequence
  Description of Artificial Sequence: Synthetic probe
aacgctggtaaaccccagccttgagatgctacgtggacgagggcatgcccaagacacacc

SEQ ID NO: 15459 - DNA, 60 bp, Artificial Sequence
  Description of Artificial Sequence: Synthetic probe
atgcccttagtaggactagcaaaaggaggggactagcggtagcagtgagttcattggatg

SEQ ID NO: 15460 - DNA, 60 bp, Artificial Sequence
  Description of Artificial Sequence: Synthetic probe
catgcccttagtaggactagcaaaaggaggggactagcggtagcagtgagttcattggat

SEQ ID NO: 15461 - DNA, 60 bp, Artificial Sequence
  Description of Artificial Sequence: Synthetic probe
gaattggagaaacagtggtgcaggtcatagcattggactcaaaacttgggcctatgccat

SEQ ID NO: 15462 - DNA, 60 bp, Artificial Sequence
  Description of Artificial Sequence: Synthetic probe
ccgtgaagtgtagaattggagaaacagtggtgcaggtcatagcattggactcaaaacttg

SEQ ID NO: 15463 - DNA, 50 bp, Artificial Sequence
  Description of Artificial Sequence: Synthetic probe
aaaacgaaaccggctacaggctggtagatgacacctcttgcaatagagat

SEQ ID NO: 15464 - DNA, 60 bp, Artificial Sequence
  Description of Artificial Sequence: Synthetic probe
tcacgcaaaaacttgtgggggaagatctctatgactgcatccttggaggaaactggactt

SEQ ID NO: 15465 - DNA, 60 bp, Artificial Sequence
  Description of Artificial Sequence: Synthetic probe
agtgcggacgtataagaggattagcccgttccctaataggcaaggttgtgtcacgcaaaa

SEQ ID NO: 15466 - DNA, 60 bp, Artificial Sequence
  Description of Artificial Sequence: Synthetic probe
ttggaatcatgcctagaggcacaacccctagggcacctgtgaggttccccacagcactac

SEQ ID NO: 15467 - DNA, 60 bp, Artificial Sequence
  Description of Artificial Sequence: Synthetic probe
ggtcgcccaggtgaaaacagtttaactaactgctacgaatacagcctgatagggtgctgc

SEQ ID NO: 15468 - DNA, 60 bp, Artificial Sequence
  Description of Artificial Sequence: Synthetic probe
acaaggcctcgagatgccacgtggacgagggcatgcccaaagcacatcttaacctgggtg

SEQ ID NO: 15469 - DNA, 60 bp, Artificial Sequence
  Description of Artificial Sequence: Synthetic probe
taagagggttagcccattccctaataggcaaggttgtgtcactcaaaaacttctggggga

SEQ ID NO: 15470 - DNA, 60 bp, Artificial Sequence
  Description of Artificial Sequence: Synthetic probe
atgcaagataggggacacagtggtgcaagtcattgcaatggatgataaattagggcctat

SEQ ID NO: 15471 - DNA, 60 bp, Artificial Sequence
  Description of Artificial Sequence: Synthetic probe
attgtaggggatcagctacgttacacagggggcaccattgaatcctgcaagtggtgcggc

SEQ ID NO: 15472 - DNA, 60 bp, Artificial Sequence
  Description of Artificial Sequence: Synthetic probe
gggaggatctctatgactgcgccttaggagggaactggacttgtattgtaggggatcagc

SEQ ID NO: 15473 - DNA, 60 bp, Artificial Sequence
  Description of Artificial Sequence: Synthetic probe
ttataggggaggatctctatgactgcgccttaggagggaactggacttgtattgtagggg

SEQ ID NO: 15474 - DNA, 60 bp, Artificial Sequence
  Description of Artificial Sequence: Synthetic probe
accaatgctaggtccctgccgcagaaaggtgactgccggaaaggcaacatcaatggagca

SEQ ID NO: 15475 - DNA, 60 bp, Artificial Sequence
  Description of Artificial Sequence: Synthetic probe
aggcacaacccctagggcacccgtgaggttccccacagcattactgaaagtgagaagggg

SEQ ID NO: 15476 - DNA, 60 bp, Artificial Sequence
  Description of Artificial Sequence: Synthetic probe
gaggcacaacccctagggcacccgtgaggttccccacagcattactgaaagtgagaaggg

SEQ ID NO: 15477 - DNA, 60 bp, Artificial Sequence
  Description of Artificial Sequence: Synthetic probe
tatgcccagaggcacaacccctagggcacccgtgaggttccccacagcattactgaaagt

SEQ ID NO: 15478 - DNA, 60 bp, Artificial Sequence
  Description of Artificial Sequence: Synthetic probe
ggagacacagtggtacaggtcactgcaatggatacaaaacttggacctatgccttgcaag

SEQ ID NO: 15479 - DNA, 54 bp, Artificial Sequence
  Description of Artificial Sequence: Synthetic probe
cgagatgctatgtggacgagggcatgcccaagacacaccttaaccctagcgggg

SEQ ID NO: 15480 - DNA, 60 bp, Artificial Sequence
  Description of Artificial Sequence: Synthetic probe
cgagatgctatgtggacgagggcatgcccaagacacaccttaaccctagcgggggtcgct

SEQ ID NO: 15481 - DNA, 60 bp, Artificial Sequence
  Description of Artificial Sequence: Synthetic probe
tgtactgtggctcttaataacatatatgatactgtctgagcagatggctatgggtgctgg

SEQ ID NO: 15482 - DNA, 60 bp, Artificial Sequence
  Description of Artificial Sequence: Synthetic probe
aacactgacctgggacccatgccctgcagcccagctgaggtgatagcaagtgaaggacca

SEQ ID NO: 15483 - DNA, 60 bp, Artificial Sequence
  Description of Artificial Sequence: Synthetic probe
agaactactccatttcagcggagaaaatggtgtacctatgaaaagataataggggaggat

SEQ ID NO: 15484 - DNA, 60 bp, Artificial Sequence
  Description of Artificial Sequence: Synthetic probe
gagaggtacttagtggccgtgcacgaaagagccctgtcaaccagtgctgagttcatgcag

SEQ ID NO: 15485 - DNA, 60 bp, Artificial Sequence
  Description of Artificial Sequence: Synthetic probe
acatatgcctcatatggatacttttgccaaatgccccagccaaaattgagagcagcaatg

SEQ ID NO: 15486 - DNA, 60 bp, Artificial Sequence
  Description of Artificial Sequence: Synthetic probe
taaagatcaggagagggctggagacaggatgggcttatacacaccaaggggggataagtt

SEQ ID NO: 15487 - DNA, 60 bp, Artificial Sequence
  Description of Artificial Sequence: Synthetic probe
acggtgttatgagcacagcctgatagggtgtagcagagacctgctattccgctagtaaaa

SEQ ID NO: 15488 - DNA, 60 bp, Artificial Sequence
  Description of Artificial Sequence: Synthetic probe
taaccaatgctaggtccctgccgcggaaaggtgactgccgggaaggcaatgtgaacggag

SEQ ID NO: 15489 - DNA, 56 bp, Artificial Sequence
  Description of Artificial Sequence: Synthetic probe
gccattattctaccaggattacaaaggacccgtctatcatagagctccattggagc

SEQ ID NO: 15490 - DNA, 60 bp, Artificial Sequence
  Description of Artificial Sequence: Synthetic probe
gccattattctaccaggattacaaaggacccgtctatcatagagctccattggagctatt

SEQ ID NO: 15491 - DNA, 60 bp, Artificial Sequence
  Description of Artificial Sequence: Synthetic probe
ccagctttccagatggtatgcccacaggggtggagtggtacaatagaatgcaccctagcg

SEQ ID NO: 15492 - DNA, 60 bp, Artificial Sequence
  Description of Artificial Sequence: Synthetic probe
cgctgccagatttagatacagttgttgacacaggtctgaaatgtgagaaaagggtgaggg

SEQ ID NO: 15493 - DNA, 60 bp, Artificial Sequence
  Description of Artificial Sequence: Synthetic probe
cgctgccagatttagatacagttgttgacacaggtctgaaatgtgagaagagggtgagag

SEQ ID NO: 15494 - DNA, 59 bp, Artificial Sequence
  Description of Artificial Sequence: Synthetic probe
tcaggggtaacgctgccagatttagatacagttgttgacacaggtctgaaatgtgaaaa

SEQ ID NO: 15495 - DNA, 60 bp, Artificial Sequence
  Description of Artificial Sequence: Synthetic probe
cacctacgcctcatatggatatttttgccaaatgccacagccaaatctcagggcagcaat

SEQ ID NO: 15496 - DNA, 60 bp, Artificial Sequence
  Description of Artificial Sequence: Synthetic probe
gcttaagaatgagagtggctatagacaagtggatgagactccttgcaatagagacggcgt

SEQ ID NO: 15497 - DNA, 60 bp, Artificial Sequence
  Description of Artificial Sequence: Synthetic probe
ctacgatatgtagctgggcccgtcgagtcttgtaagtggtgtggttacaagttcttaaaa

SEQ ID NO: 15498 - DNA, 60 bp, Artificial Sequence
  Description of Artificial Sequence: Synthetic probe
ctaaactgctacgaatacagcctgatagggtgctgcagaggcccactgtatcgctactaa

SEQ ID NO: 15499 - DNA, 60 bp, Artificial Sequence
  Description of Artificial Sequence: Synthetic probe
ttccctgaatgcaaagagggcttccaatatgccatatcgaaagacagaaaaatggggtta

SEQ ID NO: 15500 - DNA, 60 bp, Artificial Sequence
  Description of Artificial Sequence: Synthetic probe
agaaggggagcaactaaaatacacagggggtcacatcgaatcatgcaagtggtgcggtta

SEQ ID NO: 15501 - DNA, 60 bp, Artificial Sequence
  Description of Artificial Sequence: Synthetic probe
tacgccgctaggggacaattgttccgagggaatttacccatattagcaaccaaagtaaaa

SEQ ID NO: 15502 - DNA, 60 bp, Artificial Sequence
  Description of Artificial Sequence: Synthetic probe
atacgccgctaggggacaattgttccgagggaatttacccatattagcaaccaaagtaaa

SEQ ID NO: 15503 - DNA, 60 bp, Artificial Sequence
  Description of Artificial Sequence: Synthetic probe
ccttcgaaggacccttcaggcaggaatatagtgggtttgtacaatacgccgctaggggac

SEQ ID NO: 15504 - DNA, 60 bp, Artificial Sequence
  Description of Artificial Sequence: Synthetic probe
gagggtaccttcgaaggacccttcaggcaggaatatagtgggtttgtacaatacgccgct

SEQ ID NO: 15505 - DNA, 60 bp, Artificial Sequence
  Description of Artificial Sequence: Synthetic probe
ggaatttgaagacaggtactacaagaggatctttataagagagggtaccttcgaaggacc

SEQ ID NO: 15506 - DNA, 60 bp, Artificial Sequence
  Description of Artificial Sequence: Synthetic probe
tgactctaccggaatttgaagacaggtactacaagaggatctttataagagagggtacct

SEQ ID NO: 15507 - DNA, 60 bp, Artificial Sequence
  Description of Artificial Sequence: Synthetic probe
gccccaaatccggtcgccaccggaagcccatcacctgtggaatgactctaccggaatttg

SEQ ID NO: 15508 - DNA, 60 bp, Artificial Sequence
  Description of Artificial Sequence: Synthetic probe
tggcaactgccccaaatccggtcgccaccggaagcccatcacctgtggaatgactctacc

SEQ ID NO: 15509 - DNA, 60 bp, Artificial Sequence
  Description of Artificial Sequence: Synthetic probe
cctagccaataaggacaccctaaacatggttacagtgcggacgtataagagggttagccc

SEQ ID NO: 15510 - DNA, 60 bp, Artificial Sequence
  Description of Artificial Sequence: Synthetic probe
ccagatgtcctcagatgggtatacaacagattagattgcccattatgggtcaccagttgc

SEQ ID NO: 15511 - DNA, 60 bp, Artificial Sequence
  Description of Artificial Sequence: Synthetic probe
ccagaagttctcagatgggtatacaacagattagattgcccattatgggtcaccagttgc

SEQ ID NO: 15512 - DNA, 60 bp, Artificial Sequence
  Description of Artificial Sequence: Synthetic probe
aaccagaagttctcagatgggtatacaacagattagattgcccattatgggtcaccagtt

SEQ ID NO: 15513 - DNA, 60 bp, Artificial Sequence
  Description of Artificial Sequence: Synthetic probe
gtaggtgtcaaccagatgtcctcagatgggtatacaacagattagattgcccattatggg

SEQ ID NO: 15514 - DNA, 60 bp, Artificial Sequence
  Description of Artificial Sequence: Synthetic probe
gtaactggtagtgatagtaaattgtaccacatttatgtgtgcatagacggatgcataata

SEQ ID NO: 15515 - DNA, 60 bp, Artificial Sequence
  Description of Artificial Sequence: Synthetic probe
ggacccgtctatcatagagctccattggagttatttcaggaagcctctatgtgtgagaca

SEQ ID NO: 15516 - DNA, 60 bp, Artificial Sequence
  Description of Artificial Sequence: Synthetic probe
aggggtgactgcaggtcaggtaacagcaaggggcccgtgagtgggatctatctgaaaccg

SEQ ID NO: 15517 - DNA, 60 bp, Artificial Sequence
  Description of Artificial Sequence: Synthetic probe
catccttgccaaaaaggggtgactgcaggtcaggtaacagcaaggggcccgtgagtggga

SEQ ID NO: 15518 - DNA, 60 bp, Artificial Sequence
  Description of Artificial Sequence: Synthetic probe
gcatctttgccgaaaagaggtgactgtaggtcaggtaacagcaaggggcccgtgagtggg

SEQ ID NO: 15519 - DNA, 60 bp, Artificial Sequence
  Description of Artificial Sequence: Synthetic probe
agcgtctatgtgtgagatatctaaaagaatagggagagtaactggtagtgatagcaaatt

SEQ ID NO: 15520 - DNA, 60 bp, Artificial Sequence
  Description of Artificial Sequence: Synthetic probe
ggtcgggtaatagcaaagggcctgtgagtggaatctacttaaaaccagggccgttattct

SEQ ID NO: 15521 - DNA, 58 bp, Artificial Sequence
  Description of Artificial Sequence: Synthetic probe
ctatcggggaattacatcttagaattgatctatagcttgcacaaacagataaacagag

SEQ ID NO: 15522 - DNA, 60 bp, Artificial Sequence
  Description of Artificial Sequence: Synthetic probe
ttgaagcgtttgaattactaggaatggattcagaaggaaaaattaggaacctatcgggga

SEQ ID NO: 15523 - DNA, 60 bp, Artificial Sequence
  Description of Artificial Sequence: Synthetic probe
gatcataatggcactatttgaagcagttcagacaattggcaaccccctgaggcttatcta

SEQ ID NO: 15524 - DNA, 60 bp, Artificial Sequence
  Description of Artificial Sequence: Synthetic probe
gcagaaaaggactctgttgatgaaggttttcgtaaagaacttcctggaccaagctgcaac

SEQ ID NO: 15525 - DNA, 60 bp, Artificial Sequence
  Description of Artificial Sequence: Synthetic probe
gaatccagtgagcagaaaaggactctgttgatgaaggttttcgtaaagaacttcctggac

SEQ ID NO: 15526 - DNA, 54 bp, Artificial Sequence
  Description of Artificial Sequence: Synthetic probe
tcacaaaacccagtgtcagttggtatatccgtgatgctgggagtaggggcaata

SEQ ID NO: 15527 - DNA, 60 bp, Artificial Sequence
  Description of Artificial Sequence: Synthetic probe
cttgggcacaggaatcagcgcggcaatggaaatcctgtcacaaaacccagtgtcagttgg

SEQ ID NO: 15528 - DNA, 60 bp, Artificial Sequence
  Description of Artificial Sequence: Synthetic probe
aaagtgatggactcttgggcacaggaatcagcgcggcaatggaaatcctgtcacaaaacc

SEQ ID NO: 15529 - DNA, 60 bp, Artificial Sequence
  Description of Artificial Sequence: Synthetic probe
cctcccatatgccactagtgcactgaagatgttcactccaacaagattggagagcgtcgt

SEQ ID NO: 15530 - DNA, 60 bp, Artificial Sequence
  Description of Artificial Sequence: Synthetic probe
aaccttgccaaggtagtggaaccagctttggcatacctcccatatgccactagtgcactg

SEQ ID NO: 15531 - DNA, 60 bp, Artificial Sequence
  Description of Artificial Sequence: Synthetic probe
acctggaattataacaaccttgccaaggtagtggaaccagctttggcatacctcccatat

SEQ ID NO: 15532 - DNA, 60 bp, Artificial Sequence
  Description of Artificial Sequence: Synthetic probe
gtcgccagcctattcatttctgctttggcaacctacacatataaaacctggaattataac

SEQ ID NO: 15533 - DNA, 60 bp, Artificial Sequence
  Description of Artificial Sequence: Synthetic probe
gttttgtcgccagcctattcatttctgctttggcaacctacacatataaaacctggaatt

SEQ ID NO: 15534 - DNA, 60 bp, Artificial Sequence
  Description of Artificial Sequence: Synthetic probe
gcattccctggcgattccgaaacccaacaggaggggaggcgttttgtcgccagcctattc

SEQ ID NO: 15535 - DNA, 60 bp, Artificial Sequence
  Description of Artificial Sequence: Synthetic probe
aaacaagcctgcattccctggcgattccgaaacccaacaggaggggaggcgttttgtcgc

SEQ ID NO: 15536 - DNA, 60 bp, Artificial Sequence
  Description of Artificial Sequence: Synthetic probe
ggcaggcagcagtcgatctggtagtctactatgtgataaacaagcctgcattccctggcg

SEQ ID NO: 15537 - DNA, 60 bp, Artificial Sequence
  Description of Artificial Sequence: Synthetic probe
tcagaccatgtcaggcaggcagcagtcgatctggtagtctactatgtgataaacaagcct

SEQ ID NO: 15538 - DNA, 60 bp, Artificial Sequence
  Description of Artificial Sequence: Synthetic probe
taataaagtggttagcctttggaggggattcagtgtcagaccatgtcaggcaggcagcag

SEQ ID NO: 15539 - DNA, 60 bp, Artificial Sequence
  Description of Artificial Sequence: Synthetic probe
ctttttctactctagtaataaagtggttagcctttggaggggattcagtgtcagaccatg

SEQ ID NO: 15540 - DNA, 60 bp, Artificial Sequence
  Description of Artificial Sequence: Synthetic probe
acacacagcactctataaaagtatagccgcaagacttgggcatgaaacagctttttctac

SEQ ID NO: 15541 - DNA, 60 bp, Artificial Sequence
  Description of Artificial Sequence: Synthetic probe
ctcattgaaaacaaagacattattattaggtatggcttatggggagcacacacagcactc

SEQ ID NO: 15542 - DNA, 60 bp, Artificial Sequence
  Description of Artificial Sequence: Synthetic probe
tcactcattgaaaacaaagacattattattaggtatggcttatggggagcacacacagca

SEQ ID NO: 15543 - DNA, 60 bp, Artificial Sequence
  Description of Artificial Sequence: Synthetic probe
ggggattggagttcgtgaagtctcaagcagagaagataaagactgctcctgcatttaaag

SEQ ID NO: 15544 - DNA, 60 bp, Artificial Sequence
  Description of Artificial Sequence: Synthetic probe
tatgcatctgggggattggagttcgtgaagtctcaagcagagaagataaagactgctcct

SEQ ID NO: 15545 - DNA, 60 bp, Artificial Sequence
  Description of Artificial Sequence: Synthetic probe
ggttttaccaaccgctacgaatacagcctgatagggtgctgcagaggcccactgtattgc

SEQ ID NO: 15546 - DNA, 60 bp, Artificial Sequence
  Description of Artificial Sequence: Synthetic probe
gggagagtaactggtagtgacagtaaattatatcacatttacgtgtgtgttgatggatgc

SEQ ID NO: 15547 - DNA, 51 bp, Artificial Sequence
  Description of Artificial Sequence: Synthetic probe
tttgaggaagcatcaatgtgtgagataaccaaaagaatcgggagagtaact

SEQ ID NO: 15548 - DNA, 60 bp, Artificial Sequence
  Description of Artificial Sequence: Synthetic probe
cccggaccgatattctaccaggattacaaaggaccagtctattatagagccccattggag

SEQ ID NO: 15549 - DNA, 60 bp, Artificial Sequence
  Description of Artificial Sequence: Synthetic probe
tctacttgaaacccggaccgatattctaccaggattacaaaggaccagtctattatagag

SEQ ID NO: 15550 - DNA, 60 bp, Artificial Sequence
  Description of Artificial Sequence: Synthetic probe
gactgcaggtcgggtaatagcaagggacctgtgagcggaatctacttgaaacccggaccg

SEQ ID NO: 15551 - DNA, 60 bp, Artificial Sequence
  Description of Artificial Sequence: Synthetic probe
aaagagaggtgactgcaggtcgggtaatagcaagggacctgtgagcggaatctacttgaa

SEQ ID NO: 15552 - DNA, 60 bp, Artificial Sequence
  Description of Artificial Sequence: Synthetic probe
gaacttttatacaaaacatacaaacaaaaaccagcaggcgtcactgaacctgtttacaac

SEQ ID NO: 15553 - DNA, 60 bp, Artificial Sequence
  Description of Artificial Sequence: Synthetic probe
ggaacaggcctttcccctttaggcaaggctgcattacccagaaagtcatcggggaagacc

SEQ ID NO: 15554 - DNA, 60 bp, Artificial Sequence
  Description of Artificial Sequence: Synthetic probe
caagaggaacaggcctttcccctttaggcaaggctgcattacccagaaagtcatcgggga

SEQ ID NO: 15555 - DNA, 60 bp, Artificial Sequence
  Description of Artificial Sequence: Synthetic probe
acaagaggcacaggcctttcccctttaggcaaggctgcattacccagaaagtcatcgggg

SEQ ID NO: 15556 - DNA, 60 bp, Artificial Sequence
  Description of Artificial Sequence: Synthetic probe
ccgttgtacgaacatacaagaggcacaggcctttcccctttaggcaaggctgcattaccc

SEQ ID NO: 15557 - DNA, 60 bp, Artificial Sequence
  Description of Artificial Sequence: Synthetic probe
ctggccaataaggatacgttagccatgaccgttgtacgaacatacaagaggaacaggcct

SEQ ID NO: 15558 - DNA, 60 bp, Artificial Sequence
  Description of Artificial Sequence: Synthetic probe
gactagcatgaagaggggactagcggtagcagtgagttcattggatggccgaatccctga

SEQ ID NO: 15559 - DNA, 60 bp, Artificial Sequence
  Description of Artificial Sequence: Synthetic probe
gacgagggcacgcccaaagcacatcttaacctgagcgggggtcgctcaggcgaaaacagt

SEQ ID NO: 15560 - DNA, 60 bp, Artificial Sequence
  Description of Artificial Sequence: Synthetic probe
accacatttatgtgtgtattgatggatgcataatagttaagagcgctacgagagatcgcc

SEQ ID NO: 15561 - DNA, 60 bp, Artificial Sequence
  Description of Artificial Sequence: Synthetic probe
atatcacatttatgtgtgtattgatggatgcataatagttaagagcgctacgagagatcg

SEQ ID NO: 15562 - DNA, 60 bp, Artificial Sequence
  Description of Artificial Sequence: Synthetic probe
gcaaattatatcacatttatgtgtgtattgatggatgcataatagttaagagcgctacga

SEQ ID NO: 15563 - DNA, 60 bp, Artificial Sequence
  Description of Artificial Sequence: Synthetic probe
aagaggtgactgcaggtcaggtaacagcaaggggcccgtgagtgggatctatctgaaacc

SEQ ID NO: 15564 - DNA, 60 bp, Artificial Sequence
  Description of Artificial Sequence: Synthetic probe
cagggctaacatcctaaccaatgctaggtccctgccgcggaaaggtgactgccgggaagg

SEQ ID NO: 15565 - DNA, 60 bp, Artificial Sequence
  Description of Artificial Sequence: Synthetic probe
ggacgagggcatgcccacggcacatcttaacccatgcgggggttgcatgggtgaaagcgc

SEQ ID NO: 15566 - DNA, 60 bp, Artificial Sequence
  Description of Artificial Sequence: Synthetic probe
gacgagggcatgcccacagcacatcttaacctggacgggggtcgcccaggtaaaagcagt

SEQ ID NO: 15567 - DNA, 59 bp, Artificial Sequence
  Description of Artificial Sequence: Synthetic probe
aacactctggcagtgaaagagtcttgagatgccatgtctcgagggcatgcccacggcac

SEQ ID NO: 15568 - DNA, 60 bp, Artificial Sequence
  Description of Artificial Sequence: Synthetic probe
ggttcaacactctggcagtgaaagagtcttgagatgccatgtctcgagggcatgcccacg

SEQ ID NO: 15569 - DNA, 60 bp, Artificial Sequence
  Description of Artificial Sequence: Synthetic probe
aaggtctcgagatgccacgtggacgagggcatgcccaaagcacatcttaacctgagcggg

SEQ ID NO: 15570 - DNA, 50 bp, Artificial Sequence
  Description of Artificial Sequence: Synthetic probe
aggacccgtctatcatagagctccattggagttattccaggaagcctcta

SEQ ID NO: 15571 - DNA, 60 bp, Artificial Sequence
  Description of Artificial Sequence: Synthetic probe
aggacccgtctatcatagagctccattggagttattccaggaagcctctatgtgcgagac

SEQ ID NO: 15572 - DNA, 60 bp, Artificial Sequence
  Description of Artificial Sequence: Synthetic probe
agtacaggacagtcgtcagtggttcgacacgaccatggtgccgtctcgagatgccacgtg

SEQ ID NO: 15573 - DNA, 60 bp, Artificial Sequence
  Description of Artificial Sequence: Synthetic probe
cctagaggcacaacccctagggcacccgtgaggttccccacagcactactgaaagtgaga

SEQ ID NO: 15574 - DNA, 60 bp, Artificial Sequence
  Description of Artificial Sequence: Synthetic probe
ggactagcggtagcagtgagttcattggatggccgaacccctgagtacaggggagtcgtc

SEQ ID NO: 15575 - DNA, 60 bp, Artificial Sequence
  Description of Artificial Sequence: Synthetic probe
tacctcaatgcaagaaaactaggagaggatgtaccggcatacgtgtacgccacggaggat

SEQ ID NO: 15576 - DNA, 60 bp, Artificial Sequence
  Description of Artificial Sequence: Synthetic probe
acacatacctcaatgcaagaaaactaggagaggatgtaccggcatacgtgtatgccacag

SEQ ID NO: 15577 - DNA, 60 bp, Artificial Sequence
  Description of Artificial Sequence: Synthetic probe
accaccttgtggtgttgtgaacacagcctgatagggtgtagcagagacctgctatcccgc

SEQ ID NO: 15578 - DNA, 60 bp, Artificial Sequence
  Description of Artificial Sequence: Synthetic probe
accatttcatggtgttatgaacacagcctgatagggtgtagcagagacctgctatcccgt

SEQ ID NO: 15579 - DNA, 59 bp, Artificial Sequence
  Description of Artificial Sequence: Synthetic probe
gaatacagcctgatagggtgctgcagaggcccactgtattgctactaaaaatctctgct

SEQ ID NO: 15580 - DNA, 60 bp, Artificial Sequence
  Description of Artificial Sequence: Synthetic probe
ccttggtaagaagttggagaataaaagcaaagcatggtttggtgcacacgcagcgagccc

SEQ ID NO: 15581 - DNA, 60 bp, Artificial Sequence
  Description of Artificial Sequence: Synthetic probe
ccttggtaagaagttggagaataaaagcaaagcatggtttggagcacatgcagcaagtcc

SEQ ID NO: 15582 - DNA, 60 bp, Artificial Sequence
  Description of Artificial Sequence: Synthetic probe
atccttggtaagaagttggagaataaaagcaaagcatggtttggagcacatgcagcaagt

SEQ ID NO: 15583 - DNA, 59 bp, Artificial Sequence
  Description of Artificial Sequence: Synthetic probe
aactgctacgaatacagcctgatagggtgctgcagaggcccactgtattgctactaaaa

SEQ ID NO: 15584 - DNA, 60 bp, Artificial Sequence
  Description of Artificial Sequence: Synthetic probe
gaccaatctactaccaggactatgcgggacccgtctatcatagagtcccactggaactat

SEQ ID NO: 15585 - DNA, 60 bp, Artificial Sequence
  Description of Artificial Sequence: Synthetic probe
acctgtttacgatatcaacgggtgcccattgtttggggagagcagtgaggtacacccgca

SEQ ID NO: 15586 - DNA, 60 bp, Artificial Sequence
  Description of Artificial Sequence: Synthetic probe
ccgactagtagatgacacctcctgtaatagagagggcgtagccatagtgccaactggaac

SEQ ID NO: 15587 - DNA, 60 bp, Artificial Sequence
  Description of Artificial Sequence: Synthetic probe
ggctaccgactagtagatgacacctcctgtaatagagagggcgtagccatagtgccaact

SEQ ID NO: 15588 - DNA, 60 bp, Artificial Sequence
  Description of Artificial Sequence: Synthetic probe
cgggaacacagtagtgcaagtcatagcgatggacgacaagctaggacctatgccttgcag

SEQ ID NO: 15589 - DNA, 60 bp, Artificial Sequence
  Description of Artificial Sequence: Synthetic probe
tgcaagatcgggaacacagtagtgcaagtcatagcgatggacgacaagctaggacctatg

SEQ ID NO: 15590 - DNA, 59 bp, Artificial Sequence
  Description of Artificial Sequence: Synthetic probe
gaatacagcctgatagggtgctgcagaggcccactgcatcgctactaaaaatctctgct

SEQ ID NO: 15591 - DNA, 60 bp, Artificial Sequence
  Description of Artificial Sequence: Synthetic probe
ttggagacacagtggtgcaggtcatagcaatggacacaaaactcgggcctatgccttgca

SEQ ID NO: 15592 - DNA, 60 bp, Artificial Sequence
  Description of Artificial Sequence: Synthetic probe
atggaattgttttcaaatgaacttttatacaaaacatataaacaaaaaccagccggtgta

SEQ ID NO: 15593 - DNA, 60 bp, Artificial Sequence
  Description of Artificial Sequence: Synthetic probe
gaaaacacccctttttgggtgctgggggtacagcctgatagggtgctgcagaggcccact

SEQ ID NO: 15594 - DNA, 60 bp, Artificial Sequence
  Description of Artificial Sequence: Synthetic probe
tcaacgccggtaaaccccggccttgagatgccacgtggacgagggcatgcccaagacaca

SEQ ID NO: 15595 - DNA, 60 bp, Artificial Sequence
  Description of Artificial Sequence: Synthetic probe
gtcgtcagtggttcaacgccggtaaaccccggccttgagatgccacgtggacgagggcat

SEQ ID NO: 15596 - DNA, 53 bp, Artificial Sequence
  Description of Artificial Sequence: Synthetic probe
agggtgttgcagagacccactgtattgctactaaaaatctctgctgtacatgg

SEQ ID NO: 15597 - DNA, 60 bp, Artificial Sequence
  Description of Artificial Sequence: Synthetic probe
cctggcaaaccaagacaccttggacacaactgtcgttaggacatatagaagaactactcc

SEQ ID NO: 15598 - DNA, 60 bp, Artificial Sequence
  Description of Artificial Sequence: Synthetic probe
tcctggcaaaccaagacaccttggacacaactgtcgttaggacatatagaagaactactc

SEQ ID NO: 15599 - DNA, 60 bp, Artificial Sequence
  Description of Artificial Sequence: Synthetic probe
gtacaatagaatgcatcctggcgaaccaagacaccttggacacaactgtcgttaggacat

SEQ ID NO: 15600 - DNA, 60 bp, Artificial Sequence
  Description of Artificial Sequence: Synthetic probe
cccacaggggtggactggtacaatagaatgcatcctggcgaaccaagacaccttggacac

SEQ ID NO: 15601 - DNA, 60 bp, Artificial Sequence
  Description of Artificial Sequence: Synthetic probe
caaagggtacttaaatgggtccacaacaaactaaattgccctctatgggttacaagctgc

SEQ ID NO: 15602 - DNA, 60 bp, Artificial Sequence
  Description of Artificial Sequence: Synthetic probe
taaaaggatcgggagagtaactggtagtgatagtaaattgtaccacatttatgtgtgcat

SEQ ID NO: 15603 - DNA, 60 bp, Artificial Sequence
  Description of Artificial Sequence: Synthetic probe
ggagttattccaggaagcctctatgtgcgagacaactaaaaggatcgggagagtaactgg

SEQ ID NO: 15604 - DNA, 60 bp, Artificial Sequence
  Description of Artificial Sequence: Synthetic probe
ggggacacaattatacaggttatagccatggacaccaaacttgggcctatgccttgcaaa

SEQ ID NO: 15605 - DNA, 60 bp, Artificial Sequence
  Description of Artificial Sequence: Synthetic probe
gataggggacacaattatacaggttatagccatggacaccaaacttgggcctatgccttg

SEQ ID NO: 15606 - DNA, 60 bp, Artificial Sequence
  Description of Artificial Sequence: Synthetic probe
caatagagaaggtgtggccatagtaccacatgggacagtaaagtgcaagataggggacac

SEQ ID NO: 15607 - DNA, 60 bp, Artificial Sequence
  Description of Artificial Sequence: Synthetic probe
tgcaatagagaaggtgtggccatagtaccacatgggacagtaaagtgcaagataggggac

SEQ ID NO: 15608 - DNA, 60 bp, Artificial Sequence
  Description of Artificial Sequence: Synthetic probe
gagaacgagactggctacagagaagtagatgacacctcttgcaatagagaaggtgtggcc

SEQ ID NO: 15609 - DNA, 60 bp, Artificial Sequence
  Description of Artificial Sequence: Synthetic probe
agtgtaggttggagaacgagactggctacagagaagtagatgacacctcttgcaatagag

SEQ ID NO: 15610 - DNA, 59 bp, Artificial Sequence
  Description of Artificial Sequence: Synthetic probe
gtgactggggacatgctacggtatacagggggctctattgaatcctgcaagtggtgtgg

SEQ ID NO: 15611 - DNA, 60 bp, Artificial Sequence
  Description of Artificial Sequence: Synthetic probe
gggaggatctctatgattgtgcccttggaggaaattggacttgtgtgactggggacatgc

SEQ ID NO: 15612 - DNA, 60 bp, Artificial Sequence
  Description of Artificial Sequence: Synthetic probe
tcctgggggaggatctctatgattgtgcccttggaggaaattggacttgtgtgactgggg

SEQ ID NO: 15613 - DNA, 60 bp, Artificial Sequence
  Description of Artificial Sequence: Synthetic probe
caggaggcctgttccattccctcacaggcagaactgcatcacccaaaaagtcctggggga

SEQ ID NO: 15614 - DNA, 60 bp, Artificial Sequence
  Description of Artificial Sequence: Synthetic probe
agggataccttaagaacaacagtagtacggacgtacaggaggcctgttccattccctcac

SEQ ID NO: 15615 - DNA, 60 bp, Artificial Sequence
  Description of Artificial Sequence: Synthetic probe
tgcatgctagttaatagggataccttaagaacaacagtagtacggacgtacaggaggcct

SEQ ID NO: 15616 - DNA, 60 bp, Artificial Sequence
  Description of Artificial Sequence: Synthetic probe
gactggtagatagcacatcttgtaatagggatggtgtggccatagtacaacatggggttc

SEQ ID NO: 15617 - DNA, 60 bp, Artificial Sequence
  Description of Artificial Sequence: Synthetic probe
cagactggtagatagcacatcttgtaatagggatggtgtggccatagtacaacatggggt

SEQ ID NO: 15618 - DNA, 56 bp, Artificial Sequence
  Description of Artificial Sequence: Synthetic probe
gtggcaggaaaccaactggagtatgctgggggcccaatagagtcttgtaagtggtg

SEQ ID NO: 15619 - DNA, 60 bp, Artificial Sequence
  Description of Artificial Sequence: Synthetic probe
ttataggggaagacctccatgactgtatccttggggggaattggacttgtgtggcaggaa

SEQ ID NO: 15620 - DNA, 60 bp, Artificial Sequence
  Description of Artificial Sequence: Synthetic probe
caggaggaccaggccattcccttataggcaaggttgcataacccaaaaagttatagggga

SEQ ID NO: 15621 - DNA, 60 bp, Artificial Sequence
  Description of Artificial Sequence: Synthetic probe
caacaaggacactttggacatagcagtggtacggacatacaggaggaccaggccattccc

SEQ ID NO: 15622 - DNA, 60 bp, Artificial Sequence
  Description of Artificial Sequence: Synthetic probe
tgtgctctagccaacaaggacactttggacatagcagtggtacggacatacaggaggacc

SEQ ID NO: 15623 - DNA, 60 bp, Artificial Sequence
  Description of Artificial Sequence: Synthetic probe
ccaggaagcctctatgtgtgagacaactaaaagggttgggagagtgactggtagtgacag

SEQ ID NO: 15624 - DNA, 60 bp, Artificial Sequence
  Description of Artificial Sequence: Synthetic probe
tggagctattccaggaagcctctatgtgtgagacaactaaaagggttgggagagtgactg

SEQ ID NO: 15625 - DNA, 60 bp, Artificial Sequence
  Description of Artificial Sequence: Synthetic probe
ccgtgagtgggatttacgtgaaaccggggccattattctaccaggattacaaaggacccg

SEQ ID NO: 15626 - DNA, 60 bp, Artificial Sequence
  Description of Artificial Sequence: Synthetic probe
atggagttgattacaaatgaacttttatacaaaacatacaaacaaaaacccgttggagtg

SEQ ID NO: 15627 - DNA, 60 bp, Artificial Sequence
  Description of Artificial Sequence: Synthetic probe
ccaggattatatagggccagtctaccacagagcaccattggagttgttcgaggaagggtc

SEQ ID NO: 15628 - DNA, 60 bp, Artificial Sequence
  Description of Artificial Sequence: Synthetic probe
ggccacaattctaccaggattatatagggccagtctaccacagagcaccattggagttgt

SEQ ID NO: 15629 - DNA, 60 bp, Artificial Sequence
  Description of Artificial Sequence: Synthetic probe
gatgggcctatcaagaagtgcaagtggtgtggctacgactttctcaactctgagggactg

SEQ ID NO: 15630 - DNA, 60 bp, Artificial Sequence
  Description of Artificial Sequence: Synthetic probe
cccaatcggcaagtgcaagctgaagaatgaaagtggctacagactagtagatgaaacctc

SEQ ID NO: 15631 - DNA, 60 bp, Artificial Sequence
  Description of Artificial Sequence: Synthetic probe
gtctgccgcacttcccaatcggcaagtgcaagctgaagaatgaaagtggctacagactag

SEQ ID NO: 15632 - DNA, 60 bp, Artificial Sequence
  Description of Artificial Sequence: Synthetic probe
acgacatcaacgggagtcctctgttcggagagagcagtgaggtacacccgcaatccacac

SEQ ID NO: 15633 - DNA, 60 bp, Artificial Sequence
  Description of Artificial Sequence: Synthetic probe
ttacgacatcaacgggtgcccgctgtttggagagagcagtgaggtacacccgcaatccac

SEQ ID NO: 15634 - DNA, 60 bp, Artificial Sequence
  Description of Artificial Sequence: Synthetic probe
gggctacaactcagggtattactacagtggggaagacccagctaacttgagagtggtaac

SEQ ID NO: 15635 - DNA, 60 bp, Artificial Sequence
  Description of Artificial Sequence: Synthetic probe
ccaagggctacaactcagggtattactacagtggggaagacccagctaacttgagagtgg

SEQ ID NO: 15636 - DNA, 60 bp, Artificial Sequence
  Description of Artificial Sequence: Synthetic probe
ccaagggctacaactcagggtattactacagtggggaagacccggctaacttgagggtgg

SEQ ID NO: 15637 - DNA, 60 bp, Artificial Sequence
  Description of Artificial Sequence: Synthetic probe
agctaagggctacaactcagggtattactacagtggggaagacccagctaacttgagagt

SEQ ID NO: 15638 - DNA, 60 bp, Artificial Sequence
  Description of Artificial Sequence: Synthetic probe
agccaagggctacaactcagggtattactacagtggggaagacccagctaacttgagagt

SEQ ID NO: 15639 - DNA, 58 bp, Artificial Sequence
  Description of Artificial Sequence: Synthetic probe
aaaagtactcaaatgggtccacaacaagctaaactgccccttatgggtttctagctgc

SEQ ID NO: 15640 - DNA, 60 bp, Artificial Sequence
  Description of Artificial Sequence: Synthetic probe
agagatcatcaaaaagtactcaaatgggtccacaacaagctaaactgccccctatgggtt

SEQ ID NO: 15641 - DNA, 60 bp, Artificial Sequence
  Description of Artificial Sequence: Synthetic probe
agagatcatcaaaaagtactcaaatgggtccacaacaagctaaactgccccttatgggtt

SEQ ID NO: 15642 - DNA, 60 bp, Artificial Sequence
  Description of Artificial Sequence: Synthetic probe
caacatcctaaccaatgctaggtccctgccgcggaaaggtgactgccggagaggcaatgt

SEQ ID NO: 15643 - DNA, 60 bp, Artificial Sequence
  Description of Artificial Sequence: Synthetic probe
aacatcctaaccaatgctaggtccctgccgcggaaaggtgactgccgggaaggcaatgtg

SEQ ID NO: 15644 - DNA, 50 bp, Artificial Sequence
  Description of Artificial Sequence: Synthetic probe
gaatacagcctgatagggtgctgcagaggcccactgtattgccactaaaa

SEQ ID NO: 15645 - DNA, 59 bp, Artificial Sequence
  Description of Artificial Sequence: Synthetic probe
ccattggggaagacctctacgactgtgccttaggagggaactggacttgtgtgccgggg

SEQ ID NO: 15646 - DNA, 50 bp, Artificial Sequence
  Description of Artificial Sequence: Synthetic probe
cagaggcccactgtattgctactaaaaatctctgctgtacatggcacatg

SEQ ID NO: 15647 - DNA, 60 bp, Artificial Sequence
  Description of Artificial Sequence: Synthetic probe
ggcacaagccttttccctataggcagggctgtattacccagacaaccattggggaagacc

SEQ ID NO: 15648 - DNA, 60 bp, Artificial Sequence
  Description of Artificial Sequence: Synthetic probe
cctttcccctataggcagggttgtattacccagaaaaccattggggaagacctctacgac

SEQ ID NO: 15649 - DNA, 60 bp, Artificial Sequence
  Description of Artificial Sequence: Synthetic probe
ttgactccatggtacaggtatggtgtgaaggaaaggacttgaaaatattaaggacgtgca

SEQ ID NO: 15650 - DNA, 60 bp, Artificial Sequence
  Description of Artificial Sequence: Synthetic probe
gccatgcccttagtaggactagcaaaaggaggggactagcggtagcagtgagttcattgg

SEQ ID NO: 15651 - DNA, 60 bp, Artificial Sequence
  Description of Artificial Sequence: Synthetic probe
gctgtacactggccaacaaggatacattatccacaaccgttgtacgaacatacaagaggc

SEQ ID NO: 15652 - DNA, 60 bp, Artificial Sequence
  Description of Artificial Sequence: Synthetic probe
gccttccagatggtttgccctataggatggacggggaccgtgagctgtacactggccaac

SEQ ID NO: 15653 - DNA, 60 bp, Artificial Sequence
  Description of Artificial Sequence: Synthetic probe
cccttggtgagaggaaaatttaatgtaacacttttaaatgggccagccttccagatggtt

SEQ ID NO: 15654 - DNA, 60 bp, Artificial Sequence
  Description of Artificial Sequence: Synthetic probe
tgtgatgctaaacccttggtgagaggaaaatttaatgtaacacttttaaatgggccagcc

SEQ ID NO: 15655 - DNA, 60 bp, Artificial Sequence
  Description of Artificial Sequence: Synthetic probe
ggggagttcagatatcgaatcatatgtgagagggaagccaggtatctggccattctacac

SEQ ID NO: 15656 - DNA, 60 bp, Artificial Sequence
  Description of Artificial Sequence: Synthetic probe
gccctcttggagctacgggcctcaccactcagtggtatgtttactcggatggaatgcggc

SEQ ID NO: 15657 - DNA, 60 bp, Artificial Sequence
  Description of Artificial Sequence: Synthetic probe
gatcggccctcttggagctacgggcctcaccactcagtggtatgtttactcggatggaat

SEQ ID NO: 15658 - DNA, 60 bp, Artificial Sequence
  Description of Artificial Sequence: Synthetic probe
tacccagactgtaaacccgacttctcttacgccatagcaaaaaatgaagagatcggccct

SEQ ID NO: 15659 - DNA, 60 bp, Artificial Sequence
  Description of Artificial Sequence: Synthetic probe
cgagatgctacgtggacgagggcatgcccaagacacaccttaaccctggcgggggtcgct

SEQ ID NO: 15660 - DNA, 60 bp, Artificial Sequence
  Description of Artificial Sequence: Synthetic probe
atctgaaaccggggccgttattctaccaggattacaagggacccgtctatcatagagctc

SEQ ID NO: 15661 - DNA, 60 bp, Artificial Sequence
  Description of Artificial Sequence: Synthetic probe
gtgagtgggatctatctgaaaccggggccgttattctaccaggattacagaggacccgtc

SEQ ID NO: 15662 - DNA, 60 bp, Artificial Sequence
  Description of Artificial Sequence: Synthetic probe
gtgttatgaacacagcctgatagggtgtagcagagacctgctattccgctagtaaaaact

SEQ ID NO: 15663 - DNA, 57 bp, Artificial Sequence
  Description of Artificial Sequence: Synthetic probe
gtgttatgaacacagcctgatagggtgtagcagagacctgctattccgctagtaaaa

SEQ ID NO: 15664 - DNA, 60 bp, Artificial Sequence
  Description of Artificial Sequence: Synthetic probe
gcagtcaacactaaaactaccacataaaagaggggagtgtgaagtccccactaatttggc

SEQ ID NO: 15665 - DNA, 60 bp, Artificial Sequence
  Description of Artificial Sequence: Synthetic probe
gtctgcatagatgggtgtgtcctcctgaagagagcaactggagaccaaccagaagtcttc

SEQ ID NO: 15666 - DNA, 60 bp, Artificial Sequence
  Description of Artificial Sequence: Synthetic probe
gtctgcatagatgggtgtgtcctcctgaagagagcaactagggtccaaccagaagtcctc

SEQ ID NO: 15667 - DNA, 60 bp, Artificial Sequence
  Description of Artificial Sequence: Synthetic probe
atttatgtctgcatagatgggtgtgtcctcctgaagagagcaactggagaccaaccagaa

SEQ ID NO: 15668 - DNA, 60 bp, Artificial Sequence
  Description of Artificial Sequence: Synthetic probe
atttatgtctgcatagatgggtgtgtcctcctgaagagagcaactagggtccaaccagaa

SEQ ID NO: 15669 - DNA, 60 bp, Artificial Sequence
  Description of Artificial Sequence: Synthetic probe
cactaaagctaccgcaccagcgaggcagcgctaacatcctgaccaatgctaggtccctgc

SEQ ID NO: 15670 - DNA, 60 bp, Artificial Sequence
  Description of Artificial Sequence: Synthetic probe
acactaaagctaccgcaccagcgaggcagcgctaacatcccgaccaatgctaggtccctg

SEQ ID NO: 15671 - DNA, 60 bp, Artificial Sequence
  Description of Artificial Sequence: Synthetic probe
cgcaatccacactaaagctaccgcaccagcgaggcagcgctaacatcccgaccaatgcta

SEQ ID NO: 15672 - DNA, 60 bp, Artificial Sequence
  Description of Artificial Sequence: Synthetic probe
tacacccgcaatccacactaaagctaccgcaccagcgaggcagcgctaacatcctgacca

SEQ ID NO: 15673 - DNA, 60 bp, Artificial Sequence
  Description of Artificial Sequence: Synthetic probe
tacaaaacatacaaacaaaaacccgctggagtggaggaaccagtttatgaccgaacaggt

SEQ ID NO: 15674 - DNA, 60 bp, Artificial Sequence
  Description of Artificial Sequence: Synthetic probe
tacaaaacatacaaacaaaaacccgctggagtggaggaaccggtctacgaccgaccaggt

SEQ ID NO: 15675 - DNA, 60 bp, Artificial Sequence
  Description of Artificial Sequence: Synthetic probe
gcaggggtcgctcaggtgaaagcgggtaaactacccgttacggacacagcctgatagggt

SEQ ID NO: 15676 - DNA, 60 bp, Artificial Sequence
  Description of Artificial Sequence: Synthetic probe
ccagggccgctgttttaccaggactacattggacctgtctaccatagggccccattggag

SEQ ID NO: 15677 - DNA, 60 bp, Artificial Sequence
  Description of Artificial Sequence: Synthetic probe
cctgggcctctgttttatcaggactatattggacctgtctaccatagggccccattggag

SEQ ID NO: 15678 - DNA, 60 bp, Artificial Sequence
  Description of Artificial Sequence: Synthetic probe
accagggccgctgttttaccaggactacattggacctgtctaccatagggccccattgga

SEQ ID NO: 15679 - DNA, 60 bp, Artificial Sequence
  Description of Artificial Sequence: Synthetic probe
acctgggcctctgttttatcaggactatattggacctgtctaccatagggccccattgga

SEQ ID NO: 15680 - DNA, 53 bp, Artificial Sequence
  Description of Artificial Sequence: Synthetic probe
aaaagaggtgactgcaggtcgggcaatagcaaaggacctgtgagtggaatcta

SEQ ID NO: 15681 - DNA, 60 bp, Artificial Sequence
  Description of Artificial Sequence: Synthetic probe
taccaaaaagaggtgactgcaggtcgggcaatagcaaaggacctgtgagtggaatctatc

SEQ ID NO: 15682 - DNA, 60 bp, Artificial Sequence
  Description of Artificial Sequence: Synthetic probe
ccaactgttacgaatacagcctgatagggtgctgcagaggcccactgtactgctactaaa

SEQ ID NO: 15683 - DNA, 60 bp, Artificial Sequence
  Description of Artificial Sequence: Synthetic probe
gagtgactggtagtgacagtaaattgtaccacatttatgtgtgcatagatggatgcataa

SEQ ID NO: 15684 - DNA, 60 bp, Artificial Sequence
  Description of Artificial Sequence: Synthetic probe
agagtgactggtagtgacagtaaattgtaccacatttatgtgtgcatagatggatgcata

SEQ ID NO: 15685 - DNA, 60 bp, Artificial Sequence
  Description of Artificial Sequence: Synthetic probe
gggagagtaactggtagtgatagtaaattgtaccacatttatgtgtgcatagatggatgc

SEQ ID NO: 15686 - DNA, 60 bp, Artificial Sequence
  Description of Artificial Sequence: Synthetic probe
cataaaggtctcgagatgccacgtggacgagggcatgcccagagcacatcttaacctgag

SEQ ID NO: 15687 - DNA, 60 bp, Artificial Sequence
  Description of Artificial Sequence: Synthetic probe
aaatgcaagctgaagaatgaaagtggctacagacaagtagatgagacctcttgtaacaga

SEQ ID NO: 15688 - DNA, 60 bp, Artificial Sequence
  Description of Artificial Sequence: Synthetic probe
gccaactggaacaatgaaatgcaagataggagacacagtggtgcaggtcatagctatgga

SEQ ID NO: 15689 - DNA, 60 bp, Artificial Sequence
  Description of Artificial Sequence: Synthetic probe
agtgccaactggaacaatgaaatgcaagataggagacacagtggtgcaggtcatagctat

SEQ ID NO: 15690 - DNA, 60 bp, Artificial Sequence
  Description of Artificial Sequence: Synthetic probe
aagacctaccacactaccccattggtaagtgcaggctaaaaaatgagacaggctaccgac

SEQ ID NO: 15691 - DNA, 60 bp, Artificial Sequence
  Description of Artificial Sequence: Synthetic probe
cctgcatattaggaggcaactggacgtgtatcgtgggggaccagttgagatatacagggg

SEQ ID NO: 15692 - DNA, 60 bp, Artificial Sequence
  Description of Artificial Sequence: Synthetic probe
ccaaggtacggacatataggaggaccaagccattcccttacaggcagggttgtaccacac

SEQ ID NO: 15693 - DNA, 60 bp, Artificial Sequence
  Description of Artificial Sequence: Synthetic probe
caccctagatttgaccaaggtacggacatataggaggaccaagccattcccttacaggca

SEQ ID NO: 15694 - DNA, 60 bp, Artificial Sequence
  Description of Artificial Sequence: Synthetic probe
gcccaaagtgtggtagacagggaaagcccataacatgtggaatgacactcgcagacttgg

SEQ ID NO: 15695 - DNA, 60 bp, Artificial Sequence
  Description of Artificial Sequence: Synthetic probe
actgcccaaagtgtggtagacagggaaagcccataacatgtggaatgacactcgcagact

SEQ ID NO: 15696 - DNA, 60 bp, Artificial Sequence
  Description of Artificial Sequence: Synthetic probe
cctcagcaaaagtgtgcactgcatagtttgcacaatctgtgaagggaaagattggaatgg

SEQ ID NO: 15697 - DNA, 60 bp, Artificial Sequence
  Description of Artificial Sequence: Synthetic probe
gaaagtggctacagacaagtagatgagacctcttgcaacatagacggtgtggctatagtg

SEQ ID NO: 15698 - DNA, 60 bp, Artificial Sequence
  Description of Artificial Sequence: Synthetic probe
cctgttgggtggtagatacgtgctatggttgctggtcacgtatatggttttatcagaaca

SEQ ID NO: 15699 - DNA, 60 bp, Artificial Sequence
  Description of Artificial Sequence: Synthetic probe
ggcgtgcaccttcaattatacaaggacattaaacaacaaatacttcgagcctagggacag

SEQ ID NO: 15700 - DNA, 60 bp, Artificial Sequence
  Description of Artificial Sequence: Synthetic probe
aactcgggcctatgccttgcagaccacatgagatcatatcaagtgagggacctgtggaaa

SEQ ID NO: 15701 - DNA, 60 bp, Artificial Sequence
  Description of Artificial Sequence: Synthetic probe
agatacggttgtacaggttattgctttggacaccaaactcgggcctatgccttgcagacc

SEQ ID NO: 15702 - DNA, 60 bp, Artificial Sequence
  Description of Artificial Sequence: Synthetic probe
gaaatgcaggataggagatacggttgtacaggttattgctttggacaccaaactcgggcc

SEQ ID NO: 15703 - DNA, 60 bp, Artificial Sequence
  Description of Artificial Sequence: Synthetic probe
agggacggtgtggccatagtaccacaggggacagtgaaatgcaggataggagatacggtt

SEQ ID NO: 15704 - DNA, 60 bp, Artificial Sequence
  Description of Artificial Sequence: Synthetic probe
gacacttcttgcaatagggacggtgtggccatagtaccacaggggacagtgaaatgcagg

SEQ ID NO: 15705 - DNA, 60 bp, Artificial Sequence
  Description of Artificial Sequence: Synthetic probe
cgattggcaagtgtaagctagagaatgagactggctacaggctagtggatgacacttctt

SEQ ID NO: 15706 - DNA, 60 bp, Artificial Sequence
  Description of Artificial Sequence: Synthetic probe
acatataggaggtccaaaccattcccctacagacaaggctgtatcacccaaaaagtcgta

SEQ ID NO: 15707 - DNA, 60 bp, Artificial Sequence
  Description of Artificial Sequence: Synthetic probe
acggggcggccttccaaatggtatgtcccataggatggacggggtctgtcagctgtatgc

SEQ ID NO: 15708 - DNA, 60 bp, Artificial Sequence
  Description of Artificial Sequence: Synthetic probe
atgtgatgccagacccgtagtgagagggaaattcaatacaactctgctaaacggggcggc

SEQ ID NO: 15709 - DNA, 58 bp, Artificial Sequence
  Description of Artificial Sequence: Synthetic probe
ccagatatctggcaatcttgcatagaagagccctaccaacctctgtagtatttagaaa

SEQ ID NO: 15710 - DNA, 60 bp, Artificial Sequence
  Description of Artificial Sequence: Synthetic probe
tacccagactgtagacctgatttctcatacgccatagcaaaggatgaaaagattggccct

SEQ ID NO: 15711 - DNA, 60 bp, Artificial Sequence
  Description of Artificial Sequence: Synthetic probe
caattctagcgacgaagatgaagctactaatggtggggaaccttggcgcggaagttggcg

SEQ ID NO: 15712 - DNA, 60 bp, Artificial Sequence
  Description of Artificial Sequence: Synthetic probe
ccaattctagcgacgaagatgaagctactaatggtggggaaccttggcgcggaagttggc

SEQ ID NO: 15713 - DNA, 60 bp, Artificial Sequence
  Description of Artificial Sequence: Synthetic probe
ggttcgacactccatcaatcgaggagtctcgagatgccatgtggacgagggcatgcccac

SEQ ID NO: 15714 - DNA, 60 bp, Artificial Sequence
  Description of Artificial Sequence: Synthetic probe
ggttcgacactccattaaccgaggagtctcgagatgccatgtggacgagggcatgcccac

SEQ ID NO: 15715 - DNA, 60 bp, Artificial Sequence
  Description of Artificial Sequence: Synthetic probe
ggtgttggggttacagcctgatagggtgctgcagaggcccacttataggctagtataaaa

SEQ ID NO: 15716 - DNA, 60 bp, Artificial Sequence
  Description of Artificial Sequence: Synthetic probe
ggtgttggggttacagcctgatagggtgctgcagaggcccactcataggctagtataaaa

SEQ ID NO: 15717 - DNA, 60 bp, Artificial Sequence
  Description of Artificial Sequence: Synthetic probe
ccggtgttggggttacagcctgatagggtgctgcagaggcccacgtataggctagtataa

SEQ ID NO: 15718 - DNA, 60 bp, Artificial Sequence
  Description of Artificial Sequence: Synthetic probe
atggagttgattacaaatgaacttttatacaaaacatacaaacaaaaacccgccggggtg

SEQ ID NO: 15719 - DNA, 56 bp, Artificial Sequence
  Description of Artificial Sequence: Synthetic probe
cgttattctaccaggattacaaaggacccgtctatcatagagctccattggagttc

SEQ ID NO: 15720 - DNA, 60 bp, Artificial Sequence
  Description of Artificial Sequence: Synthetic probe
ttacaaaggacccgtctatcatagagctccattggagttatttcaggaagcctctatgtg

SEQ ID NO: 15721 - DNA, 60 bp, Artificial Sequence
  Description of Artificial Sequence: Synthetic probe
gcatgcccacggcacatcttagcctatgcgggggttgcgtaggtgaaagcaccaccttgt

SEQ ID NO: 15722 - DNA, 60 bp, Artificial Sequence
  Description of Artificial Sequence: Synthetic probe
ggttcgacgctctggcaatgaaagagcctcgatatgccatgtggacgagggcatgcccac

SEQ ID NO: 15723 - DNA, 60 bp, Artificial Sequence
  Description of Artificial Sequence: Synthetic probe
ccggtctactaccaggactatgcggggcccgtctatcatagagccccactggaactatgt

SEQ ID NO: 15724 - DNA, 60 bp, Artificial Sequence
  Description of Artificial Sequence: Synthetic probe
gaccggtctactaccaggactatgcggggcccgtctatcatagagccccactggaactat

SEQ ID NO: 15725 - DNA, 60 bp, Artificial Sequence
  Description of Artificial Sequence: Synthetic probe
caggaccgatctactatcaggactatgcggggcccgtctatcatagagccccactggaac

SEQ ID NO: 15726 - DNA, 60 bp, Artificial Sequence
  Description of Artificial Sequence: Synthetic probe
tgcaagctgaagaatgaaagtggctacagacaagtagatgagaccccttgcaacagaaac

SEQ ID NO: 15727 - DNA, 60 bp, Artificial Sequence
  Description of Artificial Sequence: Synthetic probe
gagatgccatgtggacgagggcatgcccacggcacatcttaacccatgcgggggttgcat

SEQ ID NO: 15728 - DNA, 60 bp, Artificial Sequence
  Description of Artificial Sequence: Synthetic probe
gagacctcttgcaacagagacggcgtggctatagtgctaactggtcgggtgaaatgcagg

SEQ ID NO: 15729 - DNA, 60 bp, Artificial Sequence
  Description of Artificial Sequence: Synthetic probe
gtctgccacacttcccaatcggcaagtgcaaactgaagaatgaaagtggctacagacaag

SEQ ID NO: 15730 - DNA, 57 bp, Artificial Sequence
  Description of Artificial Sequence: Synthetic probe
ggaccaattacggtatgtagatgggcctgtcgagtcttgcaagtggtgtggttataa

SEQ ID NO: 15731 - DNA, 60 bp, Artificial Sequence
  Description of Artificial Sequence: Synthetic probe
tgtgcactggccaataaggatacattagccatgaccattgtacggacatacaagaggtac

SEQ ID NO: 15732 - DNA, 60 bp, Artificial Sequence
  Description of Artificial Sequence: Synthetic probe
aaagtgagggcctgccacacttcccaatcggcaagtgcaagctgaagaatgaaagtggct

SEQ ID NO: 15733 - DNA, 60 bp, Artificial Sequence
  Description of Artificial Sequence: Synthetic probe
gttacaagtttgttaaaagtgagggcctgccacacttcccaatcggcaagtgcaagctga

SEQ ID NO: 15734 - DNA, 60 bp, Artificial Sequence
  Description of Artificial Sequence: Synthetic probe
gttacaaatttgttaaaagtgagggcctgccacacttcccaatcggcaagtgcaagctga

SEQ ID NO: 15735 - DNA, 60 bp, Artificial Sequence
  Description of Artificial Sequence: Synthetic probe
tgtagatgggcctgttgagtcttgcaagtggtgtggttacaagtttgttaaaagtgaggg

SEQ ID NO: 15736 - DNA, 60 bp, Artificial Sequence
  Description of Artificial Sequence: Synthetic probe
tgtagatgggcctgttgagtcttgcaagtggtgtggttacaaatttgttaaaagtgaggg

SEQ ID NO: 15737 - DNA, 60 bp, Artificial Sequence
  Description of Artificial Sequence: Synthetic probe
ggaccaattacgatatgtagatgggcctgttgagtcttgcaagtggtgtggttacaaatt

SEQ ID NO: 15738 - DNA, 60 bp, Artificial Sequence
  Description of Artificial Sequence: Synthetic probe
ggaccaattacgatatgtagatgggcctgttgagtcttgcaagtggtgtggttacaagtt

SEQ ID NO: 15739 - DNA, 60 bp, Artificial Sequence
  Description of Artificial Sequence: Synthetic probe
gggaagacctctacaactgtgccttaggagggaactggacttgtgtgccaggggaagaac

SEQ ID NO: 15740 - DNA, 60 bp, Artificial Sequence
  Description of Artificial Sequence: Synthetic probe
ttggggaagacctctacaactgtgccttaggagggaactggacttgtgtgccaggggaag

SEQ ID NO: 15741 - DNA, 51 bp, Artificial Sequence
  Description of Artificial Sequence: Synthetic probe
ttagacacaaccgttgtgcgaacgtacaagagggacaggccttttccctac

SEQ ID NO: 15742 - DNA, 53 bp, Artificial Sequence
  Description of Artificial Sequence: Synthetic probe
cgttagccacaaccattgtgcgaacgtacaagagggacaggccttttccgtat

SEQ ID NO: 15743 - DNA, 60 bp, Artificial Sequence
  Description of Artificial Sequence: Synthetic probe
ggtgaaagcgccatccgtggcgttatggacacagcctgatagggtgtagcagagacctgc

SEQ ID NO: 15744 - DNA, 52 bp, Artificial Sequence
  Description of Artificial Sequence: Synthetic probe
atagcaagttgaaagatgggcctatcaagaagtgtaagtggtgcggctatga

SEQ ID NO: 15745 - DNA, 60 bp, Artificial Sequence
  Description of Artificial Sequence: Synthetic probe
gtggtgcggttacagattcctaaagggtgaggggctaccacattacccgattggcaagtg

SEQ ID NO: 15746 - DNA, 60 bp, Artificial Sequence
  Description of Artificial Sequence: Synthetic probe
caagtggtgcggttacagattcctaaagggtgaggggctaccacattacccgattggcaa

SEQ ID NO: 15747 - DNA, 60 bp, Artificial Sequence
  Description of Artificial Sequence: Synthetic probe
tttctgaggaacctaccaattctagcgacgaagatgaagctactaatggtggggaacctt

SEQ ID NO: 15748 - DNA, 60 bp, Artificial Sequence
  Description of Artificial Sequence: Synthetic probe
aacaaggcctcgagatgccacgtggacgagggcatgcccaaagcacatcttaacctgggc

SEQ ID NO: 15749 - DNA, 60 bp, Artificial Sequence
  Description of Artificial Sequence: Synthetic probe
agttcaacgcaatatggaattgccttgagatgctacgtggacgagggcatgcccaagacg

SEQ ID NO: 15750 - DNA, 56 bp, Artificial Sequence
  Description of Artificial Sequence: Synthetic probe
gtaagtgcatgctcatcaatgagagtgggtacaggtatgtagatgacacctcttgc

SEQ ID NO: 15751 - DNA, 56 bp, Artificial Sequence
  Description of Artificial Sequence: Synthetic probe
gtaagtgcatgctcagcaatgagagtgggtacaggtatgtagatgacacctcttgc

SEQ ID NO: 15752 - DNA, 60 bp, Artificial Sequence
  Description of Artificial Sequence: Synthetic probe
gaaagcagtctaaccaactgctacggatacagcctgatagggtgctgcaggggcccactg

SEQ ID NO: 15753 - DNA, 60 bp, Artificial Sequence
  Description of Artificial Sequence: Synthetic probe
atgcccatagtaggactagcaaaaagaggggactagcggtagcagtgagttcattggatg

SEQ ID NO: 15754 - DNA, 60 bp, Artificial Sequence
  Description of Artificial Sequence: Synthetic probe
cggggttgctatagtaccatctggccatgtgaaatgcaggatagggaatacggtggtgca

SEQ ID NO: 15755 - DNA, 60 bp, Artificial Sequence
  Description of Artificial Sequence: Synthetic probe
gagacggggttgctatagtaccatctggccatgtgaaatgcaggatagggaatacggtgg

SEQ ID NO: 15756 - DNA, 60 bp, Artificial Sequence
  Description of Artificial Sequence: Synthetic probe
ggggatccattacgatatgtagatgggcctgtggagtcgtgcaagtggtgtggttacaag

SEQ ID NO: 15757 - DNA, 60 bp, Artificial Sequence
  Description of Artificial Sequence: Synthetic probe
gtgccgggggatccattacgatatgtagatgggcctgtggagtcgtgcaagtggtgtggt

SEQ ID NO: 15758 - DNA, 60 bp, Artificial Sequence
  Description of Artificial Sequence: Synthetic probe
ggcacaagccctttccctatagacatggttgtattacccagaaaaccattggggaagacc

SEQ ID NO: 15759 - DNA, 60 bp, Artificial Sequence
  Description of Artificial Sequence: Synthetic probe
caagaggcacaagccctttccctatagacatggttgtattacccagaaaaccattgggga

SEQ ID NO: 15760 - DNA, 60 bp, Artificial Sequence
  Description of Artificial Sequence: Synthetic probe
ctggctaataaggatacgttagccacaactgttgtacgaacatacaagaggcacaagccc

SEQ ID NO: 15761 - DNA, 60 bp, Artificial Sequence
  Description of Artificial Sequence: Synthetic probe
tgcacactggctaataaggatacgttagccacaactgttgtacgaacatacaagaggcac

SEQ ID NO: 15762 - DNA, 60 bp, Artificial Sequence
  Description of Artificial Sequence: Synthetic probe
ggggctgagctacggtatgcaggtgggcccgtcgagtcttgtaagtggtgtggttacaaa

SEQ ID NO: 15763 - DNA, 60 bp, Artificial Sequence
  Description of Artificial Sequence: Synthetic probe
ggggatacagtggtgcaagtcattgcaatggatgataaactagggcctatgccttgcaaa

SEQ ID NO: 15764 - DNA, 60 bp, Artificial Sequence
  Description of Artificial Sequence: Synthetic probe
atgcaagataggggatacagtggtgcaagtcattgcaatggatgataaactagggcctat

SEQ ID NO: 15765 - DNA, 60 bp, Artificial Sequence
  Description of Artificial Sequence: Synthetic probe
ggtttaaccaaccgctacgaatacagcctgatagggtgctgcagaggcccactgtatcgc

SEQ ID NO: 15766 - DNA, 60 bp, Artificial Sequence
  Description of Artificial Sequence: Synthetic probe
tgcatgctggccaataaggatacgttagccacaaccgttgtacgaacatacaataggcac

SEQ ID NO: 15767 - DNA, 60 bp, Artificial Sequence
  Description of Artificial Sequence: Synthetic probe
tgcacactggccaataaggatacgttagccacaaccgttgtacggacatacaagaggcac

SEQ ID NO: 15768 - DNA, 60 bp, Artificial Sequence
  Description of Artificial Sequence: Synthetic probe
ccatttatatggtgtgatgaacacagcctgatagggcgtagcagagacctgctatcccgc

SEQ ID NO: 15769 - DNA, 60 bp, Artificial Sequence
  Description of Artificial Sequence: Synthetic probe
gcaccatttatatggtgtgatgaacacagcctgatagggccgtagcagagacctgctatc

SEQ ID NO: 15770 - DNA, 60 bp, Artificial Sequence
  Description of Artificial Sequence: Synthetic probe
ttggagtggaggaaccagtttacgatcaagctggtaaccctttgtttggcgaaagaggag

SEQ ID NO: 15771 - DNA, 60 bp, Artificial Sequence
  Description of Artificial Sequence: Synthetic probe
ttggagtggaggaaccagtttacgaccaagctggtaaccctttgtttggcgaaagaggag

SEQ ID NO: 15772 - DNA, 60 bp, Artificial Sequence
  Description of Artificial Sequence: Synthetic probe
acaaacaaaaaccaattggagtggaggaaccagtttacgatcaagctggtaaccctttgt

SEQ ID NO: 15773 - DNA, 60 bp, Artificial Sequence
  Description of Artificial Sequence: Synthetic probe
acaaacaaaaaccaattggagtggaggaaccagtttacgaccaagctggtaaccctttgt

SEQ ID NO: 15774 - DNA, 60 bp, Artificial Sequence
  Description of Artificial Sequence: Synthetic probe
ctactatcaggactatgcggggcccgtctatcatagagccccactggaattatgtagaga

SEQ ID NO: 15775 - DNA, 60 bp, Artificial Sequence
  Description of Artificial Sequence: Synthetic probe
taagaggactgtcccattccctaacaggcaaggttgtgtcactcaaaaacttctggggga

SEQ ID NO: 15776 - DNA, 60 bp, Artificial Sequence
  Description of Artificial Sequence: Synthetic probe
agagggcaactctttctgaggaacctaccaattctagcgacgaagatgaagctactaatg

SEQ ID NO: 15777 - DNA, 60 bp, Artificial Sequence
  Description of Artificial Sequence: Synthetic probe
gccagaggacaactctttctgaggaacctaccaattctagcgacgaagatgaagctacta

SEQ ID NO: 15778 - DNA, 60 bp, Artificial Sequence
  Description of Artificial Sequence: Synthetic probe
cacagccagaggacaactctttctgaggaacctaccaattctagcgacgaagatgaagct

SEQ ID NO: 15779 - DNA, 60 bp, Artificial Sequence
  Description of Artificial Sequence: Synthetic probe
cgcagccagagggcaactctttctgaggaacctaccaattctagcgacgaagatgaagct

SEQ ID NO: 15780 - DNA, 60 bp, Artificial Sequence
  Description of Artificial Sequence: Synthetic probe
gtccaatacacagccagaggacaactctttctgaggaacctaccaattctagcgacgaag

SEQ ID NO: 15781 - DNA, 60 bp, Artificial Sequence
  Description of Artificial Sequence: Synthetic probe
atcctgaccaatgctaggtccctgccgcggaaaggtgactgccggaaaggcaacatcaat

SEQ ID NO: 15782 - DNA, 60 bp, Artificial Sequence
  Description of Artificial Sequence: Synthetic probe
gaagtgcaaaatcggagacacagtggtacaggtcactgcaatggatacaaaacttggacc

SEQ ID NO: 15783 - DNA, 60 bp, Artificial Sequence
  Description of Artificial Sequence: Synthetic probe
agggatggtgtagcaatagtgccacatggactcgtgaagtgcaaaatcggagacacagtg

SEQ ID NO: 15784 - DNA, 60 bp, Artificial Sequence
  Description of Artificial Sequence: Synthetic probe
gacacctcttgtaatagggatggtgtagcaatagtgccacatggactcgtgaagtgcaaa

SEQ ID NO: 15785 - DNA, 54 bp, Artificial Sequence
  Description of Artificial Sequence: Synthetic probe
ttttgaagagtgaaggactaccacactatccaattggcaaatgcaggttgaaaa

SEQ ID NO: 15786 - DNA, 60 bp, Artificial Sequence
  Description of Artificial Sequence: Synthetic probe
caagtggtgcggctacaagtttttgaagagtgaaggactaccacactatccaattggcaa

SEQ ID NO: 15787 - DNA, 60 bp, Artificial Sequence
  Description of Artificial Sequence: Synthetic probe
tgtatagtaggaggacagctacattacacagggggtgccatagagtcatgcaagtggtgc

SEQ ID NO: 15788 - DNA, 60 bp, Artificial Sequence
  Description of Artificial Sequence: Synthetic probe
gggaagacctctataactgtgtcctgggaggaaactggacttgtatagtaggaggacagc

SEQ ID NO: 15789 - DNA, 60 bp, Artificial Sequence
  Description of Artificial Sequence: Synthetic probe
aacttctaggggaagacctctataactgtgtcctgggaggaaactggacttgtatagtag

SEQ ID NO: 15790 - DNA, 60 bp, Artificial Sequence
  Description of Artificial Sequence: Synthetic probe
cctagccaataaggacaccttagacgcggccgtagtgcggacgtataagagggttggccc

SEQ ID NO: 15791 - DNA, 60 bp, Artificial Sequence
  Description of Artificial Sequence: Synthetic probe
tgcgtcctagccaataaggacaccttagacgcggccgtagtgcggacgtataagagggtt

SEQ ID NO: 15792 - DNA, 60 bp, Artificial Sequence
  Description of Artificial Sequence: Synthetic probe
ccacatttatgtgtgtattgatggatgtataatagttaagagtgctacaagagatcgcca

SEQ ID NO: 15793 - DNA, 57 bp, Artificial Sequence
  Description of Artificial Sequence: Synthetic probe
ctgagaggaggaggtgttcttgtgtgcaaaaagataactgaacacgaaaaatgccat

SEQ ID NO: 15794 - DNA, 60 bp, Artificial Sequence
  Description of Artificial Sequence: Synthetic probe
gtaaagatgctcatggtaggcaatctaggggaggaaatcggggatttggaacaccttggt

SEQ ID NO: 15795 - DNA, 60 bp, Artificial Sequence
  Description of Artificial Sequence: Synthetic probe
attccagcaaccaaagtaaagatgctcatggtaggcaatctaggggaggaaatcggggat

SEQ ID NO: 15796 - DNA, 60 bp, Artificial Sequence
  Description of Artificial Sequence: Synthetic probe
ggggattggagttcgtgaagtctcaagcagagaagatacctattccagcaaccaaagtaa

SEQ ID NO: 15797 - DNA, 60 bp, Artificial Sequence
  Description of Artificial Sequence: Synthetic probe
atgcatctgggggattggagttcgtgaagtctcaagcagagaagatacctattccagcaa

SEQ ID NO: 15798 - DNA, 60 bp, Artificial Sequence
  Description of Artificial Sequence: Synthetic probe
ggggaaccttggcgcggaagttggcgacctggagcacctgggatgggtactgagagggcc

SEQ ID NO: 15799 - DNA, 60 bp, Artificial Sequence
  Description of Artificial Sequence: Synthetic probe
taatggtggggaaccttggcgcggaagttggcgacctggagcacctgggatgggtactga

SEQ ID NO: 15800 - DNA, 60 bp, Artificial Sequence
  Description of Artificial Sequence: Synthetic probe
gctactaatggtggggaaccttggcgcggaagttggcgacctggagcacctgggatgggt

SEQ ID NO: 15801 - DNA, 60 bp, Artificial Sequence
  Description of Artificial Sequence: Synthetic probe
agatgaagctactaatggtggggaaccttggcgcggaagttggcgacctggagcacctgg

SEQ ID NO: 15802 - DNA, 60 bp, Artificial Sequence
  Description of Artificial Sequence: Synthetic probe
agggttacatccaatacgcagccagagggcaactctttctgaggaacctaccaattctag

SEQ ID NO: 15803 - DNA, 60 bp, Artificial Sequence
  Description of Artificial Sequence: Synthetic probe
cgtggtgagatccctgagcggtctaagccctgagtacagggcagtcgtcagtagttcgac

SEQ ID NO: 15804 - DNA, 60 bp, Artificial Sequence
  Description of Artificial Sequence: Synthetic probe
gccatcgtggtgagatccctgagcggtctaagccctgagtacagggcagtcgtcagtagt

SEQ ID NO: 15805 - DNA, 60 bp, Artificial Sequence
  Description of Artificial Sequence: Synthetic probe
cgtcgtggtgagatccctgagcggtctaagccctgagtacagggcagtcgtcagtagttc

SEQ ID NO: 15806 - DNA, 60 bp, Artificial Sequence
  Description of Artificial Sequence: Synthetic probe
gccgtcgtggtgagatccctgagcagtctaagccctgagtacagggcagtcgtcagtagt

SEQ ID NO: 15807 - DNA, 60 bp, Artificial Sequence
  Description of Artificial Sequence: Synthetic probe
tgcatcctagccaataaggacaccctaaatatggttgtagtgcggacgtataagagggtt

SEQ ID NO: 15808 - DNA, 60 bp, Artificial Sequence
  Description of Artificial Sequence: Synthetic probe
ggggatgatggacgcgagtgagaagaccaactacacgtgttgcaggttgcaaaggcatga

SEQ ID NO: 15809 - DNA, 60 bp, Artificial Sequence
  Description of Artificial Sequence: Synthetic probe
atcttaactaatgttaggtccctgccgcagaaaggtgactgccggaaaggcaatgtgaat

SEQ ID NO: 15810 - DNA, 60 bp, Artificial Sequence
  Description of Artificial Sequence: Synthetic probe
acccagagcctatccagcttgcatataacagttatgaggtccaagtccctgtgctgttcc

SEQ ID NO: 15811 - DNA, 60 bp, Artificial Sequence
  Description of Artificial Sequence: Synthetic probe
aagaatggctgtcaccgtgggcgaacaggctcagcggagaggcagggtaggtagagtgaa

SEQ ID NO: 15812 - DNA, 58 bp, Artificial Sequence
  Description of Artificial Sequence: Synthetic probe
tatagtgccatctggccgggtcaaatgcaagataggggacacagtggtacaagtcatc

SEQ ID NO: 15813 - DNA, 60 bp, Artificial Sequence
  Description of Artificial Sequence: Synthetic probe
agacggcgtggccgtagtgccatctggccgggtcaaatgcaagataggggatacagtggt

SEQ ID NO: 15814 - DNA, 60 bp, Artificial Sequence
  Description of Artificial Sequence: Synthetic probe
aatagagacggcgtggctatagtgccatctggccgggtcaaatgcaagataggggacaca

SEQ ID NO: 15815 - DNA, 60 bp, Artificial Sequence
  Description of Artificial Sequence: Synthetic probe
acttcttgcaacagagacggcgtggccgtagtgccatctggccgggtcaaatgcaagata

SEQ ID NO: 15816 - DNA, 60 bp, Artificial Sequence
  Description of Artificial Sequence: Synthetic probe
acttcttgcaacagagatggtgtggctatagtgccatctggccgggtcaaatgcaagata

SEQ ID NO: 15817 - DNA, 60 bp, Artificial Sequence
  Description of Artificial Sequence: Synthetic probe
acttcttgcaacatagatggtgtggctatagtgccatctggccgggtcaaatgcaagata

SEQ ID NO: 15818 - DNA, 60 bp, Artificial Sequence
  Description of Artificial Sequence: Synthetic probe
gaccaagcaggcaaccccttgttcggcgagagaggagtggttcatccgcaggcaacacta

SEQ ID NO: 15819 - DNA, 60 bp, Artificial Sequence
  Description of Artificial Sequence: Synthetic probe
aagactggagaacaagagtaagacatggttcggggcatatgcagcctccccatactgtga

SEQ ID NO: 15820 - DNA, 60 bp, Artificial Sequence
  Description of Artificial Sequence: Synthetic probe
aaaagactggagaacaagagtaagacatggttcggggcatatgcagcctccccatactgt

SEQ ID NO: 15821 - DNA, 60 bp, Artificial Sequence
  Description of Artificial Sequence: Synthetic probe
gacgggatgaccaactccctggagaacgccaggcaagggactgcaaaactaacaacctgg

SEQ ID NO: 15822 - DNA, 53 bp, Artificial Sequence
  Description of Artificial Sequence: Synthetic probe
aaagaggggactagcggtagcagtgagttcattggatggccgaatccctgagt

SEQ ID NO: 15823 - DNA, 60 bp, Artificial Sequence
  Description of Artificial Sequence: Synthetic probe
gatgggatgaccaactccctagaaagtgccaggcaagggactgcaaaactaacaacctgg

SEQ ID NO: 15824 - DNA, 60 bp, Artificial Sequence
  Description of Artificial Sequence: Synthetic probe
acaagacccaagctaatcttacagagggtcaaccaccgagagagtgcgccgtcacgtgca

SEQ ID NO: 15825 - DNA, 60 bp, Artificial Sequence
  Description of Artificial Sequence: Synthetic probe
tgggtttcaataatgaacaagacccaagctaatcttacagagggtcaaccaccaagagag

SEQ ID NO: 15826 - DNA, 60 bp, Artificial Sequence
  Description of Artificial Sequence: Synthetic probe
atgggacagaagggatacaacgggcgatgttccaaaggggcgtgaataggagcctacacg

SEQ ID NO: 15827 - DNA, 60 bp, Artificial Sequence
  Description of Artificial Sequence: Synthetic probe
aagtcacgatgggtgaaaacataacacagtggaacctaaaggataatgggacagaaggga

SEQ ID NO: 15828 - DNA, 60 bp, Artificial Sequence
  Description of Artificial Sequence: Synthetic probe
atagcaaagggcctgtgagtggaatctatttaaaaccagggccgttattctaccaggatt

SEQ ID NO: 15829 - DNA, 60 bp, Artificial Sequence
  Description of Artificial Sequence: Synthetic probe
gacgagggcatgcccacagcacatcttaacctggacgggggtcgttcaggtaaaaacggt

SEQ ID NO: 15830 - DNA, 60 bp, Artificial Sequence
  Description of Artificial Sequence: Synthetic probe
gacgagggcatgcccacagcacatcttaacctggacgggggtcgttcaggtgaaaacggt

SEQ ID NO: 15831 - DNA, 60 bp, Artificial Sequence
  Description of Artificial Sequence: Synthetic probe
taatgttaggtccctgccgcggaaaggtgactgccggaaaggcaatgtgaatggagcagt

SEQ ID NO: 15832 - DNA, 60 bp, Artificial Sequence
  Description of Artificial Sequence: Synthetic probe
gcgtaaatagaagtctgcatgggatctggccagagaaaatctgtacaggtgtcccctccc

SEQ ID NO: 15833 - DNA, 51 bp, Artificial Sequence
  Description of Artificial Sequence: Synthetic probe
ttgaagagtgaagggctaccacattatccaattggcaaatgcaggttaaaa

SEQ ID NO: 15834 - DNA, 60 bp, Artificial Sequence
  Description of Artificial Sequence: Synthetic probe
ctggggtgaaaacaccttatagtgttggtatcacagcctgatagggtgctgcagaggccc

SEQ ID NO: 15835 - DNA, 60 bp, Artificial Sequence
  Description of Artificial Sequence: Synthetic probe
tctcctgggtggtagatacgtgctatggttactggtcacgtatatggttttatcagaaca

SEQ ID NO: 15836 - DNA, 60 bp, Artificial Sequence
  Description of Artificial Sequence: Synthetic probe
aaaccgcatgtaccttcaattacacaaggacattaaagaacaaatacttcgagcccagag

SEQ ID NO: 15837 - DNA, 60 bp, Artificial Sequence
  Description of Artificial Sequence: Synthetic probe
aggggcctgtggaaaaaaccgcatgtaccttcaattacacaaggacattaaagaacaaat

SEQ ID NO: 15838 - DNA, 60 bp, Artificial Sequence
  Description of Artificial Sequence: Synthetic probe
ccaaactcgggcctatgccgtgcagaccacatgagatcatatcaagtgaggggcctgtgg

SEQ ID NO: 15839 - DNA, 60 bp, Artificial Sequence
  Description of Artificial Sequence: Synthetic probe
taccaaactcgggcctatgccgtgcagaccacatgagatcatatcaagtgaggggcctgt

SEQ ID NO: 15840 - DNA, 60 bp, Artificial Sequence
  Description of Artificial Sequence: Synthetic probe
ataggagatgtggtcgtacaggtcgttgctctggataccaaactcgggcctatgccgtgc

SEQ ID NO: 15841 - DNA, 60 bp, Artificial Sequence
  Description of Artificial Sequence: Synthetic probe
acggtgaaatgcaagataggagatgtggtcgtacaggtcgttgctctggataccaaactc

SEQ ID NO: 15842 - DNA, 60 bp, Artificial Sequence
  Description of Artificial Sequence: Synthetic probe
gcaacagggatggcgtggccatagtaacacaagggacggtgaaatgcaagataggagatg

SEQ ID NO: 15843 - DNA, 60 bp, Artificial Sequence
  Description of Artificial Sequence: Synthetic probe
tggatgacacttcttgcaacagggatggcgtggccatagtaacacaagggacggtgaaat

SEQ ID NO: 15844 - DNA, 60 bp, Artificial Sequence
  Description of Artificial Sequence: Synthetic probe
ttacccgattggcaagtgtaagctggagaacgagactggctacaggttagtggatgacac

SEQ ID NO: 15845 - DNA, 53 bp, Artificial Sequence
  Description of Artificial Sequence: Synthetic probe
acatataggaggctcaaacctttcccttacagacaaggctgtatcacccaaaa

SEQ ID NO: 15846 - DNA, 60 bp, Artificial Sequence
  Description of Artificial Sequence: Synthetic probe
cgggccagccttccaaatggtatgccccataggatggacggggtccgttagctgtatgct

SEQ ID NO: 15847 - DNA, 60 bp, Artificial Sequence
  Description of Artificial Sequence: Synthetic probe
cactgctaaacgggccagccttccaaatggtatgccccataggatggacggggtccgtta

SEQ ID NO: 15848 - DNA, 60 bp, Artificial Sequence
  Description of Artificial Sequence: Synthetic probe
gaaacaattgaaatgggagacgactttgaattcggactttgcccatgtgatgccagaccc

SEQ ID NO: 15849 - DNA, 60 bp, Artificial Sequence
  Description of Artificial Sequence: Synthetic probe
ggacggaagcagaaggaaacaattgaaatgggagacgactttgaattcggactttgccca

SEQ ID NO: 15850 - DNA, 60 bp, Artificial Sequence
  Description of Artificial Sequence: Synthetic probe
caccaggaatgaagctagaggacactatggtaatagcttggtgcaaagacggccagttta

SEQ ID NO: 15851 - DNA, 60 bp, Artificial Sequence
  Description of Artificial Sequence: Synthetic probe
gcccattgggtgctgaaagcctcaccaccacttggaaagattactcaccaggaatgaagc

SEQ ID NO: 15852 - DNA, 60 bp, Artificial Sequence
  Description of Artificial Sequence: Synthetic probe
gattggcccattgggtgctgaaagcctcaccaccacttggaaagattactcaccaggaat

SEQ ID NO: 15853 - DNA, 60 bp, Artificial Sequence
  Description of Artificial Sequence: Synthetic probe
gctgaagaatgaaagtggctacagactagtagatgagaccccttgtaacagagacggcgt

SEQ ID NO: 15854 - DNA, 60 bp, Artificial Sequence
  Description of Artificial Sequence: Synthetic probe
gatagggaacacagtggtgcaagtcatagcaatggacgataggctagggcctatgccttg

SEQ ID NO: 15855 - DNA, 60 bp, Artificial Sequence
  Description of Artificial Sequence: Synthetic probe
tgcaagatagggaacacagtggtgcaagtcatagcaatggacgataggctagggcctatg

SEQ ID NO: 15856 - DNA, 60 bp, Artificial Sequence
  Description of Artificial Sequence: Synthetic probe
agggatccttggtaagaagttggagaataaaagcaaagcatggtttggtgcacacgcagc

SEQ ID NO: 15857 - DNA, 60 bp, Artificial Sequence
  Description of Artificial Sequence: Synthetic probe
gagactgagtatggcatcaagaccgactcagggtgtcccgaaggtgcgaggtgttacgtg

SEQ ID NO: 15858 - DNA, 60 bp, Artificial Sequence
  Description of Artificial Sequence: Synthetic probe
ccgatgagactgagtatggcatcaagaccgactcagggtgtcccgaaggtgcaaggtgct

SEQ ID NO: 15859 - DNA, 60 bp, Artificial Sequence
  Description of Artificial Sequence: Synthetic probe
aataagatgaccgatgagactgagtatggcatcaagaccgactcagggtgtcccgaaggt

SEQ ID NO: 15860 - DNA, 60 bp, Artificial Sequence
  Description of Artificial Sequence: Synthetic probe
catagtaacaataagatgaccgatgagactgagtatggcatcaagaccgactcagggtgc

SEQ ID NO: 15861 - DNA, 60 bp, Artificial Sequence
  Description of Artificial Sequence: Synthetic probe
caactaagagaattggcagagtgaccggtagcaatgggaaattataccacatttatgtct

SEQ ID NO: 15862 - DNA, 60 bp, Artificial Sequence
  Description of Artificial Sequence: Synthetic probe
caaccaagagaattggcagagtgaccggtagcaatgggaaattataccacatttatgtct

SEQ ID NO: 15863 - DNA, 60 bp, Artificial Sequence
  Description of Artificial Sequence: Synthetic probe
gacgagggcaagcccacagcacatcttaacctggacgggggtcgttcaggtgaaaacggt

SEQ ID NO: 15864 - DNA, 60 bp, Artificial Sequence
  Description of Artificial Sequence: Synthetic probe
gtagcaggggatcagctacattacacagggggtgtcatagaatcctgcaagtggtgcggc

SEQ ID NO: 15865 - DNA, 60 bp, Artificial Sequence
  Description of Artificial Sequence: Synthetic probe
aactggacttgtatagcaggggatcagctacattacacagggggtgacatagaatcctgt

SEQ ID NO: 15866 - DNA, 59 bp, Artificial Sequence
  Description of Artificial Sequence: Synthetic probe
actatcaggactatgcagggcccgtctatcatagagtcccactggaactatgtagagag

SEQ ID NO: 15867 - DNA, 60 bp, Artificial Sequence
  Description of Artificial Sequence: Synthetic probe
tctactaccaggactatgcgggacccgtctatcatagagtcccactggaactatgtagag

SEQ ID NO: 15868 - DNA, 60 bp, Artificial Sequence
  Description of Artificial Sequence: Synthetic probe
cgaaacctcttgcaatagggatggtgtagcgatagtgcaacatggacttgtgaagtgtag

SEQ ID NO: 15869 - DNA, 60 bp, Artificial Sequence
  Description of Artificial Sequence: Synthetic probe
agacgaaacctcttgcaatagggatggtgtagcgatagtgcaacatggacttgtgaagtg

SEQ ID NO: 15870 - DNA, 50 bp, Artificial Sequence
  Description of Artificial Sequence: Synthetic probe
aaaacgaaactggctacaggctggtagacgaaacctcttgcaatagggat

SEQ ID NO: 15871 - DNA, 60 bp, Artificial Sequence
  Description of Artificial Sequence: Synthetic probe
gtgtaacaggggaacagctgcattacacaggaggtgccatagaatcctgtaagtcgtgcg

SEQ ID NO: 15872 - DNA, 60 bp, Artificial Sequence
  Description of Artificial Sequence: Synthetic probe
gaggaaactggacttgtgtaacaggggaacagctgcattacacaggaggtgccatagaat

SEQ ID NO: 15873 - DNA, 60 bp, Artificial Sequence
  Description of Artificial Sequence: Synthetic probe
acttctaggggaggatctctataactgtgtcctcggaggaaactggacttgtgtaacagg

SEQ ID NO: 15874 - DNA, 60 bp, Artificial Sequence
  Description of Artificial Sequence: Synthetic probe
ttgtgtcactcaaaaacttctaggggaggatctctataactgtgtcctcggaggaaactg

SEQ ID NO: 15875 - DNA, 60 bp, Artificial Sequence
  Description of Artificial Sequence: Synthetic probe
gtgtagaattggagacacagtggtgcaggtcatagcgatggacacaaaacttgggcctat

SEQ ID NO: 15876 - DNA, 60 bp, Artificial Sequence
  Description of Artificial Sequence: Synthetic probe
agtcgtcagtggttcgacgcctcggaaagaaggtctcgagatgccacgtggacgagggca

SEQ ID NO: 15877 - DNA, 60 bp, Artificial Sequence
  Description of Artificial Sequence: Synthetic probe
agtcgtcagtggttcgacacctcggaaagaaggtctcgagatgccacgtggacgagggca

SEQ ID NO: 15878 - DNA, 60 bp, Artificial Sequence
  Description of Artificial Sequence: Synthetic probe
tgaagaatgagagtggctacagacaagtggatgaaacttcttgcaacagagatggtgtgg

SEQ ID NO: 15879 - DNA, 60 bp, Artificial Sequence
  Description of Artificial Sequence: Synthetic probe
ttggcaaatgcaagctgaagaatgagagtggctacagacaagtggatgaaacttcttgca

SEQ ID NO: 15880 - DNA, 52 bp, Artificial Sequence
  Description of Artificial Sequence: Synthetic probe
ggggatcaactacgatatgtaggtgggccggttgagtcttgtaagtggtgtg

SEQ ID NO: 15881 - DNA, 58 bp, Artificial Sequence
  Description of Artificial Sequence: Synthetic probe
gtgccgggggatcaactacgatatgtaggtgggccggttgagtcttgtaagtggtgtg

SEQ ID NO: 15882 - DNA, 59 bp, Artificial Sequence
  Description of Artificial Sequence: Synthetic probe
ccataggggaagaccttttcgactgtatcttaggagggaactggacttgtgtgccgggg

SEQ ID NO: 15883 - DNA, 60 bp, Artificial Sequence
  Description of Artificial Sequence: Synthetic probe
ggaacaggccatttccatacaggcaggactgtgtcacccagaaaaccataggggaagacc

SEQ ID NO: 15884 - DNA, 60 bp, Artificial Sequence
  Description of Artificial Sequence: Synthetic probe
caaaaggaacaggccatttccatacaggcaggactgtgtcacccagaaaaccatagggga

SEQ ID NO: 15885 - DNA, 53 bp, Artificial Sequence
  Description of Artificial Sequence: Synthetic probe
cgttagctacgaccgttgtgcgaacgtacaaaaggaacaggccatttccatac

SEQ ID NO: 15886 - DNA, 60 bp, Artificial Sequence
  Description of Artificial Sequence: Synthetic probe
tgtacgctggccaataaggacacgttagctacgaccgttgtgcgaacgtacaaaaggaac

SEQ ID NO: 15887 - DNA, 60 bp, Artificial Sequence
  Description of Artificial Sequence: Synthetic probe
cattagcggtgttatggacacagcctgatagggtgtagcagagacctgctattccgctag

SEQ ID NO: 15888 - DNA, 60 bp, Artificial Sequence
  Description of Artificial Sequence: Synthetic probe
ggtttaaccaaccgccacggatacagcctgatagggtgctgcagaggcccactgtattgc

SEQ ID NO: 15889 - DNA, 60 bp, Artificial Sequence
  Description of Artificial Sequence: Synthetic probe
ttggcaaatgcaggttagaaaacgaaactggctacaggctggtagacgacacctcttgca

SEQ ID NO: 15890 - DNA, 60 bp, Artificial Sequence
  Description of Artificial Sequence: Synthetic probe
ttggcaagtgcaggttaaaaaacgagactggctacaggctggtagacgacacctcttgca

SEQ ID NO: 15891 - DNA, 55 bp, Artificial Sequence
  Description of Artificial Sequence: Synthetic probe
catggtgttggggttacagcctgatagggtgctgcagaggcccacgtataggcta

SEQ ID NO: 15892 - DNA, 60 bp, Artificial Sequence
  Description of Artificial Sequence: Synthetic probe
gggacaagcctttcccctataggcagggctgtatcacccagaaaaccattggggaagacc

SEQ ID NO: 15893 - DNA, 60 bp, Artificial Sequence
  Description of Artificial Sequence: Synthetic probe
caagagggacaagcctttcccctataggcagggctgtatcacccagaaaaccattgggga

SEQ ID NO: 15894 - DNA, 60 bp, Artificial Sequence
  Description of Artificial Sequence: Synthetic probe
acctatgaaaaaataataggggaagatatccatgaatgcattctaggcggaaactggaca

SEQ ID NO: 15895 - DNA, 60 bp, Artificial Sequence
  Description of Artificial Sequence: Synthetic probe
gggttgcatgggtgaaagcgctattcgtggcgttatggacacagcctgatagggtgtagc

SEQ ID NO: 15896 - DNA, 60 bp, Artificial Sequence
  Description of Artificial Sequence: Synthetic probe
ggggttgcatgggtgaaagcgctattcgtggcgttatggacacagcctgatagggtgtag

SEQ ID NO: 15897 - DNA, 60 bp, Artificial Sequence
  Description of Artificial Sequence: Synthetic probe
gggggctgcatgggtgaaagcgccatccgtggcgttatggacacagcctgatagggtgta

SEQ ID NO: 15898 - DNA, 60 bp, Artificial Sequence
  Description of Artificial Sequence: Synthetic probe
gggggttgcatgggtgaaagcgctattcgtggcgttatggacacagcctgatagggtgta

SEQ ID NO: 15899 - DNA, 60 bp, Artificial Sequence
  Description of Artificial Sequence: Synthetic probe
atggagttgttttcaaatgaacttttatacaaaacatacaaacaaaaaccagcaggcgtc

SEQ ID NO: 15900 - DNA, 60 bp, Artificial Sequence
  Description of Artificial Sequence: Synthetic probe
caggaaacagcaaccgggtctaaagactaccactatgacctgttacaggcacagaggtac

SEQ ID NO: 15901 - DNA, 60 bp, Artificial Sequence
  Description of Artificial Sequence: Synthetic probe
ggttcgacaccttgacacaaaggtctcgagatgccacgtggacgagggcatgcccaaagc

SEQ ID NO: 15902 - DNA, 60 bp, Artificial Sequence
  Description of Artificial Sequence: Synthetic probe
tggagaatgagagtggctatagacaagtagatgagacttcttgcaacagagacggcgtgg

SEQ ID NO: 15903 - DNA, 60 bp, Artificial Sequence
  Description of Artificial Sequence: Synthetic probe
gcggagaaaatggtgtacctatgaaaagataataggggaagatatccatgaatgcattct

SEQ ID NO: 15904 - DNA, 60 bp, Artificial Sequence
  Description of Artificial Sequence: Synthetic probe
ggttaggacatacagaagaactactccatttcagcggagaaaatggtgctcctatgaaaa

SEQ ID NO: 15905 - DNA, 60 bp, Artificial Sequence
  Description of Artificial Sequence: Synthetic probe
cgtcaggacatatagaagaactactccatttcagcggagaaaatggtgcacctatgaaaa

SEQ ID NO: 15906 - DNA, 60 bp, Artificial Sequence
  Description of Artificial Sequence: Synthetic probe
tcgtcaggacatatagaagaactactccatttcagcggagaaaatggtgcacctatgaaa

SEQ ID NO: 15907 - DNA, 60 bp, Artificial Sequence
  Description of Artificial Sequence: Synthetic probe
tgcaagctgaagaatgaaagtggctacagacaagtagatgagacctcttgcaacatagac

SEQ ID NO: 15908 - DNA, 60 bp, Artificial Sequence
  Description of Artificial Sequence: Synthetic probe
gtgaagggaaagattggaatggagccaactgcccaaagtgtggaagacaagggaaaccca

SEQ ID NO: 15909 - DNA, 60 bp, Artificial Sequence
  Description of Artificial Sequence: Synthetic probe
gtgaagggaaagattggaatggagccaactgcccaaagtgtggtagacaggggaagccca

SEQ ID NO: 15910 - DNA, 60 bp, Artificial Sequence
  Description of Artificial Sequence: Synthetic probe
tgtgaagggaaagattggaatggagccaactgcccaaagtgtggtagacaggggaagccc

SEQ ID NO: 15911 - DNA, 60 bp, Artificial Sequence
  Description of Artificial Sequence: Synthetic probe
cacaatctgtgaagggaaagattggaatggagccaactgcccaaagtgtggtagacaggg

SEQ ID NO: 15912 - DNA, 60 bp, Artificial Sequence
  Description of Artificial Sequence: Synthetic probe
tttgcacaatctgtgaagggaaagattggaatggagccaactgcccaaagtgtggtagac

SEQ ID NO: 15913 - DNA, 60 bp, Artificial Sequence
  Description of Artificial Sequence: Synthetic probe
aatctgcacaatctgtgaagggaaagattggaatggagccaactgcccaaagtgtggaag

SEQ ID NO: 15914 - DNA, 60 bp, Artificial Sequence
  Description of Artificial Sequence: Synthetic probe
gacaccttggacacaactgtcgttaggacatatagaagaactactccatttcagcggaga

SEQ ID NO: 15915 - DNA, 60 bp, Artificial Sequence
  Description of Artificial Sequence: Synthetic probe
tcctggcgaaccaagacaccttggacacaactgtcgttaggacatatagaagaaccactc

SEQ ID NO: 15916 - DNA, 60 bp, Artificial Sequence
  Description of Artificial Sequence: Synthetic probe
ccatcggggaagacctctacagctgtgtcttgggagggaattggacttgtgtgccggggg

SEQ ID NO: 15917 - DNA, 60 bp, Artificial Sequence
  Description of Artificial Sequence: Synthetic probe
ccattggggaagacctctacgactgtgtcttgggagggaattggacttgtgtgccggggg

SEQ ID NO: 15918 - DNA, 60 bp, Artificial Sequence
  Description of Artificial Sequence: Synthetic probe
ttggggaagacctctacaactgtgtcttgggagggaattggacttgtgtgccgggggatc

SEQ ID NO: 15919 - DNA, 60 bp, Artificial Sequence
  Description of Artificial Sequence: Synthetic probe
catttatgtgtgtattgatggatgcataatagttaagagtgctacaagagatcgccaaaa

SEQ ID NO: 15920 - DNA, 60 bp, Artificial Sequence
  Description of Artificial Sequence: Synthetic probe
acatttatgtgtgtattgatggatgcataatagttaagagtgctacaagagatcgccaaa

SEQ ID NO: 15921 - DNA, 60 bp, Artificial Sequence
  Description of Artificial Sequence: Synthetic probe
gtgatagcaaattataccacatttatgtgtgtattgatggatgcataatagttaagagcg

SEQ ID NO: 15922 - DNA, 60 bp, Artificial Sequence
  Description of Artificial Sequence: Synthetic probe
catccgcagtcaacactaaaactaccacataaaagaggggagtgtgaagtccccactaat

SEQ ID NO: 15923 - DNA, 60 bp, Artificial Sequence
  Description of Artificial Sequence: Synthetic probe
ggtgaaagcggtaaagacagaccgctacgaatacagcctgatagggtgctgcagaggccc

SEQ ID NO: 15924 - DNA, 53 bp, Artificial Sequence
  Description of Artificial Sequence: Synthetic probe
ttttgaagagtgaagggctaccgcactatccaattggcaaatgcaggttaaaa

SEQ ID NO: 15925 - DNA, 60 bp, Artificial Sequence
  Description of Artificial Sequence: Synthetic probe
gtggtgcggctataagtttttgaagagtgaagggctaccgcactatccaattggcaaatg

SEQ ID NO: 15926 - DNA, 60 bp, Artificial Sequence
  Description of Artificial Sequence: Synthetic probe
gtggtgcggctttaagtttttgaagagtgaagggctaccgcactatccaattggcaaatg

SEQ ID NO: 15927 - DNA, 56 bp, Artificial Sequence
  Description of Artificial Sequence: Synthetic probe
tgaggggcccgtgcagaaaacagcatgtaccttcaattacacacagacacttaaaa

SEQ ID NO: 15928 - DNA, 60 bp, Artificial Sequence
  Description of Artificial Sequence: Synthetic probe
tgaggggcccgtgcagaaaacagcatgtaccttcaattacacacagacacttaaaaataa

SEQ ID NO: 15929 - DNA, 60 bp, Artificial Sequence
  Description of Artificial Sequence: Synthetic probe
gcctatgccttgtaaaccatatgagatcatttcaagtgaggggcccgtgcagaaaacagc

SEQ ID NO: 15930 - DNA, 60 bp, Artificial Sequence
  Description of Artificial Sequence: Synthetic probe
gattccagacttgggcctatgccttgtaaaccatatgagatcatttcaagtgaggggccc

SEQ ID NO: 15931 - DNA, 60 bp, Artificial Sequence
  Description of Artificial Sequence: Synthetic probe
agataggggatacagtggttcaggttaaagcaatggattccagacttgggcctatgcctt

SEQ ID NO: 15932 - DNA, 60 bp, Artificial Sequence
  Description of Artificial Sequence: Synthetic probe
gaggactaaaatgtaagataggggatacagtggttcaggttaaagcaatggattccagac

SEQ ID NO: 15933 - DNA, 60 bp, Artificial Sequence
  Description of Artificial Sequence: Synthetic probe
cctgtaacagagacggtgtggctatagtgccaactggaggactaaaatgtaagatagggg

SEQ ID NO: 15934 - DNA, 60 bp, Artificial Sequence
  Description of Artificial Sequence: Synthetic probe
agtggatgatacctcctgtaacagagacggtgtggctatagtgccaactggaggactaaa

SEQ ID NO: 15935 - DNA, 60 bp, Artificial Sequence
  Description of Artificial Sequence: Synthetic probe
ggcaagtgcaggttgaagaatgagactagttaccggctagtggatgatacctcctgtaac

SEQ ID NO: 15936 - DNA, 60 bp, Artificial Sequence
  Description of Artificial Sequence: Synthetic probe
gtggctacaattttcagaaaggagaaggcctaccacactatccaattggcaagtgcaggt

SEQ ID NO: 15937 - DNA, 60 bp, Artificial Sequence
  Description of Artificial Sequence: Synthetic probe
agacttgtaaatggtgtggctacaattttcagaaaggagaaggcctaccacactatccaa

SEQ ID NO: 15938 - DNA, 60 bp, Artificial Sequence
  Description of Artificial Sequence: Synthetic probe
taatgaagacactctggacacgaccaaggtgcggacctatagaaggaccaagccgttccc

SEQ ID NO: 15939 - DNA, 60 bp, Artificial Sequence
  Description of Artificial Sequence: Synthetic probe
ggaatgcactctagttaatgaagacactctggacacgaccaaggtgcggacctatagaag

SEQ ID NO: 15940 - DNA, 60 bp, Artificial Sequence
  Description of Artificial Sequence: Synthetic probe
ggccagcatttcaaatggcgtgcccaattggatggacaggggtcgtggaatgcactctag

SEQ ID NO: 15941 - DNA, 60 bp, Artificial Sequence
  Description of Artificial Sequence: Synthetic probe
aatgggccagcatttcaaatggcgtgcccaattggatggacaggggtcgtggaatgcact

SEQ ID NO: 15942 - DNA, 60 bp, Artificial Sequence
  Description of Artificial Sequence: Synthetic probe
gtgatgccaagcccgtggtaagagggaaatttaacacgacattgctaaatgggccagcat

SEQ ID NO: 15943 - DNA, 60 bp, Artificial Sequence
  Description of Artificial Sequence: Synthetic probe
catgtgatgccaagcccgtggtaagagggaaatttaacacgacattgctaaatgggccag

SEQ ID NO: 15944 - DNA, 52 bp, Artificial Sequence
  Description of Artificial Sequence: Synthetic probe
agggccggtattctaccaggattacaaaggacccgtctattatagagccccg

SEQ ID NO: 15945 - DNA, 58 bp, Artificial Sequence
  Description of Artificial Sequence: Synthetic probe
cactccttcagttgaggagtctcgagatgccatgtggacgagggcatgcccacggcac

SEQ ID NO: 15946 - DNA, 60 bp, Artificial Sequence
  Description of Artificial Sequence: Synthetic probe
gacactccattagttgaggagtctcgagatgccatgtggacgagggcatgcccacggcac

SEQ ID NO: 15947 - DNA, 60 bp, Artificial Sequence
  Description of Artificial Sequence: Synthetic probe
acaggagccaggaaacagcaaccgggtcaaaagactaccactatgacctgttacaggcac

SEQ ID NO: 15948 - DNA, 60 bp, Artificial Sequence
  Description of Artificial Sequence: Synthetic probe
gagtgggtagagtaaagcccgggagatattacaggagccaggaaacagcaaccgggtcaa

SEQ ID NO: 15949 - DNA, 60 bp, Artificial Sequence
  Description of Artificial Sequence: Synthetic probe
agagtgggtagagtaaagcccgggagatattacaggagccaggaaacagcaaccgggtca

SEQ ID NO: 15950 - DNA, 60 bp, Artificial Sequence
  Description of Artificial Sequence: Synthetic probe
gggcagagtgggtagagtgaagcccgggagatattacaggagccaggaaacagcaaccgg

SEQ ID NO: 15951 - DNA, 60 bp, Artificial Sequence
  Description of Artificial Sequence: Synthetic probe
gcaggcccagcgcaggggcagagtgggtagagtgaagcccgggagatattacaggagcca

SEQ ID NO: 15952 - DNA, 60 bp, Artificial Sequence
  Description of Artificial Sequence: Synthetic probe
agaatggccgtcaccgtgggtgagcaggcccagcgcaggggcagagtgggtagagtaaag

SEQ ID NO: 15953 - DNA, 60 bp, Artificial Sequence
  Description of Artificial Sequence: Synthetic probe
gcctcaagagaatggccgtcaccgtgggtgagcaggcccagcgcaggggcagagtgggta

SEQ ID NO: 15954 - DNA, 60 bp, Artificial Sequence
  Description of Artificial Sequence: Synthetic probe
taccctttattgtaacaggcctcaagagaatggccgtcaccgcgggtgagcaggcccagc

SEQ ID NO: 15955 - DNA, 60 bp, Artificial Sequence
  Description of Artificial Sequence: Synthetic probe
ataccctttattgtaacaggcctcaagagaatggccgtcaccgcgggtgagcaggcccag

SEQ ID NO: 15956 - DNA, 60 bp, Artificial Sequence
  Description of Artificial Sequence: Synthetic probe
gagggtttcacccaagataccttttattgtaacaggcctcaagagaatggccgtcaccgt

SEQ ID NO: 15957 - DNA, 60 bp, Artificial Sequence
  Description of Artificial Sequence: Synthetic probe
tcaggggtgacattaccagatttagacacagttgtggacactgggttgaaatgtgaaaag

SEQ ID NO: 15958 - DNA, 60 bp, Artificial Sequence
  Description of Artificial Sequence: Synthetic probe
tgagtcaggggtgacattaccagatttagacacagttgtggacactgggctgaaatgcga

SEQ ID NO: 15959 - DNA, 60 bp, Artificial Sequence
  Description of Artificial Sequence: Synthetic probe
agctacaaatgccattgagtcaggggtgacattaccagatttagacacagttgtggacac

SEQ ID NO: 15960 - DNA, 60 bp, Artificial Sequence
  Description of Artificial Sequence: Synthetic probe
cacagtctccgtatgtagtcgtagctacaaatgccattgagtcaggggtgacattaccag

SEQ ID NO: 15961 - DNA, 60 bp, Artificial Sequence
  Description of Artificial Sequence: Synthetic probe
cgagaaacatggcagttgaggtggccaagaagctaaaagctaagggctacaattccgggt

SEQ ID NO: 15962 - DNA, 60 bp, Artificial Sequence
  Description of Artificial Sequence: Synthetic probe
cgagaaacatggcagtcgaggtggccaagaagctaaaagctaagggctacaattctggat

SEQ ID NO: 15963 - DNA, 60 bp, Artificial Sequence
  Description of Artificial Sequence: Synthetic probe
cctacgagaaacatggcagtcgaggtggccaagaagctaaaagctaagggctacaattct

SEQ ID NO: 15964 - DNA, 60 bp, Artificial Sequence
  Description of Artificial Sequence: Synthetic probe
cctacgagaaacatggcagttgaggtggccaagaagctaaaagctaagggctacaattcc

SEQ ID NO: 15965 - DNA, 60 bp, Artificial Sequence
  Description of Artificial Sequence: Synthetic probe
gagagtataagagttgttgccatgacggccaccccagcaggatcagtaacgacaactggt

SEQ ID NO: 15966 - DNA, 60 bp, Artificial Sequence
  Description of Artificial Sequence: Synthetic probe
ggttctcagagagtataagagttgttgccatgacggccaccccggcagggtcagtaacaa

SEQ ID NO: 15967 - DNA, 60 bp, Artificial Sequence
  Description of Artificial Sequence: Synthetic probe
atccatagattctcagagagtataagagttgttgccatgacggccaccccagcaggatca

SEQ ID NO: 15968 - DNA, 60 bp, Artificial Sequence
  Description of Artificial Sequence: Synthetic probe
aagcagtgatagaggagataggaagacacaaacgggtgctagtgctcataccattaaggg

SEQ ID NO: 15969 - DNA, 60 bp, Artificial Sequence
  Description of Artificial Sequence: Synthetic probe
aaagcagtgatagaggagataggaagacacaaacgggtgctagtgctcataccattaagg

SEQ ID NO: 15970 - DNA, 60 bp, Artificial Sequence
  Description of Artificial Sequence: Synthetic probe
ggtgtggttacagattccaaagtggcgaggggctaccacattacccaattggcaagtgta

SEQ ID NO: 15971 - DNA, 60 bp, Artificial Sequence
  Description of Artificial Sequence: Synthetic probe
ggcaaatgcaggttagaaaacgaaactggctacaggctggtagacgacacctcttgcaac

SEQ ID NO: 15972 - DNA, 60 bp, Artificial Sequence
  Description of Artificial Sequence: Synthetic probe
gtggaccttctaggcttggactggccagacccagggaatcagcaagtagtggaaactggg

SEQ ID NO: 15973 - DNA, 60 bp, Artificial Sequence
  Description of Artificial Sequence: Synthetic probe
actgatcacccagagcctatccagcttgcatataacagttatgaggtccaagtccctgtg

SEQ ID NO: 15974 - DNA, 60 bp, Artificial Sequence
  Description of Artificial Sequence: Synthetic probe
agggtaggtagagtgaagcccggtaggtattataggagtcaggaaacagcaaccgggtca

SEQ ID NO: 15975 - DNA, 60 bp, Artificial Sequence
  Description of Artificial Sequence: Synthetic probe
gtcttaaaagaatggctgtcaccgtgggcgaacaggctcagcggagaggcagggtaggta

SEQ ID NO: 15976 - DNA, 60 bp, Artificial Sequence
  Description of Artificial Sequence: Synthetic probe
gtggttgccatgactgccaccccagcagggtcagtaaccacaacagggcagaaacaccca

SEQ ID NO: 15977 - DNA, 60 bp, Artificial Sequence
  Description of Artificial Sequence: Synthetic probe
tggctacagacaagtagatgagacctcttgtaacagagacggggttgctatagtaccatc

SEQ ID NO: 15978 - DNA, 60 bp, Artificial Sequence
  Description of Artificial Sequence: Synthetic probe
agtggctacagacaagtagatgagacctcttgtaacagagacggcgtggctatagtgcca

SEQ ID NO: 15979 - DNA, 60 bp, Artificial Sequence
  Description of Artificial Sequence: Synthetic probe
atagggaggacgactggtagtgatggtaagttgtaccacatttatgtgtgtatagatgga

SEQ ID NO: 15980 - DNA, 55 bp, Artificial Sequence
  Description of Artificial Sequence: Synthetic probe
aaccttttccctataggcagggctgtattacccagaaaacctttggggaagacct

SEQ ID NO: 15981 - DNA, 60 bp, Artificial Sequence
  Description of Artificial Sequence: Synthetic probe
gtagcgatagtgccaaacggacttgtgaagtgtaaaattggagacacagtggtgcaggtc

SEQ ID NO: 15982 - DNA, 60 bp, Artificial Sequence
  Description of Artificial Sequence: Synthetic probe
gtgtagcgatagtgccaaacggacttgtgaagtgtaaaattggagacacagtggtgcagg

SEQ ID NO: 15983 - DNA, 60 bp, Artificial Sequence
  Description of Artificial Sequence: Synthetic probe
gactaccacattatccaattggcaaatgcaggttaaagaacgagactggctacaggctgg

SEQ ID NO: 15984 - DNA, 60 bp, Artificial Sequence
  Description of Artificial Sequence: Synthetic probe
caaaagagtgaaggactaccacattatccaattggcaaatgcaggttaaagaacgagact

SEQ ID NO: 15985 - DNA, 60 bp, Artificial Sequence
  Description of Artificial Sequence: Synthetic probe
gggtgccattgaaacctgcaagtggtgtagctacaagttccaaaagagtgaaggactacc

SEQ ID NO: 15986 - DNA, 60 bp, Artificial Sequence
  Description of Artificial Sequence: Synthetic probe
gttatgtagggggtgccattgaaacctgcaagtggtgtagctacaagttccaaaagagtg

SEQ ID NO: 15987 - DNA, 60 bp, Artificial Sequence
  Description of Artificial Sequence: Synthetic probe
caataaggacaccctaagcacggccgtagtgcggacgtataaaagggttagcccattccc

SEQ ID NO: 15988 - DNA, 60 bp, Artificial Sequence
  Description of Artificial Sequence: Synthetic probe
tgtaccttagtcaataaggacaccctaagcacggccgtagtgcggacgtataaaagggtt

SEQ ID NO: 15989 - DNA, 60 bp, Artificial Sequence
  Description of Artificial Sequence: Synthetic probe
tgacactccggtcactaaggagtctcaagatgccatgtggacgagggcatgcccacggca

SEQ ID NO: 15990 - DNA, 60 bp, Artificial Sequence
  Description of Artificial Sequence: Synthetic probe
ggtttgacactccggtcactaaggagtctcaagatgccatgtggacgagggcatgcccac

SEQ ID NO: 15991 - DNA, 60 bp, Artificial Sequence
  Description of Artificial Sequence: Synthetic probe
ggcaaggttgtgtcactcaaaaacttctgggggaagatctacatgactgtgcccttggag

SEQ ID NO: 15992 - DNA, 60 bp, Artificial Sequence
  Description of Artificial Sequence: Synthetic probe
aggcaaggttgtgtcactcaaaaacttctgggggaagatctctatgactgtatgcttgga

SEQ ID NO: 15993 - DNA, 56 bp, Artificial Sequence
  Description of Artificial Sequence: Synthetic probe
tatgcttggaggaaactggacttgtatagcaggggaacagctacattacacagggg

SEQ ID NO: 15994 - DNA, 60 bp, Artificial Sequence
  Description of Artificial Sequence: Synthetic probe
ggcgaaagaggagagatacatccgcagtcaacactaaagttaccacataaaagaggggag

SEQ ID NO: 15995 - DNA, 60 bp, Artificial Sequence
  Description of Artificial Sequence: Synthetic probe
aaccctttgtttggcgaaagaggagagatacatccgcagtcaacactaaagttaccacat

SEQ ID NO: 15996 - DNA, 60 bp, Artificial Sequence
  Description of Artificial Sequence: Synthetic probe
aaccctttgtttggcgaaagaggagagatacatccgcagtcaacactaaaactaccacat

SEQ ID NO: 15997 - DNA, 60 bp, Artificial Sequence
  Description of Artificial Sequence: Synthetic probe
cgaccaagctggtaaccctttgtttggcgaaagaggagagatacatccgcagtcaacact

SEQ ID NO: 15998 - DNA, 60 bp, Artificial Sequence
  Description of Artificial Sequence: Synthetic probe
cagtatacgaccaagctggtaaccctttgtttggcgaaagaggagagatacatccgcagt

SEQ ID NO: 15999 - DNA, 60 bp, Artificial Sequence
  Description of Artificial Sequence: Synthetic probe
gcactacagctacttgatggggcaaccaacaccatcgaaggagcaagggtagggacagcc

SEQ ID NO: 16000 - DNA, 60 bp, Artificial Sequence
  Description of Artificial Sequence: Synthetic probe
ccgcactacagctacttgatggggcaaccaacaccatcgaaggagcaagggtagggacag

SEQ ID NO: 16001 - DNA, 60 bp, Artificial Sequence
  Description of Artificial Sequence: Synthetic probe
gcggcaacatgctgcaggagaccgcactacagctacttgatggggcaaccaacaccatcg

SEQ ID NO: 16002 - DNA, 60 bp, Artificial Sequence
  Description of Artificial Sequence: Synthetic probe
gattgcggcaacatgctgcaggagaccgcactacagctacttgatggggcaaccaacacc

SEQ ID NO: 16003 - DNA, 60 bp, Artificial Sequence
  Description of Artificial Sequence: Synthetic probe
ggttcgacgctttatgtgataagcctcgagatgccacgtggacgagggcatgcccacagc

SEQ ID NO: 16004 - DNA, 50 bp, Artificial Sequence
  Description of Artificial Sequence: Synthetic probe
gaatacagcctgatagggtgctgcagaggcccactgtattgctactaaaa

SEQ ID NO: 16005 - DNA, 60 bp, Artificial Sequence
  Description of Artificial Sequence: Synthetic probe
gattttgaggaaaggcactacagaggaattttcatacgggaaggggactatgaaggaccc

SEQ ID NO: 16006 - DNA, 60 bp, Artificial Sequence
  Description of Artificial Sequence: Synthetic probe
gggatgtcactagctgattttgaggaaaggcactacagaggaattttcatacgggaaggg

SEQ ID NO: 16007 - DNA, 60 bp, Artificial Sequence
  Description of Artificial Sequence: Synthetic probe
gaaactgtcctaagtgcggacgccacgggaaacccataacatgcgggatgtcactagctg

SEQ ID NO: 16008 - DNA, 60 bp, Artificial Sequence
  Description of Artificial Sequence: Synthetic probe
aaggaggaaactgtcctaagtgcggacgccacgggaaacccataacatgcgggatgtcac

SEQ ID NO: 16009 - DNA, 60 bp, Artificial Sequence
  Description of Artificial Sequence: Synthetic probe
gtgttgcaaggtgtactgtggctgatactcataacaggggcgcaagggtacccagactgc

SEQ ID NO: 16010 - DNA, 60 bp, Artificial Sequence
  Description of Artificial Sequence: Synthetic probe
gtgttgcaaggcatactgtggctgatactcataacaggggcgcaagggtacccagactgc

SEQ ID NO: 16011 - DNA, 60 bp, Artificial Sequence
  Description of Artificial Sequence: Synthetic probe
gtgttgcaaggtatactgtggctgatactcataacaggggcgcaagggtacccagactgc

SEQ ID NO: 16012 - DNA, 60 bp, Artificial Sequence
  Description of Artificial Sequence: Synthetic probe
acacagaactgaaggcaattcacggtatgatggatgcaagtgagaagacaaattatacat

SEQ ID NO: 16013 - DNA, 60 bp, Artificial Sequence
  Description of Artificial Sequence: Synthetic probe
cccacctggccactgacgcagaactgaaggcaattcacggtatgatggatgcaagtgaga

SEQ ID NO: 16014 - DNA, 60 bp, Artificial Sequence
  Description of Artificial Sequence: Synthetic probe
catcccacctggccactgacatggaactgaaggcaattcacggtatgatggatgcaagtg

SEQ ID NO: 16015 - DNA, 60 bp, Artificial Sequence
  Description of Artificial Sequence: Synthetic probe
tgttccttcccacctggccactgacgcagaactgaaggcaattcacggtatgatggatgc

SEQ ID NO: 16016 - DNA, 59 bp, Artificial Sequence
  Description of Artificial Sequence: Synthetic probe
gagacacggtggtgcaagtcgtggcgatggattcaaaacttgggcccatgccttgcaaa

SEQ ID NO: 16017 - DNA, 60 bp, Artificial Sequence
  Description of Artificial Sequence: Synthetic probe
aatagtgccaaatggacttgttaagtgtaaaattggagacacggtggtgcaagtcgtggc

SEQ ID NO: 16018 - DNA, 60 bp, Artificial Sequence
  Description of Artificial Sequence: Synthetic probe
cgtgggtggtgtagcaatagtgccaaatggacttgttaagtgtaaaattggagacacggt

SEQ ID NO: 16019 - DNA, 60 bp, Artificial Sequence
  Description of Artificial Sequence: Synthetic probe
gactggctacaggctggtagactctacctcttgcaacgtgggtggtgtagcaatagtgcc

SEQ ID NO: 16020 - DNA, 60 bp, Artificial Sequence
  Description of Artificial Sequence: Synthetic probe
caagagggacagtccatttcctgataggcaaagttgtgtcacacaaaaacttgtagggga

SEQ ID NO: 16021 - DNA, 60 bp, Artificial Sequence
  Description of Artificial Sequence: Synthetic probe
cctagccaacaaagacaccctagacacagctgtggtgcggatatacaagagggacagtcc

SEQ ID NO: 16022 - DNA, 60 bp, Artificial Sequence
  Description of Artificial Sequence: Synthetic probe
tgtgtcctagccaacaaagacaccctagacacagctgtggtgcggatatacaagagggac

SEQ ID NO: 16023 - DNA, 53 bp, Artificial Sequence
  Description of Artificial Sequence: Synthetic probe
ctgatagggtgctgcagaggcccactgtattgctactaaaaatctctgctgta

SEQ ID NO: 16024 - DNA, 55 bp, Artificial Sequence
  Description of Artificial Sequence: Synthetic probe
aaccttttccttataggcagggctgtattacccagaaaaccattggggaaggcct

SEQ ID NO: 16025 - DNA, 60 bp, Artificial Sequence
  Description of Artificial Sequence: Synthetic probe
ggcccagaagtgatagatatgcctgatgactttgagttaggactctgcccttgcgactca

SEQ ID NO: 16026 - DNA, 60 bp, Artificial Sequence
  Description of Artificial Sequence: Synthetic probe
ggaagataggcccagaagtgatagatatgcctgatgactttgagttaggactctgccctt

SEQ ID NO: 16027 - DNA, 60 bp, Artificial Sequence
  Description of Artificial Sequence: Synthetic probe
cagggccgttattctaccaggattacaaaggacccgtctatcatagagccccgttggagc

SEQ ID NO: 16028 - DNA, 60 bp, Artificial Sequence
  Description of Artificial Sequence: Synthetic probe
ggcacaagccttttccctataggcagggctgtatcacccagaaaaccatcggggaagacc

SEQ ID NO: 16029 - DNA, 60 bp, Artificial Sequence
  Description of Artificial Sequence: Synthetic probe
tgccttctggcattggggttacagcctgatagggtgctgcagaggcccacgcataggcta

SEQ ID NO: 16030 - DNA, 60 bp, Artificial Sequence
  Description of Artificial Sequence: Synthetic probe
atgccttctggcattggggttacagcctgatagggtgctgcagaggcccacgcataggct

SEQ ID NO: 16031 - DNA, 60 bp, Artificial Sequence
  Description of Artificial Sequence: Synthetic probe
aaatgcctgctggcattggggttacagcctgatagggtgctgcagaggcccacgcatagg

SEQ ID NO: 16032 - DNA, 52 bp, Artificial Sequence
  Description of Artificial Sequence: Synthetic probe
agatgccacgtggacgagggcatgcccacagctcatcttaacctggacgggg

SEQ ID NO: 16033 - DNA, 60 bp, Artificial Sequence
  Description of Artificial Sequence: Synthetic probe
agatgccacgtggacgagggcatgcccacagctcatcttaacctggacgggggtcgccca

SEQ ID NO: 16034 - DNA, 60 bp, Artificial Sequence
  Description of Artificial Sequence: Synthetic probe
gagtacaaggcagtcgtcagtggttcgacaccttagaaaaggaggtctcgagatgccacg

SEQ ID NO: 16035 - DNA, 60 bp, Artificial Sequence
  Description of Artificial Sequence: Synthetic probe
ggggtagcaacagtggtgagttcattggatggctgaagccttgagtacaaggcagtcgtc

SEQ ID NO: 16036 - DNA, 60 bp, Artificial Sequence
  Description of Artificial Sequence: Synthetic probe
aaatgagaggggtagcaacagtggtgagttcattggatggctgaagccttgagtacaagg

SEQ ID NO: 16037 - DNA, 60 bp, Artificial Sequence
  Description of Artificial Sequence: Synthetic probe
atccctgagcggtctaagtcctgagtacaggacagtcgtcagtggttcgacgcggtcatc

SEQ ID NO: 16038 - DNA, 60 bp, Artificial Sequence
  Description of Artificial Sequence: Synthetic probe
gttctcaaatgggtccacaacaagctggattgcccgctatgggtaacaagttgttccgat

SEQ ID NO: 16039 - DNA, 60 bp, Artificial Sequence
  Description of Artificial Sequence: Synthetic probe
gacaccccttgcaatagagatggtgtagcgatagtgcaacatggaaccgtgaagtgtaga

SEQ ID NO: 16040 - DNA, 60 bp, Artificial Sequence
  Description of Artificial Sequence: Synthetic probe
gacacctcttgcaatagagatggtgtagcgatagtgcaacaaggagccgtgaagtgtaga

SEQ ID NO: 16041 - DNA, 60 bp, Artificial Sequence
  Description of Artificial Sequence: Synthetic probe
gacaccccttgcaatagagatggtgtagcgatagtgcaacatggaactgtgaagtgtaga

SEQ ID NO: 16042 - DNA, 60 bp, Artificial Sequence
  Description of Artificial Sequence: Synthetic probe
agatgacaccccttgcaatagagatggtgtagcgatagtgcaacatggaactgtgaagtg

SEQ ID NO: 16043 - DNA, 60 bp, Artificial Sequence
  Description of Artificial Sequence: Synthetic probe
agatgacacctcttgcaatagagatggtgtagcgatagtgcaacaaggagccgtgaagtg

SEQ ID NO: 16044 - DNA, 60 bp, Artificial Sequence
  Description of Artificial Sequence: Synthetic probe
agatgacaccccttgcaatagagatggtgtagcgatagtgcaacatggaaccgtgaagtg

SEQ ID NO: 16045 - DNA, 60 bp, Artificial Sequence
  Description of Artificial Sequence: Synthetic probe
acaggctggtagatgacactccttgcaatagagatggtgtagcgatagtgcaacatggaa

SEQ ID NO: 16046 - DNA, 51 bp, Artificial Sequence
  Description of Artificial Sequence: Synthetic probe
gtgttggggttacagcctgatagggcgctgcagaggcccacgtataggcta

SEQ ID NO: 16047 - DNA, 60 bp, Artificial Sequence
  Description of Artificial Sequence: Synthetic probe
aacctaaaatgatactacaagatgcattggtcaaagttcggtgtaaggatggtgagtttg

SEQ ID NO: 16048 - DNA, 60 bp, Artificial Sequence
  Description of Artificial Sequence: Synthetic probe
gtaggcctgctaggtgcagaaggccttaccaccctttggcgggaatacaaacctaaaatg

SEQ ID NO: 16049 - DNA, 60 bp, Artificial Sequence
  Description of Artificial Sequence: Synthetic probe
agtaggcctgctaggtgcagaaggccttaccaccctttggcgggaatacaaacctaaaat

SEQ ID NO: 16050 - DNA, 60 bp, Artificial Sequence
  Description of Artificial Sequence: Synthetic probe
ccaactgctacggacacagcctgatagggtgctgcagaggcccactgtattgctactaaa

SEQ ID NO: 16051 - DNA, 60 bp, Artificial Sequence
  Description of Artificial Sequence: Synthetic probe
ggtaagaagttggagaataaaagcaaagcatggtttggtgcacatgcagcaagtccatac

SEQ ID NO: 16052 - DNA, 60 bp, Artificial Sequence
  Description of Artificial Sequence: Synthetic probe
tggtaagaagttggagaataaaagcaaagcatggtttggtgcacatgcagcaagtccata

SEQ ID NO: 16053 - DNA, 52 bp, Artificial Sequence
  Description of Artificial Sequence: Synthetic probe
agcaatgaatactatgatgtgcagccgatgccagggaaagcataggaggttc

SEQ ID NO: 16054 - DNA, 60 bp, Artificial Sequence
  Description of Artificial Sequence: Synthetic probe
gtgtagaattggagacacagtggtgcaggtcttggcaatggacacaaaacttgggcctat

SEQ ID NO: 16055 - DNA, 60 bp, Artificial Sequence
  Description of Artificial Sequence: Synthetic probe
cctagccaataaggacaccctaaacatggtcgtagtgcggacgtataacagggctagccc

SEQ ID NO: 16056 - DNA, 60 bp, Artificial Sequence
  Description of Artificial Sequence: Synthetic probe
ggctggtggacgataccccttgcaatagaaatggtgtagcgatagtgccacacggaacta

SEQ ID NO: 16057 - DNA, 60 bp, Artificial Sequence
  Description of Artificial Sequence: Synthetic probe
ataacaggggaacagctacattacactgggggtgccgtagaatcctgtaagtggtgcggc

SEQ ID NO: 16058 - DNA, 60 bp, Artificial Sequence
  Description of Artificial Sequence: Synthetic probe
taagaggactagcccattccccaacaggcaaggttgtgtcactcaaaaactgctggggga

SEQ ID NO: 16059 - DNA, 60 bp, Artificial Sequence
  Description of Artificial Sequence: Synthetic probe
aaggacaccttagacttggttgtagtgcggacgtataagaggactagcccattccccaac

SEQ ID NO: 16060 - DNA, 60 bp, Artificial Sequence
  Description of Artificial Sequence: Synthetic probe
tgcgtcctagccaataaggacaccttagacttggttgtagtgcggacgtataagaggact

SEQ ID NO: 16061 - DNA, 60 bp, Artificial Sequence
  Description of Artificial Sequence: Synthetic probe
gactgcaggtcaggtaataacaaggggcctgtgagtggaatctatttaaaaccagggccg

SEQ ID NO: 16062 - DNA, 60 bp, Artificial Sequence
  Description of Artificial Sequence: Synthetic probe
tgactgcaggtcaggtaataacaaggggcctgtgagtggaatctatttaaaaccagggcc

SEQ ID NO: 16063 - DNA, 60 bp, Artificial Sequence
  Description of Artificial Sequence: Synthetic probe
gacgcctcggaaatagaggtctcgatatgccacgtggacgagggcacgcccaaagcacat

SEQ ID NO: 16064 - DNA, 60 bp, Artificial Sequence
  Description of Artificial Sequence: Synthetic probe
agtcgtcagtggttcgacgcctcggaaatagaggtctcgatatgccacgtggacgagggc

SEQ ID NO: 16065 - DNA, 60 bp, Artificial Sequence
  Description of Artificial Sequence: Synthetic probe
gttacgagaactacacatacctcaatgcaagaaaactaggggaggatgtaccggcatacg

SEQ ID NO: 16066 - DNA, 60 bp, Artificial Sequence
  Description of Artificial Sequence: Synthetic probe
tgacagacagttacgagaactacacatacctcaatgcaagaaaactaggggaggatgtac

SEQ ID NO: 16067 - DNA, 60 bp, Artificial Sequence
  Description of Artificial Sequence: Synthetic probe
tggacgagggcatgcccaaagcacatcttaacctgagcgggggtcgcccaggtgaaagca

SEQ ID NO: 16068 - DNA, 60 bp, Artificial Sequence
  Description of Artificial Sequence: Synthetic probe
gtgaagcccggtaggtattacagaagtcaggaaacagcaaccgggtcaaaggactaccac

SEQ ID NO: 16069 - DNA, 60 bp, Artificial Sequence
  Description of Artificial Sequence: Synthetic probe
ttgtaaaaccagaccccctgacgcaactatagtagtagaaggagtcaagtaccaggtgaa

SEQ ID NO: 16070 - DNA, 60 bp, Artificial Sequence
  Description of Artificial Sequence: Synthetic probe
gggaagacctctataactgtgcccttggaggaaactggacttgtatagtaggggaacagc

SEQ ID NO: 16071 - DNA, 60 bp, Artificial Sequence
  Description of Artificial Sequence: Synthetic probe
aacttctaggggaagacctctataactgtgcccttggaggaaactggacttgtatagtag

SEQ ID NO: 16072 - DNA, 60 bp, Artificial Sequence
  Description of Artificial Sequence: Synthetic probe
aactaatgctaggtccctgccgcggaaaggtgactgccggaaaggcaatgtgaacggagc

SEQ ID NO: 16073 - DNA, 60 bp, Artificial Sequence
  Description of Artificial Sequence: Synthetic probe
aacatcctaactaatgctaggtccctgccgcggaaaggtgactgccggaaaggcaatgtg

SEQ ID NO: 16074 - DNA, 53 bp, Artificial Sequence
  Description of Artificial Sequence: Synthetic probe
tactttggctattggtcacgtacatggtcctgtcagaacagaatgcctcagct

SEQ ID NO: 16075 - DNA, 60 bp, Artificial Sequence
  Description of Artificial Sequence: Synthetic probe
tgttaaaaggggactaccaatattggtttgatctggaggtcagtgaccaccatcgggatt

SEQ ID NO: 16076 - DNA, 51 bp, Artificial Sequence
  Description of Artificial Sequence: Synthetic probe
tgttaaaaggggactaccaatattggtttgatctggaggtcagtgaccacc

SEQ ID NO: 16077 - DNA, 60 bp, Artificial Sequence
  Description of Artificial Sequence: Synthetic probe
caagtattatgaacccagggacaattacttccagcaatacatgttaaaaggggactacca

SEQ ID NO: 16078 - DNA, 60 bp, Artificial Sequence
  Description of Artificial Sequence: Synthetic probe
cttaaggaacaagtattatgaacccagggacaattacttccagcaatacatgttaaaagg

SEQ ID NO: 16079 - DNA, 60 bp, Artificial Sequence
  Description of Artificial Sequence: Synthetic probe
gagggaccagtggagaagacagcgtgtacattcaactatacaaggaccttaaggaacaag

SEQ ID NO: 16080 - DNA, 60 bp, Artificial Sequence
  Description of Artificial Sequence: Synthetic probe
agtgagggaccagtggagaagacagcgtgtacattcaactatacaaggaccttaaggaac

SEQ ID NO: 16081 - DNA, 60 bp, Artificial Sequence
  Description of Artificial Sequence: Synthetic probe
gacctatgccttgcaagccacatgaaattatatctagtgagggaccagtggagaagacag

SEQ ID NO: 16082 - DNA, 60 bp, Artificial Sequence
  Description of Artificial Sequence: Synthetic probe
tggacacgaaacttggacctatgccttgcaagccacatgaaattatatctagtgagggac

SEQ ID NO: 16083 - DNA, 60 bp, Artificial Sequence
  Description of Artificial Sequence: Synthetic probe
taaaattggagacacgctggtgcaggtcgtggcaatggacacgaaacttggacctatgcc

SEQ ID NO: 16084 - DNA, 60 bp, Artificial Sequence
  Description of Artificial Sequence: Synthetic probe
tggactggtgaagtgtaaaattggagacacgctggtgcaggtcgtggcaatggacacgaa

SEQ ID NO: 16085 - DNA, 60 bp, Artificial Sequence
  Description of Artificial Sequence: Synthetic probe
gacgacacctcttgcaatgtggatggcgtagcgatagtgccaaatggactggtgaagtgt

SEQ ID NO: 16086 - DNA, 60 bp, Artificial Sequence
  Description of Artificial Sequence: Synthetic probe
ttggtagacgacacctcttgcaatgtggatggcgtagcgatagtgccaaatggactggtg

SEQ ID NO: 16087 - DNA, 60 bp, Artificial Sequence
  Description of Artificial Sequence: Synthetic probe
cacactatccaattggcaaatgcaggttaaaaaatgagactggctacaggttggtagacg

SEQ ID NO: 16088 - DNA, 60 bp, Artificial Sequence
  Description of Artificial Sequence: Synthetic probe
gcaagtggtgcggctacaagttcttgaagagtgaagggttaccacactatccaattggca

SEQ ID NO: 16089 - DNA, 60 bp, Artificial Sequence
  Description of Artificial Sequence: Synthetic probe
tgaatcctgcaagtggtgcggctacaagttcttgaagagtgaagggttaccacactatcc

SEQ ID NO: 16090 - DNA, 60 bp, Artificial Sequence
  Description of Artificial Sequence: Synthetic probe
aactggacgtgtatagtaggggatcagctacgttacacagggggtaccattgaatcctgc

SEQ ID NO: 16091 - DNA, 60 bp, Artificial Sequence
  Description of Artificial Sequence: Synthetic probe
taggggaagatctctatgactgcatcttaggaggaaactggacgtgtatagtaggggatc

SEQ ID NO: 16092 - DNA, 60 bp, Artificial Sequence
  Description of Artificial Sequence: Synthetic probe
ttactcaaaaacttttaggggaagatctctatgactgcatcttaggaggaaactggacgt

SEQ ID NO: 16093 - DNA, 60 bp, Artificial Sequence
  Description of Artificial Sequence: Synthetic probe
agtgcggacgtataagagggttgtcccattccctaataggcaaggttgtgttactcaaaa

SEQ ID NO: 16094 - DNA, 60 bp, Artificial Sequence
  Description of Artificial Sequence: Synthetic probe
gggtctgtgagctgtaccctagctaataaggacaccctagatacggccgtagtgcggacg

SEQ ID NO: 16095 - DNA, 60 bp, Artificial Sequence
  Description of Artificial Sequence: Synthetic probe
cagccttccagatggtgtgccccatagggtggacagggtctgtgagctgtaccctagcta

SEQ ID NO: 16096 - DNA, 60 bp, Artificial Sequence
  Description of Artificial Sequence: Synthetic probe
cactactaaatgggccagccttccagatggtgtgccccatagggtggacagggtctgtga

SEQ ID NO: 16097 - DNA, 60 bp, Artificial Sequence
  Description of Artificial Sequence: Synthetic probe
cccgtgtgattcaaaacccgtagtaagagggaaatttaacacaacactactaaatgggcc

SEQ ID NO: 16098 - DNA, 60 bp, Artificial Sequence
  Description of Artificial Sequence: Synthetic probe
gatctgcccgtgtgattcaaaacccgtagtaagagggaaatttaacacaacactactaaa

SEQ ID NO: 16099 - DNA, 60 bp, Artificial Sequence
  Description of Artificial Sequence: Synthetic probe
ggggctgaaggtcttactaccacctggtatgaatactcagatgggatgcagctgagcgac

SEQ ID NO: 16100 - DNA, 60 bp, Artificial Sequence
  Description of Artificial Sequence: Synthetic probe
tccgctgggggctgaaggtcttactaccacctggtatgaatactcagatgggatgcagct

SEQ ID NO: 16101 - DNA, 60 bp, Artificial Sequence
  Description of Artificial Sequence: Synthetic probe
aacaaggtctcgagatgccacgtggacgagggcatgcccaaagcacatcttagcctgggc

SEQ ID NO: 16102 - DNA, 60 bp, Artificial Sequence
  Description of Artificial Sequence: Synthetic probe
cctcgagatgctacgtggacgagggcatgcccaggacacactttaaccctggcgggggtc

SEQ ID NO: 16103 - DNA, 57 bp, Artificial Sequence
  Description of Artificial Sequence: Synthetic probe
cctcgagatgctacgtggacgagggcatgcccaggacacactttaaccctggcgggg

SEQ ID NO: 16104 - DNA, 55 bp, Artificial Sequence
  Description of Artificial Sequence: Synthetic probe
atgctaataacaggggcacagggcttccctgaatgcaaagagggcttccaatatg

SEQ ID NO: 16105 - DNA, 60 bp, Artificial Sequence
  Description of Artificial Sequence: Synthetic probe
ctgatgctaataacaggggcacagagcttccctgaatgcaaagagggcttccaatatgcc

SEQ ID NO: 16106 - DNA, 60 bp, Artificial Sequence
  Description of Artificial Sequence: Synthetic probe
ctgatgctaataacaggggcacagggcttccctgaatgcaaagagggcttccaatatgcc

SEQ ID NO: 16107 - DNA, 51 bp, Artificial Sequence
  Description of Artificial Sequence: Synthetic probe
gatgccacgtggacgagggcatgcccacagcacatcttagcctgagcgggg

SEQ ID NO: 16108 - DNA, 60 bp, Artificial Sequence
  Description of Artificial Sequence: Synthetic probe
ttggagacacagtggtgcaagtcatagcaatggacacaaaacttgggcctatgccttgca

SEQ ID NO: 16109 - DNA, 60 bp, Artificial Sequence
  Description of Artificial Sequence: Synthetic probe
tgaagaatgaaagtggctacagacaagtagatgagacctcttgtaacagagacggtgtgg

SEQ ID NO: 16110 - DNA, 60 bp, Artificial Sequence
  Description of Artificial Sequence: Synthetic probe
tctaaagaatgaaagtggctacagacaagtagatgagacctcttgtaacagagacggggt

SEQ ID NO: 16111 - DNA, 60 bp, Artificial Sequence
  Description of Artificial Sequence: Synthetic probe
gctaaaaaatgaaagtggctacagacaagtagatgagacctcttgcaacagagacggtgt

SEQ ID NO: 16112 - DNA, 60 bp, Artificial Sequence
  Description of Artificial Sequence: Synthetic probe
tgcgtcctagccaataaggacaccctaaacatggttacagtgcggacgtataagagggtt

SEQ ID NO: 16113 - DNA, 60 bp, Artificial Sequence
  Description of Artificial Sequence: Synthetic probe
tgcgtcctagccaataaggacaccctaaacatggtcgtagtgcggacgtataacagggct

SEQ ID NO: 16114 - DNA, 60 bp, Artificial Sequence
  Description of Artificial Sequence: Synthetic probe
cagaagccaggaaacagcaaccgggtcaaaggactaccactatgacctcttgcaggcaca

SEQ ID NO: 16115 - DNA, 60 bp, Artificial Sequence
  Description of Artificial Sequence: Synthetic probe
acagaagccaggaaacagcaaccgggtcaaaggactaccactatgacctcttgcaggcac

SEQ ID NO: 16116 - DNA, 60 bp, Artificial Sequence
  Description of Artificial Sequence: Synthetic probe
tagtgaatgagagtggctatagacaagtggatgagacttcttgcaacagagacggcgtgg

SEQ ID NO: 16117 - DNA, 60 bp, Artificial Sequence
  Description of Artificial Sequence: Synthetic probe
cactcacggtgttatggacacagcctgatagggtgtagcagagacctgctattccgctag

SEQ ID NO: 16118 - DNA, 60 bp, Artificial Sequence
  Description of Artificial Sequence: Synthetic probe
ccacagaactcccaaaggcagtgatagaggagataggaagacacaaacgggtgttggtgc

SEQ ID NO: 16119 - DNA, 60 bp, Artificial Sequence
  Description of Artificial Sequence: Synthetic probe
ctacagaactcccaaaggcagtgatagaggagataggaagacacaagcgggtgctagtgc

SEQ ID NO: 16120 - DNA, 60 bp, Artificial Sequence
  Description of Artificial Sequence: Synthetic probe
accacagaactcccaaaggcagtgatagaggagataggaagacacaaacgggtgttggtg

SEQ ID NO: 16121 - DNA, 60 bp, Artificial Sequence
  Description of Artificial Sequence: Synthetic probe
ggtaaagcgttgaagcaagtgatgggactgtcctccgctgaaaatgccctactcatagca

SEQ ID NO: 16122 - DNA, 60 bp, Artificial Sequence
  Description of Artificial Sequence: Synthetic probe
gctcatctccgaggatttgccatccgccgtcaagaatatcatggccagaactgaccaccc

SEQ ID NO: 16123 - DNA, 60 bp, Artificial Sequence
  Description of Artificial Sequence: Synthetic probe
ttgtgacatcacagtctccgtatgtagtcgtagctacaaatgccattgagtcaggggtga

SEQ ID NO: 16124 - DNA, 60 bp, Artificial Sequence
  Description of Artificial Sequence: Synthetic probe
agcaggatcagtaacgacaactggtcagaagcacccaatagaggagttcattgcccctga

SEQ ID NO: 16125 - DNA, 60 bp, Artificial Sequence
  Description of Artificial Sequence: Synthetic probe
gcgtctatgtgtgagatatctaaaagaattgggagagtaactggtagtgatagcaaatta

SEQ ID NO: 16126 - DNA, 60 bp, Artificial Sequence
  Description of Artificial Sequence: Synthetic probe
agcgtctatgtgtgagatatctaaaagaattgggagagtaactggtagtgatagcaaatt

SEQ ID NO: 16127 - DNA, 60 bp, Artificial Sequence
  Description of Artificial Sequence: Synthetic probe
gtggctatagtaccatctggtctggtaaaatgcaagataggggacacagtggtgcaagtc

SEQ ID NO: 16128 - DNA, 51 bp, Artificial Sequence
  Description of Artificial Sequence: Synthetic probe
gtggtgcaggtcatagcaatggatacaaaacttggacctatgccttgcaaa

SEQ ID NO: 16129 - DNA, 55 bp, Artificial Sequence
  Description of Artificial Sequence: Synthetic probe
cacagtggtgcaggtcttggcaatggatacaaaacttggacctatgccttgcaaa

SEQ ID NO: 16130 - DNA, 60 bp, Artificial Sequence
  Description of Artificial Sequence: Synthetic probe
gagtggctatagacaagtggatgagactccttgcaatagagacggcgtggctatagtgcc

SEQ ID NO: 16131 - DNA, 60 bp, Artificial Sequence
  Description of Artificial Sequence: Synthetic probe
agagtggctatagacaagtggatgagactccttgcaatagagacggcgtggctatagtgc

SEQ ID NO: 16132 - DNA, 60 bp, Artificial Sequence
  Description of Artificial Sequence: Synthetic probe
gcaggcttgagaatgagagtggctatagacaagtggatgagactccttgcaatagagacg

SEQ ID NO: 16133 - DNA, 60 bp, Artificial Sequence
  Description of Artificial Sequence: Synthetic probe
gacgtactacgatacataggagggcccgtcgagtcttgtaagtggtgtggttacaagttc

SEQ ID NO: 16134 - DNA, 60 bp, Artificial Sequence
  Description of Artificial Sequence: Synthetic probe
acgagggcatgcccaagacacaccttaacctgggcgggggtcgtccaggtgaaaacaccc

SEQ ID NO: 16135 - DNA, 60 bp, Artificial Sequence
  Description of Artificial Sequence: Synthetic probe
ccaggattatgtggggcccgtctatcatagagccccactggaactatgtagggaggcaag

SEQ ID NO: 16136 - DNA, 54 bp, Artificial Sequence
  Description of Artificial Sequence: Synthetic probe
tgagatgctacgtggacgagggcatgcccaagacacaccttaaccctggcgggg

SEQ ID NO: 16137 - DNA, 60 bp, Artificial Sequence
  Description of Artificial Sequence: Synthetic probe
tgagatgctacgtggacgagggcatgcccaagacacaccttaaccctggcgggggtcgcc

SEQ ID NO: 16138 - DNA, 60 bp, Artificial Sequence
  Description of Artificial Sequence: Synthetic probe
ccagctttccagatggtatgcccacaggggtggactggtacaatagaatgcaccctagcg

SEQ ID NO: 16139 - DNA, 60 bp, Artificial Sequence
  Description of Artificial Sequence: Synthetic probe
ccagctttccagatggtatgcccacaggggtggactggtacaatagaatgcatcctggcg

SEQ ID NO: 16140 - DNA, 60 bp, Artificial Sequence
  Description of Artificial Sequence: Synthetic probe
cttactgaatggaccagctttccagatggtatgcccacaggggtggactggtacaataga

SEQ ID NO: 16141 - DNA, 60 bp, Artificial Sequence
  Description of Artificial Sequence: Synthetic probe
agcttactgaatggaccagctttccagatggtatgcccacaggggtggactggtacaata

SEQ ID NO: 16142 - DNA, 60 bp, Artificial Sequence
  Description of Artificial Sequence: Synthetic probe
atgctagcctgctgaatggaccagctttccagatggtatgcccacaggggtggactggta

SEQ ID NO: 16143 - DNA, 60 bp, Artificial Sequence
  Description of Artificial Sequence: Synthetic probe
gctagcctgctgaatggaccagctttccagatggtatgcccacaggggtggactggtaca

SEQ ID NO: 16144 - DNA, 60 bp, Artificial Sequence
  Description of Artificial Sequence: Synthetic probe
gctagcctactgaatggaccagctttccagatggtatgcccacaggggtggagtggtaca

SEQ ID NO: 16145 - DNA, 60 bp, Artificial Sequence
  Description of Artificial Sequence: Synthetic probe
ccttgcagaccgtacgaaatctcatcaagtgagggacctgtggaaaagacggcatgcacc

SEQ ID NO: 16146 - DNA, 60 bp, Artificial Sequence
  Description of Artificial Sequence: Synthetic probe
agtgggggagcaactacagtacacagggggtcacatagaatcatgcaagtggtgcggtta

SEQ ID NO: 16147 - DNA, 60 bp, Artificial Sequence
  Description of Artificial Sequence: Synthetic probe
gccagacccgtagtaagagggaagttcaacacaacactgctaaacgggccagctttccaa

SEQ ID NO: 16148 - DNA, 60 bp, Artificial Sequence
  Description of Artificial Sequence: Synthetic probe
attacaggggcacagggctacccggactgcaaacccgatttttcatatgccatagcaaag

SEQ ID NO: 16149 - DNA, 60 bp, Artificial Sequence
  Description of Artificial Sequence: Synthetic probe
ggccttatgagacagctacagtgctggcattcgaagaggtggggcaggtgataaaaattg

SEQ ID NO: 16150 - DNA, 60 bp, Artificial Sequence
  Description of Artificial Sequence: Synthetic probe
ggggtcatttatcagaggtgctactactctctctagtggtgatgtctgactttgccccag

SEQ ID NO: 16151 - DNA, 60 bp, Artificial Sequence
  Description of Artificial Sequence: Synthetic probe
ttgcaggaatattggtgcagggtccttgcaactttgagatagcggcgagtgatgtattgt

SEQ ID NO: 16152 - DNA, 60 bp, Artificial Sequence
  Description of Artificial Sequence: Synthetic probe
acagaagggatacaacgggcaatgttccaaaggggcgtgaataggagcctacatgggata

SEQ ID NO: 16153 - DNA, 60 bp, Artificial Sequence
  Description of Artificial Sequence: Synthetic probe
ctgcgtgaaatcacatcgcgtgatgggagtacagcctgatagggtgttgcagagacccac

SEQ ID NO: 16154 - DNA, 60 bp, Artificial Sequence
  Description of Artificial Sequence: Synthetic probe
gcctgagtgaaatcacattgtgtgatgggagtacagcctgatagggtgttgcagagaccc

SEQ ID NO: 16155 - DNA, 60 bp, Artificial Sequence
  Description of Artificial Sequence: Synthetic probe
gcctgcgtgaaatcacatcgcgtgatgggagtacagcctgatagggtgttgcagagaccc

SEQ ID NO: 16156 - DNA, 60 bp, Artificial Sequence
  Description of Artificial Sequence: Synthetic probe
gcctgtgtgaaatcacctcgcgtgatgggagtacagcctgatagggtgttgcagagaccc

SEQ ID NO: 16157 - DNA, 60 bp, Artificial Sequence
  Description of Artificial Sequence: Synthetic probe
taagtattatgagccaagggaccggtacttccaacaatacatgttaaaagggaagtggca

SEQ ID NO: 16158 - DNA, 60 bp, Artificial Sequence
  Description of Artificial Sequence: Synthetic probe
taagtattatgagccaagggaccggtacttccaacaatacatgttaaaaggggaatggca

SEQ ID NO: 16159 - DNA, 60 bp, Artificial Sequence
  Description of Artificial Sequence: Synthetic probe
ttggcaaatgtaagctagtgaatgagagtggctatagacaagtggatgagacttcttgca

SEQ ID NO: 16160 - DNA, 53 bp, Artificial Sequence
  Description of Artificial Sequence: Synthetic probe
ccaggggaagaactacgatatgtaggtggcccagtcgagtcttgtaaatggtg

SEQ ID NO: 16161 - DNA, 60 bp, Artificial Sequence
  Description of Artificial Sequence: Synthetic probe
tgtacactggccaataaggatacgttagacacaaccgttgtgcgaacgtacaagagggac

SEQ ID NO: 16162 - DNA, 60 bp, Artificial Sequence
  Description of Artificial Sequence: Synthetic probe
gagccaggaaacagcaaccgggtcaaaagactaccactatgacctgttacaggcacagag

SEQ ID NO: 16163 - DNA, 60 bp, Artificial Sequence
  Description of Artificial Sequence: Synthetic probe
ctgtcttgagatgctatgtggacgagggcatgcccaagatgtaccttaacataggcgggg

SEQ ID NO: 16164 - DNA, 60 bp, Artificial Sequence
  Description of Artificial Sequence: Synthetic probe
acctgtcttgagatgctatgtggacgagggcatgcccaagatgtaccttaacataggcgg

SEQ ID NO: 16165 - DNA, 54 bp, Artificial Sequence
  Description of Artificial Sequence: Synthetic probe
acacaggtaatgacctgtcttgagatgctatgtggacgagggcatgcccaagat

SEQ ID NO: 16166 - DNA, 60 bp, Artificial Sequence
  Description of Artificial Sequence: Synthetic probe
atctaagccctgagtacagggcagtcgtcaatagttcaacacaggtaatgacctgtcttg

SEQ ID NO: 16167 - DNA, 58 bp, Artificial Sequence
  Description of Artificial Sequence: Synthetic probe
atctaagccctgagtacagggcagtcgtcaatagttcaacacaggtaatgacctgtct

SEQ ID NO: 16168 - DNA, 60 bp, Artificial Sequence
  Description of Artificial Sequence: Synthetic probe
tgaaaacggtttaaccaaccgctacgaatacagcctgatagggtgctgcagaggcccact

SEQ ID NO: 16169 - DNA, 60 bp, Artificial Sequence
  Description of Artificial Sequence: Synthetic probe
ggagatacggtcatacaggtcattgccttggacaccaagctcgggcccatgccttgcaga

SEQ ID NO: 16170 - DNA, 60 bp, Artificial Sequence
  Description of Artificial Sequence: Synthetic probe
gataggagatacggtcatacaggtcattgccttggacaccaagctcgggcccatgccttg

SEQ ID NO: 16171 - DNA, 60 bp, Artificial Sequence
  Description of Artificial Sequence: Synthetic probe
gagaatgagactggctacaggtttgtagatgacacttcttgcaacaggaatggcgtagcc

SEQ ID NO: 16172 - DNA, 60 bp, Artificial Sequence
  Description of Artificial Sequence: Synthetic probe
gggaggacctccatgactgtatccttggaggaaattggacgtgtatagcgggtgagcaac

SEQ ID NO: 16173 - DNA, 60 bp, Artificial Sequence
  Description of Artificial Sequence: Synthetic probe
ttgtaggggaggacctccatgactgtatccttggaggaaattggacgtgtatagcgggtg

SEQ ID NO: 16174 - DNA, 60 bp, Artificial Sequence
  Description of Artificial Sequence: Synthetic probe
tagtaggtccaaaccattcccttacagacaaggctgcatcactcaaaaagttgtagggga

SEQ ID NO: 16175 - DNA, 60 bp, Artificial Sequence
  Description of Artificial Sequence: Synthetic probe
tgtatactagctaatgaagataccttagatacaactgtagtacagacgtatagtaggtcc

SEQ ID NO: 16176 - DNA, 59 bp, Artificial Sequence
  Description of Artificial Sequence: Synthetic probe
gggatacagtggttcaggttatagcaatggatccaggacttgggcctatgcattgtaaa

SEQ ID NO: 16177 - DNA, 60 bp, Artificial Sequence
  Description of Artificial Sequence: Synthetic probe
gtgtggctatagtgccatctggaacactaaaatgcaagataggggatacagtggttcagg

SEQ ID NO: 16178 - DNA, 60 bp, Artificial Sequence
  Description of Artificial Sequence: Synthetic probe
cagagatggtgtggctatagtgccatctggaacactaaaatgcaagataggggatacagt

SEQ ID NO: 16179 - DNA, 60 bp, Artificial Sequence
  Description of Artificial Sequence: Synthetic probe
gactggttaccgactagtggatgataccacctgtaacagagatggtgtggctatagtgcc

SEQ ID NO: 16180 - DNA, 60 bp, Artificial Sequence
  Description of Artificial Sequence: Synthetic probe
aggttgaagaatgagactggttaccgactagtggatgataccacctgtaacagagatggt

SEQ ID NO: 16181 - DNA, 60 bp, Artificial Sequence
  Description of Artificial Sequence: Synthetic probe
acaattttcagaaagaagaaggcttaccacactacccaattggcaagtgcaggttgaaga

SEQ ID NO: 16182 - DNA, 58 bp, Artificial Sequence
  Description of Artificial Sequence: Synthetic probe
ggggccccattgagacttgtaaatggtgtggccacaattttcagaaagaagaaggctt

SEQ ID NO: 16183 - DNA, 60 bp, Artificial Sequence
  Description of Artificial Sequence: Synthetic probe
gcagctaaaatacgcagggggccccattgagacttgtaaatggtgtggccacaattttca

SEQ ID NO: 16184 - DNA, 60 bp, Artificial Sequence
  Description of Artificial Sequence: Synthetic probe
cctgtgatctgggaggtaattggacatgcattgcaggagagcagctaaaatacgcagggg

SEQ ID NO: 16185 - DNA, 60 bp, Artificial Sequence
  Description of Artificial Sequence: Synthetic probe
caatgaagacaccctggatacgaccaaggtgcggacttatagaagggccaaaccgtaccc

SEQ ID NO: 16186 - DNA, 60 bp, Artificial Sequence
  Description of Artificial Sequence: Synthetic probe
tgcactttagtcaatgaagacaccctggatacgaccaaggtgcggacttatagaagggcc

SEQ ID NO: 16187 - DNA, 60 bp, Artificial Sequence
  Description of Artificial Sequence: Synthetic probe
ggtcacagcctgatagggtgctgcagaggcccactgcataggctagtataaaaaatctct

SEQ ID NO: 16188 - DNA, 53 bp, Artificial Sequence
  Description of Artificial Sequence: Synthetic probe
ggtcacagcctgatagggtgctgcagaggcccactgcataggctagtataaaa

SEQ ID NO: 16189 - DNA, 52 bp, Artificial Sequence
  Description of Artificial Sequence: Synthetic probe
acttaggtgggtccacaacaggctcaactgtcctctatgggtcacaagctgc

SEQ ID NO: 16190 - DNA, 60 bp, Artificial Sequence
  Description of Artificial Sequence: Synthetic probe
acagtgaagagtgccacaagaagtcaccaaaaggtacttaggtgggtccacaacaggctc

SEQ ID NO: 16191 - DNA, 60 bp, Artificial Sequence
  Description of Artificial Sequence: Synthetic probe
atagaaggatgtataacagtgaagagtgccacaagaagtcaccaaaaggtacttaggtgg

SEQ ID NO: 16192 - DNA, 60 bp, Artificial Sequence
  Description of Artificial Sequence: Synthetic probe
gggtcccgtctatcacagagccccactggagcttttcgaggagggatttatgtgtgaaac

SEQ ID NO: 16193 - DNA, 60 bp, Artificial Sequence
  Description of Artificial Sequence: Synthetic probe
ataagggtcccgtctatcacagagccccactggagcttttcgaggagggatttatgtgtg

SEQ ID NO: 16194 - DNA, 60 bp, Artificial Sequence
  Description of Artificial Sequence: Synthetic probe
ctacctgaagccagggccactattctttcaagactataagggtcccgtctatcacagagc

SEQ ID NO: 16195 - DNA, 60 bp, Artificial Sequence
  Description of Artificial Sequence: Synthetic probe
ttggcatctttaccaaaaagaggtgattgcaggtctggtaacagcaaaggacctgtgagt

SEQ ID NO: 16196 - DNA, 60 bp, Artificial Sequence
  Description of Artificial Sequence: Synthetic probe
cgacgctaaagctcccacacaagagaggggaacgtgacgttcccaccaatttggcatctt

SEQ ID NO: 16197 - DNA, 60 bp, Artificial Sequence
  Description of Artificial Sequence: Synthetic probe
tcaggcaggtaatcctttatttggtgaaaagggggcaatccaccctcaatcgacgctaaa

SEQ ID NO: 16198 - DNA, 60 bp, Artificial Sequence
  Description of Artificial Sequence: Synthetic probe
ggatgcatattggtgaaaagcgccacaagaaacaaccaacgagtacttaggtgggtccac

SEQ ID NO: 16199 - DNA, 60 bp, Artificial Sequence
  Description of Artificial Sequence: Synthetic probe
tatagatggatgcatattggtgaaaagcgccacaagaaacaaccaacgagtacttaggtg

SEQ ID NO: 16200 - DNA, 58 bp, Artificial Sequence
  Description of Artificial Sequence: Synthetic probe
aaaacccgctggagtggaggaaccagtttatgaccgaacaggtaaccccttgtttggc

SEQ ID NO: 16201 - DNA, 60 bp, Artificial Sequence
  Description of Artificial Sequence: Synthetic probe
ggagacacagtcgtgcaggtcatagctatggacaccaacctagggcctatgccttgcaga

SEQ ID NO: 16202 - DNA, 60 bp, Artificial Sequence
  Description of Artificial Sequence: Synthetic probe
gataggagacacagtcgtgcaggtcatagctatggacaccaacctagggcctatgccttg

SEQ ID NO: 16203 - DNA, 60 bp, Artificial Sequence
  Description of Artificial Sequence: Synthetic probe
gcgtagccatagtgccatctggatcaatgagttgcaagataggagacacagtcgtgcagg

SEQ ID NO: 16204 - DNA, 60 bp, Artificial Sequence
  Description of Artificial Sequence: Synthetic probe
tgtaatagagagggcgtagccatagtgccatctggatcaatgagttgcaagataggagac

SEQ ID NO: 16205 - DNA, 60 bp, Artificial Sequence
  Description of Artificial Sequence: Synthetic probe
atgagacaggctaccgactagtggatgatacctcctgtaatagagagggcgtagccatag

SEQ ID NO: 16206 - DNA, 60 bp, Artificial Sequence
  Description of Artificial Sequence: Synthetic probe
agtgcaggttggaaaatgagacaggctaccgactagtggatgatacctcctgtaatagag

SEQ ID NO: 16207 - DNA, 59 bp, Artificial Sequence
  Description of Artificial Sequence: Synthetic probe
aaaagcgacggcctaccacactaccctatcggtaagtgcaggttggaaaatgagacagg

SEQ ID NO: 16208 - DNA, 60 bp, Artificial Sequence
  Description of Artificial Sequence: Synthetic probe
tggccacgatttcagaaaaagcgacggcctaccacactaccctatcggtaagtgcaggtt

SEQ ID NO: 16209 - DNA, 60 bp, Artificial Sequence
  Description of Artificial Sequence: Synthetic probe
ggggaccagttgagatatacagggggccttatcgagacttgtaggtggtgtggccacgat

SEQ ID NO: 16210 - DNA, 57 bp, Artificial Sequence
  Description of Artificial Sequence: Synthetic probe
aacacagtggtgcaagtcatagcaatggatgacaagctagggcctatgccttgcaaa

SEQ ID NO: 16211 - DNA, 54 bp, Artificial Sequence
  Description of Artificial Sequence: Synthetic probe
aacacagtggtgcaagtcatagcaatggatgacaagctagggcctatgccttgc

SEQ ID NO: 16212 - DNA, 59 bp, Artificial Sequence
  Description of Artificial Sequence: Synthetic probe
ccattggggaagacctctacgaatgtgtcttaggagggaattggacttgtgtgccgggg

SEQ ID NO: 16213 - DNA, 59 bp, Artificial Sequence
  Description of Artificial Sequence: Synthetic probe
ccatcggggaagatctctacgactgtgtcttaggagggaattggacttgtgtgccgggg

SEQ ID NO: 16214 - DNA, 60 bp, Artificial Sequence
  Description of Artificial Sequence: Synthetic probe
aaaggtctcgagatgccacgtggacgagggcatgcccaaagcacatcttagcctgagcgg

SEQ ID NO: 16215 - DNA, 60 bp, Artificial Sequence
  Description of Artificial Sequence: Synthetic probe
tatccaattggcaaatgcaggttaaaaaacgaaaccggctacaggctggtagatgacacc

SEQ ID NO: 16216 - DNA, 60 bp, Artificial Sequence
  Description of Artificial Sequence: Synthetic probe
ccaaccgctacgaatacagcctgatagggtgctgcagaggcccactggattgctactgaa

SEQ ID NO: 16217 - DNA, 60 bp, Artificial Sequence
  Description of Artificial Sequence: Synthetic probe
ctggagcatctgggatgggtactgagagggccagctgtgtgcaagaaaatcaccaaccac

SEQ ID NO: 16218 - DNA, 60 bp, Artificial Sequence
  Description of Artificial Sequence: Synthetic probe
cctggagcatctgggatgggtactgagagggccacccgtgtgcaagaaagtcaccaacca

SEQ ID NO: 16219 - DNA, 60 bp, Artificial Sequence
  Description of Artificial Sequence: Synthetic probe
actaatggtggggaacctaggcgcggaagttggcgacctggagcatctgggatgggtact

SEQ ID NO: 16220 - DNA, 60 bp, Artificial Sequence
  Description of Artificial Sequence: Synthetic probe
gggtaatctaagccctgagtacagggcagtcgtcagtagttcgacacaggtggggacctg

SEQ ID NO: 16221 - DNA, 60 bp, Artificial Sequence
  Description of Artificial Sequence: Synthetic probe
tgaaaacagtttgaccaactgttacgaatacagcctgatagggtgctgcagaggcccact

SEQ ID NO: 16222 - DNA, 60 bp, Artificial Sequence
  Description of Artificial Sequence: Synthetic probe
taggatggacagggactgtaagctgcacgctggccaataaggatacgttagccacaacca

SEQ ID NO: 16223 - DNA, 60 bp, Artificial Sequence
  Description of Artificial Sequence: Synthetic probe
agatggtttgtcctataggatggacagggactgtaagctgcacgctggccaataaggata

SEQ ID NO: 16224 - DNA, 51 bp, Artificial Sequence
  Description of Artificial Sequence: Synthetic probe
cccatgcgatgctagacccttgataagaggaaaatttaatacaacacttct

SEQ ID NO: 16225 - DNA, 60 bp, Artificial Sequence
  Description of Artificial Sequence: Synthetic probe
gacatagtagaaatggatgacaactttgatttcggtctttgcccatgcgatgctagaccc

SEQ ID NO: 16226 - DNA, 60 bp, Artificial Sequence
  Description of Artificial Sequence: Synthetic probe
tggtccagcctcccagatggtttgtcctatagggtggacagggactgtgagctgtgcact

SEQ ID NO: 16227 - DNA, 60 bp, Artificial Sequence
  Description of Artificial Sequence: Synthetic probe
agctacgggcctcaccacccagtggtatgaatactcagaggggatgcggctacaggacac

SEQ ID NO: 16228 - DNA, 60 bp, Artificial Sequence
  Description of Artificial Sequence: Synthetic probe
gattggcccacttggagctacgggcctcaccacccagtggtatgaatactcagaggggat

SEQ ID NO: 16229 - DNA, 53 bp, Artificial Sequence
  Description of Artificial Sequence: Synthetic probe
ttttatacgctatagccaaaattaatgagattggcccacttggagctacgggc

SEQ ID NO: 16230 - DNA, 60 bp, Artificial Sequence
  Description of Artificial Sequence: Synthetic probe
tacccagactgcaaacccgactttttatacgctatagccaaaattaatgagattggccca

SEQ ID NO: 16231 - DNA, 60 bp, Artificial Sequence
  Description of Artificial Sequence: Synthetic probe
gccacaagggcaggtaaagtgtaagataggagacacagttgtacaggtcatagctcttga

SEQ ID NO: 16232 - DNA, 60 bp, Artificial Sequence
  Description of Artificial Sequence: Synthetic probe
agtgccacaagggcaggtaaagtgtaagataggagacacagttgtacaggtcatagctct

SEQ ID NO: 16233 - DNA, 53 bp, Artificial Sequence
  Description of Artificial Sequence: Synthetic probe
gtaggttgaagaccgagactggctatagatttgtagactccacttcttgcaac

SEQ ID NO: 16234 - DNA, 60 bp, Artificial Sequence
  Description of Artificial Sequence: Synthetic probe
caaatgagggattaccacactaccccattggcaagtgtaggttgaagaccgagactggct

SEQ ID NO: 16235 - DNA, 60 bp, Artificial Sequence
  Description of Artificial Sequence: Synthetic probe
ttataacttcagaacaaatgagggattaccacactaccccattggcaagtgtaggttgaa

SEQ ID NO: 16236 - DNA, 60 bp, Artificial Sequence
  Description of Artificial Sequence: Synthetic probe
acaggaggctctattgaatcctgcaagtggtgtggttataacttcagaacaaatgaggga

SEQ ID NO: 16237 - DNA, 60 bp, Artificial Sequence
  Description of Artificial Sequence: Synthetic probe
gaccaactacaatatacaggaggctctattgaatcctgcaagtggtgtggttataacttc

SEQ ID NO: 16238 - DNA, 60 bp, Artificial Sequence
  Description of Artificial Sequence: Synthetic probe
gtgatcttggaggaaactggacttgtataactggggaccaactacaatatacaggaggct

SEQ ID NO: 16239 - DNA, 60 bp, Artificial Sequence
  Description of Artificial Sequence: Synthetic probe
aggacctctataactgtgatcttggaggaaactggacttgtataactggggaccaactac

SEQ ID NO: 16240 - DNA, 60 bp, Artificial Sequence
  Description of Artificial Sequence: Synthetic probe
cagaccattcccttataggcaaggctgtatcacccaaaaaattgtgggggaggacctcta

SEQ ID NO: 16241 - DNA, 60 bp, Artificial Sequence
  Description of Artificial Sequence: Synthetic probe
ctagacacaaccgtggtgcgggagtacaggaggcccagaccattcccttataggcaaggc

SEQ ID NO: 16242 - DNA, 60 bp, Artificial Sequence
  Description of Artificial Sequence: Synthetic probe
gctaatagagataccctagacacaaccgtggtgcgggagtacaggaggcccagaccattc

SEQ ID NO: 16243 - DNA, 60 bp, Artificial Sequence
  Description of Artificial Sequence: Synthetic probe
ggtgtgccccataggatggacagggaccgtgagctgtatgttagctaatagagataccct

SEQ ID NO: 16244 - DNA, 60 bp, Artificial Sequence
  Description of Artificial Sequence: Synthetic probe
acatgtggaatgacactcgcagactttgaggagaaacattacaaaaagatttttataaga

SEQ ID NO: 16245 - DNA, 53 bp, Artificial Sequence
  Description of Artificial Sequence: Synthetic probe
gcccataacatgtggaatgacactcgcagactttgaggagaaacattacaaaa

SEQ ID NO: 16246 - DNA, 60 bp, Artificial Sequence
  Description of Artificial Sequence: Synthetic probe
gcccataacatgtggaatgacactcgcagactttgaggagaaacattacaaaaagatatt

SEQ ID NO: 16247 - DNA, 53 bp, Artificial Sequence
  Description of Artificial Sequence: Synthetic probe
tacttaggtgggtccacaacaaactcaattgtcccctgtgggtagcaagttgc

SEQ ID NO: 16248 - DNA, 58 bp, Artificial Sequence
  Description of Artificial Sequence: Synthetic probe
acgagtacttaggtgggtccacaacaaactcaattgtcccctgtgggtagcaagttgc

SEQ ID NO: 16249 - DNA, 60 bp, Artificial Sequence
  Description of Artificial Sequence: Synthetic probe
ggagttctttgaagaagggtctatgtgtgaaacaactagaaggatagggaggacgactgg

SEQ ID NO: 16250 - DNA, 60 bp, Artificial Sequence
  Description of Artificial Sequence: Synthetic probe
ggagttctttgaagaagggtctatgtgtgaaacgactagaaggatagggaggacaactgg

SEQ ID NO: 16251 - DNA, 60 bp, Artificial Sequence
  Description of Artificial Sequence: Synthetic probe
ccccattggagttctttgaagaagggtctatgtgtgaaacgactagaaggatagggagga

SEQ ID NO: 16252 - DNA, 60 bp, Artificial Sequence
  Description of Artificial Sequence: Synthetic probe
ccccattggagttctttgaagaagggtctatgtgtgaaacaactagaaggatagggagga

SEQ ID NO: 16253 - DNA, 60 bp, Artificial Sequence
  Description of Artificial Sequence: Synthetic probe
cgaaagagagtcaatacaccctcaatcaacgttaaaactaccacacaagagaggggaagg

SEQ ID NO: 16254 - DNA, 60 bp, Artificial Sequence
  Description of Artificial Sequence: Synthetic probe
aaccccttgtttggcgaaagagagtcaatacaccctcaatcaacgttaaaactaccacac

SEQ ID NO: 16255 - DNA, 60 bp, Artificial Sequence
  Description of Artificial Sequence: Synthetic probe
ccgaacaggtaaccccttgtttggcgaaagagagtcaatacaccctcaatcaacgttaaa

SEQ ID NO: 16256 - DNA, 60 bp, Artificial Sequence
  Description of Artificial Sequence: Synthetic probe
cgacctggattctgtagaccaccacaaagactacttctcagagtacataatcatagcagt

SEQ ID NO: 16257 - DNA, 60 bp, Artificial Sequence
  Description of Artificial Sequence: Synthetic probe
cggacctatcaagaagtgtaagtggtgtggctatgacttcgtcaactcagagggactacc

SEQ ID NO: 16258 - DNA, 60 bp, Artificial Sequence
  Description of Artificial Sequence: Synthetic probe
aactggtggccatagcaagttgaaagacggacctatcaagaagtgtaagtggtgtggcta

SEQ ID NO: 16259 - DNA, 60 bp, Artificial Sequence
  Description of Artificial Sequence: Synthetic probe
cccttgtgacgcaaaaccagtgataaagggcaaatttaatgccagcttactgaatggacc

SEQ ID NO: 16260 - DNA, 60 bp, Artificial Sequence
  Description of Artificial Sequence: Synthetic probe
gactctgcccttgtgactcaaaaccagtgataaagggcaaatttaatgccagcttactga

SEQ ID NO: 16261 - DNA, 58 bp, Artificial Sequence
  Description of Artificial Sequence: Synthetic probe
tttatgtgtgaaacaactaaacggatagggagagtaactggcagtgacggaaagctgt

SEQ ID NO: 16262 - DNA, 52 bp, Artificial Sequence
  Description of Artificial Sequence: Synthetic probe
gctccactggagctctttgaggagggatttatgtgtgaaacaactaaacgga

SEQ ID NO: 16263 - DNA, 60 bp, Artificial Sequence
  Description of Artificial Sequence: Synthetic probe
aaaagaggtgattgcaggtctggtaacagcaaaggacctgtgagtggaatctacctgaag

SEQ ID NO: 16264 - DNA, 60 bp, Artificial Sequence
  Description of Artificial Sequence: Synthetic probe
gaaatgcaagataggagacaccgtcgtgcaggtcattgctatagacactaaactcgggcc

SEQ ID NO: 16265 - DNA, 60 bp, Artificial Sequence
  Description of Artificial Sequence: Synthetic probe
cacagggactggtgaaatgcaagataggagacaccgtcgtgcaggtcattgctatagaca

SEQ ID NO: 16266 - DNA, 60 bp, Artificial Sequence
  Description of Artificial Sequence: Synthetic probe
gacacttcctgtaacagggatggcgtggccatagtaacacagggactggtgaaatgcaag

SEQ ID NO: 16267 - DNA, 60 bp, Artificial Sequence
  Description of Artificial Sequence: Synthetic probe
cagatttgtggatgacacttcctgtaacagggatggcgtggccatagtaacacagggact

SEQ ID NO: 16268 - DNA, 60 bp, Artificial Sequence
  Description of Artificial Sequence: Synthetic probe
agggaattggacatgtgtaccgggggagcaactacaatacacagggggtcacatcgaatc

SEQ ID NO: 16269 - DNA, 60 bp, Artificial Sequence
  Description of Artificial Sequence: Synthetic probe
ccagatggtgtgccccataggatggacagggactgtgagctgtacgttggccaataggga

SEQ ID NO: 16270 - DNA, 60 bp, Artificial Sequence
  Description of Artificial Sequence: Synthetic probe
tccagatggtgtgccccataggatggacagggactgtgagctgtacgttggccaataggg

SEQ ID NO: 16271 - DNA, 60 bp, Artificial Sequence
  Description of Artificial Sequence: Synthetic probe
ggaaagttcaatacaacactgctaaatggaccagccttccagatggtgtgccccatagga

SEQ ID NO: 16272 - DNA, 60 bp, Artificial Sequence
  Description of Artificial Sequence: Synthetic probe
acccatagtaagaggaaagttcaatacaacactgctaaatggaccagccttccagatggt

SEQ ID NO: 16273 - DNA, 60 bp, Artificial Sequence
  Description of Artificial Sequence: Synthetic probe
ggtgacaactttgaatttggactctgcccatgcgatgccaaacccatagtaagaggaaag

SEQ ID NO: 16274 - DNA, 60 bp, Artificial Sequence
  Description of Artificial Sequence: Synthetic probe
gtcgaaatgggtgacaactttgaatttggactctgcccatgcgatgccaaacccatagta

SEQ ID NO: 16275 - DNA, 59 bp, Artificial Sequence
  Description of Artificial Sequence: Synthetic probe
aaaacttttcgaggggcaaaggcgagaagacatagtcgaaatgggtgacaactttgaat

SEQ ID NO: 16276 - DNA, 60 bp, Artificial Sequence
  Description of Artificial Sequence: Synthetic probe
ccagcgtggtattcgaaaaacttttcgaggggcaaaggcgagaagacatagtcgaaatgg

SEQ ID NO: 16277 - DNA, 60 bp, Artificial Sequence
  Description of Artificial Sequence: Synthetic probe
gagaaaccagatatcttgcaaaattgcattcaagagccttgccgaccagcgtggtattcg

SEQ ID NO: 16278 - DNA, 60 bp, Artificial Sequence
  Description of Artificial Sequence: Synthetic probe
cacaagagaaaccagatatcttgcaaaattgcattcaagagccttgccgaccagcgtggt

SEQ ID NO: 16279 - DNA, 60 bp, Artificial Sequence
  Description of Artificial Sequence: Synthetic probe
gtgcaaagatggtaagatcacatactattcaggatgcacaagagaaaccagatatcttgc

SEQ ID NO: 16280 - DNA, 60 bp, Artificial Sequence
  Description of Artificial Sequence: Synthetic probe
atggtcatagtttggtgcaaagatggtaagatcacatactattcaggatgcacaagagaa

SEQ ID NO: 16281 - DNA, 60 bp, Artificial Sequence
  Description of Artificial Sequence: Synthetic probe
ggtggaaggtacgtgctttggcttctggtcacgtatttggtcctgtcagaacggaatgcc

SEQ ID NO: 16282 - DNA, 60 bp, Artificial Sequence
  Description of Artificial Sequence: Synthetic probe
aatgggccagccttccacatggtatgccccacaggatggacagggtccgtgaactgcgtc

SEQ ID NO: 16283 - DNA, 60 bp, Artificial Sequence
  Description of Artificial Sequence: Synthetic probe
ggagcgtgaagtccccactaatttggcttctttaccaaagagaggtgactgcaggtcggg

SEQ ID NO: 16284 - DNA, 60 bp, Artificial Sequence
  Description of Artificial Sequence: Synthetic probe
ccgcataaaagaggggagcgtgaagtccccactaatttggcttctttaccaaagagaggt

SEQ ID NO: 16285 - DNA, 60 bp, Artificial Sequence
  Description of Artificial Sequence: Synthetic probe
cccacaggggtggactggtagaatagaatgcaccccggcaaaccaagacaccttggatac

SEQ ID NO: 16286 - DNA, 60 bp, Artificial Sequence
  Description of Artificial Sequence: Synthetic probe
ccagatggtatgcccacaggggtggactggtagaatagaatgcaccccggcaaaccaaga

SEQ ID NO: 16287 - DNA, 60 bp, Artificial Sequence
  Description of Artificial Sequence: Synthetic probe
gcctgacgactttgagtttggactctgcccttgtgactcaaaaccagtaataaagggcaa

SEQ ID NO: 16288 - DNA, 60 bp, Artificial Sequence
  Description of Artificial Sequence: Synthetic probe
tagatatgcctgacgactttgagtttggactctgcccttgtgactcaaaaccagtaataa

SEQ ID NO: 16289 - DNA, 60 bp, Artificial Sequence
  Description of Artificial Sequence: Synthetic probe
gcacaagggaagagaggtatttagtggctgtgcatgaaagagccctatcaaccagtgctg

SEQ ID NO: 16290 - DNA, 60 bp, Artificial Sequence
  Description of Artificial Sequence: Synthetic probe
gtgcacaagggaagagaggtatttagtggctgtgcatgaaagagccctatcaaccagtgc

SEQ ID NO: 16291 - DNA, 60 bp, Artificial Sequence
  Description of Artificial Sequence: Synthetic probe
tggggccggagagcttaactacgacttggcatcttcccactaaaaaattagggggctcca

SEQ ID NO: 16292 - DNA, 60 bp, Artificial Sequence
  Description of Artificial Sequence: Synthetic probe
cgtatagaaggtccagaccattcccttataggcaaggctgtattacccaaaagaccctgg

SEQ ID NO: 16293 - DNA, 60 bp, Artificial Sequence
  Description of Artificial Sequence: Synthetic probe
cagcagtagtacggacgtatagaaggtccagaccattcccttataggcaaggctgtatta

SEQ ID NO: 16294 - DNA, 60 bp, Artificial Sequence
  Description of Artificial Sequence: Synthetic probe
ggtaaacggaccagcctcccagatggtatgtcccataggttggacagggactgtgagctg

SEQ ID NO: 16295 - DNA, 60 bp, Artificial Sequence
  Description of Artificial Sequence: Synthetic probe
cgaaatggatgacaactttgagtttggactctgcccatgcgatgccaaacccattgtaag

SEQ ID NO: 16296 - DNA, 56 bp, Artificial Sequence
  Description of Artificial Sequence: Synthetic probe
ttttcgaggggcaagggcaagaggacacagtcgaaatggatgacaactttgagttt

SEQ ID NO: 16297 - DNA, 60 bp, Artificial Sequence
  Description of Artificial Sequence: Synthetic probe
agtgtggtattcaaaaaatttttcgaggggcaagggcaagaggacacagtcgaaatggat

SEQ ID NO: 16298 - DNA, 60 bp, Artificial Sequence
  Description of Artificial Sequence: Synthetic probe
gggaaaccaggtatcttgcaattttgcattcaggagccttaccgaccagtgtggtattca

SEQ ID NO: 16299 - DNA, 60 bp, Artificial Sequence
  Description of Artificial Sequence: Synthetic probe
ctagggaaaccaggtatcttgcaattttgcattcaggagccttaccgaccagtgtggtat

SEQ ID NO: 16300 - DNA, 60 bp, Artificial Sequence
  Description of Artificial Sequence: Synthetic probe
acatggaatgacactggaagacactatggtcatagcatggtgcaaagatggtaagttaac

SEQ ID NO: 16301 - DNA, 60 bp, Artificial Sequence
  Description of Artificial Sequence: Synthetic probe
cacatggaatgacactggaagacactatggtcatagcatggtgcaaagatggtaagttaa

SEQ ID NO: 16302 - DNA, 60 bp, Artificial Sequence
  Description of Artificial Sequence: Synthetic probe
ggagctgaagaccttactactgtctggaaggattactcacatggaatgacactggaagac

SEQ ID NO: 16303 - DNA, 60 bp, Artificial Sequence
  Description of Artificial Sequence: Synthetic probe
aattggcctacaaggagctgaagaccttactactgtctggaaggattactcacatggaat

SEQ ID NO: 16304 - DNA, 60 bp, Artificial Sequence
  Description of Artificial Sequence: Synthetic probe
cctgaatactcatatgccatagccaagagtgatagaattggcctacaaggagctgaagac

SEQ ID NO: 16305 - DNA, 60 bp, Artificial Sequence
  Description of Artificial Sequence: Synthetic probe
cacctagactgcaaacctgaatactcatatgccatagccaagagtgatagaattggccta

SEQ ID NO: 16306 - DNA, 60 bp, Artificial Sequence
  Description of Artificial Sequence: Synthetic probe
ccttggtaagaagttggagaataaaagcaatgcatggtttggtgcacatgcagcaagtcc

SEQ ID NO: 16307 - DNA, 60 bp, Artificial Sequence
  Description of Artificial Sequence: Synthetic probe
gaacttttatacaaaacatataaacaaaaaccagcgggtgtcactgaacctgtttacgat

SEQ ID NO: 16308 - DNA, 60 bp, Artificial Sequence
  Description of Artificial Sequence: Synthetic probe
gtgcagacgtacagaagatccaggccgttccctcataggcagggctgcatcacccataag

SEQ ID NO: 16309 - DNA, 60 bp, Artificial Sequence
  Description of Artificial Sequence: Synthetic probe
gtgctgacgtacataagatccaggccgttccctcataggcagggctgcatcacccataag

SEQ ID NO: 16310 - DNA, 60 bp, Artificial Sequence
  Description of Artificial Sequence: Synthetic probe
ggtgcagacgtacagaagatccaggccgttccctcataggcagggctgcatcacccataa

SEQ ID NO: 16311 - DNA, 60 bp, Artificial Sequence
  Description of Artificial Sequence: Synthetic probe
ggtgagtttgtacaccgcaaaaagtgtggaaaggaagccaggtatctggctatcctacac

SEQ ID NO: 16312 - DNA, 60 bp, Artificial Sequence
  Description of Artificial Sequence: Synthetic probe
tcggtgtaaggatggtgagtttgtacaccgcaaaaagtgtggaaaggaagccaggtatct

SEQ ID NO: 16313 - DNA, 60 bp, Artificial Sequence
  Description of Artificial Sequence: Synthetic probe
gatactacaagatgcattggtcaaagttcggtgtaaggatggtgagtttgtacaccgcaa

SEQ ID NO: 16314 - DNA, 60 bp, Artificial Sequence
  Description of Artificial Sequence: Synthetic probe
ggcaggaatacaaacctaaaatgatactacaagatgcattggtcgaagttcggtgtaagg

SEQ ID NO: 16315 - DNA, 60 bp, Artificial Sequence
  Description of Artificial Sequence: Synthetic probe
ccagattactcatatgccatagccaagaatgacaaagtaggcctgctaggtgcagaaggc

SEQ ID NO: 16316 - DNA, 60 bp, Artificial Sequence
  Description of Artificial Sequence: Synthetic probe
tacccgaaatgcaaaccagattactcatatgccatagccaagaatgacaaagtaggcctg

SEQ ID NO: 16317 - DNA, 60 bp, Artificial Sequence
  Description of Artificial Sequence: Synthetic probe
gacgagggcatgcccacagcacatcttaacctgagcgggggtcgttcaggtgaaacggtt

SEQ ID NO: 16318 - DNA, 60 bp, Artificial Sequence
  Description of Artificial Sequence: Synthetic probe
ttcatacgggaaggggactatgaaggcccatttaggcaagaatataatggttttgtgcaa

SEQ ID NO: 16319 - DNA, 60 bp, Artificial Sequence
  Description of Artificial Sequence: Synthetic probe
gaaagtggaaaggaggaaactgtcctaagtgcggacgccacgggaaacccataacatgcg

SEQ ID NO: 16320 - DNA, 60 bp, Artificial Sequence
  Description of Artificial Sequence: Synthetic probe
tgtaggcagaaagtggaaaggaggaaactgtcctaagtgcggacgccacgggaaacccat

SEQ ID NO: 16321 - DNA, 60 bp, Artificial Sequence
  Description of Artificial Sequence: Synthetic probe
gaataaaaccaggcactgtataatatgcacactatgtgtaggcagaaagtggaaaggagg

SEQ ID NO: 16322 - DNA, 60 bp, Artificial Sequence
  Description of Artificial Sequence: Synthetic probe
agagctagtacattgaataaaaccaggcactgtataatatgcacactatgtgtaggcaga

SEQ ID NO: 16323 - DNA, 60 bp, Artificial Sequence
  Description of Artificial Sequence: Synthetic probe
gtgactgcaggtcaggtaacagcaagggacctgtgagtggaatctatttaaaaccagggc

SEQ ID NO: 16324 - DNA, 60 bp, Artificial Sequence
  Description of Artificial Sequence: Synthetic probe
gattagtagatgagacctcttgcaacagagacggtgtggctatagtaccatctggtctgg

SEQ ID NO: 16325 - DNA, 60 bp, Artificial Sequence
  Description of Artificial Sequence: Synthetic probe
gtgcctggggatcaactacaatatgtagatgggcctatcgagtcttgcaagtggtgtggt

SEQ ID NO: 16326 - DNA, 60 bp, Artificial Sequence
  Description of Artificial Sequence: Synthetic probe
caaggatacattggccacagccgttgtacggacatacaagagggacaagcctttccccta

SEQ ID NO: 16327 - DNA, 60 bp, Artificial Sequence
  Description of Artificial Sequence: Synthetic probe
tgcacactggtcaacaaggatacattggccacagccgttgtacggacatacaagagggac

SEQ ID NO: 16328 - DNA, 60 bp, Artificial Sequence
  Description of Artificial Sequence: Synthetic probe
ccattggggaagacctctacgactgtgccttgggagggaattggacttgtgtgccggggg

SEQ ID NO: 16329 - DNA, 60 bp, Artificial Sequence
  Description of Artificial Sequence: Synthetic probe
gctacaggcctcaccactcagtggtacgaatactcggatggaatgcggctgcaggactca

SEQ ID NO: 16330 - DNA, 60 bp, Artificial Sequence
  Description of Artificial Sequence: Synthetic probe
gctacaggcctcaccactcagtggtacgaatactcggatgggatgcggctgcaggactca

SEQ ID NO: 16331 - DNA, 60 bp, Artificial Sequence
  Description of Artificial Sequence: Synthetic probe
gagctacaggcctcaccactcagtggtacgaatactcggatggaatgcggctgcaggact

SEQ ID NO: 16332 - DNA, 60 bp, Artificial Sequence
  Description of Artificial Sequence: Synthetic probe
gagctacaggcctcaccactcagtggtacgaatactcggatgggatgcggctgcaggact

SEQ ID NO: 16333 - DNA, 60 bp, Artificial Sequence
  Description of Artificial Sequence: Synthetic probe
tcggcccacaaggagctataggcctcaccactcagtggtacgaatactcggatgggatgc

SEQ ID NO: 16334 - DNA, 60 bp, Artificial Sequence
  Description of Artificial Sequence: Synthetic probe
tcggcccacttggagctacaggcctcaccactcagtggtacgaatactcggatacgatgc

SEQ ID NO: 16335 - DNA, 60 bp, Artificial Sequence
  Description of Artificial Sequence: Synthetic probe
tcggcccactaggagctataggcctcaccactcagtggtacgaatactcggatgggatgc

SEQ ID NO: 16336 - DNA, 60 bp, Artificial Sequence
  Description of Artificial Sequence: Synthetic probe
cactatccaattggcaagtgcaggttgaagaatgagactagttaccggctagtggatgat

SEQ ID NO: 16337 - DNA, 60 bp, Artificial Sequence
  Description of Artificial Sequence: Synthetic probe
aagaaggcttaccacactacccaattggcaagtgcaggttgaagaatgagactggttacc

SEQ ID NO: 16338 - DNA, 60 bp, Artificial Sequence
  Description of Artificial Sequence: Synthetic probe
gatctctactcctgtgatctgggaggtaattggacatgcattgcaggagagcagataaaa

SEQ ID NO: 16339 - DNA, 60 bp, Artificial Sequence
  Description of Artificial Sequence: Synthetic probe
gacctctactcctgtgatctgggaggtaattggacatgcattgcaggagagcagctaaaa

SEQ ID NO: 16340 - DNA, 60 bp, Artificial Sequence
  Description of Artificial Sequence: Synthetic probe
atgacagttaggaatctcgagaaccaattcgtttgaaagcaagcgccgcattacacttac

SEQ ID NO: 16341 - DNA, 60 bp, Artificial Sequence
  Description of Artificial Sequence: Synthetic probe
tcgccgtaaccgatgacgctaagaaaagatacaaagttagactacagcgatttagaactc

SEQ ID NO: 16342 - DNA, 60 bp, Artificial Sequence
  Description of Artificial Sequence: Synthetic probe
cgaggtcgacgccgtttcactatattgcactcagatgataatgcttcgagcagcgatcgg

SEQ ID NO: 16343 - DNA, 60 bp, Artificial Sequence
  Description of Artificial Sequence: Synthetic probe
taccgtgttcacactcatgaatattgagacgcgtgttgctgaggagctagccgaatatat

SEQ ID NO: 16344 - DNA, 60 bp, Artificial Sequence
  Description of Artificial Sequence: Synthetic probe
ggattgatgtgatcttgaggaaggatgttgtgatgaggggcttcatcactgcgagcacga

SEQ ID NO: 16345 - DNA, 60 bp, Artificial Sequence
  Description of Artificial Sequence: Synthetic probe
ctttgaaggtgaattagacagtgcaccttatatgttccccgatcagaatttgtctccgca

SEQ ID NO: 16346 - DNA, 60 bp, Artificial Sequence
  Description of Artificial Sequence: Synthetic probe
gagtcaagcgcaaggacacttctctcgagcggctacgaattggagtaccagaaggcatta

SEQ ID NO: 16347 - DNA, 60 bp, Artificial Sequence
  Description of Artificial Sequence: Synthetic probe
caggcggctttgagcgatccgcaggtgatgaatcttgttgaggagcttccattgggagag

SEQ ID NO: 16348 - DNA, 60 bp, Artificial Sequence
  Description of Artificial Sequence: Synthetic probe
ggaagattgtacacgatatcccgccgtgttggaatgaaactcaaggagataaacgcggtc

SEQ ID NO: 16349 - DNA, 60 bp, Artificial Sequence
  Description of Artificial Sequence: Synthetic probe
cgctcgctttatatgtgcccataggctggaatggttatggcgcgcatcccgcggcgctaa

SEQ ID NO: 16350 - DNA, 60 bp, Artificial Sequence
  Description of Artificial Sequence: Synthetic probe
cggcgcttggaagatgaagcgaactattaaggaagacgcaacatacagggatagaaagtt

SEQ ID NO: 16351 - DNA, 60 bp, Artificial Sequence
  Description of Artificial Sequence: Synthetic probe
gatgtgcaaggatacgttcggtcgcaagtgcaaacaatgataacgaaagtgagtagagga

SEQ ID NO: 16352 - DNA, 58 bp, Artificial Sequence
  Description of Artificial Sequence: Synthetic probe
gacacaaacgcacgcaaaacagggctgctacgtaccgcaagaccgtatgatgatcatc

SEQ ID NO: 16353 - DNA, 60 bp, Artificial Sequence
  Description of Artificial Sequence: Synthetic probe
cgcaacttcgattttcaacactgttgctaagtgtggccatgaagcgtctcccagtaaaac

SEQ ID NO: 16354 - DNA, 60 bp, Artificial Sequence
  Description of Artificial Sequence: Synthetic probe
tgcccgtttcaaatgttgatgtcgcaaagcgtattgcggtcgataagggatttgacacac

SEQ ID NO: 16355 - DNA, 60 bp, Artificial Sequence
  Description of Artificial Sequence: Synthetic probe
gagcagatcatcgacttcggatacggggaaggtagggtagcaaatacgttgtggaatggg

SEQ ID NO: 16356 - DNA, 60 bp, Artificial Sequence
  Description of Artificial Sequence: Synthetic probe
gcacctcactcgatataattttcggactggtatgttgcaagggatcagagaagcgatgac

SEQ ID NO: 16357 - DNA, 60 bp, Artificial Sequence
  Description of Artificial Sequence: Synthetic probe
gcgacgggttcgcgtgtaatggatgccgcagactgctttcgaaactcagcggatcgggat

SEQ ID NO: 16358 - DNA, 60 bp, Artificial Sequence
  Description of Artificial Sequence: Synthetic probe
gagtcctgattataggaaaatcggtggaaaggttattgtgggtgatcttgaagcgacggg

SEQ ID NO: 16359 - DNA, 60 bp, Artificial Sequence
  Description of Artificial Sequence: Synthetic probe
cgtaactttacctttgaacgaatacttttcacgagttggcggaattacgagtcctgatta

SEQ ID NO: 16360 - DNA, 60 bp, Artificial Sequence
  Description of Artificial Sequence: Synthetic probe
gtgttgagctctaccaaactaagggatcgcgagatgtaccaatcaaagcaacgagaacca

SEQ ID NO: 16361 - DNA, 60 bp, Artificial Sequence
  Description of Artificial Sequence: Synthetic probe
caagcgtatgtagaggcgaaggagcgccgggaagaaatagtgaaaccggaagatctgtac

SEQ ID NO: 16362 - DNA, 60 bp, Artificial Sequence
  Description of Artificial Sequence: Synthetic probe
gtattcacaggagttgggttcacacgatcacaggttgcccatattcgaaaagatgttaaa

SEQ ID NO: 16363 - DNA, 60 bp, Artificial Sequence
  Description of Artificial Sequence: Synthetic probe
caaagaagattaacaatgtcttaagggcaccctactcgtggtttgtaaagatgtggggcg

SEQ ID NO: 16364 - DNA, 60 bp, Artificial Sequence
  Description of Artificial Sequence: Synthetic probe
caagtcgcatacactacgcctcttttattcgagatgtgctgtatggagtcgattctagag

SEQ ID NO: 16365 - DNA, 60 bp, Artificial Sequence
  Description of Artificial Sequence: Synthetic probe
gccatgcgttcgaggtctacatcaattcgattttaccgtggagtgaacttgatccggagg

SEQ ID NO: 16366 - DNA, 60 bp, Artificial Sequence
  Description of Artificial Sequence: Synthetic probe
cgagtggttgaacggttttatccaggaatagaatttaggagtgatgaaggggcatgttac

SEQ ID NO: 16367 - DNA, 60 bp, Artificial Sequence
  Description of Artificial Sequence: Synthetic probe
ccagcagtaagaatggttgcaggcgttgtaggtcatctgcttttcacggcgggaggacga

SEQ ID NO: 16368 - DNA, 60 bp, Artificial Sequence
  Description of Artificial Sequence: Synthetic probe
atccaatgcccggcccgctaacacgtgcaattgcgcgcgccgcttatgtgtagtccactt

SEQ ID NO: 16369 - DNA, 60 bp, Artificial Sequence
  Description of Artificial Sequence: Synthetic probe
gagaactgcgattttgaacagaaccaccttaccaaacatgttgccgccaattttcccgcc

SEQ ID NO: 16370 - DNA, 60 bp, Artificial Sequence
  Description of Artificial Sequence: Synthetic probe
cttggcatggtttgagaactgcgattttgaacagaaccaccttaccaaacatgttgccgc

SEQ ID NO: 16371 - DNA, 60 bp, Artificial Sequence
  Description of Artificial Sequence: Synthetic probe
ttttacatttcgatggataagaccttaaaccagtatccagctctaacggcggagattttt

SEQ ID NO: 16372 - DNA, 60 bp, Artificial Sequence
  Description of Artificial Sequence: Synthetic probe
cgttggtggcgtcgacatgagggctggacgtataatagcgtgggatggtcaggctgcgtt

SEQ ID NO: 16373 - DNA, 60 bp, Artificial Sequence
  Description of Artificial Sequence: Synthetic probe
cgttactgtgagcgttggtggcgtcgacatgagggctggacgtataatagcgtgggatgg

SEQ ID NO: 16374 - DNA, 60 bp, Artificial Sequence
  Description of Artificial Sequence: Synthetic probe
acgaccccatgatgatatatctggtttggagaaggattgagaacttcgctatgcctcaag

SEQ ID NO: 16375 - DNA, 60 bp, Artificial Sequence
  Description of Artificial Sequence: Synthetic probe
tgcacgccaaccgtatggttttttcttagaaacagaagaggtttaccagcctgggagatg

SEQ ID NO: 16376 - DNA, 60 bp, Artificial Sequence
  Description of Artificial Sequence: Synthetic probe
gcagcgaatgagatcgctcgcgttacgggtgagacttcaacatggggacctgcacgccaa

SEQ ID NO: 16377 - DNA, 60 bp, Artificial Sequence
  Description of Artificial Sequence: Synthetic probe
gagtattggcaacaccagaaataccattcacgactgaggcagcgaatgagatcgctcgcg

SEQ ID NO: 16378 - DNA, 60 bp, Artificial Sequence
  Description of Artificial Sequence: Synthetic probe
tggcgaccataggagtattggcaacaccagaaataccattcacgactgaggcagcgaatg

SEQ ID NO: 16379 - DNA, 60 bp, Artificial Sequence
  Description of Artificial Sequence: Synthetic probe
agcaatcgtataatgatgcggtgaggatgagttttacggaattttcatcagttccgctag

SEQ ID NO: 16380 - DNA, 60 bp, Artificial Sequence
  Description of Artificial Sequence: Synthetic probe
aagcaatcgtataatgatgcggtgaggatgagttttacggaattttcatcagttccgcta

SEQ ID NO: 16381 - DNA, 60 bp, Artificial Sequence
  Description of Artificial Sequence: Synthetic probe
cagcaggtggaagattcacgaatttaacacaagatatggcgagacagcttgatatagcct

SEQ ID NO: 16382 - DNA, 60 bp, Artificial Sequence
  Description of Artificial Sequence: Synthetic probe
atgatattccgaccagagatcaccgcggtatggaggttgctgagccagaggtgttaggag

SEQ ID NO: 16383 - DNA, 60 bp, Artificial Sequence
  Description of Artificial Sequence: Synthetic probe
gcgaggtgctttagttgcagctgagtgtgaattgggtgacgtttacagtacactccgacg

SEQ ID NO: 16384 - DNA, 60 bp, Artificial Sequence
  Description of Artificial Sequence: Synthetic probe
atccatgcttgcgaggtgctttagttgcagctgagtgtgaattgggtgacgtttacagta

SEQ ID NO: 16385 - DNA, 60 bp, Artificial Sequence
  Description of Artificial Sequence: Synthetic probe
gtgtggaggacaaatcagtatccatgcttgcgaggtgctttagttgcagctgagtgtgaa

SEQ ID NO: 16386 - DNA, 60 bp, Artificial Sequence
  Description of Artificial Sequence: Synthetic probe
agtgtggaggacaaatcagtatccatgcttgcgaggtgctttagttgcagctgagtgtga

SEQ ID NO: 16387 - DNA, 60 bp, Artificial Sequence
  Description of Artificial Sequence: Synthetic probe
gttgtaaagattcctgaatccgatatgatagatataccaagattaacaattgtagaggcg

SEQ ID NO: 16388 - DNA, 66 bp, Artificial Sequence
  Description of Artificial Sequence: Synthetic probe
gacataatgttgtaaagattcctgaatccgatatgatagatataccaagattaacgatagtagagg

SEQ ID NO: 16389 - DNA, 60 bp, Artificial Sequence
  Description of Artificial Sequence: Synthetic probe
aaggaaaacataatgttgtaaagattcctgaatccgatatgatagatataccaagattaa

SEQ ID NO: 16390 - DNA, 60 bp, Artificial Sequence
  Description of Artificial Sequence: Synthetic probe
ttgaagaaagacataatgttgtaaagattcctgaatccgatatgatagatataccaagat

SEQ ID NO: 16391 - DNA, 60 bp, Artificial Sequence
  Description of Artificial Sequence: Synthetic probe
cgatgactaaagtctttattaacaagaggattgttgagcgagttagagttgggcagattc

SEQ ID NO: 16392 - DNA, 60 bp, Artificial Sequence
  Description of Artificial Sequence: Synthetic probe
gcaaggtctaccttttagctatgacactaatgaaaggggtgggttagcgtatgcaacggt

SEQ ID NO: 16393 - DNA, 60 bp, Artificial Sequence
  Description of Artificial Sequence: Synthetic probe
caacgcatcggaatgaaatgttggaggttgctcccttggttgaatctgtttatgcgtcgg

SEQ ID NO: 16394 - DNA, 60 bp, Artificial Sequence
  Description of Artificial Sequence: Synthetic probe
tgtcgttctggatgtaagttggatatggctttggttggcctttaatcggtcgtttgagcc

SEQ ID NO: 16395 - DNA, 60 bp, Artificial Sequence
  Description of Artificial Sequence: Synthetic probe
gggaaccgttggactttcagattggcaggaaccaatacgattgtaatgtattccgagcgg

SEQ ID NO: 16396 - DNA, 60 bp, Artificial Sequence
  Description of Artificial Sequence: Synthetic probe
ccgaggatttcttcaattacgctcactcaacgaattacgacgactgggccttttgcaata

SEQ ID NO: 16397 - DNA, 60 bp, Artificial Sequence
  Description of Artificial Sequence: Synthetic probe
gtgcatgctccgaaccggtttatcgcatatataatagattgcagggttacatagaagccg

SEQ ID NO: 16398 - DNA, 60 bp, Artificial Sequence
  Description of Artificial Sequence: Synthetic probe
cgcagagccggaagtgttaggcgtggagttcaagaatgtgctgcctgtgttaacgactga

SEQ ID NO: 16399 - DNA, 60 bp, Artificial Sequence
  Description of Artificial Sequence: Synthetic probe
ggagatgtcacaggtaggcgatgttatcacggaagatgaaccggaaaagttctattcgac

SEQ ID NO: 16400 - DNA, 60 bp, Artificial Sequence
  Description of Artificial Sequence: Synthetic probe
ggctgctcagaatgagcaacgtccagaaagaataaagacaacgccctatttagaagggga

SEQ ID NO: 16401 - DNA, 60 bp, Artificial Sequence
  Description of Artificial Sequence: Synthetic probe
cgccaccgaaacaactattttctacttgatatataatgttgaattctccaatacgccaga

SEQ ID NO: 16402 - DNA, 60 bp, Artificial Sequence
  Description of Artificial Sequence: Synthetic probe
gcacagagatatgctcccagagcctcggcttgacgacattgaaagatttagacaggaagg

SEQ ID NO: 16403 - DNA, 60 bp, Artificial Sequence
  Description of Artificial Sequence: Synthetic probe
cgcatcgcaatgagatgttggaagttgccccattagttgaatccgtttatgcgtcggagt

SEQ ID NO: 16404 - DNA, 60 bp, Artificial Sequence
  Description of Artificial Sequence: Synthetic probe
cccgatttaatagccggcgctcatcagaatgcggatcctgttgttttagatgtaagttgg

SEQ ID NO: 16405 - DNA, 60 bp, Artificial Sequence
  Description of Artificial Sequence: Synthetic probe
gtcgagtatagagaacccgcaccttacgtacatgcgcagcgctacatacggtattgtggc

SEQ ID NO: 16406 - DNA, 60 bp, Artificial Sequence
  Description of Artificial Sequence: Synthetic probe
gcgtgtgcaggttaattatggccccacgggagagccgttggatttccagatcggcaggaa

SEQ ID NO: 16407 - DNA, 60 bp, Artificial Sequence
  Description of Artificial Sequence: Synthetic probe
gaggacgattcactaacctaactcaaaacatggctcgtcagttggatattgcgctgaacg

SEQ ID NO: 16408 - DNA, 60 bp, Artificial Sequence
  Description of Artificial Sequence: Synthetic probe
ttatgaacatagcgacgtgtttaccaacgggggaatatatagcaccgaatccaagaatct

SEQ ID NO: 16409 - DNA, 60 bp, Artificial Sequence
  Description of Artificial Sequence: Synthetic probe
ctcaattggatggctagaacggttaggtcataggaagagaattacgtattcgcaagaggt

SEQ ID NO: 16410 - DNA, 60 bp, Artificial Sequence
  Description of Artificial Sequence: Synthetic probe
cccgactagagatcatcgcgggatggaggttgcagaaccagaagtgttaggcgtggaatt

SEQ ID NO: 16411 - DNA, 60 bp, Artificial Sequence
  Description of Artificial Sequence: Synthetic probe
gcggagtgcaactgctcgaagattaccgcaaaagtgggatgatggatgaggccgtgaagc

SEQ ID NO: 16412 - DNA, 60 bp, Artificial Sequence
  Description of Artificial Sequence: Synthetic probe
gcggggtgcaactgctcgaagattaccgcaaaagtgggatgatggatgaggccgtgaagc

SEQ ID NO: 16413 - DNA, 60 bp, Artificial Sequence
  Description of Artificial Sequence: Synthetic probe
accaatcaaagagggtcaaattgtgaatccaacatttatatcaagatatcgccaaatcgc

SEQ ID NO: 16414 - DNA, 60 bp, Artificial Sequence
  Description of Artificial Sequence: Synthetic probe
ctatgtgccaatcaaagaaggtcaaatcgtgaatccaacatttatatcaagatatcgcca

SEQ ID NO: 16415 - DNA, 60 bp, Artificial Sequence
  Description of Artificial Sequence: Synthetic probe
ctatgtgccaatcaaagagggtcaaattgtgaatccaacatttatatcaagatatcgcca

SEQ ID NO: 16416 - DNA, 60 bp, Artificial Sequence
  Description of Artificial Sequence: Synthetic probe
ccgcagtggtttaagagtttaaatcctatgctcggagtgataaatctaggtgcgactttc

SEQ ID NO: 16417 - DNA, 60 bp, Artificial Sequence
  Description of Artificial Sequence: Synthetic probe
accgcacagcagcttaatgacgttagaaaaatttatttagctttgatgttcccaggacag

SEQ ID NO: 16418 - DNA, 60 bp, Artificial Sequence
  Description of Artificial Sequence: Synthetic probe
accgcacagcagctaaatgacgttagaaaaatttatttagctttgatgttcccaggacag

SEQ ID NO: 16419 - DNA, 60 bp, Artificial Sequence
  Description of Artificial Sequence: Synthetic probe
cacaatggacttgtagtcacttaaagaggaattgtctattcaatgggatgtgtgccaaac

SEQ ID NO: 16420 - DNA, 60 bp, Artificial Sequence
  Description of Artificial Sequence: Synthetic probe
ccacaatggacttgtagtcacttaaagaggaattgtctattcaatgggatgtgtgccaaa

SEQ ID NO: 16421 - DNA, 60 bp, Artificial Sequence
  Description of Artificial Sequence: Synthetic probe
ttgacctcgcggcgtaaattcccactgctgtataacgggggagggtgcgcggcactacac

SEQ ID NO: 16422 - DNA, 60 bp, Artificial Sequence
  Description of Artificial Sequence: Synthetic probe
aggtcagtaggtagagtggcgccccaaggttcgtatcgtgcagagtggttgatctcacga

SEQ ID NO: 16423 - DNA, 60 bp, Artificial Sequence
  Description of Artificial Sequence: Synthetic probe
gaaggaagtaatgaagaagcaatcgtataatgatgccgtgaggatgagttttacggaatt

SEQ ID NO: 16424 - DNA, 60 bp, Artificial Sequence
  Description of Artificial Sequence: Synthetic probe
ttgatatgattaagaaggaagtaatgaagaagcaatcgtataatgatgccgtgaggatga

SEQ ID NO: 16425 - DNA, 60 bp, Artificial Sequence
  Description of Artificial Sequence: Synthetic probe
gaatccaatgttgggtgtggtaaatctaggggcaaccttcctgatgatggtttgtgcaaa

SEQ ID NO: 16426 - DNA, 60 bp, Artificial Sequence
  Description of Artificial Sequence: Synthetic probe
gcggcggttgtcgctttgctgacatcggtttgtacgttgtcgagcgatatgagcgtggcg

SEQ ID NO: 16427 - DNA, 60 bp, Artificial Sequence
  Description of Artificial Sequence: Synthetic probe
gatagcggcggttgtcgctttgctgacatcggtttgtacgttgtcgagcgatatgagcgt

SEQ ID NO: 16428 - DNA, 60 bp, Artificial Sequence
  Description of Artificial Sequence: Synthetic probe
ccgccaaggtatgctccgagcgcgccaatgccatcatcgatgcccactgttgcacttgaa

SEQ ID NO: 16429 - DNA, 60 bp, Artificial Sequence
  Description of Artificial Sequence: Synthetic probe
tttcccaaccgccaaggtatgctccgagcgcgccaatgccatcatcgatgcccactgttg

SEQ ID NO: 16430 - DNA, 60 bp, Artificial Sequence
  Description of Artificial Sequence: Synthetic probe
gagcgggttgaagagctgagtttagtccgtgtggatgatacgatttcccaaccgccaagg

SEQ ID NO: 16431 - DNA, 60 bp, Artificial Sequence
  Description of Artificial Sequence: Synthetic probe
taatcaggagcgggttgaagagctgagtttagtccgtgtggatgatacgatttcccaacc

SEQ ID NO: 16432 - DNA, 60 bp, Artificial Sequence
  Description of Artificial Sequence: Synthetic probe
agtcattggcacgcgttgggattagcgcaagaggcgagcgggcgtacgttaacggaggcg

SEQ ID NO: 16433 - DNA, 60 bp, Artificial Sequence
  Description of Artificial Sequence: Synthetic probe
ggcataggcagtggtcggtccccatgatattgtttgacgacgcggtcaggttgataccgg

SEQ ID NO: 16434 - DNA, 60 bp, Artificial Sequence
  Description of Artificial Sequence: Synthetic probe
gtattcacgtacttaagcggacaggatgatttccctacattgactaattatttgaagagt

SEQ ID NO: 16435 - DNA, 60 bp, Artificial Sequence
  Description of Artificial Sequence: Synthetic probe
acggtcagcgggaacgacaattagaagacaataaatatgtgttcggtcgcgtgaatttat

SEQ ID NO: 16436 - DNA, 60 bp, Artificial Sequence
  Description of Artificial Sequence: Synthetic probe
cgagtggggctgccacaaatgagggtagattttatgcgcttatcgcaatagctgcgacgg

SEQ ID NO: 16437 - DNA, 60 bp, Artificial Sequence
  Description of Artificial Sequence: Synthetic probe
agcttaacaggataaggacggaatggataaacgcgtcatatgatagaactcggattaggg

SEQ ID NO: 16438 - DNA, 60 bp, Artificial Sequence
  Description of Artificial Sequence: Synthetic probe
gcggtctatcatataacagattcatctctagtatggtgcaagtggttgttagagggaaag

SEQ ID NO: 16439 - DNA, 60 bp, Artificial Sequence
  Description of Artificial Sequence: Synthetic probe
ataggaaataacggtctatcatataacagattcatctctagtatggtgcaagtggttgtt

SEQ ID NO: 16440 - DNA, 60 bp, Artificial Sequence
  Description of Artificial Sequence: Synthetic probe
aaagtgcaaccatacaaatcttgaactattgcgaagtttgacaacaattgaagcgttcca

SEQ ID NO: 16441 - DNA, 60 bp, Artificial Sequence
  Description of Artificial Sequence: Synthetic probe
cgaggaatgatggtatagtggtaccgaggctgttggatatcaccctaaaggcttacgatg

SEQ ID NO: 16442 - DNA, 60 bp, Artificial Sequence
  Description of Artificial Sequence: Synthetic probe
cataatctagcgaaaattccggaatcggacatggttgatgttcccaaactagacatcgtt

SEQ ID NO: 16443 - DNA, 60 bp, Artificial Sequence
  Description of Artificial Sequence: Synthetic probe
aaacgtatcagcccggtcgttggtttatgcgagctgcgcaggctgtgactgccgtggtgt

SEQ ID NO: 16444 - DNA, 60 bp, Artificial Sequence
  Description of Artificial Sequence: Synthetic probe
cactatcgcagcaagagcgctcactgtgatgcgagcatgtgctactttacaagaagcaag

SEQ ID NO: 16445 - DNA, 60 bp, Artificial Sequence
  Description of Artificial Sequence: Synthetic probe
gacactatcgcagcaagagcgctcactgtgatgcgagcatgtgctactttacaagaagca

SEQ ID NO: 16446 - DNA, 60 bp, Artificial Sequence
  Description of Artificial Sequence: Synthetic probe
ggacactatcgcagcaagagcgctcactgtgatgcgggcatgtgccaccttacaagaagc

SEQ ID NO: 16447 - DNA, 60 bp, Artificial Sequence
  Description of Artificial Sequence: Synthetic probe
ggacactatcgcagcaagagcgctcactgtgatgcgggcatgtgccactttacaggaagc

SEQ ID NO: 16448 - DNA, 60 bp, Artificial Sequence
  Description of Artificial Sequence: Synthetic probe
atggacactatcgcagcaagagcgctcactgtgatgcgggcatgtgccactttacaagaa

SEQ ID NO: 16449 - DNA, 60 bp, Artificial Sequence
  Description of Artificial Sequence: Synthetic probe
atgcctcaaggtaattcgcagcaaacgctagccggcgttactgtgagcgttggtggcgtc

SEQ ID NO: 16450 - DNA, 60 bp, Artificial Sequence
  Description of Artificial Sequence: Synthetic probe
ctgggagatggtttatgcgagctgcacaggcagtaacggctgttgtgtgtgggcccgaca

SEQ ID NO: 16451 - DNA, 60 bp, Artificial Sequence
  Description of Artificial Sequence: Synthetic probe
gagatcgctcgcgttacgggtgagacttcaacatggggacctgcacgccaaccgtatggt

SEQ ID NO: 16452 - DNA, 60 bp, Artificial Sequence
  Description of Artificial Sequence: Synthetic probe
ttggcgcaaaggaatgaaatgttcttcatgtgcttagacatgatgctatcagctgcgggg

SEQ ID NO: 16453 - DNA, 60 bp, Artificial Sequence
  Description of Artificial Sequence: Synthetic probe
caacggttgcccttgaaatattggacaaagcgatgtcaaacacaactggtgcaacgcaaa

SEQ ID NO: 16454 - DNA, 60 bp, Artificial Sequence
  Description of Artificial Sequence: Synthetic probe
ccaacggttgcccttgaaatattggacaaagcgatgtcaaacacaactggtgcaacgcaa

SEQ ID NO: 16455 - DNA, 60 bp, Artificial Sequence
  Description of Artificial Sequence: Synthetic probe
gccaacagttgcccttgaaatattggacaaagcgatgtcaaacacaactggtgcaacgca

SEQ ID NO: 16456 - DNA, 60 bp, Artificial Sequence
  Description of Artificial Sequence: Synthetic probe
gccaacggttgcccttgaaatactggacaaagcgatgtcaaacacaactggtgcaacgca

SEQ ID NO: 16457 - DNA, 60 bp, Artificial Sequence
  Description of Artificial Sequence: Synthetic probe
gccaacggttgcccttgaaatattggacaaagcgatgtcaaacacaactggtgcaacgca

SEQ ID NO: 16458 - DNA, 60 bp, Artificial Sequence
  Description of Artificial Sequence: Synthetic probe
tatgccaacggttgcccttgaaatactggacaaagcgatgtcaaacacaactggtgcaac

SEQ ID NO: 16459 - DNA, 60 bp, Artificial Sequence
  Description of Artificial Sequence: Synthetic probe
aatctaaatacggtacgaaagttgatgtttacagagatgaggtcccagcacagatcatcg

SEQ ID NO: 16460 - DNA, 60 bp, Artificial Sequence
  Description of Artificial Sequence: Synthetic probe
ggcagcaaatgaaatcgcacgtgttacgggtgaaacttcaacatggggccctgcgcgcca

SEQ ID NO: 16461 - DNA, 50 bp, Artificial Sequence
  Description of Artificial Sequence: Synthetic probe
gcacatagacagtggagtataccggtgctgctgtatgcgcacgatatccg

SEQ ID NO: 16462 - DNA, 60 bp, Artificial Sequence
  Description of Artificial Sequence: Synthetic probe
agaattattgagcaaacatacgatgccctcggaggattctgaagtaacgtttgaacaccc

SEQ ID NO: 16463 - DNA, 60 bp, Artificial Sequence
  Description of Artificial Sequence: Synthetic probe
agaattattgagcagacatacgatgccctcggaggattctgaagtaacgtttgaacaccc

SEQ ID NO: 16464 - DNA, 60 bp, Artificial Sequence
  Description of Artificial Sequence: Synthetic probe
gtcgtcgatgactgataaactctctaagcaggaggattacgcagggattgtttcaaggcg

SEQ ID NO: 16465 - DNA, 60 bp, Artificial Sequence
  Description of Artificial Sequence: Synthetic probe
acagaatatgtcgtcgatgactgataaactctctaagcaggaggattacgcagggattgt

SEQ ID NO: 16466 - DNA, 60 bp, Artificial Sequence
  Description of Artificial Sequence: Synthetic probe
cgacctggtatgatgggccgcgctctctctaagcaacaaaatatgtcgtcgatgactgat

SEQ ID NO: 16467 - DNA, 60 bp, Artificial Sequence
  Description of Artificial Sequence: Synthetic probe
cgacctggtatgatgggccgcgctctctctaagcaacagaatatgtcgtcgatgactgat

SEQ ID NO: 16468 - DNA, 60 bp, Artificial Sequence
  Description of Artificial Sequence: Synthetic probe
agatactatgatgtacgacctggtatgatgggccgcgctctctctaagcaacagaatatg

SEQ ID NO: 16469 - DNA, 60 bp, Artificial Sequence
  Description of Artificial Sequence: Synthetic probe
ctggcgagatactatgatgtacgacctggtatgatgggccgcgctctctctaagcaacag

SEQ ID NO: 16470 - DNA, 60 bp, Artificial Sequence
  Description of Artificial Sequence: Synthetic probe
cctgcagcgatattgtctagcaagatactatgatgtacgacctggtatgatgggccgcgc

SEQ ID NO: 16471 - DNA, 60 bp, Artificial Sequence
  Description of Artificial Sequence: Synthetic probe
ccctgagtttgccggattactataacaaatggataattgctccgatgtttaacgctaagt

SEQ ID NO: 16472 - DNA, 60 bp, Artificial Sequence
  Description of Artificial Sequence: Synthetic probe
gtacgagaggttagcatcaacaaaggtaatgagtgcgatctgttccctgaggatgaagaa

SEQ ID NO: 16473 - DNA, 60 bp, Artificial Sequence
  Description of Artificial Sequence: Synthetic probe
tgaagtacgagaggttagcatcaacaaaggtaatgagtgcgatctgttccctgaggatga

SEQ ID NO: 16474 - DNA, 60 bp, Artificial Sequence
  Description of Artificial Sequence: Synthetic probe
ccgctttgaataaaataagagaacaatggatcgctcgaaatttcgatcaaagggaaatca

SEQ ID NO: 16475 - DNA, 60 bp, Artificial Sequence
  Description of Artificial Sequence: Synthetic probe
gcctttggcgatacaagaggaaataaccgctttgaataaaataagagaacaatggatcgc

SEQ ID NO: 16476 - DNA, 60 bp, Artificial Sequence
  Description of Artificial Sequence: Synthetic probe
attgaagggaagacgcctttggcgatacaagaggaaataaccgctttgaataaaataaga

SEQ ID NO: 16477 - DNA, 60 bp, Artificial Sequence
  Description of Artificial Sequence: Synthetic probe
gtacaagttcgaattgaagggaagacgcctttggcgatacaagaggaaataaccgctttg

SEQ ID NO: 16478 - DNA, 60 bp, Artificial Sequence
  Description of Artificial Sequence: Synthetic probe
tggtacaagttcgaattgaagggaagacgcctttggcgatacaagaggaaataaccgctt

SEQ ID NO: 16479 - DNA, 60 bp, Artificial Sequence
  Description of Artificial Sequence: Synthetic probe
gggtgaccagggataccagaagttgaaagaagggttggtacaagttcgaattgaagggaa

SEQ ID NO: 16480 - DNA, 60 bp, Artificial Sequence
  Description of Artificial Sequence: Synthetic probe
tgggcgaccaaggataccagaagttgaaagaagggttggtacaagttagaattgaaggga

SEQ ID NO: 16481 - DNA, 60 bp, Artificial Sequence
  Description of Artificial Sequence: Synthetic probe
cgtatgcattaaaacctacatataagataatatcaaatgcggaacgtgcatcaacgagtg

SEQ ID NO: 16482 - DNA, 60 bp, Artificial Sequence
  Description of Artificial Sequence: Synthetic probe
ggcgtatacattaaagcccacatataagataatatcaaatgcggaacgtgcatcaacgag

SEQ ID NO: 16483 - DNA, 60 bp, Artificial Sequence
  Description of Artificial Sequence: Synthetic probe
cggcgtatacattaaagcccacatataagataatatcaaatgcggaacgtgcatcaacga

SEQ ID NO: 16484 - DNA, 60 bp, Artificial Sequence
  Description of Artificial Sequence: Synthetic probe
ggcgtatacattgaaacccacatataagataatatcaaatgcggaacgtgcatcaacgag

SEQ ID NO: 16485 - DNA, 60 bp, Artificial Sequence
  Description of Artificial Sequence: Synthetic probe
atcttataatgacgcggtgaggatgaaattaccagagttctcgtcaatcccgctagatgg

SEQ ID NO: 16486 - DNA, 60 bp, Artificial Sequence
  Description of Artificial Sequence: Synthetic probe
gggagtggcgaggaaattcctgatccgctaagcccaggagagcgagggatacaagccaag

SEQ ID NO: 16487 - DNA, 60 bp, Artificial Sequence
  Description of Artificial Sequence: Synthetic probe
acatgccatggacgctcggccatctgctccttccactcaattacttccgccgcagacctc

SEQ ID NO: 16488 - DNA, 60 bp, Artificial Sequence
  Description of Artificial Sequence: Synthetic probe
agaggtctgcggcggaggtaattgagtggaaggagcagatggccgagcgtccatggcatg

SEQ ID NO: 16489 - DNA, 60 bp, Artificial Sequence
  Description of Artificial Sequence: Synthetic probe
gaggtccgctacactttcaaaggcgcgcgattttaggtgcacttaaatttggggttaagg

SEQ ID NO: 16490 - DNA, 60 bp, Artificial Sequence
  Description of Artificial Sequence: Synthetic probe
atgcatatcttgagaggtccgctacactttcaaaggcgcgcgattttaggtgcacttaaa

SEQ ID NO: 16491 - DNA, 60 bp, Artificial Sequence
  Description of Artificial Sequence: Synthetic probe
acgcgcagaggatcgtatatgatgacgaattgcaaatgcatatcttgagaggtccgctac

SEQ ID NO: 16492 - DNA, 60 bp, Artificial Sequence
  Description of Artificial Sequence: Synthetic probe
aaactttgaaatcaaacgcgcagaggatcgtatatgatgacgaattgcaaatgcatatct

SEQ ID NO: 16493 - DNA, 60 bp, Artificial Sequence
  Description of Artificial Sequence: Synthetic probe
atatctcggttcgatgcactatgacataacgtatgaaactttgaaatcaaacgcgcagag

SEQ ID NO: 16494 - DNA, 60 bp, Artificial Sequence
  Description of Artificial Sequence: Synthetic probe
aacagtacatcctatatatctcggttcgatgcactatgacataacgtatgaaactttgaa

SEQ ID NO: 16495 - DNA, 60 bp, Artificial Sequence
  Description of Artificial Sequence: Synthetic probe
ggtagcgcgtacacatccccgatgcacgctcgacgcatgattaggtcgaaaacagtacat

SEQ ID NO: 16496 - DNA, 60 bp, Artificial Sequence
  Description of Artificial Sequence: Synthetic probe
gtcccactttcacgcaaacgagtcattctttttgggattcgatctaggcatcgatgtcgt

SEQ ID NO: 16497 - DNA, 60 bp, Artificial Sequence
  Description of Artificial Sequence: Synthetic probe
gggattcagacgatgtcttcttctttcactgtgtgtcccactttcacgcaaacgagtcat

SEQ ID NO: 16498 - DNA, 60 bp, Artificial Sequence
  Description of Artificial Sequence: Synthetic probe
ttgaaccgaccatggttgcgactacattagagcacagatttgatgagatacccgataaag

SEQ ID NO: 16499 - DNA, 60 bp, Artificial Sequence
  Description of Artificial Sequence: Synthetic probe
cgcacctgcgtacgccgaaaattgaaccgaccatggttgcgactacattagagcacagat

SEQ ID NO: 16500 - DNA, 60 bp, Artificial Sequence
  Description of Artificial Sequence: Synthetic probe
tcgcacctgcgtacgccgaaaattgaaccgaccatggttgcgactacattagagcacaga

SEQ ID NO: 16501 - DNA, 60 bp, Artificial Sequence
  Description of Artificial Sequence: Synthetic probe
gagtgggattgatctgtcgcacttgcgcacgccgaaaattgaaccgaccatggttgcgac

SEQ ID NO: 16502 - DNA, 60 bp, Artificial Sequence
  Description of Artificial Sequence: Synthetic probe
gggaatgaccgcggatgtgcttgaagccgcgtctgaggaagtaccgttagttggttctgg

SEQ ID NO: 16503 - DNA, 50 bp, Artificial Sequence
  Description of Artificial Sequence: Synthetic probe
atagacaaaagatcgatgcattaaaagcggctattgaagttgagagagac

SEQ ID NO: 16504 - DNA, 60 bp, Artificial Sequence
  Description of Artificial Sequence: Synthetic probe
cgcgcgttagcacgagcgttacagcgtgaagcgactgaaagaacagaagcggaatctacg

SEQ ID NO: 16505 - DNA, 60 bp, Artificial Sequence
  Description of Artificial Sequence: Synthetic probe
aatgatcagatgcgcgcgttagcacgagcgttacagcgtgaagcgactgaaagaacagaa

SEQ ID NO: 16506 - DNA, 60 bp, Artificial Sequence
  Description of Artificial Sequence: Synthetic probe
cgtcgcggagaatgatcagatgcgcgcgttagcacgagcgttacagcgtgaagcgactga

SEQ ID NO: 16507 - DNA, 60 bp, Artificial Sequence
  Description of Artificial Sequence: Synthetic probe
attactcgtcgcggagaatgatcagatgcgcgcgttagcacgagcgttacagcgtgaagc

SEQ ID NO: 16508 - DNA, 60 bp, Artificial Sequence
  Description of Artificial Sequence: Synthetic probe
aggtgttgtgcaaagctgtcaattcatacgaaaaattactcgtcgcggagaatgatcaga

SEQ ID NO: 16509 - DNA, 60 bp, Artificial Sequence
  Description of Artificial Sequence: Synthetic probe
caggaggaacagtataaggtgttgtgcaaagctgtcaattcatacgaaaaattactcgtc

SEQ ID NO: 16510 - DNA, 60 bp, Artificial Sequence
  Description of Artificial Sequence: Synthetic probe
atttatgaatggcgaaatgcgagaagaggcggagcaggaggaacagtataaggtgttgtg

SEQ ID NO: 16511 - DNA, 60 bp, Artificial Sequence
  Description of Artificial Sequence: Synthetic probe
cgatggattagttcagggtagcgtacactcgatcatgacgggagaatcatacggtgaatc

SEQ ID NO: 16512 - DNA, 60 bp, Artificial Sequence
  Description of Artificial Sequence: Synthetic probe
tcgacggattagttcagggtagcgtacactcgatcatgacgggagaatcatacggtgaat

SEQ ID NO: 16513 - DNA, 60 bp, Artificial Sequence
  Description of Artificial Sequence: Synthetic probe
gtggggaatgcgttgacatcgaatacagcaaagaaaatctatagtacaatcgggaaggca

SEQ ID NO: 16514 - DNA, 60 bp, Artificial Sequence
  Description of Artificial Sequence: Synthetic probe
ttaaggggtccgctgcatttccaaagacgcgcaatactaggcgcgttaaagtttggggta

SEQ ID NO: 16515 - DNA, 60 bp, Artificial Sequence
  Description of Artificial Sequence: Synthetic probe
attttgaggatctggcggcccattggcacgctttaggtgcggcgcaggaagctaaagggc

SEQ ID NO: 16516 - DNA, 60 bp, Artificial Sequence
  Description of Artificial Sequence: Synthetic probe
gctaacacgagagagatccagcatatcaaagaggagattttaccaaagttcaagaaagta

SEQ ID NO: 16517 - DNA, 60 bp, Artificial Sequence
  Description of Artificial Sequence: Synthetic probe
agcaattgagggcgcatataaattgaaaaaggtgataaatgcgttaagtggaattgattt

SEQ ID NO: 16518 - DNA, 60 bp, Artificial Sequence
  Description of Artificial Sequence: Synthetic probe
ttcaagagattgctgggatgacggcagatgtgttagaggcggcttcggaagaggtacctt

SEQ ID NO: 16519 - DNA, 60 bp, Artificial Sequence
  Description of Artificial Sequence: Synthetic probe
gggagtcatacggcgaatcagtgaaacaagccgtgctactgaacgttctgggggcagggg

SEQ ID NO: 16520 - DNA, 60 bp, Artificial Sequence
  Description of Artificial Sequence: Synthetic probe
gcacagagatatgctcccggaacctcggcttgatgacattgaaagatttaggcaggaggg

SEQ ID NO: 16521 - DNA, 60 bp, Artificial Sequence
  Description of Artificial Sequence: Synthetic probe
cgcatgctggtcgccgcaggtaaagattcggaggcagcgtacttccgcagtatgttaccc

SEQ ID NO: 16522 - DNA, 60 bp, Artificial Sequence
  Description of Artificial Sequence: Synthetic probe
tggatcaacgccaaccgcacagcagcttaatgacgttaggaagatctacttagctctaat

SEQ ID NO: 16523 - DNA, 60 bp, Artificial Sequence
  Description of Artificial Sequence: Synthetic probe
tcgcgggatggaggttgcggaaccagaggtattaggcgtggaattcaaaaatgtgctgcc

SEQ ID NO: 16524 - DNA, 60 bp, Artificial Sequence
  Description of Artificial Sequence: Synthetic probe
ctgcggtagtgtgtggtccggatatgattcaagtgtcactgaatgctggagcaagaggag

SEQ ID NO: 16525 - DNA, 60 bp, Artificial Sequence
  Description of Artificial Sequence: Synthetic probe
aactgcggtagtgtgtggtccggatatgattcaagtgtcactgaatgctggagcaagagg

SEQ ID NO: 16526 - DNA, 60 bp, Artificial Sequence
  Description of Artificial Sequence: Synthetic probe
gctacggggtcgcgcgtgatggacgctgctgattgctttcgtaactctgcagaccgtgat

SEQ ID NO: 16527 - DNA, 60 bp, Artificial Sequence
  Description of Artificial Sequence: Synthetic probe
ttaacggctcattggcacgcattgggggcggctcagatggccgtaggacgcacgctaacc

SEQ ID NO: 16528 - DNA, 60 bp, Artificial Sequence
  Description of Artificial Sequence: Synthetic probe
aggatgagtttcacagagttttcatcagtcccgctagatggtttcgaattaccattaacc

SEQ ID NO: 16529 - DNA, 60 bp, Artificial Sequence
  Description of Artificial Sequence: Synthetic probe
ttcgaacagtattaaagatgtggtgcgagctacagcgtatttcacagcgccaaccggaga

SEQ ID NO: 16530 - DNA, 60 bp, Artificial Sequence
  Description of Artificial Sequence: Synthetic probe
tatgttagtttcgaacagtattaaagatgtggtgcgagctacagcgtatttcacagcgcc

SEQ ID NO: 16531 - DNA, 60 bp, Artificial Sequence
  Description of Artificial Sequence: Synthetic probe
cggatgacgtttccgtcatgcttagaaacgcgtgaaggcgggtgtaggggctacttcaac

SEQ ID NO: 16532 - DNA, 60 bp, Artificial Sequence
  Description of Artificial Sequence: Synthetic probe
cggatgatgtttccgtcatgcttagaaacgcgtgaaggcgggtgcaggggctacttcaac

SEQ ID NO: 16533 - DNA, 60 bp, Artificial Sequence
  Description of Artificial Sequence: Synthetic probe
tcctatctatttggggatgcatgattacgaagtttcatacgagcagatcaaaatgaacgc

SEQ ID NO: 16534 - DNA, 54 bp, Artificial Sequence
  Description of Artificial Sequence: Synthetic probe
aaaaggttattgaggtcgaggagtagtcatcctatctatttggggatgcatgat

SEQ ID NO: 16535 - DNA, 60 bp, Artificial Sequence
  Description of Artificial Sequence: Synthetic probe
ggacaaggggcgattcatcaaaaaaggttattgaggtcgaggagtagtcatcctatctat

SEQ ID NO: 16536 - DNA, 60 bp, Artificial Sequence
  Description of Artificial Sequence: Synthetic probe
gaatgtggctggacaaggagcgattcatcaaaaaaggttattgaggtcgaggagtagtca

SEQ ID NO: 16537 - DNA, 60 bp, Artificial Sequence
  Description of Artificial Sequence: Synthetic probe
aggaggataaagaaaacataacaaattggtctgaaaaacgcattcatcccaaaacggtgc

SEQ ID NO: 16538 - DNA, 60 bp, Artificial Sequence
  Description of Artificial Sequence: Synthetic probe
ggttgatcatatacagaacgtgattgttccgaaacttaaaaaagcagcagaggaggataa

SEQ ID NO: 16539 - DNA, 60 bp, Artificial Sequence
  Description of Artificial Sequence: Synthetic probe
ggttgatcatatacagaacgtgattgttccgaaacttaaaaaagcagtagaggaggataa

SEQ ID NO: 16540 - DNA, 60 bp, Artificial Sequence
  Description of Artificial Sequence: Synthetic probe
ctccaaaggggaaagacatatctgatttacgattgaccgaaggcttgatagcgaaaatgg

SEQ ID NO: 16541 - DNA, 60 bp, Artificial Sequence
  Description of Artificial Sequence: Synthetic probe
actccaaaggggaaagacatatctgatttacgattgaccgaaggcttgatagcgaaaatg

SEQ ID NO: 16542 - DNA, 60 bp, Artificial Sequence
  Description of Artificial Sequence: Synthetic probe
gcgattctagatactccaaaggggaaagacatatctgatttacgattgaccgaaggtttg

SEQ ID NO: 16543 - DNA, 60 bp, Artificial Sequence
  Description of Artificial Sequence: Synthetic probe
aattgaaggcgcgtacaaaattaaggctgtgataagtgctctgtctggaatcgatttgac

SEQ ID NO: 16544 - DNA, 60 bp, Artificial Sequence
  Description of Artificial Sequence: Synthetic probe
acgagcattgcgactgctcgcgcaattgaaggcgcgtacaaaattaaggctgtgataagc

SEQ ID NO: 16545 - DNA, 60 bp, Artificial Sequence
  Description of Artificial Sequence: Synthetic probe
ggagcgggtgttgctacgagcattgcgactgctcgcgcaattgaaggcgcgtacaaaatt

SEQ ID NO: 16546 - DNA, 60 bp, Artificial Sequence
  Description of Artificial Sequence: Synthetic probe
gtaccgttatttggagcgggtgttgctacgagcattgcaactgctcgcgcaattgaaggc

SEQ ID NO: 16547 - DNA, 60 bp, Artificial Sequence
  Description of Artificial Sequence: Synthetic probe
gagcgcggatgttttagaagcagcggcagaagaagtaccgttatttggagcgggtgttgc

SEQ ID NO: 16548 - DNA, 60 bp, Artificial Sequence
  Description of Artificial Sequence: Synthetic probe
gtatgagcgcggatgttttagaagcagcggcagaagaagtaccgttatttggagcgggtg

SEQ ID NO: 16549 - DNA, 60 bp, Artificial Sequence
  Description of Artificial Sequence: Synthetic probe
cggtatgagcgcggatgttttagaagcagcggcagaagaagtaccgttatttggagcggg

SEQ ID NO: 16550 - DNA, 60 bp, Artificial Sequence
  Description of Artificial Sequence: Synthetic probe
aagaaattgccggtatgagcgcggatgttttagaagcagcggcagaagaagtaccgttat

SEQ ID NO: 16551 - DNA, 60 bp, Artificial Sequence
  Description of Artificial Sequence: Synthetic probe
aaatgagagtattaacaaactcaaacaggctttgtacctcgaatcaacagaacgtacgga

SEQ ID NO: 16552 - DNA, 60 bp, Artificial Sequence
  Description of Artificial Sequence: Synthetic probe
ggaaaatgagagtattaacaaactcaaacaggctttgtacctcgaatcaacagaacgtac

SEQ ID NO: 16553 - DNA, 60 bp, Artificial Sequence
  Description of Artificial Sequence: Synthetic probe
taagttcggaagggatctcgatgaggtttataagtttgcgacccaggagcataaggttgg

SEQ ID NO: 16554 - DNA, 60 bp, Artificial Sequence
  Description of Artificial Sequence: Synthetic probe
cggagatattggataagttcggaagggatctcgatgaggtttataagtttgcgacccagg

SEQ ID NO: 16555 - DNA, 60 bp, Artificial Sequence
  Description of Artificial Sequence: Synthetic probe
ctgacccgctgagcccaggtgagaatgaaatttatagaaagttgagacagctcgaggagg

SEQ ID NO: 16556 - DNA, 60 bp, Artificial Sequence
  Description of Artificial Sequence: Synthetic probe
cgacacgatagctgacccgctgagcccaggtgagaatgaaatttatagaaagttgagaca

SEQ ID NO: 16557 - DNA, 60 bp, Artificial Sequence
  Description of Artificial Sequence: Synthetic probe
ggaggaggcgatacgatagctgacccgctgagcccaggtgagaatgaaatttatagaaaa

SEQ ID NO: 16558 - DNA, 60 bp, Artificial Sequence
  Description of Artificial Sequence: Synthetic probe
agggaagtgtacattcaatcatgacaggagagtcgtatggcgagagtgtcaagcaggcgg

SEQ ID NO: 16559 - DNA, 60 bp, Artificial Sequence
  Description of Artificial Sequence: Synthetic probe
agggaagcgtacactcaatcatgacgggagagtcgtatggcgagagtgtcaagcaggcgg

SEQ ID NO: 16560 - DNA, 60 bp, Artificial Sequence
  Description of Artificial Sequence: Synthetic probe
ttgcatgatggggaagatcatcaagtcgttgggcaaatttggcaaaaaagtcgggaacgc

SEQ ID NO: 16561 - DNA, 60 bp, Artificial Sequence
  Description of Artificial Sequence: Synthetic probe
ccctctcaagtgatatgagcgtggcatttaagcttaatggtacatcaacggaaataccgc

SEQ ID NO: 16562 - DNA, 60 bp, Artificial Sequence
  Description of Artificial Sequence: Synthetic probe
tgcacgctttcaagtgatatgagcgtggcatttaagcttaatggtacatcaacggaaata

SEQ ID NO: 16563 - DNA, 60 bp, Artificial Sequence
  Description of Artificial Sequence: Synthetic probe
tgtaccctctcaagtgatatgagcgtggcatttaagcttaatggtacatcaacggaaata

SEQ ID NO: 16564 - DNA, 60 bp, Artificial Sequence
  Description of Artificial Sequence: Synthetic probe
gcatttatgaagtaatgaagaagtcggtgatcgctacagcctgggtaggccgtgctcctc

SEQ ID NO: 16565 - DNA, 60 bp, Artificial Sequence
  Description of Artificial Sequence: Synthetic probe
gggcttatgctacgatgtttgaaatggttcgatgcattatcaccctatgctatgcggaaa

SEQ ID NO: 16566 - DNA, 60 bp, Artificial Sequence
  Description of Artificial Sequence: Synthetic probe
ggcttatgctacgatgtttgaaatggttcgatgcattatcaccctatgctatgcagaaaa

SEQ ID NO: 16567 - DNA, 60 bp, Artificial Sequence
  Description of Artificial Sequence: Synthetic probe
ggcttatgctacgatgtttgaaatggttcgatgcattatcaccctatgctatgcggaaaa

SEQ ID NO: 16568 - DNA, 60 bp, Artificial Sequence
  Description of Artificial Sequence: Synthetic probe
gggcttatgctacgatgtttgaaatggttcgatgcattatcaccctatgctatgcagaaa

SEQ ID NO: 16569 - DNA, 60 bp, Artificial Sequence
  Description of Artificial Sequence: Synthetic probe
taagttaaatcaacagactaaggacatcacttatgagcaaggtaacccttgcgatttatt

SEQ ID NO: 16570 - DNA, 60 bp, Artificial Sequence
  Description of Artificial Sequence: Synthetic probe
taaattaaatcaacagactaaggacatcacttatgagcaaggtaacccttgcgatttatt

SEQ ID NO: 16571 - DNA, 60 bp, Artificial Sequence
  Description of Artificial Sequence: Synthetic probe
tgaatctactaaaaggtatgaattgcagcgcgtgggtgcgtgtgagcgtgttgcttttgt

SEQ ID NO: 16572 - DNA, 60 bp, Artificial Sequence
  Description of Artificial Sequence: Synthetic probe
gaggtgaagatggagatcatgctaatcatcaagccgatgaggatgaacagggtgaggacg

SEQ ID NO: 16573 - DNA, 60 bp, Artificial Sequence
  Description of Artificial Sequence: Synthetic probe
ggctggtgttagctggaatttgaatcatcaaagtgaggaggaggcggatggaggtgaaga

SEQ ID NO: 16574 - DNA, 60 bp, Artificial Sequence
  Description of Artificial Sequence: Synthetic probe
gggtgtgagtgtaacaccgatggcaacacgggtgcaacataatggagtgatggttgatgc

SEQ ID NO: 16575 - DNA, 60 bp, Artificial Sequence
  Description of Artificial Sequence: Synthetic probe
gagtggaaatttgagggtgtgagtgtaacaccgatggcaacacgggtgcaacataatgga

SEQ ID NO: 16576 - DNA, 60 bp, Artificial Sequence
  Description of Artificial Sequence: Synthetic probe
cgagtggggtggaggcgacgactgaaagatgggaagagtggaaatttgagggtgtgagtg

SEQ ID NO: 16577 - DNA, 60 bp, Artificial Sequence
  Description of Artificial Sequence: Synthetic probe
gcataatgttaacaccgagtggggtggaggcgacgactgaaagatgggaagagtggaaat

SEQ ID NO: 16578 - DNA, 54 bp, Artificial Sequence
  Description of Artificial Sequence: Synthetic probe
aacccaagggttatgttttgaacgttccggggccaggtgcttatagaatacagg

SEQ ID NO: 16579 - DNA, 60 bp, Artificial Sequence
  Description of Artificial Sequence: Synthetic probe
tgagttcgcgattcatggcgtaaacccgatgcctgggccgctcacacgtgctattgcacg

SEQ ID NO: 16580 - DNA, 60 bp, Artificial Sequence
  Description of Artificial Sequence: Synthetic probe
gctgaagagatcagatatgtacaacagctcttcggaagggtcccaacaggtgaatttcca

SEQ ID NO: 16581 - DNA, 60 bp, Artificial Sequence
  Description of Artificial Sequence: Synthetic probe
ggttatgctgaagagatcagatatgtacaacagctcttcggaagggtcccaacaggtgaa

SEQ ID NO: 16582 - DNA, 60 bp, Artificial Sequence
  Description of Artificial Sequence: Synthetic probe
gctatttcaccacagtggacttgcagtcacttaaaaaggaattgtctatttaatggaatg

SEQ ID NO: 16583 - DNA, 60 bp, Artificial Sequence
  Description of Artificial Sequence: Synthetic probe
taccgattcagctgatcaatttcttaaggatggatgattttgcgaagcattttaacaggt

SEQ ID NO: 16584 - DNA, 60 bp, Artificial Sequence
  Description of Artificial Sequence: Synthetic probe
ttattcagttttgagacctgagctcgcaatccacggcgtgaatccaatgcctggcccgct

SEQ ID NO: 16585 - DNA, 60 bp, Artificial Sequence
  Description of Artificial Sequence: Synthetic probe
atctttcctccgaatgatcgggacagtgtactaacgatcctactactgtcaacgctcgca

SEQ ID NO: 16586 - DNA, 60 bp, Artificial Sequence
  Description of Artificial Sequence: Synthetic probe
tgaggaccgccatactaaacagaacaacccttcccaacatgttacccccaatctttcctc

SEQ ID NO: 16587 - DNA, 60 bp, Artificial Sequence
  Description of Artificial Sequence: Synthetic probe
aggtttcgctgaatgcgggcgcgagaggtgacgtgcagcagatatttcaaggtcgcaatg

SEQ ID NO: 16588 - DNA, 60 bp, Artificial Sequence
  Description of Artificial Sequence: Synthetic probe
tcaggtttcgctgaatgcgggcgcgagaggtgacgtgcagcagatatttcaaggtcgcaa

SEQ ID NO: 16589 - DNA, 60 bp, Artificial Sequence
  Description of Artificial Sequence: Synthetic probe
gttgttacaccagtggtttgtgggccagatatggttcaggtttcgctgaatgcgggcgcg

SEQ ID NO: 16590 - DNA, 60 bp, Artificial Sequence
  Description of Artificial Sequence: Synthetic probe
ccttgaaaccgaagaagtttatcaacctggaagatggcttatgcgagccgctcaagttgt

SEQ ID NO: 16591 - DNA, 60 bp, Artificial Sequence
  Description of Artificial Sequence: Synthetic probe
acggttttttccttgaaaccgaagaagtttatcaacctggaagatggcttatgcgagccg

SEQ ID NO: 16592 - DNA, 60 bp, Artificial Sequence
  Description of Artificial Sequence: Synthetic probe
cgacgcctgagataccgtttacgaccgaagctgcgaatgagattgcgcgtgttaccggag

SEQ ID NO: 16593 - DNA, 60 bp, Artificial Sequence
  Description of Artificial Sequence: Synthetic probe
tttcttatgtgtttagatatgatgctatcagcagcgggaatcaatgttggcccaatctca

SEQ ID NO: 16594 - DNA, 60 bp, Artificial Sequence
  Description of Artificial Sequence: Synthetic probe
agaaagcatacatgtcagctgtgttacttgaaacactcaaagcagatcccgacctgtggc

SEQ ID NO: 16595 - DNA, 60 bp, Artificial Sequence
  Description of Artificial Sequence: Synthetic probe
ccattaatcggcgcaggtatggccactgctgtagcaaccggcagagcgatagaaggcgca

SEQ ID NO: 16596 - DNA, 60 bp, Artificial Sequence
  Description of Artificial Sequence: Synthetic probe
gtgccattaatcggcgcaggtatggccactgctgtagcaaccggcagagcgatagaaggc

SEQ ID NO: 16597 - DNA, 60 bp, Artificial Sequence
  Description of Artificial Sequence: Synthetic probe
gctgtctgcggctgggataaatgttggaccgatatccccagattatacccaacatatggc

SEQ ID NO: 16598 - DNA, 60 bp, Artificial Sequence
  Description of Artificial Sequence: Synthetic probe
gctgtctgcggctgggataaacgttgggccgatatccccagattatacccaacatatggc

SEQ ID NO: 16599 - DNA, 60 bp, Artificial Sequence
  Description of Artificial Sequence: Synthetic probe
ccattaacctaagatcagtaggtagagtggcgccccaaggtttgcaccggatggagtggt

SEQ ID NO: 16600 - DNA, 60 bp, Artificial Sequence
  Description of Artificial Sequence: Synthetic probe
tttgcaatccacggcgtaaatccaatgcctggcccgcttacacgtgcgattgctcgcgcc

SEQ ID NO: 16601 - DNA, 60 bp, Artificial Sequence
  Description of Artificial Sequence: Synthetic probe
ttcgcaatccacggtgtaaatccaatgcctggcccgcttacacgtgcgattgctcgcgcc

SEQ ID NO: 16602 - DNA, 60 bp, Artificial Sequence
  Description of Artificial Sequence: Synthetic probe
gagacctgagtttgcgatccatggcgtaaatccaatgcctggcccgcttacacgtgcgat

SEQ ID NO: 16603 - DNA, 60 bp, Artificial Sequence
  Description of Artificial Sequence: Synthetic probe
gacgctcgcagatgtttattcagttttgagacctgagttcgcaatccacggcgtaaatcc

SEQ ID NO: 16604 - DNA, 60 bp, Artificial Sequence
  Description of Artificial Sequence: Synthetic probe
aacgctcgcagatgtttattcagttttgagacctgagttcgcaatccacggcgtgaatcc

SEQ ID NO: 16605 - DNA, 60 bp, Artificial Sequence
  Description of Artificial Sequence: Synthetic probe
aacgctcgcagatgtttattcagttttgagacctgagttcgcaatccacggcgtaaatcc

SEQ ID NO: 16606 - DNA, 60 bp, Artificial Sequence
  Description of Artificial Sequence: Synthetic probe
tgctactgtcgacgctcgcagatgtttattcagttttgagacctgagtttgcaatccacg

SEQ ID NO: 16607 - DNA, 60 bp, Artificial Sequence
  Description of Artificial Sequence: Synthetic probe
cacgatcctgctactgtcaacgctcgcagatgtttattcagttttgagacctgagttcgc

SEQ ID NO: 16608 - DNA, 60 bp, Artificial Sequence
  Description of Artificial Sequence: Synthetic probe
cagatcccaccctgtggtgtgattgatgtacgcgcatcagaactaactgggtgctcgccg

SEQ ID NO: 16609 - DNA, 60 bp, Artificial Sequence
  Description of Artificial Sequence: Synthetic probe
gaggcgcgggtgaggaggtcgggtgatgaaaactggcaaagctggctgctgcctatgatt

SEQ ID NO: 16610 - DNA, 60 bp, Artificial Sequence
  Description of Artificial Sequence: Synthetic probe
tggaggcgcgggtgaggaggtcgggtgatgaaaactggcaaagctggctgctgcctatga

SEQ ID NO: 16611 - DNA, 60 bp, Artificial Sequence
  Description of Artificial Sequence: Synthetic probe
cttaaggatggatgattctgcgaaacattttaataggtatgcttcgatggcgatacagca

SEQ ID NO: 16612 - DNA, 60 bp, Artificial Sequence
  Description of Artificial Sequence: Synthetic probe
tcaatttcttaaggatggatgattctgcgaaacattttaataggtatgcttcgatggcga

SEQ ID NO: 16613 - DNA, 60 bp, Artificial Sequence
  Description of Artificial Sequence: Synthetic probe
ggatcgatccaaacctatttggtattcgcggacagcataatcaaatcaaacgtgaggttg

SEQ ID NO: 16614 - DNA, 60 bp, Artificial Sequence
  Description of Artificial Sequence: Synthetic probe
cggctgatgattggatcgatccaaacctatttggtattcgcggacagcataatcaaatca

SEQ ID NO: 16615 - DNA, 60 bp, Artificial Sequence
  Description of Artificial Sequence: Synthetic probe
ctctctgcaatgccttacatctatgtgccgatcaaagaaggtcaaattgtgaatccaaca

SEQ ID NO: 16616 - DNA, 60 bp, Artificial Sequence
  Description of Artificial Sequence: Synthetic probe
gatgattctctctctgcaatgccttacatctatgtgccgatcaaagaaggtcaaattgtg

SEQ ID NO: 16617 - DNA, 60 bp, Artificial Sequence
  Description of Artificial Sequence: Synthetic probe
cggaaagagttagattggatgattctctctctgcaatgccttacatctatgtgccgatca

SEQ ID NO: 16618 - DNA, 60 bp, Artificial Sequence
  Description of Artificial Sequence: Synthetic probe
gcgggatggaagtcgcagagccggaagtgttaggcgtggagttcaagaatgtgctgcctg

SEQ ID NO: 16619 - DNA, 60 bp, Artificial Sequence
  Description of Artificial Sequence: Synthetic probe
ggtacatcaacggaaataccacagtggtttaagagtttaaatcctatgcttggagtggta

SEQ ID NO: 16620 - DNA, 60 bp, Artificial Sequence
  Description of Artificial Sequence: Synthetic probe
aatggtacatcaacggaaataccacagtggtttaagagtttaaatcctatgcttggagtg

SEQ ID NO: 16621 - DNA, 60 bp, Artificial Sequence
  Description of Artificial Sequence: Synthetic probe
gccatctacttttcacggcgggaggacgatttactaacctaactcagaatatggcgcgtc

SEQ ID NO: 16622 - DNA, 60 bp, Artificial Sequence
  Description of Artificial Sequence: Synthetic probe
tcatctgcttttcacggcgggaggacgatttactaacctgactcagaacatggctcgtca

SEQ ID NO: 16623 - DNA, 60 bp, Artificial Sequence
  Description of Artificial Sequence: Synthetic probe
caacgcattattacccgacctaattgctggggcgcatcagaacgccgacccagttgtgct

SEQ ID NO: 16624 - DNA, 60 bp, Artificial Sequence
  Description of Artificial Sequence: Synthetic probe
tcaacgcattattacccgacctaattgctggggcgcatcagaacgccgacccagttgtgc

SEQ ID NO: 16625 - DNA, 60 bp, Artificial Sequence
  Description of Artificial Sequence: Synthetic probe
caacgcattattacccgacctaattgctggggcgcatcagaacgccgacccagttgtgtt

SEQ ID NO: 16626 - DNA, 60 bp, Artificial Sequence
  Description of Artificial Sequence: Synthetic probe
cccgacctaattgctggggcgcatcagaacgccgacccagttgtgctagatgtgagttgg

SEQ ID NO: 16627 - DNA, 60 bp, Artificial Sequence
  Description of Artificial Sequence: Synthetic probe
ccttgaaatattggacaaagcgatgtcaaacacaactggtgcaacgcaaacacaaaaagc

SEQ ID NO: 16628 - DNA, 57 bp, Artificial Sequence
  Description of Artificial Sequence: Synthetic probe
ccttgaaatattggacaaagcgatgtcaaacacaactggtgcaacgcaaacacaaaa

SEQ ID NO: 16629 - DNA, 55 bp, Artificial Sequence
  Description of Artificial Sequence: Synthetic probe
ccttgaaatattggacaaagcgatgtcaaacacaactggtgcaacgcaaacacag

SEQ ID NO: 16630 - DNA, 57 bp, Artificial Sequence
  Description of Artificial Sequence: Synthetic probe
ccttgaaatactggacaaagcgatgtcaaacacaactggtgcaacgcaaacacaaaa

SEQ ID NO: 16631 - DNA, 60 bp, Artificial Sequence
  Description of Artificial Sequence: Synthetic probe
cggttgcccttgaaatattggacaaagcgatgtcaaacacaactggtgcaacgcaaacac

SEQ ID NO: 16632 - DNA, 60 bp, Artificial Sequence
  Description of Artificial Sequence: Synthetic probe
caccaagctggctgcgccaactgtgtagacgtgcgaccaatctatgcacttggtagcggc

SEQ ID NO: 16633 - DNA, 60 bp, Artificial Sequence
  Description of Artificial Sequence: Synthetic probe
gggccgctgcaaacgattttgaggatctgatgcttactgaccaagtttatatgcatcgag

SEQ ID NO: 16634 - DNA, 60 bp, Artificial Sequence
  Description of Artificial Sequence: Synthetic probe
ttgcgacaggaacgggatacaacggatgggctacaatcgatgttgagtatagagatccgg

SEQ ID NO: 16635 - DNA, 60 bp, Artificial Sequence
  Description of Artificial Sequence: Synthetic probe
cccacgggggaatacatcgcgccgaacccaagaatttcatcgattacgctgacccagaga

SEQ ID NO: 16636 - DNA, 60 bp, Artificial Sequence
  Description of Artificial Sequence: Synthetic probe
tggatcgataatcgagaacggaaacgtagccacacgagacgtcgacgtattcataggcgc

SEQ ID NO: 16637 - DNA, 60 bp, Artificial Sequence
  Description of Artificial Sequence: Synthetic probe
cgcttgctgatgtttacactgttttaagaccagagtttgcgattcatggcgtaaatccga

SEQ ID NO: 16638 - DNA, 60 bp, Artificial Sequence
  Description of Artificial Sequence: Synthetic probe
tgctcttatctacgcttgctgatgtttacactgttttaagaccagagtttgcgattcatg

SEQ ID NO: 16639 - DNA, 60 bp, Artificial Sequence
  Description of Artificial Sequence: Synthetic probe
gttttagggaccatacatggcatgggttgaagtcggcgatattaaacagaaccacactgc

SEQ ID NO: 16640 - DNA, 60 bp, Artificial Sequence
  Description of Artificial Sequence: Synthetic probe
cagatatttcagggtcgtaatgaccccatgatgatatacctagtatggagaaggatcgaa

SEQ ID NO: 16641 - DNA, 60 bp, Artificial Sequence
  Description of Artificial Sequence: Synthetic probe
ccaaccggggagatggtttatgcgcgccgctcaagcggtgactgcagtagtgtgcggtcc

SEQ ID NO: 16642 - DNA, 60 bp, Artificial Sequence
  Description of Artificial Sequence: Synthetic probe
agatagctcgcgtgactggggagacatcgacatggggaccagcgcgtcagccttatggtt

SEQ ID NO: 16643 - DNA, 60 bp, Artificial Sequence
  Description of Artificial Sequence: Synthetic probe
cagaagcggcggatgagatagctcgcgtgactggggagacatcgacatggggaccagcgc

SEQ ID NO: 16644 - DNA, 60 bp, Artificial Sequence
  Description of Artificial Sequence: Synthetic probe
tggtgtgctagcgacgccggaaatacctttcacaacagaagcggcggatgagatagctcg

SEQ ID NO: 16645 - DNA, 60 bp, Artificial Sequence
  Description of Artificial Sequence: Synthetic probe
gagatgttctttatgtgtttggatatgatgttgtctgctgctggtataaatgttggaccg

SEQ ID NO: 16646 - DNA, 60 bp, Artificial Sequence
  Description of Artificial Sequence: Synthetic probe
cgaggggtgatgatgcgcccgacctcgttagcgcagagaaatgagatgttctttatgtgt

SEQ ID NO: 16647 - DNA, 60 bp, Artificial Sequence
  Description of Artificial Sequence: Synthetic probe
acaatgcgcagagaatagtttatgatgaggagctgcaaatgcacattctgagggggccct

SEQ ID NO: 16648 - DNA, 60 bp, Artificial Sequence
  Description of Artificial Sequence: Synthetic probe
cgcagcagccgcaaattcacatttacgcggccccgtgggattctgatgacgtgtttttct

SEQ ID NO: 16649 - DNA, 60 bp, Artificial Sequence
  Description of Artificial Sequence: Synthetic probe
gcagtaagtgtgttgaataaaaagacggctgtaaccgataactgcaatgaaatcgcgcac

SEQ ID NO: 16650 - DNA, 60 bp, Artificial Sequence
  Description of Artificial Sequence: Synthetic probe
cgcatatgaggagtccgaagattgagcctactatcatcgctacaacattagagcatcgat

SEQ ID NO: 16651 - DNA, 60 bp, Artificial Sequence
  Description of Artificial Sequence: Synthetic probe
gatccaggagattgctggaatgaccgctgatgtcttagaggcagcatcggaggaggtgcc

SEQ ID NO: 16652 - DNA, 58 bp, Artificial Sequence
  Description of Artificial Sequence: Synthetic probe
gaaggagtacagacagaagatcgacgcgcttaaagatgcgatcgaaattgagcgagac

SEQ ID NO: 16653 - DNA, 60 bp, Artificial Sequence
  Description of Artificial Sequence: Synthetic probe
ggactcgaaaatggcgacattagcacgcgcgttgcagcgggaggcctcagagagaagtca

SEQ ID NO: 16654 - DNA, 60 bp, Artificial Sequence
  Description of Artificial Sequence: Synthetic probe
aacaaaagaatttgggaaggagctagaagaagtttacgatttcatgaatggcgaggcgaa

SEQ ID NO: 16655 - DNA, 60 bp, Artificial Sequence
  Description of Artificial Sequence: Synthetic probe
atggggagtcagttaaacaggcagttctcctcaacgtgttaggtacaggcgaagaattac

SEQ ID NO: 16656 - DNA, 60 bp, Artificial Sequence
  Description of Artificial Sequence: Synthetic probe
ttggaagcgcgctgtcgtcaaacacagcgaagaaaatttattcgactattgggaaggcag

SEQ ID NO: 16657 - DNA, 60 bp, Artificial Sequence
  Description of Artificial Sequence: Synthetic probe
gtgcaaagtcgttttggttaggatgcctggacatgtgttcggaaacgacgaattgatgac

SEQ ID NO: 16658 - DNA, 60 bp, Artificial Sequence
  Description of Artificial Sequence: Synthetic probe
gtgggattgtagctgtaagtgtgggtcaagagggccagttacaggtgtattcctctggaa

SEQ ID NO: 16659 - DNA, 60 bp, Artificial Sequence
  Description of Artificial Sequence: Synthetic probe
cccgcaagtgcgctcggagcaggtattaagtaaatactattactcacgcagacatatatg

SEQ ID NO: 16660 - DNA, 60 bp, Artificial Sequence
  Description of Artificial Sequence: Synthetic probe
acccgcaagtgcgctcggagcaggtattaagtaaatactattactcacgcagacatatat

SEQ ID NO: 16661 - DNA, 51 bp, Artificial Sequence
  Description of Artificial Sequence: Synthetic probe
taggactcgcagattcgatcgtttacacgctcccggttgcgcatccgaaaa

SEQ ID NO: 16662 - DNA, 60 bp, Artificial Sequence
  Description of Artificial Sequence: Synthetic probe
cggtgattctaagaagaaacaggacgccgacgatatgcataaagagtacggtgtcgcttg

SEQ ID NO: 16663 - DNA, 60 bp, Artificial Sequence
  Description of Artificial Sequence: Synthetic probe
gttaaaagagtgttccacaatggaggagttcgtcattcctgtgttttctgagagggagat

SEQ ID NO: 16664 - DNA, 60 bp, Artificial Sequence
  Description of Artificial Sequence: Synthetic probe
atttacaatgcgttggggcgtgtgaacgcgtcgcctttgtttccaaggacttaagcctac

SEQ ID NO: 16665 - DNA, 60 bp, Artificial Sequence
  Description of Artificial Sequence: Synthetic probe
gcatgatgttgacgtccacaggagttgaagcaacgacggagagatgggaggaatggaagt

SEQ ID NO: 16666 - DNA, 60 bp, Artificial Sequence
  Description of Artificial Sequence: Synthetic probe
gatgaggtcaaattatgatgttcgcgaacttcggcaaaagatcaaaaatgaacgagaatc

SEQ ID NO: 16667 - DNA, 60 bp, Artificial Sequence
  Description of Artificial Sequence: Synthetic probe
gtgatgaggtcaaattatgatgttcgcgaacttcggcaaaagatcaaaaatgaacgagag

SEQ ID NO: 16668 - DNA, 60 bp, Artificial Sequence
  Description of Artificial Sequence: Synthetic probe
gatgggaggagtggaagtttgagggcgttacggtgacgccactggctactcgggtacaac

SEQ ID NO: 16669 - DNA, 60 bp, Artificial Sequence
  Description of Artificial Sequence: Synthetic probe
gcagccgctaagacattatgcggggtgatcgcaaagttgagttcgcagccgtattgtcaa

SEQ ID NO: 16670 - DNA, 60 bp, Artificial Sequence
  Description of Artificial Sequence: Synthetic probe
gatgcagccgctaagacattatgcggggtgatcgcaaagttgagttcgcagccgtattgt

SEQ ID NO: 16671 - DNA, 60 bp, Artificial Sequence
  Description of Artificial Sequence: Synthetic probe
ccacgatcgcagcagccccaaattcatatctacagcgcgccatgggattctgatgacgtt

SEQ ID NO: 16672 - DNA, 60 bp, Artificial Sequence
  Description of Artificial Sequence: Synthetic probe
aatgtactaggagcaggagatgagatcccagacccgctgagtccgggtgagcgcggcatt

SEQ ID NO: 16673 - DNA, 60 bp, Artificial Sequence
  Description of Artificial Sequence: Synthetic probe
gagggatggcaggagggtatcttcatgctcggacgcgtactactgagatgggaactgacg

SEQ ID NO: 16674 - DNA, 60 bp, Artificial Sequence
  Description of Artificial Sequence: Synthetic probe
gcagagttggctactgcctatgattattgttcgtgaaggattagatcacccggatcggtg

SEQ ID NO: 16675 - DNA, 60 bp, Artificial Sequence
  Description of Artificial Sequence: Synthetic probe
gggtgatgagaactggcagagttggctactgcctatgattattgttcgtgaaggattaga

SEQ ID NO: 16676 - DNA, 60 bp, Artificial Sequence
  Description of Artificial Sequence: Synthetic probe
gcttctctcaaccatacgaagaggatgtcgaggggaagatgaagcgatgcggggtgcaac

SEQ ID NO: 16677 - DNA, 60 bp, Artificial Sequence
  Description of Artificial Sequence: Synthetic probe
gatgcggtgaggatgagttttacggagttttcatcagtcccgctagatggtttcgaatta

SEQ ID NO: 16678 - DNA, 60 bp, Artificial Sequence
  Description of Artificial Sequence: Synthetic probe
cggtgaggatgagctttacggaattttcatcagtcccgctagatggtttcgaattaccat

SEQ ID NO: 16679 - DNA, 60 bp, Artificial Sequence
  Description of Artificial Sequence: Synthetic probe
aggatgaaagagcttacgctacaatgtttgagacggttagatgtattattaccttgtgct

SEQ ID NO: 16680 - DNA, 60 bp, Artificial Sequence
  Description of Artificial Sequence: Synthetic probe
tatggatatgctcctcgtgcagatgggacggtgcctgattggaacaatctaggcagtttt

SEQ ID NO: 16681 - DNA, 60 bp, Artificial Sequence
  Description of Artificial Sequence: Synthetic probe
gagtgtttatgctggggcgcatactactgagatgggagcttacgaaagcgcaacgcagtg

SEQ ID NO: 16682 - DNA, 60 bp, Artificial Sequence
  Description of Artificial Sequence: Synthetic probe
ggggatcattactacacgacaagctgctacaccggagccgaagcgctagttacgacagct

SEQ ID NO: 16683 - DNA, 60 bp, Artificial Sequence
  Description of Artificial Sequence: Synthetic probe
atcggttgctcacctttcaggaccgtgacgatcgaagaacatgtaggtaatgagccgatc

SEQ ID NO: 16684 - DNA, 60 bp, Artificial Sequence
  Description of Artificial Sequence: Synthetic probe
tttccaagtgatgtatttgccaattcagctgataaatttcttaagaatggatgatttcgc

SEQ ID NO: 16685 - DNA, 55 bp, Artificial Sequence
  Description of Artificial Sequence: Synthetic probe
cgctattccctacatctatgttcccataagacaaggccaaattgtgaacccaacg

SEQ ID NO: 16686 - DNA, 60 bp, Artificial Sequence
  Description of Artificial Sequence: Synthetic probe
aaagaggcaatgtatgatcgagaaactgtttggctacaatgctttaaaagcttctctcag

SEQ ID NO: 16687 - DNA, 60 bp, Artificial Sequence
  Description of Artificial Sequence: Synthetic probe
ccttgagactgaggaggtttatcaacctggaagatggtttatgcgagctgctcatgttgt

SEQ ID NO: 16688 - DNA, 60 bp, Artificial Sequence
  Description of Artificial Sequence: Synthetic probe
ttttttccttgagactgaggaggtttatcaacctggaagatggtttatgcgagctgctca

SEQ ID NO: 16689 - DNA, 60 bp, Artificial Sequence
  Description of Artificial Sequence: Synthetic probe
gggggcgcttaaattcggagtaaaagtgctgggcgacaagattgatgtaccactctttct

SEQ ID NO: 16690 - DNA, 60 bp, Artificial Sequence
  Description of Artificial Sequence: Synthetic probe
ggacgaagagaaagagctggagggtattgacgataagagaatacatccaagggttatgat

SEQ ID NO: 16691 - DNA, 60 bp, Artificial Sequence
  Description of Artificial Sequence: Synthetic probe
ggtattgatctttcgcatctacgaacaccgaaaatagaacccacgatggtcgcaaccacc

SEQ ID NO: 16692 - DNA, 60 bp, Artificial Sequence
  Description of Artificial Sequence: Synthetic probe
cggagaatgacgagatgcgcacgttggctcgtgccctacagcgggaaacaactgaacgaa

SEQ ID NO: 16693 - DNA, 60 bp, Artificial Sequence
  Description of Artificial Sequence: Synthetic probe
tttatgatgaggagttgcagatgcatattctgaggggacctttgcacttccagcgtcgag

SEQ ID NO: 16694 - DNA, 60 bp, Artificial Sequence
  Description of Artificial Sequence: Synthetic probe
gcattatgatatcacgtatgaagctctaaaaaataatgcgcagagaatagtttatgatga

SEQ ID NO: 16695 - DNA, 60 bp, Artificial Sequence
  Description of Artificial Sequence: Synthetic probe
gaagatttgactagccattggcacgcgttgggattagcgcaagaggcgagcgggcgtacg

SEQ ID NO: 16696 - DNA, 60 bp, Artificial Sequence
  Description of Artificial Sequence: Synthetic probe
cgttcactttgaagatttgactagccattggcacgcgttgggattagcgcaagaggcgag

SEQ ID NO: 16697 - DNA, 60 bp, Artificial Sequence
  Description of Artificial Sequence: Synthetic probe
ttgaaggaatagaggataaagtgattcatccgcgagtgatgatgaggttcaaaattccta

SEQ ID NO: 16698 - DNA, 60 bp, Artificial Sequence
  Description of Artificial Sequence: Synthetic probe
atcgatttaaagagataccagatgaacagttggcagtaagtgtgctgaataaaaagacag

SEQ ID NO: 16699 - DNA, 60 bp, Artificial Sequence
  Description of Artificial Sequence: Synthetic probe
ggagcccgaagattgagcccactattatcgctacgacattggaacatcgatttaaagaga

SEQ ID NO: 16700 - DNA, 60 bp, Artificial Sequence
  Description of Artificial Sequence: Synthetic probe
gcgcgggtatggccacagccgtagcgaccggtagagcaatagagggcgcgtataagttga

SEQ ID NO: 16701 - DNA, 60 bp, Artificial Sequence
  Description of Artificial Sequence: Synthetic probe
ttatgtgcaggtctggcggactcagtcgtatatacattaccagttgcgcatcctaaaaaa

SEQ ID NO: 16702 - DNA, 59 bp, Artificial Sequence
  Description of Artificial Sequence: Synthetic probe
ctggcgggacgtatcagaaacgcgtgctagagatgaaggatccctgccagcttacgtgt

SEQ ID NO: 16703 - DNA, 60 bp, Artificial Sequence
  Description of Artificial Sequence: Synthetic probe
gcgcggtacgtggatacattaagtcccctgcggagtcgttagattttgttctcgggccct

SEQ ID NO: 16704 - DNA, 60 bp, Artificial Sequence
  Description of Artificial Sequence: Synthetic probe
gtgtggagaacgaatccgtatccatgcttgcggggtgctttagttgcagctgagtgtgaa

SEQ ID NO: 16705 - DNA, 60 bp, Artificial Sequence
  Description of Artificial Sequence: Synthetic probe
cgacgtgtgattatggcggctttaaaatatggtgtgaaggtgatgtcgagggcggatgat

SEQ ID NO: 16706 - DNA, 60 bp, Artificial Sequence
  Description of Artificial Sequence: Synthetic probe
gatttagaaatcgagtatgtgcattatgaagatctggcgcaacattggcattcgttgggg

SEQ ID NO: 16707 - DNA, 60 bp, Artificial Sequence
  Description of Artificial Sequence: Synthetic probe
aagcgattgaagaggatagagatgaaatcacgaattggtcaccgaagcggatacatccga

SEQ ID NO: 16708 - DNA, 60 bp, Artificial Sequence
  Description of Artificial Sequence: Synthetic probe
gttagaggctatattggatgcgccaggagggaatgtaacggatttgatgctaacgcgggg

SEQ ID NO: 16709 - DNA, 60 bp, Artificial Sequence
  Description of Artificial Sequence: Synthetic probe
ggcgctggggtggcgacaagtattgcaacggcgcgagcgatagaaggtgcctataaattg

SEQ ID NO: 16710 - DNA, 60 bp, Artificial Sequence
  Description of Artificial Sequence: Synthetic probe
ctggaaaaggctttgcgcgcatacgggaatgtagtgaaggtcgaaggagaaagcgttcag

SEQ ID NO: 16711 - DNA, 60 bp, Artificial Sequence
  Description of Artificial Sequence: Synthetic probe
catcgtttgaagaggttggaggatgagcagaaaggagaaattatacgtacgaagcacaat

SEQ ID NO: 16712 - DNA, 60 bp, Artificial Sequence
  Description of Artificial Sequence: Synthetic probe
gtcgtatggggagagcgtgaaacaggcggttattctaaatgtagtgggtggaggcgattc

SEQ ID NO: 16713 - DNA, 60 bp, Artificial Sequence
  Description of Artificial Sequence: Synthetic probe
cgattgggaaagcagctgaaaggttcgtagagagtgatctcggcagcgcaactatagatg

SEQ ID NO: 16714 - DNA, 54 bp, Artificial Sequence
  Description of Artificial Sequence: Synthetic probe
acgtgaggttgagagacaaattaacacatacccttacactggatacagaggtag

SEQ ID NO: 16715 - DNA, 60 bp, Artificial Sequence
  Description of Artificial Sequence: Synthetic probe
tagatatgatgttgtccgcggctgggataaatgttggaccgatatcgccagattatactc

SEQ ID NO: 16716 - DNA, 60 bp, Artificial Sequence
  Description of Artificial Sequence: Synthetic probe
aatcaaacgtgaggttgagagacaaattaacacatgcccctacactggatacaaaggcag

SEQ ID NO: 16717 - DNA, 60 bp, Artificial Sequence
  Description of Artificial Sequence: Synthetic probe
gccattaacctaagatcagtaggtagagtggcgccccgaggtttgcaccgcatggagtgg

SEQ ID NO: 16718 - DNA, 60 bp, Artificial Sequence
  Description of Artificial Sequence: Synthetic probe
acggcgtaaatccgatgccggggccgctcacacgtgctattgcacgcgccgcctatgtgt

SEQ ID NO: 16719 - DNA, 60 bp, Artificial Sequence
  Description of Artificial Sequence: Synthetic probe
gcgattcatggcgtaaatccgatgccggggccgctcacacgtgctattgcacgcgccgcc

SEQ ID NO: 16720 - DNA, 60 bp, Artificial Sequence
  Description of Artificial Sequence: Synthetic probe
gactgggagagcaatcgaaggagcatataaactcaagaaagtaataaacgccttgagcgg

SEQ ID NO: 16721 - DNA, 60 bp, Artificial Sequence
  Description of Artificial Sequence: Synthetic probe
accgcgattgcgactgggagagcaatcgaaggagcatataaactcaagaaagtaataaac

SEQ ID NO: 16722 - DNA, 60 bp, Artificial Sequence
  Description of Artificial Sequence: Synthetic probe
ttcggaggctgcgtattttcgcagtatgttacctttccatatggtaagattcgctagaat

SEQ ID NO: 16723 - DNA, 60 bp, Artificial Sequence
  Description of Artificial Sequence: Synthetic probe
acagatgcacatattaagaggaccactacacttccaaaggcgggcgatactaggcgcgat

SEQ ID NO: 16724 - DNA, 60 bp, Artificial Sequence
  Description of Artificial Sequence: Synthetic probe
cacgtatagctcgcagatgcacgctcggaggatgatacggtcgaagactgtacaccccat

SEQ ID NO: 16725 - DNA, 60 bp, Artificial Sequence
  Description of Artificial Sequence: Synthetic probe
ggttgggaggagtctgaacgaagtgtacaaagaatttttgaacttagcgattaataacac

SEQ ID NO: 16726 - DNA, 60 bp, Artificial Sequence
  Description of Artificial Sequence: Synthetic probe
ggattctgacgacgttttcttcttccattgtatatcgcatcaccacgcgaatgaatcatt

SEQ ID NO: 16727 - DNA, 60 bp, Artificial Sequence
  Description of Artificial Sequence: Synthetic probe
gtgctggatcataagtttaaggatattcccgatgaaatgctcgctgtaagtgttttatca

SEQ ID NO: 16728 - DNA, 60 bp, Artificial Sequence
  Description of Artificial Sequence: Synthetic probe
gagggagcttacaaattgaagaaggtcataaacgctctcagcggaatcgatttgacccac

SEQ ID NO: 16729 - DNA, 60 bp, Artificial Sequence
  Description of Artificial Sequence: Synthetic probe
gtgccactaataggtgcaggaatggcgacagctgtagccacgggtagggctatcgaggga

SEQ ID NO: 16730 - DNA, 60 bp, Artificial Sequence
  Description of Artificial Sequence: Synthetic probe
aggagatagctggaatgacggcggatgtgttggaggcagcttcggaggaggtgccactaa

SEQ ID NO: 16731 - DNA, 60 bp, Artificial Sequence
  Description of Artificial Sequence: Synthetic probe
gcccgggtgaacgtggaatgcagacgaagatccgtgagttggaggatgaacagcgcaatg

SEQ ID NO: 16732 - DNA, 60 bp, Artificial Sequence
  Description of Artificial Sequence: Synthetic probe
agcacaattgggaaagcggctgaacgatttgcagagagcgaaattggctcagcggctatt

SEQ ID NO: 16733 - DNA, 60 bp, Artificial Sequence
  Description of Artificial Sequence: Synthetic probe
ccactttgcacgggtgtgggttgcacagacggagtgtcggttgtgggaggtgtaacccat

SEQ ID NO: 16734 - DNA, 60 bp, Artificial Sequence
  Description of Artificial Sequence: Synthetic probe
cgttagctgatgtatatactgtactgcgaccggagttcgctatccatggtgtgaatccaa

SEQ ID NO: 16735 - DNA, 60 bp, Artificial Sequence
  Description of Artificial Sequence: Synthetic probe
tttgttgttgtcaacgttagctgatgtatatactgtactgcgaccggagttcgctatcca

SEQ ID NO: 16736 - DNA, 52 bp, Artificial Sequence
  Description of Artificial Sequence: Synthetic probe
caggccgctctacaaattcataaccctactcagcagaatgcaatggtgcaga

SEQ ID NO: 16737 - DNA, 60 bp, Artificial Sequence
  Description of Artificial Sequence: Synthetic probe
gaggtgttgacatgagggcaggacgcataatcgcgtgggatgggcaggccgctctacaaa

SEQ ID NO: 16738 - DNA, 60 bp, Artificial Sequence
  Description of Artificial Sequence: Synthetic probe
tgctggtgctagaggtgacgtgcaacaaatctttcagggtcgtaatgatcccatgatgat

SEQ ID NO: 16739 - DNA, 60 bp, Artificial Sequence
  Description of Artificial Sequence: Synthetic probe
aatgctggtgctagaggtgacgtgcaacaaatctttcagggtcgtaatgatcccatgatg

SEQ ID NO: 16740 - DNA, 60 bp, Artificial Sequence
  Description of Artificial Sequence: Synthetic probe
gcatctgaattaactgggtgctcgccgttcaaaatggtgaagatcgaagagcatgtagga

SEQ ID NO: 16741 - DNA, 60 bp, Artificial Sequence
  Description of Artificial Sequence: Synthetic probe
acgtgcatctgaattaactgggtgctcgccgttcaaaatggtgaagatcgaagagcatgt

SEQ ID NO: 16742 - DNA, 60 bp, Artificial Sequence
  Description of Artificial Sequence: Synthetic probe
taaatctaggtgcgactttcataatgatggtttgtgcgaagagcgaaagagggttaaatc

SEQ ID NO: 16743 - DNA, 60 bp, Artificial Sequence
  Description of Artificial Sequence: Synthetic probe
ttcaaacagtattaaagatgtggtgcgagctacagcgtatttcacagcgccaaccggaga

SEQ ID NO: 16744 - DNA, 60 bp, Artificial Sequence
  Description of Artificial Sequence: Synthetic probe
tatgttagtttcaaacagtattaaagatgtggtgcgagctacagcgtatttcacagcgcc

SEQ ID NO: 16745 - DNA, 60 bp, Artificial Sequence
  Description of Artificial Sequence: Synthetic probe
cctatgtagaccggattgacgtgatattaagaaaggatgtcgttatgcgaggctttatca

SEQ ID NO: 16746 - DNA, 60 bp, Artificial Sequence
  Description of Artificial Sequence: Synthetic probe
gcaaaagaacgtagagaagagatcgttaaacctgaggacttatacacatcgatgttgcga

SEQ ID NO: 16747 - DNA, 60 bp, Artificial Sequence
  Description of Artificial Sequence: Synthetic probe
gaacgtgagcactgaattcgataaacagctgaagccgaacccaagcaatctggttcggga

SEQ ID NO: 16748 - DNA, 60 bp, Artificial Sequence
  Description of Artificial Sequence: Synthetic probe
caccattttatccgcataagagttcgaacatgatactagcgtctttcctattgagtattc

SEQ ID NO: 16749 - DNA, 57 bp, Artificial Sequence
  Description of Artificial Sequence: Synthetic probe
gaggcggtgaagtattcgcaaaaattgggctcgcatgatcgtagattacctcttttt

SEQ ID NO: 16750 - DNA, 60 bp, Artificial Sequence
  Description of Artificial Sequence: Synthetic probe
cggcaggtgatgacaggaattcaaaggatgtgttttatgacaagtttcgaaccgagccaa

SEQ ID NO: 16751 - DNA, 59 bp, Artificial Sequence
  Description of Artificial Sequence: Synthetic probe
atgcaagttatggctgacttcgtaaaccgttttgattcaccattccaccaggggaatag

SEQ ID NO: 16752 - DNA, 60 bp, Artificial Sequence
  Description of Artificial Sequence: Synthetic probe
gttaaaaatctatagagatggacactatcgccgcaagagcactcactgtgatgcgagcat

SEQ ID NO: 16753 - DNA, 60 bp, Artificial Sequence
  Description of Artificial Sequence: Synthetic probe
cgtgaatttctcaatctatcaatctcacacacgtatagcagcgccatacatgcgaggcgt

SEQ ID NO: 16754 - DNA, 59 bp, Artificial Sequence
  Description of Artificial Sequence: Synthetic probe
cggcgcgggcatggccgcagctgtagcgaccggtagagcaatagagggcgcatataaat

SEQ ID NO: 16755 - DNA, 60 bp, Artificial Sequence
  Description of Artificial Sequence: Synthetic probe
atgactgcggacgtcttagaagcagcatcggaggaggtacctctaatcggcgcgggcatg

SEQ ID NO: 16756 - DNA, 60 bp, Artificial Sequence
  Description of Artificial Sequence: Synthetic probe
ggaatgactgcggacgtcttagaagcagcatcggaggaggtacctctaatcggcgcgggc

SEQ ID NO: 16757 - DNA, 60 bp, Artificial Sequence
  Description of Artificial Sequence: Synthetic probe
aagaaaatttattcaaccattgggaaggcggcagagcggtttgctgaaagtgagatcggt

SEQ ID NO: 16758 - DNA, 60 bp, Artificial Sequence
  Description of Artificial Sequence: Synthetic probe
gcgagtgagggttggacaaatcctcgctgtattgaataggagatttgtcgcatataaggg

SEQ ID NO: 16759 - DNA, 60 bp, Artificial Sequence
  Description of Artificial Sequence: Synthetic probe
cctcgttacaaccgtcgcttaaactggcgttggaggaagaagcttgggctgcggcgaatg

SEQ ID NO: 16760 - DNA, 60 bp, Artificial Sequence
  Description of Artificial Sequence: Synthetic probe
taccctcgttacaaccgtcgcttaaactggcgttggaggaagaagcttgggctgcggcga

SEQ ID NO: 16761 - DNA, 60 bp, Artificial Sequence
  Description of Artificial Sequence: Synthetic probe
gccggcgctcatcaaaatgcagatcctgtcgttttagatgtaagttggatatcgctttgg

SEQ ID NO: 16762 - DNA, 60 bp, Artificial Sequence
  Description of Artificial Sequence: Synthetic probe
tgcttttcacggcgggaggaagatttacaaacctaactcaaaatatggctcgtcagttgg

SEQ ID NO: 16763 - DNA, 60 bp, Artificial Sequence
  Description of Artificial Sequence: Synthetic probe
tgaaccggagaagttctactcgacgatcatcaaaaaagtcagatttatacgcggaaaagg

SEQ ID NO: 16764 - DNA, 60 bp, Artificial Sequence
  Description of Artificial Sequence: Synthetic probe
gattgaagggttattcacacgtagatcgttacatgcatccagatgcctctgtgatgaaag

SEQ ID NO: 16765 - DNA, 60 bp, Artificial Sequence
  Description of Artificial Sequence: Synthetic probe
cgcagaagataggttgggtgaagagatagcttatgaaatgagcggtgcattctctagtgc

SEQ ID NO: 16766 - DNA, 60 bp, Artificial Sequence
  Description of Artificial Sequence: Synthetic probe
ttcgcagaagataggttgggtgaagagatagcttatgaaatgagcggtgcattctctagt

SEQ ID NO: 16767 - DNA, 60 bp, Artificial Sequence
  Description of Artificial Sequence: Synthetic probe
cgccgctgtatatggagtatgcggagataggagccagattcgacgatgaaccaaccgatg

SEQ ID NO: 16768 - DNA, 60 bp, Artificial Sequence
  Description of Artificial Sequence: Synthetic probe
aatgccagaaataccgccgctgtatatggagtatgcggagataggagccagattcgacga

SEQ ID NO: 16769 - DNA, 60 bp, Artificial Sequence
  Description of Artificial Sequence: Synthetic probe
gttagattttcagatcggaaggaatcaatatgactgtaatgttttcagagcagatttcgc

SEQ ID NO: 16770 - DNA, 60 bp, Artificial Sequence
  Description of Artificial Sequence: Synthetic probe
aaccgttagattttcagatcggaaggaatcaatatgactgtaatgttttcagagcagatt

SEQ ID NO: 16771 - DNA, 60 bp, Artificial Sequence
  Description of Artificial Sequence: Synthetic probe
gcagatcccaacctgtggtgtgattgatgtacgcgcatcagagctaacggggtgctcgcc

SEQ ID NO: 16772 - DNA, 60 bp, Artificial Sequence
  Description of Artificial Sequence: Synthetic probe
ctcaacgtgttaggtacaggtgaagaattaccagacccactgagccctggcgagcgtggt

SEQ ID NO: 16773 - DNA, 60 bp, Artificial Sequence
  Description of Artificial Sequence: Synthetic probe
gcggcatcggaggaggttccgctgattggtgcggggatggctacggctgtagcgacagga

SEQ ID NO: 16774 - DNA, 60 bp, Artificial Sequence
  Description of Artificial Sequence: Synthetic probe
aagatgaagaggatagagatgagcgggaagatgaggagcaggtgaagaccctgagtgatg

SEQ ID NO: 16775 - DNA, 60 bp, Artificial Sequence
  Description of Artificial Sequence: Synthetic probe
atctagatgagaaagatgaagaggatagagatgagcgggaagatgaggagcaggtgaaga

SEQ ID NO: 16776 - DNA, 60 bp, Artificial Sequence
  Description of Artificial Sequence: Synthetic probe
ggagcgggttgaagagttgagtttggtccatgtggatgatacaatttctcagccgccaag

SEQ ID NO: 16777 - DNA, 60 bp, Artificial Sequence
  Description of Artificial Sequence: Synthetic probe
taatcaggagcgggttgaagagttgagtttggtccatgtggatgatacaatttctcagcc

SEQ ID NO: 16778 - DNA, 60 bp, Artificial Sequence
  Description of Artificial Sequence: Synthetic probe
gctgctcactaaactggctaatctgtgagcctgtgacacggctccctagcaacttcaact

SEQ ID NO: 16779 - DNA, 60 bp, Artificial Sequence
  Description of Artificial Sequence: Synthetic probe
taacgaaattcgcaggtttagtctacgggaactacgagctgctcactaaactggctaatc

SEQ ID NO: 16780 - DNA, 60 bp, Artificial Sequence
  Description of Artificial Sequence: Synthetic probe
atcataaggttatattaacgaaattcgcaggtttagtctacgggaactacgagctgctca

SEQ ID NO: 16781 - DNA, 57 bp, Artificial Sequence
  Description of Artificial Sequence: Synthetic probe
ccggattggttgggagtgtttggagcgagaagcacagcaaaatcaaagtctgcaggc

SEQ ID NO: 16782 - DNA, 60 bp, Artificial Sequence
  Description of Artificial Sequence: Synthetic probe
aggtacatgccagtatatagatgatgttattgttcttcaaatgaagcggcccggattggt

SEQ ID NO: 16783 - DNA, 54 bp, Artificial Sequence
  Description of Artificial Sequence: Synthetic probe
atcccatgatagttacatttgaagacgggatcaagattgtgccgacaatggttg

SEQ ID NO: 16784 - DNA, 60 bp, Artificial Sequence
  Description of Artificial Sequence: Synthetic probe
gcggtggtacttccattagctacttacaccgtgaatggagttatcccatgatagttacgt

SEQ ID NO: 16785 - DNA, 60 bp, Artificial Sequence
  Description of Artificial Sequence: Synthetic probe
gattcatcacatccctaaggaagaatatgctacacgcgaggaagagctgattcagtacat

SEQ ID NO: 16786 - DNA, 60 bp, Artificial Sequence
  Description of Artificial Sequence: Synthetic probe
ctgcgctcagatgaatcaaaggaggatgacactcattgcgcgctgcgaatcttttcagat

SEQ ID NO: 16787 - DNA, 60 bp, Artificial Sequence
  Description of Artificial Sequence: Synthetic probe
atagggtcgtaagcggatatttgggcgaccatgttgagacatatggcttagggtacaacc

SEQ ID NO: 16788 - DNA, 60 bp, Artificial Sequence
  Description of Artificial Sequence: Synthetic probe
gaggcgcagatggcaaatgagtggagtgacgacccatgggtgaatagggtcgtaagcgga

SEQ ID NO: 16789 - DNA, 60 bp, Artificial Sequence
  Description of Artificial Sequence: Synthetic probe
ctcgagtgccacttgagaaaccggacattagtacgggacgcgtttgtatgacatcaactg

SEQ ID NO: 16790 - DNA, 60 bp, Artificial Sequence
  Description of Artificial Sequence: Synthetic probe
cgcgaatagatccgagattgatcgagagaagaaggcgtacccatatcagaggataaattt

SEQ ID NO: 16791 - DNA, 60 bp, Artificial Sequence
  Description of Artificial Sequence: Synthetic probe
tccgatggagcttgcgaccagagtacgcgaatagatccgagattgatcgagagaagaagg

SEQ ID NO: 16792 - DNA, 60 bp, Artificial Sequence
  Description of Artificial Sequence: Synthetic probe
tgagatctacgttccgatggagtttgcgaccagagtacgcgaatagatccgagattgatc

SEQ ID NO: 16793 - DNA, 60 bp, Artificial Sequence
  Description of Artificial Sequence: Synthetic probe
atgtttacaagactttgagatctacgttccgatggagtttgcgaccagagtacgcgaata

SEQ ID NO: 16794 - DNA, 60 bp, Artificial Sequence
  Description of Artificial Sequence: Synthetic probe
agcatgtgaaatggaattgggagatgtttacaagactttgagatctacgttccgatggag

SEQ ID NO: 16795 - DNA, 60 bp, Artificial Sequence
  Description of Artificial Sequence: Synthetic probe
ccgacagttatcggtggcgtatctggtggagtaatccttatccatgcttgcggggaacta

SEQ ID NO: 16796 - DNA, 54 bp, Artificial Sequence
  Description of Artificial Sequence: Synthetic probe
agcaaggacgcgttggataggatatcaaatgaatggtatagcagtcgaaatacg

SEQ ID NO: 16797 - DNA, 60 bp, Artificial Sequence
  Description of Artificial Sequence: Synthetic probe
gaggatccgttgtatgatttcattctgtcaggagcattccaggtatcgaagacagcagga

SEQ ID NO: 16798 - DNA, 60 bp, Artificial Sequence
  Description of Artificial Sequence: Synthetic probe
ctggttgtaaccacgggaatgaggatccgttgtatgatttcattctgtcaggagcgttcc

SEQ ID NO: 16799 - DNA, 60 bp, Artificial Sequence
  Description of Artificial Sequence: Synthetic probe
cgccagtttcgaaggctggttgtaaccacgggaatgaggatccgttgtatgatttcattc

SEQ ID NO: 16800 - DNA, 60 bp, Artificial Sequence
  Description of Artificial Sequence: Synthetic probe
gggtatgactacgcgccagtttcgaaggctggttgtaaccacgggaatgaggatccgttg

SEQ ID NO: 16801 - DNA, 60 bp, Artificial Sequence
  Description of Artificial Sequence: Synthetic probe
atgctgaaactgtagggtatgactacgcgccagtttcgaaggctggttgtaaccacggga

SEQ ID NO: 16802 - DNA, 60 bp, Artificial Sequence
  Description of Artificial Sequence: Synthetic probe
aacattgatgggaacgatcagatgggattccaactatgctgaaactgtagggtatgacta

SEQ ID NO: 16803 - DNA, 60 bp, Artificial Sequence
  Description of Artificial Sequence: Synthetic probe
cacaccatagatgcaaaccgagggaaattgaaatttaaaacattgatgggaacgatcaga

SEQ ID NO: 16804 - DNA, 60 bp, Artificial Sequence
  Description of Artificial Sequence: Synthetic probe
atccaagcgtatgatcgtaagcataaagtatcgctaaggaagcgcttcgaagatggtgag

SEQ ID NO: 16805 - DNA, 60 bp, Artificial Sequence
  Description of Artificial Sequence: Synthetic probe
gcgctcaacgtgctaatccaagcgtatgatcgtaagcataaagtatcgctaaggaagcgc

SEQ ID NO: 16806 - DNA, 60 bp, Artificial Sequence
  Description of Artificial Sequence: Synthetic probe
taaaggcgtatgtgtgcggtcggagggcgtacgcgtagcgttgacatcaagaccagaccc

SEQ ID NO: 16807 - DNA, 60 bp, Artificial Sequence
  Description of Artificial Sequence: Synthetic probe
gtgtcaaagttagaagaaattaaaggcgtatgtgtgcggtcggaaggcgtacgcgtagcg

SEQ ID NO: 16808 - DNA, 60 bp, Artificial Sequence
  Description of Artificial Sequence: Synthetic probe
actaggagcgcttaaattcggagtaaaagtgctaggcgacaagattgatgtgccactctt

SEQ ID NO: 16809 - DNA, 60 bp, Artificial Sequence
  Description of Artificial Sequence: Synthetic probe
caaggaatttcttaacctatcaattggcagcacctatacatcaccaatgcatgcgagacg

SEQ ID NO: 16810 - DNA, 60 bp, Artificial Sequence
  Description of Artificial Sequence: Synthetic probe
caagaagataatggacgaagagaaagagttggaaggtattgatgataagagaatacaccc

SEQ ID NO: 16811 - DNA, 60 bp, Artificial Sequence
  Description of Artificial Sequence: Synthetic probe
gaatgacgagatgcgcacgttggctcgcgctctgcgacgggaaacgactgaacgaacgga

SEQ ID NO: 16812 - DNA, 60 bp, Artificial Sequence
  Description of Artificial Sequence: Synthetic probe
gggcgggggatgagattccggatccgttaagtccaggtgagcgtggcatccagatgaaga

SEQ ID NO: 16813 - DNA, 60 bp, Artificial Sequence
  Description of Artificial Sequence: Synthetic probe
cgaatcctatggagagtcggtcaagcaagcggtgctgctgaacgtgttaggggcggggga

SEQ ID NO: 16814 - DNA, 60 bp, Artificial Sequence
  Description of Artificial Sequence: Synthetic probe
cagcggagcggttcgctgagagtgaaatcgggtcggctgcaattgatgggttagtccagg

SEQ ID NO: 16815 - DNA, 60 bp, Artificial Sequence
  Description of Artificial Sequence: Synthetic probe
gctcgcgcgattgaatctaaatacggtacaaagatcgatgtttacagggatgaggttcca

SEQ ID NO: 16816 - DNA, 60 bp, Artificial Sequence
  Description of Artificial Sequence: Synthetic probe
ttgacacacaccttgatattgatacctggaaaatcgcagacatttcccaacttatggtgc

SEQ ID NO: 16817 - DNA, 60 bp, Artificial Sequence
  Description of Artificial Sequence: Synthetic probe
gcacccctcgattgacacacaccttgatattgatacctggaaaatagcggacatttccca

SEQ ID NO: 16818 - DNA, 60 bp, Artificial Sequence
  Description of Artificial Sequence: Synthetic probe
taaatttaagcacccctcgattgacacacaccttgatattgatacctggaaaatagcgga

SEQ ID NO: 16819 - DNA, 60 bp, Artificial Sequence
  Description of Artificial Sequence: Synthetic probe
ggctgcgcttgaggattatcgggatgttatatcaagacgtttaggatatgtcgagcgtga

SEQ ID NO: 16820 - DNA, 60 bp, Artificial Sequence
  Description of Artificial Sequence: Synthetic probe
tatagcgagtaaagtggctgcgcttgaggattatcgggatgttatatcaagacgtttagg

SEQ ID NO: 16821 - DNA, 60 bp, Artificial Sequence
  Description of Artificial Sequence: Synthetic probe
atgatgtacgaccaggtgtgatgggacgagcgttatctaaagagcaggaaggatcagcta

SEQ ID NO: 16822 - DNA, 60 bp, Artificial Sequence
  Description of Artificial Sequence: Synthetic probe
cactcggacgatcctgctgtagctaggacagctaaatcgtttgaccatgattccttcagc

SEQ ID NO: 16823 - DNA, 60 bp, Artificial Sequence
  Description of Artificial Sequence: Synthetic probe
aacgcactcggacgatcctgctgtagctaggacagctaaatcgtttgaccatgattcctt

SEQ ID NO: 16824 - DNA, 54 bp, Artificial Sequence
  Description of Artificial Sequence: Synthetic probe
aaaacgcactcggacgatcctgctgtagctaggacagctaaatcgtttgatcat

SEQ ID NO: 16825 - DNA, 60 bp, Artificial Sequence
  Description of Artificial Sequence: Synthetic probe
aggaaacgggtcagtcttgacgttacctgaatattataacaaatggatagtcgctccaat

SEQ ID NO: 16826 - DNA, 60 bp, Artificial Sequence
  Description of Artificial Sequence: Synthetic probe
gatgtacaaaatgagcacattcgtgatgccattatatctaagcctgttagcaatgacgga

SEQ ID NO: 16827 - DNA, 60 bp, Artificial Sequence
  Description of Artificial Sequence: Synthetic probe
gatgtacaaaatgagcacattcgtgatgccattacatctaagcctgttagcaatgacggg

SEQ ID NO: 16828 - DNA, 60 bp, Artificial Sequence
  Description of Artificial Sequence: Synthetic probe
aattcagcgatgtttgatgtacaaaatgagcacattcgtgatgccattacatctaagcct

SEQ ID NO: 16829 - DNA, 60 bp, Artificial Sequence
  Description of Artificial Sequence: Synthetic probe
gttaaaacatgcctgagccacacgcagtactctatgtcacaaatgagctctctcatatcg

SEQ ID NO: 16830 - DNA, 60 bp, Artificial Sequence
  Description of Artificial Sequence: Synthetic probe
gttaaaacatgcctgagccacacgcagtactctatgtcacaaacgagctctctcacatcg

SEQ ID NO: 16831 - DNA, 58 bp, Artificial Sequence
  Description of Artificial Sequence: Synthetic probe
gttaaaacatgcctgagccacacgcagtactctatgtcacaaacgagctctctcatat

SEQ ID NO: 16832 - DNA, 60 bp, Artificial Sequence
  Description of Artificial Sequence: Synthetic probe
atacatcgatggataagagggtgtggcatctggaatgatgaaggatggcaggaaggtatc

SEQ ID NO: 16833 - DNA, 60 bp, Artificial Sequence
  Description of Artificial Sequence: Synthetic probe
aactatgctatctaaaacattcaaagcagatacagacatgtggtgtgatcgatgtgcgtg

SEQ ID NO: 16834 - DNA, 58 bp, Artificial Sequence
  Description of Artificial Sequence: Synthetic probe
cccacgcgcgaccgcagcattgtggaatcacgcgtgaggagatcgggtgatgaaaact

SEQ ID NO: 16835 - DNA, 60 bp, Artificial Sequence
  Description of Artificial Sequence: Synthetic probe
gaatttccattgcatcagatgatgttgatgagacgcgacttccccacgcgcgaccgcagc

SEQ ID NO: 16836 - DNA, 60 bp, Artificial Sequence
  Description of Artificial Sequence: Synthetic probe
cggctatgctgaagaagtcagatatgtgcaacaactgtttgggaaagttccaactggtga

SEQ ID NO: 16837 - DNA, 57 bp, Artificial Sequence
  Description of Artificial Sequence: Synthetic probe
gatatgcttcgatggctatccaacagtatctgagagtcggctatgctgaagaagtca

SEQ ID NO: 16838 - DNA, 60 bp, Artificial Sequence
  Description of Artificial Sequence: Synthetic probe
acgggaagtagagaggcaaattaatacctgtccttattcaggctacaaaggtagggtctt

SEQ ID NO: 16839 - DNA, 60 bp, Artificial Sequence
  Description of Artificial Sequence: Synthetic probe
tggatcgatccaaatttgttcggaatccgagggcaacacaatcagataaaacgggaagta

SEQ ID NO: 16840 - DNA, 60 bp, Artificial Sequence
  Description of Artificial Sequence: Synthetic probe
gaagaggacatcgaaggaaagatgaggaggtgtggcgtacagctgctcgaagattaccgc

SEQ ID NO: 16841 - DNA, 60 bp, Artificial Sequence
  Description of Artificial Sequence: Synthetic probe
accacggaaagcatttcaactggttgaattagctaaagaggcgatgtatgatcgagagac

SEQ ID NO: 16842 - DNA, 51 bp, Artificial Sequence
  Description of Artificial Sequence: Synthetic probe
ttttgggaatcgcaattaatagatacaatgggttaacacttaggtcagtca

SEQ ID NO: 16843 - DNA, 60 bp, Artificial Sequence
  Description of Artificial Sequence: Synthetic probe
tgaaggggatatagatggacggggggatgaggagcaagcgaagaccttgagtgacgatga

SEQ ID NO: 16844 - DNA, 60 bp, Artificial Sequence
  Description of Artificial Sequence: Synthetic probe
ggaagctgtaattaattggaatctggaagagagagatgaaggggatatagatggacgggg

SEQ ID NO: 16845 - DNA, 60 bp, Artificial Sequence
  Description of Artificial Sequence: Synthetic probe
ggacataaccgctaaaacgttatgcggggctatcgcgaagttaagttcgcagccgtattg

SEQ ID NO: 16846 - DNA, 60 bp, Artificial Sequence
  Description of Artificial Sequence: Synthetic probe
tctatcgaagaatcgtgcgattcaagaaaaccacaaagaactgatgcatattaagaatga

SEQ ID NO: 16847 - DNA, 60 bp, Artificial Sequence
  Description of Artificial Sequence: Synthetic probe
ggctgttagtgttctatcaaagaatcgtgcgattcaagaaaaccacaaagaactgatgca

SEQ ID NO: 16848 - DNA, 60 bp, Artificial Sequence
  Description of Artificial Sequence: Synthetic probe
gcgcactgcttaggctcttctgttttgtctgttatggatatgctccccgcgcggatggaa

SEQ ID NO: 16849 - DNA, 60 bp, Artificial Sequence
  Description of Artificial Sequence: Synthetic probe
tcattattacacaacgagctgctataccggagctgaagcgttggttacaactgctatcca

SEQ ID NO: 16850 - DNA, 60 bp, Artificial Sequence
  Description of Artificial Sequence: Synthetic probe
cagatacagacgtgtagcgtaatagatgttcgcgcttcagagttgatcggttgctcaccc

SEQ ID NO: 16851 - DNA, 60 bp, Artificial Sequence
  Description of Artificial Sequence: Synthetic probe
ccaatggtcctggtgcgagaagggctagatcagcaggagaagtgggaatggcttctagag

SEQ ID NO: 16852 - DNA, 60 bp, Artificial Sequence
  Description of Artificial Sequence: Synthetic probe
cgatgcggtgcacagctacttgaagactaccgcaaaagtggaatgatggaggaggctatt

SEQ ID NO: 16853 - DNA, 60 bp, Artificial Sequence
  Description of Artificial Sequence: Synthetic probe
cccgcgccctacgtacatgctcagcgttatatacggtactgtggcattgattcgcgagag

SEQ ID NO: 16854 - DNA, 60 bp, Artificial Sequence
  Description of Artificial Sequence: Synthetic probe
atgccatcatctatgccaacggttgcccttgaaatactggacaaagcgatgtcaaacaca

SEQ ID NO: 16855 - DNA, 60 bp, Artificial Sequence
  Description of Artificial Sequence: Synthetic probe
gatgccatcatctatgccaacggttgcccttgaaatactggacaaagcgatgtcaaacac

SEQ ID NO: 16856 - DNA, 60 bp, Artificial Sequence
  Description of Artificial Sequence: Synthetic probe
gagatgctcacaaaactgctaaacgtgtgaggcttccgtgactgcaagcaggcgacattc

SEQ ID NO: 16857 - DNA, 60 bp, Artificial Sequence
  Description of Artificial Sequence: Synthetic probe
ggggattgcgaaagcgacactgtgcgataagagcgttctaaagtatagttataaggtggt

SEQ ID NO: 16858 - DNA, 60 bp, Artificial Sequence
  Description of Artificial Sequence: Synthetic probe
cgcggatccgttgtgatctcgattcttagtgatggctcaatcaacacgtattcagagggg

SEQ ID NO: 16859 - DNA, 60 bp, Artificial Sequence
  Description of Artificial Sequence: Synthetic probe
attcacttgtctatctaatgcctatcacacaccctatcaaaagtatcgttgctatagtta

SEQ ID NO: 16860 - DNA, 54 bp, Artificial Sequence
  Description of Artificial Sequence: Synthetic probe
ggggagttaacacgcactcgacgatgacaaaagatccgatataccaggtttact

SEQ ID NO: 16861 - DNA, 60 bp, Artificial Sequence
  Description of Artificial Sequence: Synthetic probe
cgcatctgactttccacgtggggaaagcgaagtatgatcaaaatctcgatcaagcggagc

SEQ ID NO: 16862 - DNA, 60 bp, Artificial Sequence
  Description of Artificial Sequence: Synthetic probe
ggaaggcctcagaatctacgtatggagaggcgcagaaattaaacctgctgcctttgctct

SEQ ID NO: 16863 - DNA, 60 bp, Artificial Sequence
  Description of Artificial Sequence: Synthetic probe
cgacgtactattcgagagaagacgcgttgtacgtggcgtagatgagtcgaggttcatttt

SEQ ID NO: 16864 - DNA, 60 bp, Artificial Sequence
  Description of Artificial Sequence: Synthetic probe
caaaaacccatgcccaattacgacagcctgtcaatataccttgcagaagacctcggtgtt

SEQ ID NO: 16865 - DNA, 60 bp, Artificial Sequence
  Description of Artificial Sequence: Synthetic probe
cgaaggctgctgatctactagattttaccctaggctcctactatgacacacgttttggcg

SEQ ID NO: 16866 - DNA, 60 bp, Artificial Sequence
  Description of Artificial Sequence: Synthetic probe
cgcggacccagctgtgtctaggaccatcaggccgcttaaagcgaaggctgctgatctact

SEQ ID NO: 16867 - DNA, 60 bp, Artificial Sequence
  Description of Artificial Sequence: Synthetic probe
gttccgatgtatcctgagaatatgtgaaacaacgatttccgtgagacaaaacgcggaccc

SEQ ID NO: 16868 - DNA, 60 bp, Artificial Sequence
  Description of Artificial Sequence: Synthetic probe
cggaaatggtaatgccatcatacttcaataagagaattgccgcgcctatgttccgatgta

SEQ ID NO: 16869 - DNA, 60 bp, Artificial Sequence
  Description of Artificial Sequence: Synthetic probe
tctgaaagatgcggggaatgtactcacgattgattttgagaaagatgcgaggcttaatga

SEQ ID NO: 16870 - DNA, 60 bp, Artificial Sequence
  Description of Artificial Sequence: Synthetic probe
agatggacatgcatgcgatgagttcccggatgattatgatttagtatgctcgtttgatga

SEQ ID NO: 16871 - DNA, 60 bp, Artificial Sequence
  Description of Artificial Sequence: Synthetic probe
gagtacagtacgcaggctgatgtcgcacggcagaatgacaactatacgtttacgcgcgtt

SEQ ID NO: 16872 - DNA, 60 bp, Artificial Sequence
  Description of Artificial Sequence: Synthetic probe
gcagtctggcgacgtgtataaaatgttacgtgttcgattcgactggagtgttcgcaatga

SEQ ID NO: 16873 - DNA, 60 bp, Artificial Sequence
  Description of Artificial Sequence: Synthetic probe
cgaacatgtttccgtgtttgcgaggcgctctgatagtaggagagacgcagtctggcgacg

SEQ ID NO: 16874 - DNA, 60 bp, Artificial Sequence
  Description of Artificial Sequence: Synthetic probe
ttgcagcgacagatacgaatcgagggaggatctggtggtcgaacatgtttccgtgtttgc

SEQ ID NO: 16875 - DNA, 60 bp, Artificial Sequence
  Description of Artificial Sequence: Synthetic probe
tgaaaagagcgggaggactaatgatgaaagattctttgcattgatcatgattgcagcgac

SEQ ID NO: 16876 - DNA, 59 bp, Artificial Sequence
  Description of Artificial Sequence: Synthetic probe
gagttatgcaaactattatcgtcagtcgggaggaagatgtacgacaagtacgaggagcc

SEQ ID NO: 16877 - DNA, 60 bp, Artificial Sequence
  Description of Artificial Sequence: Synthetic probe
ataggatggtgcagggtatggtatcgagtcaaggggtaaaaggccacacacctggtaaaa

SEQ ID NO: 16878 - DNA, 60 bp, Artificial Sequence
  Description of Artificial Sequence: Synthetic probe
ggcgtggtgaggtgttcaggatgggtacagagcagtataataggatggtgcagggtatgg

SEQ ID NO: 16879 - DNA, 60 bp, Artificial Sequence
  Description of Artificial Sequence: Synthetic probe
cgcttagtgagaggctgctgccgggatcgagtcatctaactagtatgcggcgtggtgagg

SEQ ID NO: 16880 - DNA, 60 bp, Artificial Sequence
  Description of Artificial Sequence: Synthetic probe
ctcaagaaagcgcgtatatgctcaagcctacgcagaagttggagcctgttgcagagaaaa

SEQ ID NO: 16881 - DNA, 60 bp, Artificial Sequence
  Description of Artificial Sequence: Synthetic probe
cggatggatgcgaaaaaagctgaagcagtatactatgggtgggccgcgcaggaggttatc

SEQ ID NO: 16882 - DNA, 60 bp, Artificial Sequence
  Description of Artificial Sequence: Synthetic probe
caggtgtggttaaagtgggctataaaggattttatggatgtgcagccgctgaaggttagt

SEQ ID NO: 16883 - DNA, 60 bp, Artificial Sequence
  Description of Artificial Sequence: Synthetic probe
tggctatgcgttgccgcgcattctggatgtgtctatcgctgcttacgatacgcggaaagg

SEQ ID NO: 16884 - DNA, 60 bp, Artificial Sequence
  Description of Artificial Sequence: Synthetic probe
gtggaggagaatgaaggtaaacatgatatcacgaaaattccagaatcgtacatgtgtgat

SEQ ID NO: 16885 - DNA, 60 bp, Artificial Sequence
  Description of Artificial Sequence: Synthetic probe
gccacaatggatgagttcgcagtacctatagttcgtgggcgcacgataccgtatgacttg

SEQ ID NO: 16886 - DNA, 60 bp, Artificial Sequence
  Description of Artificial Sequence: Synthetic probe
ggtctggtgatgaaaattggcaaagttggctattaccaatggttctggtacgagaagggc

SEQ ID NO: 16887 - DNA, 60 bp, Artificial Sequence
  Description of Artificial Sequence: Synthetic probe
gtgatttcccgacgcgtgatcgcaacatcgtggaagcacgtgtgaagaggtctggtgatg

SEQ ID NO: 16888 - DNA, 58 bp, Artificial Sequence
  Description of Artificial Sequence: Synthetic probe
agatcagatatgtgcagcaactattcgggaaggttccaaccggcgagtttccgctgca

SEQ ID NO: 16889 - DNA, 60 bp, Artificial Sequence
  Description of Artificial Sequence: Synthetic probe
gagttagaggacagcaccaccagatcaaacgagaagttgagagacaaatcaacgcttgcc

SEQ ID NO: 16890 - DNA, 60 bp, Artificial Sequence
  Description of Artificial Sequence: Synthetic probe
ccgcaaaagtggaatgatggaggaagccgcgaagcaacctgctctgattaattcgggaag

SEQ ID NO: 16891 - DNA, 60 bp, Artificial Sequence
  Description of Artificial Sequence: Synthetic probe
gcgtggaccgatacatttccagaggcgagcaatcttgggagcgttaaagttcggttgcaa

SEQ ID NO: 16892 - DNA, 60 bp, Artificial Sequence
  Description of Artificial Sequence: Synthetic probe
ttgggaacgcagatgcatacgagaaggttggtgagatcaaaaacagtacatcccatttat

SEQ ID NO: 16893 - DNA, 60 bp, Artificial Sequence
  Description of Artificial Sequence: Synthetic probe
ccagataatgcattagcggtcagcattttatcgaaaaatcgagctatccaagagaatcat

SEQ ID NO: 16894 - DNA, 60 bp, Artificial Sequence
  Description of Artificial Sequence: Synthetic probe
gcggtagccactgggagggcaatagaaggagcttacaaactgaaaaaggtgattaatgct

SEQ ID NO: 16895 - DNA, 59 bp, Artificial Sequence
  Description of Artificial Sequence: Synthetic probe
tggaggcggcatcggaagaggtaccgctaataggtgctgggatggcgaccgcggtagcc

SEQ ID NO: 16896 - DNA, 60 bp, Artificial Sequence
  Description of Artificial Sequence: Synthetic probe
aagaaatctatgagttcatgaatggggaagcgaaagtggaagccgaggatgagaaacaat

SEQ ID NO: 16897 - DNA, 60 bp, Artificial Sequence
  Description of Artificial Sequence: Synthetic probe
ggcagtcctatggtacttaccagttactcatccttctaaatgcttgatcgcgcttgaggt

SEQ ID NO: 16898 - DNA, 60 bp, Artificial Sequence
  Description of Artificial Sequence: Synthetic probe
cttacccttcttattcttaactggcgataacgtggcttatgaacatagacagtgggcggt

SEQ ID NO: 16899 - DNA, 60 bp, Artificial Sequence
  Description of Artificial Sequence: Synthetic probe
gagggtgcgctacatgatgtttcgcaggttatagtccacctgttcgataggttctttgag

SEQ ID NO: 16900 - DNA, 60 bp, Artificial Sequence
  Description of Artificial Sequence: Synthetic probe
ggatttgagggtatcactgcaaggaacaagtctgagcgttaagcaagtcccctcaagcat

SEQ ID NO: 16901 - DNA, 60 bp, Artificial Sequence
  Description of Artificial Sequence: Synthetic probe
ttggaccacgtttcgcgagtagtatttccaccgtattttgatcaatggacctacgtcccc

SEQ ID NO: 16902 - DNA, 60 bp, Artificial Sequence
  Description of Artificial Sequence: Synthetic probe
ctgttagcaatcacaagggcaatcagtgcgatttatatccagatgagggtgagatcgtga

SEQ ID NO: 16903 - DNA, 60 bp, Artificial Sequence
  Description of Artificial Sequence: Synthetic probe
gggtttggtggtctaacccatatccctgtctgcgaggcgcgttaattgcggccgagtgta

SEQ ID NO: 16904 - DNA, 60 bp, Artificial Sequence
  Description of Artificial Sequence: Synthetic probe
cgacgcgtataagaaagctgcgaagggattggtccaggtcttagttaatggcgttgttcc

SEQ ID NO: 16905 - DNA, 60 bp, Artificial Sequence
  Description of Artificial Sequence: Synthetic probe
cgcggtacaggagtcatgttatatctttaagcctacctacaaactgatcgttaactctga

SEQ ID NO: 16906 - DNA, 60 bp, Artificial Sequence
  Description of Artificial Sequence: Synthetic probe
gaataatgaaaagagatggcgtagatttcgtctcgaatactaaatggctagagtggatga

SEQ ID NO: 16907 - DNA, 60 bp, Artificial Sequence
  Description of Artificial Sequence: Synthetic probe
ccgataagagacgcaattgattacaagccggttgaaaatgatggagaggttttgcctcgt

SEQ ID NO: 16908 - DNA, 60 bp, Artificial Sequence
  Description of Artificial Sequence: Synthetic probe
cgataaaagattagtggtgcgttatgattatgtgattgagttgtcgagtccagaaggcga

SEQ ID NO: 16909 - DNA, 60 bp, Artificial Sequence
  Description of Artificial Sequence: Synthetic probe
gtatttcacgctgcgtcaggtgtacagttggagtttgcggccagagtatggacagaagga

SEQ ID NO: 16910 - DNA, 60 bp, Artificial Sequence
  Description of Artificial Sequence: Synthetic probe
gcggagcgggagaatacgggtgagagttatccgataggggaaaggttgttacaaataccc

SEQ ID NO: 16911 - DNA, 60 bp, Artificial Sequence
  Description of Artificial Sequence: Synthetic probe
gcgtatgatgatcggaaggcaacgaagaatgcgaaaggggtagagtttatgactaatgcc

SEQ ID NO: 16912 - DNA, 60 bp, Artificial Sequence
  Description of Artificial Sequence: Synthetic probe
gttgagagggatggaatgcaggaggaggcaatacaagagatagccgggatgaccgctgat

SEQ ID NO: 16913 - DNA, 60 bp, Artificial Sequence
  Description of Artificial Sequence: Synthetic probe
ttacggcgccaactggagatccgcattggaaggaagtggctcgcgaagcttcaaagaaga

SEQ ID NO: 16914 - DNA, 55 bp, Artificial Sequence
  Description of Artificial Sequence: Synthetic probe
gatgtacaacagatatttcagggtcgtaacgatcccatgatgatatatctggtgt

SEQ ID NO: 16915 - DNA, 60 bp, Artificial Sequence
  Description of Artificial Sequence: Synthetic probe
cgttgagcgagtgcgagttggacagattctggctgtgttgaacagaagatttgtagcgta

SEQ ID NO: 16916 - DNA, 60 bp, Artificial Sequence
  Description of Artificial Sequence: Synthetic probe
tatggatgacgatgactgggtaaggttcggtggtgttttacgcactgtacgcgttaagtt

SEQ ID NO: 16917 - DNA, 60 bp, Artificial Sequence
  Description of Artificial Sequence: Synthetic probe
gcgctgggtactgctcccgtcactacagccatcgctaaagctcgtattagaggaggaagc

SEQ ID NO: 16918 - DNA, 60 bp, Artificial Sequence
  Description of Artificial Sequence: Synthetic probe
cctgacctaattgccggagcgcatcagaacgccgacccagtagtgctagatgtgagctgg

SEQ ID NO: 16919 - DNA, 60 bp, Artificial Sequence
  Description of Artificial Sequence: Synthetic probe
ggatgggccacaatagatgttgaatatagagatccggccccttatgtacacgcacaacgc

SEQ ID NO: 16920 - DNA, 53 bp, Artificial Sequence
  Description of Artificial Sequence: Synthetic probe
ggcgttgtaggccatttgctctttacggcaggtgggagattcacgaatttgac

SEQ ID NO: 16921 - DNA, 60 bp, Artificial Sequence
  Description of Artificial Sequence: Synthetic probe
gtgcttacccacaggagaatacattgcgccaaaccccaggatttcatcaattacactgac

SEQ ID NO: 16922 - DNA, 60 bp, Artificial Sequence
  Description of Artificial Sequence: Synthetic probe
ggttgcaagggtatattgaggcggtgcaattacaagagctaaggaactcgatcgggtggt

SEQ ID NO: 16923 - DNA, 60 bp, Artificial Sequence
  Description of Artificial Sequence: Synthetic probe
attcatacgtggaaagggatcctttatattacacgatattccgaccagagatcatcgcgg

SEQ ID NO: 16924 - DNA, 60 bp, Artificial Sequence
  Description of Artificial Sequence: Synthetic probe
gcgattcaggaccactactttctgtgtttgcgctgcaagagataatgcaaaaggtgaggc

SEQ ID NO: 16925 - DNA, 60 bp, Artificial Sequence
  Description of Artificial Sequence: Synthetic probe
tgggttttagccttacagctaccggtaaatccgcaagtagtgtgggatgtgccacgtagc

SEQ ID NO: 16926 - DNA, 60 bp, Artificial Sequence
  Description of Artificial Sequence: Synthetic probe
agcgttggcggagtagatatgcgagcgggacgtattatagcgtgggacggacaggctgct

SEQ ID NO: 16927 - DNA, 60 bp, Artificial Sequence
  Description of Artificial Sequence: Synthetic probe
ttcggtggagatggacactatcgcagcaagagctctgagggttatcaaggcttgtaacac

SEQ ID NO: 16928 - DNA, 60 bp, Artificial Sequence
  Description of Artificial Sequence: Synthetic probe
tcagtctgcaccttatcgagtgatatgagcgtggcgtttaagttaaacggtacatcagct

SEQ ID NO: 16929 - DNA, 60 bp, Artificial Sequence
  Description of Artificial Sequence: Synthetic probe
gattatacccaacatatggctacgattggtgtgctagcaacaccggaaataccttttacg

SEQ ID NO: 16930 - DNA, 60 bp, Artificial Sequence
  Description of Artificial Sequence: Synthetic probe
ggcgctggaagaagaagcttgggctgcagcgaatgattttgaggatctgatgctgactga

SEQ ID NO: 16931 - DNA, 60 bp, Artificial Sequence
  Description of Artificial Sequence: Synthetic probe
cgttagccgctgagcaggtgtacaaaatagtcaaagtaccaagcatatccttcaggcaca

SEQ ID NO: 16932 - DNA, 58 bp, Artificial Sequence
  Description of Artificial Sequence: Synthetic probe
gagttgaagagctgagtttagtgcgcgtagatgataccatctctcaaccaccaaggta

SEQ ID NO: 16933 - DNA, 58 bp, Artificial Sequence
  Description of Artificial Sequence: Synthetic probe
gagttgaagagctgagtttagtgcgcgtagatgataccatctctcaaccaccaagata

SEQ ID NO: 16934 - DNA, 60 bp, Artificial Sequence
  Description of Artificial Sequence: Synthetic probe
ctggcgtcgagatcaactatggcgagtgacgttcacaagaaacgtttacagcgctcccgc

SEQ ID NO: 16935 - DNA, 60 bp, Artificial Sequence
  Description of Artificial Sequence: Synthetic probe
tccgaggagttaaaacagaggcagattcaaattaatttagttgattggacagagagcgag

SEQ ID NO: 16936 - DNA, 60 bp, Artificial Sequence
  Description of Artificial Sequence: Synthetic probe
gatcaagtatatatgcacagagatatgctcccagaacctcggcttgatgacatcgaaagg

SEQ ID NO: 16937 - DNA, 60 bp, Artificial Sequence
  Description of Artificial Sequence: Synthetic probe
ctgactgatcaagtatatatgcacagagatatgctcccagaacctcggcttgatgacatc

SEQ ID NO: 16938 - DNA, 60 bp, Artificial Sequence
  Description of Artificial Sequence: Synthetic probe
gctgactgatcaagtatatatgcacagagatatgctcccagaacctcggcttgatgacat

SEQ ID NO: 16939 - DNA, 60 bp, Artificial Sequence
  Description of Artificial Sequence: Synthetic probe
ctacgtggtccactacatttccaaagacgtgctatactgggtgcgttgaagtttggatgc

SEQ ID NO: 16940 - DNA, 60 bp, Artificial Sequence
  Description of Artificial Sequence: Synthetic probe
tacggcgccgtgggattctgatgatgtatttttcttccattgtatctcacatcatcacgc

SEQ ID NO: 16941 - DNA, 60 bp, Artificial Sequence
  Description of Artificial Sequence: Synthetic probe
tgatgtattagaggcggcgtctgaagaggtgcctttaattggagcaggtatggcgacggc

SEQ ID NO: 16942 - DNA, 60 bp, Artificial Sequence
  Description of Artificial Sequence: Synthetic probe
cggcaaaagaagaagctggagatgaaaagcagtttgatatcttaagtaaggcagttagct

SEQ ID NO: 16943 - DNA, 60 bp, Artificial Sequence
  Description of Artificial Sequence: Synthetic probe
cggttcagcggcgatcgatggattggtacagggcagcgtgcactcgatattgacaggcga

SEQ ID NO: 16944 - DNA, 60 bp, Artificial Sequence
  Description of Artificial Sequence: Synthetic probe
atcgcatatataataggttgcaagggtatattgaagcggtgcagttacaagagttaagga

SEQ ID NO: 16945 - DNA, 60 bp, Artificial Sequence
  Description of Artificial Sequence: Synthetic probe
gcagatttgggaagaaagtaggtaacgcgctcacatcaaacacagcgaaaaagatctata

SEQ ID NO: 16946 - DNA, 51 bp, Artificial Sequence
  Description of Artificial Sequence: Synthetic probe
cggtgttgggaaatatgtgacccatttaaacgtctcttagattacacttac

SEQ ID NO: 16947 - DNA, 52 bp, Artificial Sequence
  Description of Artificial Sequence: Synthetic probe
tcggtgttgggaaatatgtgacccatttaaacgtctcttagattacacttac

SEQ ID NO: 16948 - DNA, 60 bp, Artificial Sequence
  Description of Artificial Sequence: Synthetic probe
gtgtgaccgttagcgttggtggagttgatatgagagcgggacgcattatagcgtgggatg

SEQ ID NO: 16949 - DNA, 60 bp, Artificial Sequence
  Description of Artificial Sequence: Synthetic probe
gtctgccgcgggaataaatgttggaccgatatcaccagattatactcaacatatggctac

SEQ ID NO: 16950 - DNA, 60 bp, Artificial Sequence
  Description of Artificial Sequence: Synthetic probe
ttgtctgccgcgggaataaatgttggaccgatatcaccagattatactcaacatatggct

SEQ ID NO: 16951 - DNA, 60 bp, Artificial Sequence
  Description of Artificial Sequence: Synthetic probe
gaggagttggagatgttgatgcgggagttggaactactggaacgaatggaggaagatggg

SEQ ID NO: 16952 - DNA, 60 bp, Artificial Sequence
  Description of Artificial Sequence: Synthetic probe
ggtttgtggaggagttggagatgttgatgcgggagttggaactactggaacgaatggagg

SEQ ID NO: 16953 - DNA, 60 bp, Artificial Sequence
  Description of Artificial Sequence: Synthetic probe
gagaacgcgcgaacgagaatgttgacagaggagatggaaaggtttgtggaggagttggag

SEQ ID NO: 16954 - DNA, 60 bp, Artificial Sequence
  Description of Artificial Sequence: Synthetic probe
aaaggatttagagaacgcgcgaacgagaatgttgacagaggagatggaaaggtttgtgga

SEQ ID NO: 16955 - DNA, 60 bp, Artificial Sequence
  Description of Artificial Sequence: Synthetic probe
ggacgcactttgaatgaggcatatcgcgaattcttaaatttagcgatcagtagcacctat

SEQ ID NO: 16956 - DNA, 60 bp, Artificial Sequence
  Description of Artificial Sequence: Synthetic probe
attttgaggatttggcggcccattggcacgctctaggcgcagcgcaagaagctaaaggac

SEQ ID NO: 16957 - DNA, 56 bp, Artificial Sequence
  Description of Artificial Sequence: Synthetic probe
ttgaaggaatcgatgacaagaagatccacccgagagtaatgatgaggttcaaagtg

SEQ ID NO: 16958 - DNA, 60 bp, Artificial Sequence
  Description of Artificial Sequence: Synthetic probe
gcgtacaccgaagatagagcccacgatggttgcaaccacgttggaacatagatttgaaga

SEQ ID NO: 16959 - DNA, 60 bp, Artificial Sequence
  Description of Artificial Sequence: Synthetic probe
ttggttggctcggggatggcgaccgcgattgcgacaggaagagcgatcgaaggcgcatat

SEQ ID NO: 16960 - DNA, 60 bp, Artificial Sequence
  Description of Artificial Sequence: Synthetic probe
ttgctggaatgacagcggacgtgttagaggcggcttcagaggaagtacctttggttggct

SEQ ID NO: 16961 - DNA, 60 bp, Artificial Sequence
  Description of Artificial Sequence: Synthetic probe
agttaactcgtatgagaagttacttatagctgagaatgataagatgcacacattagcgcg

SEQ ID NO: 16962 - DNA, 60 bp, Artificial Sequence
  Description of Artificial Sequence: Synthetic probe
ggggcgggggacgaaattcccgatccgttaagcccaggggaacgcggtatccagatgaag

SEQ ID NO: 16963 - DNA, 60 bp, Artificial Sequence
  Description of Artificial Sequence: Synthetic probe
gagagtcgtacggcgaatcggtgaaacaagctgtactgctgaacgttttgggggcggggg

SEQ ID NO: 16964 - DNA, 60 bp, Artificial Sequence
  Description of Artificial Sequence: Synthetic probe
ggcggcggagaggttcgcggagagtgaaattgggtccgcggcgattgatggaatagttca

SEQ ID NO: 16965 - DNA, 57 bp, Artificial Sequence
  Description of Artificial Sequence: Synthetic probe
aatgagatgttttttatgtgtctagatatggttctggctgcggcgaatctgaatgtt

SEQ ID NO: 16966 - DNA, 59 bp, Artificial Sequence
  Description of Artificial Sequence: Synthetic probe
caagcgtacggtttctttttagagagtgaggaggttttccaaccaggtagatggtttat

SEQ ID NO: 16967 - DNA, 60 bp, Artificial Sequence
  Description of Artificial Sequence: Synthetic probe
gcttggatatgatgttgtctgctgcgggaattaacctcggtcctatatcgccagattatc

SEQ ID NO: 16968 - DNA, 60 bp, Artificial Sequence
  Description of Artificial Sequence: Synthetic probe
atcaacagatataatggattgacattacggggagtaacaatgagacctgcctcgcaagcc

SEQ ID NO: 16969 - DNA, 60 bp, Artificial Sequence
  Description of Artificial Sequence: Synthetic probe
ctgcagcggaggtaatcgaatggaaggagcagatggccgagcgtccatggcacgtgagaa

SEQ ID NO: 16970 - DNA, 60 bp, Artificial Sequence
  Description of Artificial Sequence: Synthetic probe
gtctgcagcggaggtaatcgaatggaaggagcagatggccgagcgtccatggcacgtaag

SEQ ID NO: 16971 - DNA, 60 bp, Artificial Sequence
  Description of Artificial Sequence: Synthetic probe
gcgtgttgcttttgtctctaaggacatgagcttgatcatattgccggtcggcgtttaggc

SEQ ID NO: 16972 - DNA, 58 bp, Artificial Sequence
  Description of Artificial Sequence: Synthetic probe
gcgtgttgcttttgtctctaaggacatgagcttgatcatattgccggtcggcgtttag

SEQ ID NO: 16973 - DNA, 60 bp, Artificial Sequence
  Description of Artificial Sequence: Synthetic probe
gagcgtgttgcttttgtctctaaggacatgagcttgatcatattgccggtcggcgtttag

SEQ ID NO: 16974 - DNA, 60 bp, Artificial Sequence
  Description of Artificial Sequence: Synthetic probe
gggtgcgtgtgagcgtgttgcttttgtctctaaggacatgagcttgatcatattgccggt

SEQ ID NO: 16975 - DNA, 60 bp, Artificial Sequence
  Description of Artificial Sequence: Synthetic probe
gtgtgggtgcgtgtgagcgtgttgcttttgtctctaaggacatgagcttgatcatattgc

SEQ ID NO: 16976 - DNA, 60 bp, Artificial Sequence
  Description of Artificial Sequence: Synthetic probe
tgaattgcaatgtgtgggtgcgtgtgagcgtgttgcttttgtctctaaggacatgagctt

SEQ ID NO: 16977 - DNA, 60 bp, Artificial Sequence
  Description of Artificial Sequence: Synthetic probe
gtatgaattgcaatgtgtgggtgcgtgtgagcgtgttgcttttgtctctaaggacatgag

SEQ ID NO: 16978 - DNA, 60 bp, Artificial Sequence
  Description of Artificial Sequence: Synthetic probe
gtatgaattgcagcgcgtgggtgcgtgtgagcgtgttgcttttgtctctaaggacatgag

SEQ ID NO: 16979 - DNA, 60 bp, Artificial Sequence
  Description of Artificial Sequence: Synthetic probe
gcggatcggtgggaatggcttattgattacatggataggaagcatacatgtcaactgtgc

SEQ ID NO: 16980 - DNA, 60 bp, Artificial Sequence
  Description of Artificial Sequence: Synthetic probe
caatactaggggctttgaaatttggatgtaaggttttgggggaccgtttagacgtaccac

SEQ ID NO: 16981 - DNA, 60 bp, Artificial Sequence
  Description of Artificial Sequence: Synthetic probe
gcacgcaaatgcacacgagaagattggttaggtcgaaaacggtacatccgatttacttag

SEQ ID NO: 16982 - DNA, 60 bp, Artificial Sequence
  Description of Artificial Sequence: Synthetic probe
tggcacgcaaatgcacacgagaagattggttaggtcaaaaacggtacatccaatttattt

SEQ ID NO: 16983 - DNA, 60 bp, Artificial Sequence
  Description of Artificial Sequence: Synthetic probe
cctagtgttgtttcaactattcttgagtaccgcacaaaggagattcctgataacgctcta

SEQ ID NO: 16984 - DNA, 60 bp, Artificial Sequence
  Description of Artificial Sequence: Synthetic probe
cgcactccgaaaatcgaacctagtgttgtttcaactattcttgagtaccgcacaaaggag

SEQ ID NO: 16985 - DNA, 60 bp, Artificial Sequence
  Description of Artificial Sequence: Synthetic probe
atgaccgcagatgtattagaggcggcatcggaggaggttccgctgattggggcggggatg

SEQ ID NO: 16986 - DNA, 60 bp, Artificial Sequence
  Description of Artificial Sequence: Synthetic probe
tcgcggggatgaccgcagatgtattagaggcggcatcggaggaggttccgctgattgggg

SEQ ID NO: 16987 - DNA, 60 bp, Artificial Sequence
  Description of Artificial Sequence: Synthetic probe
tgcgattgaggtagaaagagatggcatgcaagaggaggcgatacaggagatcgcggggat

SEQ ID NO: 16988 - DNA, 60 bp, Artificial Sequence
  Description of Artificial Sequence: Synthetic probe
cgcgattgaggtagaaagagatggcatgcaagaggaggcgatacaggaaatcgcggggat

SEQ ID NO: 16989 - DNA, 58 bp, Artificial Sequence
  Description of Artificial Sequence: Synthetic probe
aaaatgcgattgaggtagaaagagatggcatgcaagaggaagcaatacaggagattgc

SEQ ID NO: 16990 - DNA, 60 bp, Artificial Sequence
  Description of Artificial Sequence: Synthetic probe
tttaaaaaatgcgattgaggtagaaagagatggcatgcaagaggaggcaatacaggagat

SEQ ID NO: 16991 - DNA, 60 bp, Artificial Sequence
  Description of Artificial Sequence: Synthetic probe
gttttgagacctgagttcgcaatccacggtgtaaatccaatgcctggcccgcttacacgt

SEQ ID NO: 16992 - DNA, 60 bp, Artificial Sequence
  Description of Artificial Sequence: Synthetic probe
tcgcaatgatcctatgatgatttacctagtttggaggcggatcgagaacttctctatgcc

SEQ ID NO: 16993 - DNA, 60 bp, Artificial Sequence
  Description of Artificial Sequence: Synthetic probe
gaccaatctcacccgactacacgcaacatatggctaccataggtgtgctggcgacacccg

SEQ ID NO: 16994 - DNA, 60 bp, Artificial Sequence
  Description of Artificial Sequence: Synthetic probe
tgcattcgcatcgtacgcggaagcgtttcgtgatgatgtgagactgagacaaattaagcg

SEQ ID NO: 16995 - DNA, 60 bp, Artificial Sequence
  Description of Artificial Sequence: Synthetic probe
gagaaggctgcattcgcatcgtacgcggaagcgtttcgtgatgatgtaagattgagacag

SEQ ID NO: 16996 - DNA, 60 bp, Artificial Sequence
  Description of Artificial Sequence: Synthetic probe
gccttgattacaaccgcgattcacattcaccgctggatcagaggctgtggcatctggaac

SEQ ID NO: 16997 - DNA, 60 bp, Artificial Sequence
  Description of Artificial Sequence: Synthetic probe
aggccttgattacaaccgcgattcacattcaccgctggatcagaggctgtggcatctgga

SEQ ID NO: 16998 - DNA, 60 bp, Artificial Sequence
  Description of Artificial Sequence: Synthetic probe
aggccttgattacaaccgcgattcacattcaccgctggatcagagggtgtggcatctgga

SEQ ID NO: 16999 - DNA, 60 bp, Artificial Sequence
  Description of Artificial Sequence: Synthetic probe
ttaacaggtatgcttcaatggcgatacagcaatatctgagagttggttatgctgaagaga

SEQ ID NO: 17000 - DNA, 60 bp, Artificial Sequence
  Description of Artificial Sequence: Synthetic probe
ccagatacttggagatcggttggacgtgcccctcttcttatgaaatgcttgaacgcagcg

SEQ ID NO: 17001 - DNA, 60 bp, Artificial Sequence
  Description of Artificial Sequence: Synthetic probe
tgttcggaaacgacgaactgatgacgaaattactcaacgtttaggtcctttgacacggac

SEQ ID NO: 17002 - DNA, 60 bp, Artificial Sequence
  Description of Artificial Sequence: Synthetic probe
gcaaagttgttttggttagaatgcctggacatgtgttcggaaacgacgaactgatgacga

SEQ ID NO: 17003 - DNA, 60 bp, Artificial Sequence
  Description of Artificial Sequence: Synthetic probe
gtgcaaagttgttttggttagaatgcctggacatgtgttcggaaacgacgaactgatgac

SEQ ID NO: 17004 - DNA, 60 bp, Artificial Sequence
  Description of Artificial Sequence: Synthetic probe
tgaagtataaatgcaaagttgttttggttagaatgcctggacatgtgttcggaaacgacg

SEQ ID NO: 17005 - DNA, 60 bp, Artificial Sequence
  Description of Artificial Sequence: Synthetic probe
catattgaagtataagtgcaaagttgttttggttagaatgcctggacatgtgttcggaaa

SEQ ID NO: 17006 - DNA, 60 bp, Artificial Sequence
  Description of Artificial Sequence: Synthetic probe
gtcgttggagatgataagctcgacccgcaggtacgctcggagcaggtattaagcaagtac

SEQ ID NO: 17007 - DNA, 60 bp, Artificial Sequence
  Description of Artificial Sequence: Synthetic probe
cgtcgtaggagatgataagctcgacccgcaggtacgctcggagcaggtattgagtaagta

SEQ ID NO: 17008 - DNA, 60 bp, Artificial Sequence
  Description of Artificial Sequence: Synthetic probe
gttctaatcgtcgttggagatgataagctcgacccgcaggtacgctcggagcaggtatta

SEQ ID NO: 17009 - DNA, 60 bp, Artificial Sequence
  Description of Artificial Sequence: Synthetic probe
ttcctaactttctcatgcgtttattcaaactacgagaagtaaagcgcatctgtgacttga

SEQ ID NO: 17010 - DNA, 60 bp, Artificial Sequence
  Description of Artificial Sequence: Synthetic probe
tcagatttagctgttggagatcaggttattcactggcgatatgagataaccgaaccagtc

SEQ ID NO: 17011 - DNA, 60 bp, Artificial Sequence
  Description of Artificial Sequence: Synthetic probe
cgattcggatttagctgttggagatcaggttattcactggcgatatgagataaccgaacc

SEQ ID NO: 17012 - DNA, 60 bp, Artificial Sequence
  Description of Artificial Sequence: Synthetic probe
gtgaatttattcgattcggatttagctgttggagatcaggttattcactggcgatatgag

SEQ ID NO: 17013 - DNA, 60 bp, Artificial Sequence
  Description of Artificial Sequence: Synthetic probe
ggagcgctgatagcatccgaatgtgagttaggagacgtatattatactctgcgtcacgtg

SEQ ID NO: 17014 - DNA, 60 bp, Artificial Sequence
  Description of Artificial Sequence: Synthetic probe
tacccatgtctgcgtggagcactgatagcatccgaatgtgagttaggagacgtatattat

SEQ ID NO: 17015 - DNA, 60 bp, Artificial Sequence
  Description of Artificial Sequence: Synthetic probe
cggatactcagaaaggtcgagtttggcgaacaaatccatacccatgtctgcgtggagcgc

SEQ ID NO: 17016 - DNA, 60 bp, Artificial Sequence
  Description of Artificial Sequence: Synthetic probe
cgcgacggatactcagaaaggccgagtttggcgaacaaatccatacccatgtctgcgtgg

SEQ ID NO: 17017 - DNA, 60 bp, Artificial Sequence
  Description of Artificial Sequence: Synthetic probe
tcggacgagtggggctgccacaaatgagggtagattttatgcgcttatcgcaatagctgc

SEQ ID NO: 17018 - DNA, 60 bp, Artificial Sequence
  Description of Artificial Sequence: Synthetic probe
tcggacgagtggggctgccacaaatgagggtagattctatgcgcttatcgcgatagccgc

SEQ ID NO: 17019 - DNA, 60 bp, Artificial Sequence
  Description of Artificial Sequence: Synthetic probe
aaacagcggtctatcatataacagattcatctctagcatggtgcaagtggttgttagggg

SEQ ID NO: 17020 - DNA, 60 bp, Artificial Sequence
  Description of Artificial Sequence: Synthetic probe
gaaacagcggtctatcatataacagattcatctctagcatggtgcaagtggttgttaggg

SEQ ID NO: 17021 - DNA, 60 bp, Artificial Sequence
  Description of Artificial Sequence: Synthetic probe
ataggaaatagcggtctatcatataacagattcatctctagtatggtgcaagtggttgtt

SEQ ID NO: 17022 - DNA, 60 bp, Artificial Sequence
  Description of Artificial Sequence: Synthetic probe
gcgttccacgtacttcaaggcgctgcttatagtctgaaatcaaactacgatctaatcgcg

SEQ ID NO: 17023 - DNA, 60 bp, Artificial Sequence
  Description of Artificial Sequence: Synthetic probe
gattgaggcgttccacgtacttcaaggcgctgcttatagtctgaaatcaaactacgatct

SEQ ID NO: 17024 - DNA, 60 bp, Artificial Sequence
  Description of Artificial Sequence: Synthetic probe
tatggttgatgtgcctaaactagatatcgttagcgcgcttaactataaaccaacgagaaa

SEQ ID NO: 17025 - DNA, 60 bp, Artificial Sequence
  Description of Artificial Sequence: Synthetic probe
gttaaaagagtgtcccacaatggaggagtttgtcattcctgtgttttctgagagggagat

SEQ ID NO: 17026 - DNA, 60 bp, Artificial Sequence
  Description of Artificial Sequence: Synthetic probe
tgaaagggccggagctcagcgaggatgaagacgagagagcttatgctacgatgtttgaaa

SEQ ID NO: 17027 - DNA, 60 bp, Artificial Sequence
  Description of Artificial Sequence: Synthetic probe
ccgtctcacttctggaaggcagtattaaatgatagccccgaagcagtcaaggccgtgatg

SEQ ID NO: 17028 - DNA, 60 bp, Artificial Sequence
  Description of Artificial Sequence: Synthetic probe
cggaaccagaagtgttgggcgtggaattcaagaacgtgctgcccgtgctaacggctgaac

SEQ ID NO: 17029 - DNA, 56 bp, Artificial Sequence
  Description of Artificial Sequence: Synthetic probe
aaaagttgcaaagcagattaaattgaaggacgaacggttcatgagtttgtcaagcg

SEQ ID NO: 17030 - DNA, 50 bp, Artificial Sequence
  Description of Artificial Sequence: Synthetic probe
gaaggctctgagtgatgatgacgaacggggtgaggatgcgagtgacgacg

SEQ ID NO: 17031 - DNA, 54 bp, Artificial Sequence
  Description of Artificial Sequence: Synthetic probe
gttggaagctggaattaactggaatttggacgaggggggtaaaggagatagaga

SEQ ID NO: 17032 - DNA, 55 bp, Artificial Sequence
  Description of Artificial Sequence: Synthetic probe
aaaatgaacgagagtccgcgccacggcttcaggttcagaacgtggcgccaaagga

SEQ ID NO: 17033 - DNA, 60 bp, Artificial Sequence
  Description of Artificial Sequence: Synthetic probe
gtgaaatgcccgatttaccaggtgtgatgagatcaaattatgatgttcgcgaactgcggc

SEQ ID NO: 17034 - DNA, 60 bp, Artificial Sequence
  Description of Artificial Sequence: Synthetic probe
agtgaaatgcccgatttaccaggtgtgatgagatcaaattatgatgttcgcgaactgcgg

SEQ ID NO: 17035 - DNA, 60 bp, Artificial Sequence
  Description of Artificial Sequence: Synthetic probe
gaacccaaaggatacgtgctgaatgttccagggccaggtgcatacagaattcaggatggg

SEQ ID NO: 17036 - DNA, 60 bp, Artificial Sequence
  Description of Artificial Sequence: Synthetic probe
atccggaacccaaaggatacgtgctgaatgttccagggccaggtgcatacagaattcagg

SEQ ID NO: 17037 - DNA, 60 bp, Artificial Sequence
  Description of Artificial Sequence: Synthetic probe
tttcccaacatttgcgcgcttgatttcgaacgcgcgggaaccgacttatgtgaaagatct

SEQ ID NO: 17038 - DNA, 60 bp, Artificial Sequence
  Description of Artificial Sequence: Synthetic probe
gcgggcatgtgccactttacaagaagcaagaattgtcctagaagcaaatgtgatggagat

SEQ ID NO: 17039 - DNA, 60 bp, Artificial Sequence
  Description of Artificial Sequence: Synthetic probe
gcgggcatgtgccactttacaagaagcaagaatcgttttggaagcaaatgtgatggaaat

SEQ ID NO: 17040 - DNA, 60 bp, Artificial Sequence
  Description of Artificial Sequence: Synthetic probe
atgcgggcatgtgccactttacaagaagcaagaatcgttttggaagcaaatgtgatggaa

SEQ ID NO: 17041 - DNA, 60 bp, Artificial Sequence
  Description of Artificial Sequence: Synthetic probe
atgcgggcatgtgccactttacaagaagcaagaattgtcctagaagcaaatgtgatggag

SEQ ID NO: 17042 - DNA, 60 bp, Artificial Sequence
  Description of Artificial Sequence: Synthetic probe
actgtaatgcgggcatgtgccactttacaagaagcaagaatcgttttggaagcaaatgtg

SEQ ID NO: 17043 - DNA, 58 bp, Artificial Sequence
  Description of Artificial Sequence: Synthetic probe
tcacaatcgcaattgactatagtgaatatgatacacacctaacgcggcataatttccg

SEQ ID NO: 17044 - DNA, 60 bp, Artificial Sequence
  Description of Artificial Sequence: Synthetic probe
gcgttgaactatatcaaactaaaggttcaagagatgtaccgatcaaggccacaagaacga

SEQ ID NO: 17045 - DNA, 60 bp, Artificial Sequence
  Description of Artificial Sequence: Synthetic probe
atagcgttgaactatatcaaactaaaggttcaagagatgtaccgatcaaggccacaagaa

SEQ ID NO: 17046 - DNA, 60 bp, Artificial Sequence
  Description of Artificial Sequence: Synthetic probe
gacgttgttagttgccgctgtcgtagcattgttgacgtcagtatgcacgctttcaagtga

SEQ ID NO: 17047 - DNA, 60 bp, Artificial Sequence
  Description of Artificial Sequence: Synthetic probe
gacgttgttggttgccgctgtagtagcattgttgacgtcagtatgcacgctttcaagtga

SEQ ID NO: 17048 - DNA, 56 bp, Artificial Sequence
  Description of Artificial Sequence: Synthetic probe
ggatgcgtactcacgtcgtatatggaggtccaacccatatccctgtctacggggca

SEQ ID NO: 17049 - DNA, 60 bp, Artificial Sequence
  Description of Artificial Sequence: Synthetic probe
cggatgcgtactcacgtcgtatatggaggtccaatccatatccctgtctacggggcacgt

SEQ ID NO: 17050 - DNA, 60 bp, Artificial Sequence
  Description of Artificial Sequence: Synthetic probe
gatgaggaaaggttttatgccttgttgctgatatgtgcaacggatgcgtactcacgtcgt

SEQ ID NO: 17051 - DNA, 60 bp, Artificial Sequence
  Description of Artificial Sequence: Synthetic probe
aacacgagtggtcgcacagatgaggaaaggttttatgccttgttgctgatatgtgcaacg

SEQ ID NO: 17052 - DNA, 60 bp, Artificial Sequence
  Description of Artificial Sequence: Synthetic probe
cgaatgacatacgcgttgagatggaacggctaaaccaaatccgtgccacttggatacgtg

SEQ ID NO: 17053 - DNA, 60 bp, Artificial Sequence
  Description of Artificial Sequence: Synthetic probe
cgatccggggtattcgctttttaaaggtgggatgttacagattacggtaagtggtgagat

SEQ ID NO: 17054 - DNA, 60 bp, Artificial Sequence
  Description of Artificial Sequence: Synthetic probe
ggtaggccgaaggtaggtagcttgggaaggaatgcgagaatagatatgagcgatccgggg

SEQ ID NO: 17055 - DNA, 60 bp, Artificial Sequence
  Description of Artificial Sequence: Synthetic probe
ggtaggccgaagataggtagtttggggaggaatgcgagaatagatatgagcgatccgggg

SEQ ID NO: 17056 - DNA, 60 bp, Artificial Sequence
  Description of Artificial Sequence: Synthetic probe
gcaagagtgtgcttacgctttaaaggatacgtacgttctacgagtgcactcacagaggga

SEQ ID NO: 17057 - DNA, 60 bp, Artificial Sequence
  Description of Artificial Sequence: Synthetic probe
gcaagagtgtgcttacgctttaaaggatacgtacgttctacgagtgcattcacagaggga

SEQ ID NO: 17058 - DNA, 60 bp, Artificial Sequence
  Description of Artificial Sequence: Synthetic probe
attatataacgctgtgcaagagtgtgcttacgctttaaaggatacgtacgttctacgagt

SEQ ID NO: 17059 - DNA, 60 bp, Artificial Sequence
  Description of Artificial Sequence: Synthetic probe
cgctgatgcgatcgcgtatcgatatacgtcattggaagatgaatcaaagggttgcaatca

SEQ ID NO: 17060 - DNA, 60 bp, Artificial Sequence
  Description of Artificial Sequence: Synthetic probe
acgctgatgcgatcgcgtatcgatatacgtcattggaagatgaatcaaagggttgcaacc

SEQ ID NO: 17061 - DNA, 60 bp, Artificial Sequence
  Description of Artificial Sequence: Synthetic probe
tcagccactaaaaattgatttgagtgcgcgaaatggatttgttaagtgcgacattttcaa

SEQ ID NO: 17062 - DNA, 60 bp, Artificial Sequence
  Description of Artificial Sequence: Synthetic probe
tggaatggatgttatcagacgctatggatgttcagccactaaaaattgatttgagtgcgc

SEQ ID NO: 17063 - DNA, 60 bp, Artificial Sequence
  Description of Artificial Sequence: Synthetic probe
agtgtggcgtttaaacttaatggtacatcagcggaaataccgccgtggtttaagagttta

SEQ ID NO: 17064 - DNA, 60 bp, Artificial Sequence
  Description of Artificial Sequence: Synthetic probe
atggacactatcgcagcaagagcgcccaccgtgatgcgggcatgtgccactttacaagaa

SEQ ID NO: 17065 - DNA, 59 bp, Artificial Sequence
  Description of Artificial Sequence: Synthetic probe
tggatcgatccaaatctgtttggcattcgcggacagcacaatcagatcaaacgtgaggt

SEQ ID NO: 17066 - DNA, 59 bp, Artificial Sequence
  Description of Artificial Sequence: Synthetic probe
tggatcgatccaaatctgtttggcattcgcggacagcacaatcaaatcaaacgtgaggt

SEQ ID NO: 17067 - DNA, 60 bp, Artificial Sequence
  Description of Artificial Sequence: Synthetic probe
tcagtttgcaccctttcaagtgatatgagtgtagcattcaagataaatgggaccaaaaca

SEQ ID NO: 17068 - DNA, 60 bp, Artificial Sequence
  Description of Artificial Sequence: Synthetic probe
gttatggtagactcaaagaaagacattttaaaacatatgaactttttaaaacgcgtcgaa

SEQ ID NO: 17069 - DNA, 60 bp, Artificial Sequence
  Description of Artificial Sequence: Synthetic probe
gtcatggtaggttcaaagaaagacattttaaaacatatgaactttctaaaacgtgttgaa

SEQ ID NO: 17070 - DNA, 60 bp, Artificial Sequence
  Description of Artificial Sequence: Synthetic probe
gccccaccagaaatagatcgtgtagtccagtatacttatgagattgaacgtttacaagcg

SEQ ID NO: 17071 - DNA, 60 bp, Artificial Sequence
  Description of Artificial Sequence: Synthetic probe
gggctgaggaaaagaatcacgtattcgcaagaggttctgactgattttaggaggcaagac

SEQ ID NO: 17072 - DNA, 60 bp, Artificial Sequence
  Description of Artificial Sequence: Synthetic probe
gcagtgcaattacaagagttaaggaattcaattgggtggttagagaggttagggctgagg

SEQ ID NO: 17073 - DNA, 58 bp, Artificial Sequence
  Description of Artificial Sequence: Synthetic probe
gtggcgccccgaggtctgtgtcgtgtagagtggtgatctcacgatgcagactcctaac

SEQ ID NO: 17074 - DNA, 57 bp, Artificial Sequence
  Description of Artificial Sequence: Synthetic probe
gtggcgccccgaggtctgtgtcgtgtagagtggtgatctcacgatgcagactcctac

SEQ ID NO: 17075 - DNA, 60 bp, Artificial Sequence
  Description of Artificial Sequence: Synthetic probe
gagtttgaacccaatgttaggcgtggtgaatttaggagctaccttcttgatgatggtttg

SEQ ID NO: 17076 - DNA, 60 bp, Artificial Sequence
  Description of Artificial Sequence: Synthetic probe
acctcaatggtttaagagtttgaacccaatgttaggcgtggtgaatttaggagctacctt

SEQ ID NO: 17077 - DNA, 60 bp, Artificial Sequence
  Description of Artificial Sequence: Synthetic probe
cactactgatagcggcggttgttgctctgctgacatcagtttgcacgttatcgagtgata

SEQ ID NO: 17078 - DNA, 60 bp, Artificial Sequence
  Description of Artificial Sequence: Synthetic probe
gctgtctgcggctgggataaacgttggaccgatatccccagattatacccaacatatggc

SEQ ID NO: 17079 - DNA, 60 bp, Artificial Sequence
  Description of Artificial Sequence: Synthetic probe
gctgtctgctgctgggataaacgtaggaccgatatccccagattatacccaacatatggc

SEQ ID NO: 17080 - DNA, 60 bp, Artificial Sequence
  Description of Artificial Sequence: Synthetic probe
ccgctaaaacattatgcggggctatcgcgaagttgagttcgcagccgtattgtcaaatta

SEQ ID NO: 17081 - DNA, 60 bp, Artificial Sequence
  Description of Artificial Sequence: Synthetic probe
accgctaaaacattatgcggggctatcgcgaagttgagttcgcagccgtattgtcaaatt

SEQ ID NO: 17082 - DNA, 60 bp, Artificial Sequence
  Description of Artificial Sequence: Synthetic probe
ggatgtaaccgctaaaacattatgcggggctatcgcgaagttgagttcgcagccgtactg

SEQ ID NO: 17083 - DNA, 60 bp, Artificial Sequence
  Description of Artificial Sequence: Synthetic probe
cttggatgtaaccgctaaaacattatgcggggctatcgcgaagttgagttcgcagccgta

SEQ ID NO: 17084 - DNA, 60 bp, Artificial Sequence
  Description of Artificial Sequence: Synthetic probe
cttcgttacaaccgtcgcttaaattggcattggaagaagaagcttgggcagcggcgaatg

SEQ ID NO: 17085 - DNA, 60 bp, Artificial Sequence
  Description of Artificial Sequence: Synthetic probe
gccaaccgcgcagcagcttaatgacgttaggaaaatctatttagccttgatgtttccagg

SEQ ID NO: 17086 - DNA, 54 bp, Artificial Sequence
  Description of Artificial Sequence: Synthetic probe
tgtgtcggttgtgggaggtgtaacccattcatacgtctcttagattacacttac

SEQ ID NO: 17087 - DNA, 60 bp, Artificial Sequence
  Description of Artificial Sequence: Synthetic probe
gccgcagagcgggtgtataaaatagtcaaggttcctagtatttcgttcagacatatcgta

SEQ ID NO: 17088 - DNA, 60 bp, Artificial Sequence
  Description of Artificial Sequence: Synthetic probe
gcattagccgcagagcgggtgtataaaatagtcaaggttcctagtatttcgttcagacat

SEQ ID NO: 17089 - DNA, 60 bp, Artificial Sequence
  Description of Artificial Sequence: Synthetic probe
gagctaccttcttgatgatggtttgtgcaaaaagtgagagaagcttgaaccagcaaattg

SEQ ID NO: 17090 - DNA, 60 bp, Artificial Sequence
  Description of Artificial Sequence: Synthetic probe
gcgtggtgaatttgggagctaccttcttgatgatggtttgtgcaaaaagtgagagaagct

SEQ ID NO: 17091 - DNA, 60 bp, Artificial Sequence
  Description of Artificial Sequence: Synthetic probe
cgagtgatatgagcgtggcgtttaagttgaatggtacatcagctgagatacctcaatggt

SEQ ID NO: 17092 - DNA, 60 bp, Artificial Sequence
  Description of Artificial Sequence: Synthetic probe
tcgagtgatatgagcgtggcgtttaagttgaatggtacatcagctgagatacctcaatgg

SEQ ID NO: 17093 - DNA, 60 bp, Artificial Sequence
  Description of Artificial Sequence: Synthetic probe
tagagatggacactatcgcagcaagagcgctcactgtaatgcgggcatgtgccactttac

SEQ ID NO: 17094 - DNA, 60 bp, Artificial Sequence
  Description of Artificial Sequence: Synthetic probe
gctggattcgctgcgccagtctgtgagagtggagaagtcattaatcttgccgcacgtatg

SEQ ID NO: 17095 - DNA, 60 bp, Artificial Sequence
  Description of Artificial Sequence: Synthetic probe
gccactatgcttgagatggtgcggtgcatcattactctgtgctatgccgagaaggttcac

SEQ ID NO: 17096 - DNA, 60 bp, Artificial Sequence
  Description of Artificial Sequence: Synthetic probe
acggatatgcgccacgcgcagatggaacagtaccggactggaataacttgggcagtttct

SEQ ID NO: 17097 - DNA, 58 bp, Artificial Sequence
  Description of Artificial Sequence: Synthetic probe
attggtcacgaccgctattcatatacatcgatggattagagggtgcggcatctggaat

SEQ ID NO: 17098 - DNA, 60 bp, Artificial Sequence
  Description of Artificial Sequence: Synthetic probe
gtggtgtgatcgatgtgcgtgcgtcagaattaattggatgttcgcccttcagaatggtta

SEQ ID NO: 17099 - DNA, 60 bp, Artificial Sequence
  Description of Artificial Sequence: Synthetic probe
gggagggattggaccgatcggagagatgggaatggcttctagattatatggatagaaagc

SEQ ID NO: 17100 - DNA, 60 bp, Artificial Sequence
  Description of Artificial Sequence: Synthetic probe
atcgggtgatgaaaactggcaaagctggctactaccaatgatcatagtacgggagggatt

SEQ ID NO: 17101 - DNA, 60 bp, Artificial Sequence
  Description of Artificial Sequence: Synthetic probe
ggatgactcgctgtcggcggtgccatacatctatgtaccaatcagagaaggccaaatcgt

SEQ ID NO: 17102 - DNA, 60 bp, Artificial Sequence
  Description of Artificial Sequence: Synthetic probe
ctcaaccgtacgaagaggacatcgaagggaaaatgaagagatgtggcgtacaactgctcg

SEQ ID NO: 17103 - DNA, 60 bp, Artificial Sequence
  Description of Artificial Sequence: Synthetic probe
caagcaaaattttgaaagagcaatgattgcagcgactgatgccgaagaaccgcgaaaggc

SEQ ID NO: 17104 - DNA, 60 bp, Artificial Sequence
  Description of Artificial Sequence: Synthetic probe
gcacgagcgagagttaccaggttggaacgcagagatggatacagctgcgtagaggtacga

SEQ ID NO: 17105 - DNA, 53 bp, Artificial Sequence
  Description of Artificial Sequence: Synthetic probe
ctcgaagattaccgcaaaagtggaatgatggatgaagcggtgaagcagtctgc

SEQ ID NO: 17106 - DNA, 60 bp, Artificial Sequence
  Description of Artificial Sequence: Synthetic probe
aaaggaattgtttatttaatgggatgtgtgtcaagcaaaattttgaaagagcaatgattg

SEQ ID NO: 17107 - DNA, 60 bp, Artificial Sequence
  Description of Artificial Sequence: Synthetic probe
ttgcagtcacttaaaaaggaattgtttatttaatgggatgtgtgtcaaacaaaattttga

SEQ ID NO: 17108 - DNA, 52 bp, Artificial Sequence
  Description of Artificial Sequence: Synthetic probe
gaaaatacaacatcagtggggattatgctaatgccacgagaacttttttggc

SEQ ID NO: 17109 - DNA, 60 bp, Artificial Sequence
  Description of Artificial Sequence: Synthetic probe
cagatgcatatactaagagggccattacactttcaacggcgtgcaatattgggggcgctt

SEQ ID NO: 17110 - DNA, 60 bp, Artificial Sequence
  Description of Artificial Sequence: Synthetic probe
caaggaatttcttaacctatcgattggtagcacctatacatcaccgatgcatgcgagacg

SEQ ID NO: 17111 - DNA, 60 bp, Artificial Sequence
  Description of Artificial Sequence: Synthetic probe
tgatgttgtccattttgaggacctagccgctcactggcacgcactcggggctgctcagga

SEQ ID NO: 17112 - DNA, 60 bp, Artificial Sequence
  Description of Artificial Sequence: Synthetic probe
aagcggtgctgctgaacgtgttaggagcgggggatgagattccagatccgttaagcccag

SEQ ID NO: 17113 - DNA, 60 bp, Artificial Sequence
  Description of Artificial Sequence: Synthetic probe
gcgttcactcgattatgacgggcgaatcctatggtgagtcggtcaaacaagcggtgctgc

SEQ ID NO: 17114 - DNA, 60 bp, Artificial Sequence
  Description of Artificial Sequence: Synthetic probe
atcgggtcggctgcaattgatgggttagttcagggtagcgttcactcgattatgacgggc

SEQ ID NO: 17115 - DNA, 60 bp, Artificial Sequence
  Description of Artificial Sequence: Synthetic probe
tgtttccagaccaaaatttgtctccgcagttctatatacagaagatgatgattggcccac

SEQ ID NO: 17116 - DNA, 60 bp, Artificial Sequence
  Description of Artificial Sequence: Synthetic probe
gggatctggatcaagcgcaaaaggacctggagaacgcgcgaacgagaatgttgacagagg

SEQ ID NO: 17117 - DNA, 50 bp, Artificial Sequence
  Description of Artificial Sequence: Synthetic probe
atacacactactctgttagtggctgctgtggttgcgttgctgacatcagt

SEQ ID NO: 17118 - DNA, 60 bp, Artificial Sequence
  Description of Artificial Sequence: Synthetic probe
gcgtttcacaccatcatcggaatgaatctttcttcttggggtttgatttaggaatcgatg

SEQ ID NO: 17119 - DNA, 60 bp, Artificial Sequence
  Description of Artificial Sequence: Synthetic probe
gcagtgagtgtgttgaataagaggacagccgtaaccgataactgcaatgaaatcgcgcat

SEQ ID NO: 17120 - DNA, 60 bp, Artificial Sequence
  Description of Artificial Sequence: Synthetic probe
gctacaacactggagcaccgatttaaagagataccagatgggcagctagcagtgagtgtg

SEQ ID NO: 17121 - DNA, 60 bp, Artificial Sequence
  Description of Artificial Sequence: Synthetic probe
aactattatcgctacaacactggagcaccgatttaaagagataccagatgggcagctagc

SEQ ID NO: 17122 - DNA, 60 bp, Artificial Sequence
  Description of Artificial Sequence: Synthetic probe
gatttgtcgcatatgaggagtccaaagatcgaaccaactattatcgctacaacactggag

SEQ ID NO: 17123 - DNA, 60 bp, Artificial Sequence
  Description of Artificial Sequence: Synthetic probe
gcgttaagtggaatcgatttgtcgcatatgaggagtccaaagatcgaaccaactattatc

SEQ ID NO: 17124 - DNA, 60 bp, Artificial Sequence
  Description of Artificial Sequence: Synthetic probe
gcagaagactcgaaaatggcaatgttggcgcgcgcactgcaacgggaggcttcagagaga

SEQ ID NO: 17125 - DNA, 60 bp, Artificial Sequence
  Description of Artificial Sequence: Synthetic probe
tgttaggtacaggtgaagagttaccagatcctctgagccccggcgaacgtggtatccaaa

SEQ ID NO: 17126 - DNA, 60 bp, Artificial Sequence
  Description of Artificial Sequence: Synthetic probe
ggagagagtcgaagagctaagtctggttcgtgtggatgatacaatttcgcaaccaccgag

SEQ ID NO: 17127 - DNA, 60 bp, Artificial Sequence
  Description of Artificial Sequence: Synthetic probe
atggagcgctttttgagaaaatacaacatcagtggggattatgctaatgctacgagaact

SEQ ID NO: 17128 - DNA, 60 bp, Artificial Sequence
  Description of Artificial Sequence: Synthetic probe
atggagcgctttttgagaaaatacaacatcagtggggattacgcaaatgctacgagaact

SEQ ID NO: 17129 - DNA, 53 bp, Artificial Sequence
  Description of Artificial Sequence: Synthetic probe
cgatactaggcgcgataaaacatggagttaaaatcttagggacggaggttgat

SEQ ID NO: 17130 - DNA, 60 bp, Artificial Sequence
  Description of Artificial Sequence: Synthetic probe
tatgtggaattgaagacaaaaagatacatccgaaagtcatgatgaaattcaaaattccgc

SEQ ID NO: 17131 - DNA, 60 bp, Artificial Sequence
  Description of Artificial Sequence: Synthetic probe
tatgtggaatcgaagacaaaaagatacatccgaaagtcatgatgaagttcaaaattccgc

SEQ ID NO: 17132 - DNA, 60 bp, Artificial Sequence
  Description of Artificial Sequence: Synthetic probe
tatgtggaatcgaagacaaaaagatacatccgaaagtcatgatgaaattcaaaattccgc

SEQ ID NO: 17133 - DNA, 60 bp, Artificial Sequence
  Description of Artificial Sequence: Synthetic probe
tatgtggaatcgaagacaaaaagatacatccgaaagtcatgatgaaattcaaaatcccgc

SEQ ID NO: 17134 - DNA, 52 bp, Artificial Sequence
  Description of Artificial Sequence: Synthetic probe
aagagattatacatcttaagaacgagatattgcctagatttaagaaggcgat

SEQ ID NO: 17135 - DNA, 55 bp, Artificial Sequence
  Description of Artificial Sequence: Synthetic probe
ataaagagattatacatcttaagaacgagatattgcctagatttaagaaagcgat

SEQ ID NO: 17136 - DNA, 60 bp, Artificial Sequence
  Description of Artificial Sequence: Synthetic probe
gaatagagccatcgaagagaaccataaagagattatacatcttaagaacgagatattgcc

SEQ ID NO: 17137 - DNA, 60 bp, Artificial Sequence
  Description of Artificial Sequence: Synthetic probe
aagtgttttatcaaagaatagagccatcgaagagaaccataaagagattatacatcttaa

SEQ ID NO: 17138 - DNA, 60 bp, Artificial Sequence
  Description of Artificial Sequence: Synthetic probe
gctcgcggtaagcgttttatcaaagaatagagccatcgaagagaaccataaagagattat

SEQ ID NO: 17139 - DNA, 60 bp, Artificial Sequence
  Description of Artificial Sequence: Synthetic probe
gatgctcgcggtaagtgttttatcaaagaatagagccatcgaagagaaccataaagagat

SEQ ID NO: 17140 - DNA, 60 bp, Artificial Sequence
  Description of Artificial Sequence: Synthetic probe
ggtagagcgtgatggaatgcaggaagaggcgattcaggagatagctggaatgacggcgga

SEQ ID NO: 17141 - DNA, 60 bp, Artificial Sequence
  Description of Artificial Sequence: Synthetic probe
aggtagagcgtgatggaatgcaggaagaggcgattcaggagatagctggaatgacggcgg

SEQ ID NO: 17142 - DNA, 60 bp, Artificial Sequence
  Description of Artificial Sequence: Synthetic probe
aggtagagcgtgacggaatgcaggaagaggcgattcaggagatagctggaatgacagcgg

SEQ ID NO: 17143 - DNA, 60 bp, Artificial Sequence
  Description of Artificial Sequence: Synthetic probe
agaggccatagaggtagaacgtgatggaatgcaggaagaggcgattcaggagatagctgg

SEQ ID NO: 17144 - DNA, 60 bp, Artificial Sequence
  Description of Artificial Sequence: Synthetic probe
aaaagaggctatagaggtagagcgtgatggaatgcaggaagaggcgattcaggagatagc

SEQ ID NO: 17145 - DNA, 60 bp, Artificial Sequence
  Description of Artificial Sequence: Synthetic probe
aaaagaggccatagaggtagagcgtgatggaatgcaggaagaggcgattcaggagatagc

SEQ ID NO: 17146 - DNA, 60 bp, Artificial Sequence
  Description of Artificial Sequence: Synthetic probe
aaaagaggctatagaggtagagcgtgacggaatgcaggaagaggcgattcaggagatagc

SEQ ID NO: 17147 - DNA, 51 bp, Artificial Sequence
  Description of Artificial Sequence: Synthetic probe
ttggaaaagaattagaagaggtatatgagtttatgaatggggtcgcgaagc

SEQ ID NO: 17148 - DNA, 53 bp, Artificial Sequence
  Description of Artificial Sequence: Synthetic probe
atttggaaaagaattagaagaggtatatgagtttatgaatggggtcgcgaagc

SEQ ID NO: 17149 - DNA, 60 bp, Artificial Sequence
  Description of Artificial Sequence: Synthetic probe
tcggttgaagtataatgataagataaagcaaaaatttgggaaagaattggaagaggtata

SEQ ID NO: 17150 - DNA, 60 bp, Artificial Sequence
  Description of Artificial Sequence: Synthetic probe
attcggttgaagtataatgataagataaagcaaaaatttggaaaagaattagaagaggta

SEQ ID NO: 17151 - DNA, 60 bp, Artificial Sequence
  Description of Artificial Sequence: Synthetic probe
attcggttgaagtataatgataagataaagcaaaaatttgggaaagaattagaagaggta

SEQ ID NO: 17152 - DNA, 50 bp, Artificial Sequence
  Description of Artificial Sequence: Synthetic probe
tgtgctattaaatgtaatgggaagtggtgaagagcttccagatccattga

SEQ ID NO: 17153 - DNA, 60 bp, Artificial Sequence
  Description of Artificial Sequence: Synthetic probe
gctattgatgggttagttcaggggagcgtacattcgttgatgacgggagagtcttacggc

SEQ ID NO: 17154 - DNA, 56 bp, Artificial Sequence
  Description of Artificial Sequence: Synthetic probe
cataaagtccctaagccgattcggaaagaaagttggaaacgccttaacatcaaaca

SEQ ID NO: 17155 - DNA, 56 bp, Artificial Sequence
  Description of Artificial Sequence: Synthetic probe
cataaagtccctaagccgattcggaaagaaagttgggaacgccttaacatcaaaca

SEQ ID NO: 17156 - DNA, 56 bp, Artificial Sequence
  Description of Artificial Sequence: Synthetic probe
cataaagtccctaagccgattcggaaagaaagttgggaacgccctaacatcaaaca

SEQ ID NO: 17157 - DNA, 60 bp, Artificial Sequence
  Description of Artificial Sequence: Synthetic probe
aatgatctaattgcagcgctgagggaatacaaacggaagatggggatgagagagggagcc

SEQ ID NO: 17158 - DNA, 60 bp, Artificial Sequence
  Description of Artificial Sequence: Synthetic probe
ccatggcacgtgagaaatgatctaattgcagcgctgagggaatacaaacggaagatgggg

SEQ ID NO: 17159 - DNA, 60 bp, Artificial Sequence
  Description of Artificial Sequence: Synthetic probe
cggatgggattggatttgtctggtcatctgtacgtcacattgatgtccggcgcttatgtc

SEQ ID NO: 17160 - DNA, 60 bp, Artificial Sequence
  Description of Artificial Sequence: Synthetic probe
ctgatgaactaaaacggatgggattggatttgtctggtcatctgtacgtcacattgatgt

SEQ ID NO: 17161 - DNA, 60 bp, Artificial Sequence
  Description of Artificial Sequence: Synthetic probe
gtgttgagggtccgaaatccgacattacatgaaacggctgatgaactaaaacggatggga

SEQ ID NO: 17162 - DNA, 60 bp, Artificial Sequence
  Description of Artificial Sequence: Synthetic probe
tgttgagtcatctgtgttgagggtccgaaatccgacattacatgaaacggctgatgaact

SEQ ID NO: 17163 - DNA, 60 bp, Artificial Sequence
  Description of Artificial Sequence: Synthetic probe
cctgatccccctgtgcccgatatctccctatgtagattcatcggactgcgtgttgagtca

SEQ ID NO: 17164 - DNA, 60 bp, Artificial Sequence
  Description of Artificial Sequence: Synthetic probe
tacgcgttacccagatctaccgttatgctcaatggttcttaccgtgatatcagaattcta

SEQ ID NO: 17165 - DNA, 60 bp, Artificial Sequence
  Description of Artificial Sequence: Synthetic probe
atttgaacaccttcacatcgtacgtaagaatgggctgctgcatgaaagtgatgaaccacg

SEQ ID NO: 17166 - DNA, 60 bp, Artificial Sequence
  Description of Artificial Sequence: Synthetic probe
tatgagattaaaaggttactcacatgtggatcgccacatgcatccagatgcctccgtaat

SEQ ID NO: 17167 - DNA, 60 bp, Artificial Sequence
  Description of Artificial Sequence: Synthetic probe
acaaagaagcttaagtggcagaatgtaccactatattgttttgatgaatcatcgaaaagg

SEQ ID NO: 17168 - DNA, 60 bp, Artificial Sequence
  Description of Artificial Sequence: Synthetic probe
ccatgcctcaagcgagtggtgggtttgatcgtatgattgtcacaaagaagcttaagtggc

SEQ ID NO: 17169 - DNA, 60 bp, Artificial Sequence
  Description of Artificial Sequence: Synthetic probe
tgtcaaacgccatgcctcaagcgagtggtgggtttgatcgtatgattgtcacaaagaagc

SEQ ID NO: 17170 - DNA, 60 bp, Artificial Sequence
  Description of Artificial Sequence: Synthetic probe
gcgagtgatgacgaacatccaaagacccatataactaaggaatacattgaaaaggttgca

SEQ ID NO: 17171 - DNA, 60 bp, Artificial Sequence
  Description of Artificial Sequence: Synthetic probe
gatgcgagtgatgacgaacatccaaagacccatataactaaggaatacattgaaaaggtt

SEQ ID NO: 17172 - DNA, 56 bp, Artificial Sequence
  Description of Artificial Sequence: Synthetic probe
tgaagcgagaagcaatgtttttagggaggtggaagccggaattaattggaatctgg

SEQ ID NO: 17173 - DNA, 60 bp, Artificial Sequence
  Description of Artificial Sequence: Synthetic probe
ctaaaggatacgtgctgaatgttccaggacctggcgcgtacagaattcaggatgggcagg

SEQ ID NO: 17174 - DNA, 60 bp, Artificial Sequence
  Description of Artificial Sequence: Synthetic probe
ggatgcaaatgctaaaacattatgcggagcaattgcaaagttgagttcgcaaccgtattg

SEQ ID NO: 17175 - DNA, 60 bp, Artificial Sequence
  Description of Artificial Sequence: Synthetic probe
gtggaatgatggatgaggccgtgaagcaatctgcattggttaattcggaaagagttagat

SEQ ID NO: 17176 - DNA, 60 bp, Artificial Sequence
  Description of Artificial Sequence: Synthetic probe
ttgggcagatcactagagcgatcgcacgcgctgcgtatgtctagccgcgtttgcacggga

SEQ ID NO: 17177 - DNA, 60 bp, Artificial Sequence
  Description of Artificial Sequence: Synthetic probe
gagcaggaaggatcacggcatgggatggacaggcggcgttaaacgttcataatccgacgg

SEQ ID NO: 17178 - DNA, 60 bp, Artificial Sequence
  Description of Artificial Sequence: Synthetic probe
atatagtttggcgtcggattgagattttttcgaacgctcaagggaactcaatgcagacac

SEQ ID NO: 17179 - DNA, 60 bp, Artificial Sequence
  Description of Artificial Sequence: Synthetic probe
gtaattagtggtcctgatatggttcaagtttctatgaacgcgggggcgcgtgcggatata

SEQ ID NO: 17180 - DNA, 60 bp, Artificial Sequence
  Description of Artificial Sequence: Synthetic probe
ccaggtagatggtttatgcggcctgctcaagcagttactcctgtaattagtggtcctgat

SEQ ID NO: 17181 - DNA, 61 bp, Artificial Sequence
  Description of Artificial Sequence: Synthetic probe
catgtgttacattacaagatgcaagaatagtgttagaggcaaatgttatggaaatactagg

SEQ ID NO: 17182 - DNA, 60 bp, Artificial Sequence
  Description of Artificial Sequence: Synthetic probe
gttaaaaaatcgttcaagatggacacaatcgttgcgcgagcgctcactgtaataagatca

SEQ ID NO: 17183 - DNA, 60 bp, Artificial Sequence
  Description of Artificial Sequence: Synthetic probe
ggcaggatcggagatcattattatacaacaaattgttacactggagcggaggccttgatt

SEQ ID NO: 17184 - DNA, 60 bp, Artificial Sequence
  Description of Artificial Sequence: Synthetic probe
tggcaggatcggagatcattattatacaacaaattgttacactggagcggaggccttgat

SEQ ID NO: 17185 - DNA, 60 bp, Artificial Sequence
  Description of Artificial Sequence: Synthetic probe
tggcaggatcggggatcattattatacaacaaattgttacactggagcggaggccttgat

SEQ ID NO: 17186 - DNA, 60 bp, Artificial Sequence
  Description of Artificial Sequence: Synthetic probe
ttggcaggatcggagatcattattatacaacaaattgttacactggagcggaggccttga

SEQ ID NO: 17187 - DNA, 60 bp, Artificial Sequence
  Description of Artificial Sequence: Synthetic probe
gattgaagaagaagcgagcgatcatacatactactctactggtagctgccgtggttgcgc

SEQ ID NO: 17188 - DNA, 60 bp, Artificial Sequence
  Description of Artificial Sequence: Synthetic probe
tgtcaaacacaactggtgcaacgcaaacgcaaaaagcggagaaagctgcattcgcatcgt

SEQ ID NO: 17189 - DNA, 60 bp, Artificial Sequence
  Description of Artificial Sequence: Synthetic probe
aagaaaagatgaaacacaatcaaaatagagttgaagagctgagtttagtgcgtgtggatg

SEQ ID NO: 17190 - DNA, 60 bp, Artificial Sequence
  Description of Artificial Sequence: Synthetic probe
ttgggaacgatgagatgctgacgaagttgctcaacgtttagctctcgtgactgggagcgc

SEQ ID NO: 17191 - DNA, 59 bp, Artificial Sequence
  Description of Artificial Sequence: Synthetic probe
taacgattgatcgggatcgcaaggtacatgtacagacggagggtatagtatcgcataga

SEQ ID NO: 17192 - DNA, 60 bp, Artificial Sequence
  Description of Artificial Sequence: Synthetic probe
gttatggtatattccgataacacatccgctgaaatgtttggtggcgtttgaagtcgctga

SEQ ID NO: 17193 - DNA, 60 bp, Artificial Sequence
  Description of Artificial Sequence: Synthetic probe
gacgaaacgtctactgtatgagacgtacctatcctcgttgtgcggagggtactctgacgg

SEQ ID NO: 17194 - DNA, 60 bp, Artificial Sequence
  Description of Artificial Sequence: Synthetic probe
ggatggctatgatcgatgaggctaataaagagtgtgcggctgcgttgctcgactattatc

SEQ ID NO: 17195 - DNA, 60 bp, Artificial Sequence
  Description of Artificial Sequence: Synthetic probe
actcacgtcttatttggaatatatgattttcttcccatcctacgcaacgcggatggctat

SEQ ID NO: 17196 - DNA, 51 bp, Artificial Sequence
  Description of Artificial Sequence: Synthetic probe
atgctcaccgccagtggagcatacctatattactgtacgctcatgacattc

SEQ ID NO: 17197 - DNA, 60 bp, Artificial Sequence
  Description of Artificial Sequence: Synthetic probe
gatcatcaacgggacgcgcgaggatggaggtgatcgaaacgacattcccacgatttggac

SEQ ID NO: 17198 - DNA, 60 bp, Artificial Sequence
  Description of Artificial Sequence: Synthetic probe
ggtggtgagggatgctgtggaggcgagatggattctttataaaataagatcatcaacggg

SEQ ID NO: 17199 - DNA, 60 bp, Artificial Sequence
  Description of Artificial Sequence: Synthetic probe
atgtgatgccgtccgcggagtcagaagctaagtttgtgcacccttcaatcgatgttaagc

SEQ ID NO: 17200 - DNA, 60 bp, Artificial Sequence
  Description of Artificial Sequence: Synthetic probe
gacctggattaagagggcgagcgctgctcaaacagcaggatgggtcaactataacaaaga

SEQ ID NO: 17201 - DNA, 60 bp, Artificial Sequence
  Description of Artificial Sequence: Synthetic probe
cggatgatccagcgattgagcgcagcgtgaagccatttgatcatgacccatcaacgttac

SEQ ID NO: 17202 - DNA, 60 bp, Artificial Sequence
  Description of Artificial Sequence: Synthetic probe
aatgcgaagctgcggatcacagaaaccgttatcgcgaatgctcattcggatgatccagcg

SEQ ID NO: 17203 - DNA, 60 bp, Artificial Sequence
  Description of Artificial Sequence: Synthetic probe
gggactgggtctgtgttgacattaccagattattatgataagtggatcgtggcacccatg

SEQ ID NO: 17204 - DNA, 60 bp, Artificial Sequence
  Description of Artificial Sequence: Synthetic probe
gaagagaggtatacagagatgaaaggtcagatcatccaaagtgggtggaaccatcgagat

SEQ ID NO: 17205 - DNA, 60 bp, Artificial Sequence
  Description of Artificial Sequence: Synthetic probe
gcttcttaatgaaacgcgagaggtcagcatgagtagcggtaacgaatgcgatttgttccc

SEQ ID NO: 17206 - DNA, 60 bp, Artificial Sequence
  Description of Artificial Sequence: Synthetic probe
taggtgatgtttacagtacattaaggagttggtatcagtggagtatcagacccgcgtatg

SEQ ID NO: 17207 - DNA, 60 bp, Artificial Sequence
  Description of Artificial Sequence: Synthetic probe
taatccatatccgtgcttacgtggagcgctcattgctgcagaggtgcaattaggtgatgt

SEQ ID NO: 17208 - DNA, 60 bp, Artificial Sequence
  Description of Artificial Sequence: Synthetic probe
gtggcacgcacaggaaggacgaagataggttttatgtgttaattgttatcgctgcgtcgg

SEQ ID NO: 17209 - DNA, 60 bp, Artificial Sequence
  Description of Artificial Sequence: Synthetic probe
gagcgcagtggatagctagaggccatgaccgacgagaaatcaaggcattagacttgtgca

SEQ ID NO: 17210 - DNA, 60 bp, Artificial Sequence
  Description of Artificial Sequence: Synthetic probe
acccgcagctattgagagagaaatagcatctctgaatgaaattagagcgcagtggatagc

SEQ ID NO: 17211 - DNA, 60 bp, Artificial Sequence
  Description of Artificial Sequence: Synthetic probe
tatgtgaaactcaagaaaggatgggtccagactagaatagaggggaagaaacccgcagct

SEQ ID NO: 17212 - DNA, 60 bp, Artificial Sequence
  Description of Artificial Sequence: Synthetic probe
atgcgtttaatggtaggacgctcgagttgaatcggaatcatcgcatacagttgggggatc

SEQ ID NO: 17213 - DNA, 60 bp, Artificial Sequence
  Description of Artificial Sequence: Synthetic probe
acagttcgcaggaggccgcttatatattgaagcctacatatcaaataattgcacacgccg

SEQ ID NO: 17214 - DNA, 55 bp, Artificial Sequence
  Description of Artificial Sequence: Synthetic probe
ccacgccctatccaatagcacggtaaggttacacgcaaagagagcggatactgcg

SEQ ID NO: 17215 - DNA, 60 bp, Artificial Sequence
  Description of Artificial Sequence: Synthetic probe
aaggtcgacgtagagcatgtaccatcacggataagccacgccctatccaatagcacggta

SEQ ID NO: 17216 - DNA, 60 bp, Artificial Sequence
  Description of Artificial Sequence: Synthetic probe
gataggaagagggttattacgaatgaaggccacagcgaatttcacacgagatcaaattgg

SEQ ID NO: 17217 - DNA, 60 bp, Artificial Sequence
  Description of Artificial Sequence: Synthetic probe
ccagtcagtaacgatggatgcgtcttgccgagagtgcttgatatcactttaagagcattt

SEQ ID NO: 17218 - DNA, 60 bp, Artificial Sequence
  Description of Artificial Sequence: Synthetic probe
ctcgtgtagatgagcctaaggggcgtcacgatgtaactgagattcctaaaagatcgatgt

SEQ ID NO: 17219 - DNA, 60 bp, Artificial Sequence
  Description of Artificial Sequence: Synthetic probe
gcgtcgtgatggatgagttggcaattccaatctacacagatacgtttccggcgggtctat

SEQ ID NO: 17220 - DNA, 60 bp, Artificial Sequence
  Description of Artificial Sequence: Synthetic probe
gctgctgtggttgcgctgttgacatcagtttgcaccctctcaagcgatatgagtgtggcc

SEQ ID NO: 17221 - DNA, 60 bp, Artificial Sequence
  Description of Artificial Sequence: Synthetic probe
gcggcacctgcgtgtgagagcggagaagtaatcaatctcgctgcgcgtatgtctcagatg

SEQ ID NO: 17222 - DNA, 60 bp, Artificial Sequence
  Description of Artificial Sequence: Synthetic probe
ggggccgttcgctattctgaccgggtcaaccccaactgcgcagcaacttaatgatgttag

SEQ ID NO: 17223 - DNA, 60 bp, Artificial Sequence
  Description of Artificial Sequence: Synthetic probe
acgatgagggatggcaggagggtattttcatgcttggacgcgtactactgagatgggaac

SEQ ID NO: 17224 - DNA, 60 bp, Artificial Sequence
  Description of Artificial Sequence: Synthetic probe
cattgttcgcgaaggactagatcacgcggaccggtgggaatggcttattgattacatgga

SEQ ID NO: 17225 - DNA, 60 bp, Artificial Sequence
  Description of Artificial Sequence: Synthetic probe
ggatgcggccgatgattggatcgatccaaatttgtttggcattcgtggacagcacaatca

SEQ ID NO: 17226 - DNA, 60 bp, Artificial Sequence
  Description of Artificial Sequence: Synthetic probe
cgagatgctacgcatgctggttgccgcaggtaaagattcggaggcagcgtatttccgcag

SEQ ID NO: 17227 - DNA, 60 bp, Artificial Sequence
  Description of Artificial Sequence: Synthetic probe
taccgaggaagagaagacgtccgaagaaccagcgagtgtcgggatcactatagagggggt

SEQ ID NO: 17228 - DNA, 58 bp, Artificial Sequence
  Description of Artificial Sequence: Synthetic probe
taccgaggaagagaagacgtccgaagaaccagcgagtgtcgggatcactatagagggg

SEQ ID NO: 17229 - DNA, 60 bp, Artificial Sequence
  Description of Artificial Sequence: Synthetic probe
gggaagaagcctcatggtgatgcgcagagagagggtaccgaggaagagaagacgtccgaa

SEQ ID NO: 17230 - DNA, 60 bp, Artificial Sequence
  Description of Artificial Sequence: Synthetic probe
gggaggcgtaaacaagggaagaagcctcatggtgatgcgcagagagagggtaccgaggaa

SEQ ID NO: 17231 - DNA, 60 bp, Artificial Sequence
  Description of Artificial Sequence: Synthetic probe
agagagtaaagcggaagccaaagagggagacaaagcagaggaattaaaagatggtgaggg

SEQ ID NO: 17232 - DNA, 60 bp, Artificial Sequence
  Description of Artificial Sequence: Synthetic probe
gggcgagagcgaaaaagagagtaaagcggaagccaaagagggagacaaagcagaggaatt

SEQ ID NO: 17233 - DNA, 60 bp, Artificial Sequence
  Description of Artificial Sequence: Synthetic probe
gattatactcaacatatggctacaattggtgtgctagcaacaccggaaataccttttaca

SEQ ID NO: 17234 - DNA, 60 bp, Artificial Sequence
  Description of Artificial Sequence: Synthetic probe
tgtttattcagttttgagacctgagtttgcgatccatggcgtaaatccaatgcctggccc

SEQ ID NO: 17235 - DNA, 60 bp, Artificial Sequence
  Description of Artificial Sequence: Synthetic probe
aatgatcgggacagcgtactcacgatcctgctactgtcgacactcgcagatgtttattca

SEQ ID NO: 17236 - DNA, 60 bp, Artificial Sequence
  Description of Artificial Sequence: Synthetic probe
cccagcaaaatgctatggtgcaaattcaagtggtattttatgtttccatggataaaacgc

SEQ ID NO: 17237 - DNA, 60 bp, Artificial Sequence
  Description of Artificial Sequence: Synthetic probe
ttacctagtttggaggcggatcgagaacttttctatgccgcagggtaattcacagcgcac

SEQ ID NO: 17238 - DNA, 54 bp, Artificial Sequence
  Description of Artificial Sequence: Synthetic probe
cgtgttactggagagacttcaacatggggaccagcgcgtcagccttacggtttt

SEQ ID NO: 17239 - DNA, 60 bp, Artificial Sequence
  Description of Artificial Sequence: Synthetic probe
cgtgttactggagagacttcaacatggggaccagcgcgtcagccttacggttttttcctt

SEQ ID NO: 17240 - DNA, 60 bp, Artificial Sequence
  Description of Artificial Sequence: Synthetic probe
caatagatataatggattaactctacgcggagtcacaatgagaccaacttcattagccca

SEQ ID NO: 17241 - DNA, 60 bp, Artificial Sequence
  Description of Artificial Sequence: Synthetic probe
cagtttcaggtcgctttgcttaaagtaaaggggttcgttttcggcaacgatgagatctta

SEQ ID NO: 17242 - DNA, 60 bp, Artificial Sequence
  Description of Artificial Sequence: Synthetic probe
aggcatgttgcggaacatgtgcgcggagtcgcttcgatatcaatctcacgaaatggtgac

SEQ ID NO: 17243 - DNA, 60 bp, Artificial Sequence
  Description of Artificial Sequence: Synthetic probe
cgtcactatgtggaggactttcagatgcggtcgtttatgtattgccaatcagttttccga

SEQ ID NO: 17244 - DNA, 60 bp, Artificial Sequence
  Description of Artificial Sequence: Synthetic probe
ggcggggtacaaaagaatatacgagtaacgaaatcatctcagatggagatctatcattcg

SEQ ID NO: 17245 - DNA, 60 bp, Artificial Sequence
  Description of Artificial Sequence: Synthetic probe
gtcacacgcgaaatgttgcgttattatatgaagactgacatctttgatggcggggtacaa

SEQ ID NO: 17246 - DNA, 60 bp, Artificial Sequence
  Description of Artificial Sequence: Synthetic probe
cgttcgcccagttgaagaggcaaggtacgtcatttattcaatacgcgtggcgaggggtgc

SEQ ID NO: 17247 - DNA, 60 bp, Artificial Sequence
  Description of Artificial Sequence: Synthetic probe
ttgggagccgcttaagcaatacaaccatccagatgttctttcagaattctccgaaaccgt

SEQ ID NO: 17248 - DNA, 60 bp, Artificial Sequence
  Description of Artificial Sequence: Synthetic probe
cgagaggtctcgagaagcatgccaatccgtgctcggtttgttacacgtcatccttcgtct

SEQ ID NO: 17249 - DNA, 60 bp, Artificial Sequence
  Description of Artificial Sequence: Synthetic probe
ctcttggacgaggcggagaatggaagatattatagatcgagaggtctcgagaagcatgcc

SEQ ID NO: 17250 - DNA, 60 bp, Artificial Sequence
  Description of Artificial Sequence: Synthetic probe
gatgatccggttatgcttcaattacgaacgatcggaaacttatatgacactcgccctgcc

SEQ ID NO: 17251 - DNA, 60 bp, Artificial Sequence
  Description of Artificial Sequence: Synthetic probe
cggaagttgaatatccgtactactacgatcgatggatttatgctccgatcttcgacaccc

SEQ ID NO: 17252 - DNA, 60 bp, Artificial Sequence
  Description of Artificial Sequence: Synthetic probe
gcaatatatttctaatggattttgaaaaggacgcgagacttacatccagatcggaagttg

SEQ ID NO: 17253 - DNA, 59 bp, Artificial Sequence
  Description of Artificial Sequence: Synthetic probe
atcctctgagggatgaagctccagatgatgaattacactgtagagtagatcgggatcaa

SEQ ID NO: 17254 - DNA, 60 bp, Artificial Sequence
  Description of Artificial Sequence: Synthetic probe
gggttcaggagatgacgatgggcacgaaaacgtcatgggaaagtggatatcctctgaggg

SEQ ID NO: 17255 - DNA, 60 bp, Artificial Sequence
  Description of Artificial Sequence: Synthetic probe
gatacagggaagactccgggagcgcggattatacattgggttcaggagatgacgatgggc

SEQ ID NO: 17256 - DNA, 60 bp, Artificial Sequence
  Description of Artificial Sequence: Synthetic probe
gcatataaaacgcttcgtcagaagtttgactggagtgttcgccatgcagcggataaggca

SEQ ID NO: 17257 - DNA, 60 bp, Artificial Sequence
  Description of Artificial Sequence: Synthetic probe
agatcgaacccgtacccatgtttacgtggaacgttgatcgctacagaatgcgtactcgga

SEQ ID NO: 17258 - DNA, 60 bp, Artificial Sequence
  Description of Artificial Sequence: Synthetic probe
ggagcgatgtctctgagatttcaaggaaagattgataccatgttcttctcggaaaatact

SEQ ID NO: 17259 - DNA, 60 bp, Artificial Sequence
  Description of Artificial Sequence: Synthetic probe
ccccggatacccactgtttcgcgcaggattacttcagataacagtaagtggaacaatacc

SEQ ID NO: 17260 - DNA, 60 bp, Artificial Sequence
  Description of Artificial Sequence: Synthetic probe
ggcagaccaaaagttggaagtctaggtcaaaacgctgtgataagcatggaaaaccccgga

SEQ ID NO: 17261 - DNA, 60 bp, Artificial Sequence
  Description of Artificial Sequence: Synthetic probe
tgtcgctcaagagtgtgcctatgcctttaaagatacgtacgtattaagagtacattcaca

SEQ ID NO: 17262 - DNA, 60 bp, Artificial Sequence
  Description of Artificial Sequence: Synthetic probe
tcgagaggctgcaaccattccagggtacaagatgtgaaccatctaataaataatgggtta

SEQ ID NO: 17263 - DNA, 60 bp, Artificial Sequence
  Description of Artificial Sequence: Synthetic probe
cccactgataatgaagggaatcagatacctggagctcttgatatcgccttatgcgctcgg

SEQ ID NO: 17264 - DNA, 60 bp, Artificial Sequence
  Description of Artificial Sequence: Synthetic probe
gcgtaaagcaattgatgtgccagatggtgatgtcaggttagacttaaactacaaccccac

SEQ ID NO: 17265 - DNA, 60 bp, Artificial Sequence
  Description of Artificial Sequence: Synthetic probe
ggatagctatcaataggtacaatggactcactttacgaggagtgacgatgcgcccgacct

SEQ ID NO: 17266 - DNA, 60 bp, Artificial Sequence
  Description of Artificial Sequence: Synthetic probe
ggggatagctatcaataggtacaatggactcactttacgaggagtgacgatgcgcccgac

SEQ ID NO: 17267 - DNA, 60 bp, Artificial Sequence
  Description of Artificial Sequence: Synthetic probe
attttggggatagctatcaataggtacaatggactcactttacgaggagtgacgatgcgc

SEQ ID NO: 17268 - DNA, 60 bp, Artificial Sequence
  Description of Artificial Sequence: Synthetic probe
tgtgatggaaattttggggatagctatcaataggtacaatggactcactttacgaggagt

SEQ ID NO: 17269 - DNA, 60 bp, Artificial Sequence
  Description of Artificial Sequence: Synthetic probe
gccaatgtgatggaaattttggggatagctatcaataggtacaatggactcactttacga

SEQ ID NO: 17270 - DNA, 60 bp, Artificial Sequence
  Description of Artificial Sequence: Synthetic probe
gagtccattgtacctattgatagctatccccaaaatttccatcacattggcttccaacac

SEQ ID NO: 17271 - DNA, 60 bp, Artificial Sequence
  Description of Artificial Sequence: Synthetic probe
aaagctgcattcgcatcgtacgcagaagcgtttcgtgatgatgtgaggctaaaacagatc

SEQ ID NO: 17272 - DNA, 60 bp, Artificial Sequence
  Description of Artificial Sequence: Synthetic probe
aaagctgcattcgcatcgtacgcagaagcgtttcgtgatgatgtgaggctaagacaaatc

SEQ ID NO: 17273 - DNA, 60 bp, Artificial Sequence
  Description of Artificial Sequence: Synthetic probe
tgcagatgtggatagacgcatacatactgcagtgggatctggatcaagcacaaaaggact

SEQ ID NO: 17274 - DNA, 60 bp, Artificial Sequence
  Description of Artificial Sequence: Synthetic probe
tgcagatgtggatagacgcatacatactgcagtgggatctggatcaagcacaaaaggacc

SEQ ID NO: 17275 - DNA, 60 bp, Artificial Sequence
  Description of Artificial Sequence: Synthetic probe
caagaccgtctcatttctggaaggcggtactaaatgatagccccgaagcagtcaaggccg

SEQ ID NO: 17276 - DNA, 60 bp, Artificial Sequence
  Description of Artificial Sequence: Synthetic probe
cgagaccatctcacttctggaaggcggtactaaatgatagccccgaagcagtcaaggccg

SEQ ID NO: 17277 - DNA, 60 bp, Artificial Sequence
  Description of Artificial Sequence: Synthetic probe
gctggtgtcactgtgagcgtgggtggtgtgaacatgagagcggggcgcataatcgcatgg

SEQ ID NO: 17278 - DNA, 60 bp, Artificial Sequence
  Description of Artificial Sequence: Synthetic probe
atctacacttgctgatgtttacactgttttgaggccggaatttgcgattcacggcgtaaa

SEQ ID NO: 17279 - DNA, 60 bp, Artificial Sequence
  Description of Artificial Sequence: Synthetic probe
gggatcacacatggcatgggctaagaacggcgatattaaacagaaccacactgccgaaca

SEQ ID NO: 17280 - DNA, 60 bp, Artificial Sequence
  Description of Artificial Sequence: Synthetic probe
gactatactcaacatatggctacaattggtgtgttagcgacaccggaaataccttttaca

SEQ ID NO: 17281 - DNA, 60 bp, Artificial Sequence
  Description of Artificial Sequence: Synthetic probe
gctgtctgctgctgggataaatgttggaccgatatcaccagactatactcaacatatggc

SEQ ID NO: 17282 - DNA, 60 bp, Artificial Sequence
  Description of Artificial Sequence: Synthetic probe
tggatatgatgctgtctgctgctgggataaatgttggaccgatatcaccagactatactc

SEQ ID NO: 17283 - DNA, 55 bp, Artificial Sequence
  Description of Artificial Sequence: Synthetic probe
ggctcactctacgaggagtgacgatgcgcccgacctcgttggcacagagaaatga

SEQ ID NO: 17284 - DNA, 60 bp, Artificial Sequence
  Description of Artificial Sequence: Synthetic probe
ctgtagagatggacactatcgctgcaagagcgctcactgtgatgcgagcatgcgctacgc

SEQ ID NO: 17285 - DNA, 60 bp, Artificial Sequence
  Description of Artificial Sequence: Synthetic probe
gttaaaaatctgtagagatggacactatcgctgcaagagcgctcactgtgatgcgagcat

SEQ ID NO: 17286 - DNA, 58 bp, Artificial Sequence
  Description of Artificial Sequence: Synthetic probe
ggggtgatgtgaaaacagagtttctacatttgatcgatcacctctaaagggtccaggg

SEQ ID NO: 17287 - DNA, 58 bp, Artificial Sequence
  Description of Artificial Sequence: Synthetic probe
ggggtgatgcgaaaacggagtttctacatttgatcgatcacctctaaagggtccaggg

SEQ ID NO: 17288 - DNA, 58 bp, Artificial Sequence
  Description of Artificial Sequence: Synthetic probe
ggggtgatgtgaaaacggagtttctacatttgatcgatcacctctaaagggtccaggg

SEQ ID NO: 17289 - DNA, 60 bp, Artificial Sequence
  Description of Artificial Sequence: Synthetic probe
ctaccatggaggaattcgtcataccagtgttttctgagagagatattccatattcactgc

SEQ ID NO: 17290 - DNA, 60 bp, Artificial Sequence
  Description of Artificial Sequence: Synthetic probe
ctaccatggaggagttcgtcataccggtgttttctgagagagatattccatattcactgc

SEQ ID NO: 17291 - DNA, 50 bp, Artificial Sequence
  Description of Artificial Sequence: Synthetic probe
cactggagcggaggcgttgattacaaccgcgattcacattcatcactgga

SEQ ID NO: 17292 - DNA, 60 bp, Artificial Sequence
  Description of Artificial Sequence: Synthetic probe
atggagcgctttttgagaaaatacaacatcagtggggattacgcaaatgccacgagaact

SEQ ID NO: 17293 - DNA, 55 bp, Artificial Sequence
  Description of Artificial Sequence: Synthetic probe
atcgtatacgatgatgaattacaaatgcatatcttgcgtggtccgctacattttc

SEQ ID NO: 17294 - DNA, 60 bp, Artificial Sequence
  Description of Artificial Sequence: Synthetic probe
tacggggaaacgctcaacgcatcgtatacgatgatgaattacaaatgcatatcttgcgtg

SEQ ID NO: 17295 - DNA, 60 bp, Artificial Sequence
  Description of Artificial Sequence: Synthetic probe
gcacgtatgggacgcaaatgcacactcgaaggttaattaggtcgaaaacggtgcatccga

SEQ ID NO: 17296 - DNA, 60 bp, Artificial Sequence
  Description of Artificial Sequence: Synthetic probe
tttggccatttctagcacgtatgggacgcaaatgcacactcgaaggttaattaggtcgaa

SEQ ID NO: 17297 - DNA, 60 bp, Artificial Sequence
  Description of Artificial Sequence: Synthetic probe
tggagtatcgcgcgaaggatatcccggataatgcgcttgcagttagcgtgctgtcgaaaa

SEQ ID NO: 17298 - DNA, 60 bp, Artificial Sequence
  Description of Artificial Sequence: Synthetic probe
aagcgggatagatctaacacatcttcgtacgccgaaaattgagcccagcgtagtctctac

SEQ ID NO: 17299 - DNA, 60 bp, Artificial Sequence
  Description of Artificial Sequence: Synthetic probe
gagcgattgagggagcgtataagttgaagaaggtaattaacgcattaagcgggatagatc

SEQ ID NO: 17300 - DNA, 60 bp, Artificial Sequence
  Description of Artificial Sequence: Synthetic probe
ggaagagcgattgagggagcgtataagttgaagaaggtaattaacgcattaagcgggata

SEQ ID NO: 17301 - DNA, 51 bp, Artificial Sequence
  Description of Artificial Sequence: Synthetic probe
tagcggggatgactgctgatgtcttagaggcagcatctgaagaggtgcctc

SEQ ID NO: 17302 - DNA, 60 bp, Artificial Sequence
  Description of Artificial Sequence: Synthetic probe
acacacgcggagacaactatggtaaaagagtatcggaataagattgacgctcttaagagc

SEQ ID NO: 17303 - DNA, 60 bp, Artificial Sequence
  Description of Artificial Sequence: Synthetic probe
gacacacgcggagacaactatggtaaaagagtatcggaataagattgacgctcttaagag

SEQ ID NO: 17304 - DNA, 60 bp, Artificial Sequence
  Description of Artificial Sequence: Synthetic probe
gcgtcggctcgcgatcgctttacagaaggagattggtgagaggacacacgcggagacaac

SEQ ID NO: 17305 - DNA, 60 bp, Artificial Sequence
  Description of Artificial Sequence: Synthetic probe
ctacaaatgcgtcggctcgcgatcgctttacagaaggagattggtgagaggacacacgcg

SEQ ID NO: 17306 - DNA, 60 bp, Artificial Sequence
  Description of Artificial Sequence: Synthetic probe
gcggtgaattcgtacaacaagatattaactgaagaggacctacaaatgcgtcggctcgcg

SEQ ID NO: 17307 - DNA, 60 bp, Artificial Sequence
  Description of Artificial Sequence: Synthetic probe
tcttaagtaaggcggtgaattcgtacaacaagatattaactgaagaggacctacaaatgc

SEQ ID NO: 17308 - DNA, 60 bp, Artificial Sequence
  Description of Artificial Sequence: Synthetic probe
tatgagtggtgcggcaaaagaagaggcgggggatgagaagcagttcgatatcttaagtaa

SEQ ID NO: 17309 - DNA, 54 bp, Artificial Sequence
  Description of Artificial Sequence: Synthetic probe
tcttacggtgaatcagtcaaacaggcggtcctactaaatgttctgggtagcggc

SEQ ID NO: 17310 - DNA, 60 bp, Artificial Sequence
  Description of Artificial Sequence: Synthetic probe
gccgagagatttgcggagagcgagatcggttcagcagcgatcgatggtttagtacagggc

SEQ ID NO: 17311 - DNA, 60 bp, Artificial Sequence
  Description of Artificial Sequence: Synthetic probe
gataggcaaagcagccgagagatttgcggagagcgagatcggttcagcagcgatcgatgg

SEQ ID NO: 17312 - DNA, 60 bp, Artificial Sequence
  Description of Artificial Sequence: Synthetic probe
aaagtaggtagcgcgctcacgtctaacacggcaaaaaagatctatagtacgataggcaaa

SEQ ID NO: 17313 - DNA, 60 bp, Artificial Sequence
  Description of Artificial Sequence: Synthetic probe
atcttataatgacgcggtgaggatgaatttaccagagttttcgtcaatccccttagatgg

SEQ ID NO: 17314 - DNA, 60 bp, Artificial Sequence
  Description of Artificial Sequence: Synthetic probe
aatcttataatgacgcggtgaggatgaatttaccagagttctcgtcattcccgctagatg

SEQ ID NO: 17315 - DNA, 60 bp, Artificial Sequence
  Description of Artificial Sequence: Synthetic probe
gcatttatgaggtaatgaagaagtcggtgatagctacagcttgggttggtcgtgcgcccc

SEQ ID NO: 17316 - DNA, 60 bp, Artificial Sequence
  Description of Artificial Sequence: Synthetic probe
cggtgtgcacgctttcaagtgatatgagtgtggcatttaaacttaatggtacatcaacgg

SEQ ID NO: 17317 - DNA, 60 bp, Artificial Sequence
  Description of Artificial Sequence: Synthetic probe
gttgacgtcggtgtgcacgctttcaagtgatatgagtgtggcatttaaacttaatggtac

SEQ ID NO: 17318 - DNA, 60 bp, Artificial Sequence
  Description of Artificial Sequence: Synthetic probe
taagagtttaaaccccatgcttggagtggtaaatttgggtgcgactttcattatgatggt

SEQ ID NO: 17319 - DNA, 52 bp, Artificial Sequence
  Description of Artificial Sequence: Synthetic probe
tacacatgacgttgttggtcgccgctgtcatagcgttgttgacgtctgtatg

SEQ ID NO: 17320 - DNA, 60 bp, Artificial Sequence
  Description of Artificial Sequence: Synthetic probe
cacccaatcgctcaagatgggcaccaagctggctgcgccaactgtgtagatgtgcgacca

SEQ ID NO: 17321 - DNA, 60 bp, Artificial Sequence
  Description of Artificial Sequence: Synthetic probe
cgctcaagatgggcaccaagctggctgcgccaactgtgtagatgtgcgaccaatctatgc

SEQ ID NO: 17322 - DNA, 60 bp, Artificial Sequence
  Description of Artificial Sequence: Synthetic probe
tgatagcggcagttgtcgctctgttgacatcggtgtgcaccttgtcgagtgatatgagcg

SEQ ID NO: 17323 - DNA, 60 bp, Artificial Sequence
  Description of Artificial Sequence: Synthetic probe
gatagcggcagttgtcgctctgttgacatcggcttgcacgttgtcgagtgatatgagcgt

SEQ ID NO: 17324 - DNA, 60 bp, Artificial Sequence
  Description of Artificial Sequence: Synthetic probe
gatagcggcagttgtcgctctgttgacatcggtttgcacgttgtcgagtgatatgagcgt

SEQ ID NO: 17325 - DNA, 60 bp, Artificial Sequence
  Description of Artificial Sequence: Synthetic probe
tactgttgcactcgagatcttggataaagcgatgtcaaatacaacgggtgcaacgcagcc

SEQ ID NO: 17326 - DNA, 60 bp, Artificial Sequence
  Description of Artificial Sequence: Synthetic probe
atgcacggcgtatgattaggtcgaaaactgttcaccccatttatttaggctcgatgcatt

SEQ ID NO: 17327 - DNA, 60 bp, Artificial Sequence
  Description of Artificial Sequence: Synthetic probe
ggtcaaggaatataggcagaaaatagacgccttaaaggctgcaatagaggtggaaaggga

SEQ ID NO: 17328 - DNA, 60 bp, Artificial Sequence
  Description of Artificial Sequence: Synthetic probe
gcgtggtatccagatgaaaatcaaggagatcgaggaagagcagaggaacgagttagtgag

SEQ ID NO: 17329 - DNA, 60 bp, Artificial Sequence
  Description of Artificial Sequence: Synthetic probe
aaggcggcggaacgttttgctgagagtgagatcggttcggccgcgattgatgggctggtt

SEQ ID NO: 17330 - DNA, 57 bp, Artificial Sequence
  Description of Artificial Sequence: Synthetic probe
ttttgatgatggtttgcgcaaagagtgagagagccttgaaccagcagatagatatga

SEQ ID NO: 17331 - DNA, 60 bp, Artificial Sequence
  Description of Artificial Sequence: Synthetic probe
caacttttttgatgatggtttgcgcaaagagtgagagagccttgaaccagcagatagata

SEQ ID NO: 17332 - DNA, 60 bp, Artificial Sequence
  Description of Artificial Sequence: Synthetic probe
gctgctgtggttgctctgttgacatcagtttgcaccctctcaagcgatatgagtgtggcc

SEQ ID NO: 17333 - DNA, 60 bp, Artificial Sequence
  Description of Artificial Sequence: Synthetic probe
tattggtagctgctgtggttgctctgttgacatcagtttgcaccctctcaagcgatatga

SEQ ID NO: 17334 - DNA, 60 bp, Artificial Sequence
  Description of Artificial Sequence: Synthetic probe
taagttgaagaaagtaattaatgcattaagcgggatagatctaacacatttgcgtacgcc

SEQ ID NO: 17335 - DNA, 60 bp, Artificial Sequence
  Description of Artificial Sequence: Synthetic probe
gcacgggtgtgggttacacaggcggtgtgttggttgtggggagtgtgacccattcaaacg

SEQ ID NO: 17336 - DNA, 60 bp, Artificial Sequence
  Description of Artificial Sequence: Synthetic probe
cagatcatcgaggtggaacgcagtctccagaaggagctggggatctcgcgtgaaggagtg

SEQ ID NO: 17337 - DNA, 60 bp, Artificial Sequence
  Description of Artificial Sequence: Synthetic probe
gcgcgtacacatccccgatgcacgctcgacgcatgattaggtcgaaaacagtacatccta

SEQ ID NO: 17338 - DNA, 60 bp, Artificial Sequence
  Description of Artificial Sequence: Synthetic probe
ttgggatttgatctgggcatcgatgtcgtacattttgaagatttggccgctcactggcat

SEQ ID NO: 17339 - DNA, 60 bp, Artificial Sequence
  Description of Artificial Sequence: Synthetic probe
gttgcgactacattagagcacagatttgatgagatacccgataaagaattggcggtgagc

SEQ ID NO: 17340 - DNA, 60 bp, Artificial Sequence
  Description of Artificial Sequence: Synthetic probe
ccgttagttggttctgggatggcgacggccatagcgacaggtagagcaatagagggagcg

SEQ ID NO: 17341 - DNA, 60 bp, Artificial Sequence
  Description of Artificial Sequence: Synthetic probe
gaagcggaatctacgatggtaaaggaatatagacaaaagatcgatgcattaaaagcggct

SEQ ID NO: 17342 - DNA, 60 bp, Artificial Sequence
  Description of Artificial Sequence: Synthetic probe
gagaaatgagttagtgagattaaagcatgggaaagaaataacaagaaagttcggtgcaga

SEQ ID NO: 17343 - DNA, 60 bp, Artificial Sequence
  Description of Artificial Sequence: Synthetic probe
cagttaaacaggcggtactgctaaacgtgttaggtgcaggagatgaaattccagacccac

SEQ ID NO: 17344 - DNA, 60 bp, Artificial Sequence
  Description of Artificial Sequence: Synthetic probe
agggtagcgtacactcgatcatgacgggagaatcatacggtgaatcagttaaacaggcgg

SEQ ID NO: 17345 - DNA, 60 bp, Artificial Sequence
  Description of Artificial Sequence: Synthetic probe
cgggaaggcagcggagcggtttgcagaaagtgagattggatcagcggcaatcgacggatt

SEQ ID NO: 17346 - DNA, 60 bp, Artificial Sequence
  Description of Artificial Sequence: Synthetic probe
gcgttgacatcgaatacagcaaagaaaatctatagtacaatcgggaaggcagcggagcgg

SEQ ID NO: 17347 - DNA, 60 bp, Artificial Sequence
  Description of Artificial Sequence: Synthetic probe
catacctgagtgtcggttgtgggaagtgtgacccatttatacctctgcgattatacttac

SEQ ID NO: 17348 - DNA, 60 bp, Artificial Sequence
  Description of Artificial Sequence: Synthetic probe
gatcgcgcgcgcagcgtatgtctagcggcgcttgcacggggcgcactggccatacctgag

SEQ ID NO: 17349 - DNA, 60 bp, Artificial Sequence
  Description of Artificial Sequence: Synthetic probe
tggggtagctccaattgtggggcagataacaagggcgatcgcgcgcgcagcgtatgtcta

SEQ ID NO: 17350 - DNA, 60 bp, Artificial Sequence
  Description of Artificial Sequence: Synthetic probe
gagttcatcattcatggggtagctccaattgtggggcagataacaagggcgatcgcgcgc

SEQ ID NO: 17351 - DNA, 60 bp, Artificial Sequence
  Description of Artificial Sequence: Synthetic probe
gtctgagatttataacatttacagttttagagatccgacttggcacgcgctgcgcatggc

SEQ ID NO: 17352 - DNA, 60 bp, Artificial Sequence
  Description of Artificial Sequence: Synthetic probe
ttggcgtctgagatttataacatttacagttttagagatccgacttggcacgcgctgcgc

SEQ ID NO: 17353 - DNA, 60 bp, Artificial Sequence
  Description of Artificial Sequence: Synthetic probe
aagtcgtgttctatgtctcgatggacaaaactttgaaccaatacccagcgttggcgtctg

SEQ ID NO: 17354 - DNA, 60 bp, Artificial Sequence
  Description of Artificial Sequence: Synthetic probe
ggcgctgaacgttcacaacccaacagcagcgaacgcaatgattcagattcaagtcgtgtt

SEQ ID NO: 17355 - DNA, 60 bp, Artificial Sequence
  Description of Artificial Sequence: Synthetic probe
agagcaggaaggattacagcttgggatggccaggcggcgctgaacgttcacaacccaaca

SEQ ID NO: 17356 - DNA, 60 bp, Artificial Sequence
  Description of Artificial Sequence: Synthetic probe
gggggtgtgaatattagagcaggaaggattacagcttgggatggccaggcggcgctgaac

SEQ ID NO: 17357 - DNA, 60 bp, Artificial Sequence
  Description of Artificial Sequence: Synthetic probe
cagacatgatccaagtttcgatgaatgcgggtgcgagggcggatatacaacaaatttttc

SEQ ID NO: 17358 - DNA, 60 bp, Artificial Sequence
  Description of Artificial Sequence: Synthetic probe
ggttcatgagacccgctcaggccgtaacgccagtaatctgtgggccagacatgatccaag

SEQ ID NO: 17359 - DNA, 60 bp, Artificial Sequence
  Description of Artificial Sequence: Synthetic probe
gagatggttcatgagacccgctcaggccgtaacgccagtaatctgtgggccagacatgat

SEQ ID NO: 17360 - DNA, 60 bp, Artificial Sequence
  Description of Artificial Sequence: Synthetic probe
cggattcttcctagagagtgaagaagtgtttcagccagggagatggttcatgagacccgc

SEQ ID NO: 17361 - DNA, 60 bp, Artificial Sequence
  Description of Artificial Sequence: Synthetic probe
cgccaggcttacggattcttcctagagagtgaagaagtgtttcagccagggagatggttc

SEQ ID NO: 17362 - DNA, 60 bp, Artificial Sequence
  Description of Artificial Sequence: Synthetic probe
gagtggcaggtgagacgtcaacgtggggaccggcgcgccaggcttacggattcttcctag

SEQ ID NO: 17363 - DNA, 60 bp, Artificial Sequence
  Description of Artificial Sequence: Synthetic probe
agcaacgcctgaggttccgtttactactgagtgtgccaatgaggttgcgcgagtggcagg

SEQ ID NO: 17364 - DNA, 60 bp, Artificial Sequence
  Description of Artificial Sequence: Synthetic probe
tacgatcggtgttttagcaacgcctgaggttccgtttactactgagtgtgccaatgaggt

SEQ ID NO: 17365 - DNA, 60 bp, Artificial Sequence
  Description of Artificial Sequence: Synthetic probe
atgtgcttagatatgatgctgtcggcagcggggattaatctagggccaatatctccagac

SEQ ID NO: 17366 - DNA, 60 bp, Artificial Sequence
  Description of Artificial Sequence: Synthetic probe
acatgttctttatgtgcttagatatgatgctgtcggcagcggggattaatctagggccaa

SEQ ID NO: 17367 - DNA, 60 bp, Artificial Sequence
  Description of Artificial Sequence: Synthetic probe
gaggagttacaatgaggccaacatcccaggctcagaagaatgacatgttctttatgtgct

SEQ ID NO: 17368 - DNA, 60 bp, Artificial Sequence
  Description of Artificial Sequence: Synthetic probe
cacattaagaggagttacaatgaggccaacatcccaggctcagaagaatgacatgttctt

SEQ ID NO: 17369 - DNA, 60 bp, Artificial Sequence
  Description of Artificial Sequence: Synthetic probe
gcgtcacgctacaggatgcgagaatagtgttggaagcaaatgtgatggagattctaggta

SEQ ID NO: 17370 - DNA, 60 bp, Artificial Sequence
  Description of Artificial Sequence: Synthetic probe
atgagatcttgcgtcacgctacaggatgcgagaatagtgttggaagcaaatgtgatggag

SEQ ID NO: 17371 - DNA, 60 bp, Artificial Sequence
  Description of Artificial Sequence: Synthetic probe
agatggacacaatcgctgcacgagcgctcaccgttatgagatcttgcgtcacgctacagg

SEQ ID NO: 17372 - DNA, 60 bp, Artificial Sequence
  Description of Artificial Sequence: Synthetic probe
gttaaaaatctatagagatggacacaatcgctgcacgagcgctcaccgttatgagatctt

SEQ ID NO: 17373 - DNA, 60 bp, Artificial Sequence
  Description of Artificial Sequence: Synthetic probe
cgagaagattggttaggtcgaaaacggtacatccgatttacttaggttccttgcactacg

SEQ ID NO: 17374 - DNA, 60 bp, Artificial Sequence
  Description of Artificial Sequence: Synthetic probe
atctcaccgcccattggcatgcattgggagcagctcaaacggcagcgggacgtacgctaa

SEQ ID NO: 17375 - DNA, 60 bp, Artificial Sequence
  Description of Artificial Sequence: Synthetic probe
gttgtttcaactattcttgagtaccgcgcaaaggagattcctgataacgctctggctgtt

SEQ ID NO: 17376 - DNA, 60 bp, Artificial Sequence
  Description of Artificial Sequence: Synthetic probe
agggagggctattgagggagcgtacaaactcaaaaaagtgatcaatgctttaagcgggat

SEQ ID NO: 17377 - DNA, 60 bp, Artificial Sequence
  Description of Artificial Sequence: Synthetic probe
ggttcagcggcgatcgatggattagtacagggaagcgtacattcaatcataacgggcgaa

SEQ ID NO: 17378 - DNA, 60 bp, Artificial Sequence
  Description of Artificial Sequence: Synthetic probe
gctctgcagttgcccgtgaatcctcaggtggtttgggacgttcctcggagctcgattgct

SEQ ID NO: 17379 - DNA, 60 bp, Artificial Sequence
  Description of Artificial Sequence: Synthetic probe
gtgctagctctgcagttgcccgtgaatcctcaggtggtttgggatgttcctcggagctcg

SEQ ID NO: 17380 - DNA, 60 bp, Artificial Sequence
  Description of Artificial Sequence: Synthetic probe
gcgagcatgcgctacgcttcaagaagcaagaattgtgttggaagccaatgtgatggaaat

SEQ ID NO: 17381 - DNA, 60 bp, Artificial Sequence
  Description of Artificial Sequence: Synthetic probe
ggttggaatgggtacggtgcacatccagcggctcttaatatcgttatgacggaagagatg

SEQ ID NO: 17382 - DNA, 60 bp, Artificial Sequence
  Description of Artificial Sequence: Synthetic probe
ggaagttggaagggagcagccagggattcttaccttcctatcggaacaatacgtggggga

SEQ ID NO: 17383 - DNA, 58 bp, Artificial Sequence
  Description of Artificial Sequence: Synthetic probe
ggaagttggaagggagcagccagggattcttaccttcctatcggaacaatacgtgggg

SEQ ID NO: 17384 - DNA, 60 bp, Artificial Sequence
  Description of Artificial Sequence: Synthetic probe
atagaactaaatcacatccctttagcgatgcaagttatggctgactttgtaaaccgtttc

SEQ ID NO: 17385 - DNA, 60 bp, Artificial Sequence
  Description of Artificial Sequence: Synthetic probe
ggtttgtgcgaagagtgaaagagggctaaatcagcaaattgacatgattaagaaggaggt

SEQ ID NO: 17386 - DNA, 52 bp, Artificial Sequence
  Description of Artificial Sequence: Synthetic probe
gtgtacgctatcaagtgatatgagtgtggcatttaaattcaatggtacatta

SEQ ID NO: 17387 - DNA, 60 bp, Artificial Sequence
  Description of Artificial Sequence: Synthetic probe
gacgttgcttatcgctgctgtcgtggcgttattaacatcggtgtgtacgctatcaagtga

SEQ ID NO: 17388 - DNA, 60 bp, Artificial Sequence
  Description of Artificial Sequence: Synthetic probe
ggctcaggcagatcaaacgccacgttaatgaacagattcttccaaagttaaagagtgact

SEQ ID NO: 17389 - DNA, 60 bp, Artificial Sequence
  Description of Artificial Sequence: Synthetic probe
tgatgatgtgaggctcaggcagatcaaacgccacgttaatgaacagattcttccaaagtt

SEQ ID NO: 17390 - DNA, 52 bp, Artificial Sequence
  Description of Artificial Sequence: Synthetic probe
gccgtcatcaatgccaaccgttgcccttgaaatactggataaagcgatgtca

SEQ ID NO: 17391 - DNA, 60 bp, Artificial Sequence
  Description of Artificial Sequence: Synthetic probe
ggagagagttgaagagttgagcctggttcgagtggatgatacgatttcacaaccgccgag

SEQ ID NO: 17392 - DNA, 60 bp, Artificial Sequence
  Description of Artificial Sequence: Synthetic probe
taatcaggagagagttgaagagttgagcctggttcgagtggatgatacgatttcacaacc

SEQ ID NO: 17393 - DNA, 60 bp, Artificial Sequence
  Description of Artificial Sequence: Synthetic probe
tgtggtgcgagctacggcgtattttacagcgccaaccggagattcacattggaaggaagt

SEQ ID NO: 17394 - DNA, 60 bp, Artificial Sequence
  Description of Artificial Sequence: Synthetic probe
gataggggcacgggagagcgcagttatgttagtttctaacagtattaaagatgtggtgcg

SEQ ID NO: 17395 - DNA, 60 bp, Artificial Sequence
  Description of Artificial Sequence: Synthetic probe
agaaagatggctccgataggggcacgggagagcgcagttatgttagtttctaacagtatt

SEQ ID NO: 17396 - DNA, 56 bp, Artificial Sequence
  Description of Artificial Sequence: Synthetic probe
ccgaggaagacaagacgtctgaggaaccagcgagtgttggaatcactatagagggg

SEQ ID NO: 17397 - DNA, 60 bp, Artificial Sequence
  Description of Artificial Sequence: Synthetic probe
ccgaggaagacaagacgtctgaggaaccagcgagtgttggaatcactatagagggggtca

SEQ ID NO: 17398 - DNA, 53 bp, Artificial Sequence
  Description of Artificial Sequence: Synthetic probe
acgctagggccgctgagaaaggaaggcgcaaacaagggaagaaagcccatggt

SEQ ID NO: 17399 - DNA, 60 bp, Artificial Sequence
  Description of Artificial Sequence: Synthetic probe
ctggggatttcgcgtgagggagtggccgagcaaacggaaagattgagagatctgcggcga

SEQ ID NO: 17400 - DNA, 60 bp, Artificial Sequence
  Description of Artificial Sequence: Synthetic probe
gctggggatttcgcgtgagggagtggccgagcaaacggaaagattgagagatctgcggcg

SEQ ID NO: 17401 - DNA, 60 bp, Artificial Sequence
  Description of Artificial Sequence: Synthetic probe
ggagttaaaacaaaggcagattcaaattaacttggttgattggatggagagcgagagcga

SEQ ID NO: 17402 - DNA, 60 bp, Artificial Sequence
  Description of Artificial Sequence: Synthetic probe
tccgaggagttaaaacaaaggcagattcaaattaacttggttgattggatggagagcgag

SEQ ID NO: 17403 - DNA, 60 bp, Artificial Sequence
  Description of Artificial Sequence: Synthetic probe
ctctaaggacatgagcttgatcatattgccggtcggcgtttaggcgcttgtgaccgcgtg

SEQ ID NO: 17404 - DNA, 60 bp, Artificial Sequence
  Description of Artificial Sequence: Synthetic probe
gtctctaaggacatgagcttgatcatattgccggtcggcgtttaggcgcttgtgaccgca

SEQ ID NO: 17405 - DNA, 60 bp, Artificial Sequence
  Description of Artificial Sequence: Synthetic probe
tgtctctaaggacatgagcttgatcatattgccggtcggcgtttaggcgcttgtgaccgc

SEQ ID NO: 17406 - DNA, 60 bp, Artificial Sequence
  Description of Artificial Sequence: Synthetic probe
ttgtctctaaggacatgagcttgatcatattgccggtcggcgtttaggcgcttgtgaccg

SEQ ID NO: 17407 - DNA, 60 bp, Artificial Sequence
  Description of Artificial Sequence: Synthetic probe
ggtccagctcgtcaggcgtacggtttcttcctagagagtgaggaggtgtttcagccggga

SEQ ID NO: 17408 - DNA, 60 bp, Artificial Sequence
  Description of Artificial Sequence: Synthetic probe
gatgagtcatcgaaaaggtatgagttgcagtgtgtaggtgcgtgtgagcgtgttgctttt

SEQ ID NO: 17409 - DNA, 60 bp, Artificial Sequence
  Description of Artificial Sequence: Synthetic probe
gcagagaaggttcatttcgctgggtttgcagcacctgcgtgtgagagcggggaagtcatc

SEQ ID NO: 17410 - DNA, 60 bp, Artificial Sequence
  Description of Artificial Sequence: Synthetic probe
tatgcagagaaggttcatttcgctgggtttgcagcacctgcgtgtgagagcggggaagtc

SEQ ID NO: 17411 - DNA, 60 bp, Artificial Sequence
  Description of Artificial Sequence: Synthetic probe
gggtatcttcatgctcggacgcgtactactgagatgggaactaacgaaggcacaacgcag

SEQ ID NO: 17412 - DNA, 60 bp, Artificial Sequence
  Description of Artificial Sequence: Synthetic probe
agggtatcttcatgctcggacgcgtactactgagatgggaactaacgaaggcacaacgca

SEQ ID NO: 17413 - DNA, 60 bp, Artificial Sequence
  Description of Artificial Sequence: Synthetic probe
gggtgcgttgaaattcggatgcaaaatactaggggatcgattggacgtaccactcttctt

SEQ ID NO: 17414 - DNA, 60 bp, Artificial Sequence
  Description of Artificial Sequence: Synthetic probe
agatcgaagaccgtacatccaatctacctaggatcgcttcactatgatatttcgttcgcg

SEQ ID NO: 17415 - DNA, 60 bp, Artificial Sequence
  Description of Artificial Sequence: Synthetic probe
agacctcacagctcattggcacgcgctgggtgcagcgcagatggcggtgggacgcacgct

SEQ ID NO: 17416 - DNA, 60 bp, Artificial Sequence
  Description of Artificial Sequence: Synthetic probe
ttccgagagcgcagcagccgcatattcatatttatagcgcaccatgggattcagatgacg

SEQ ID NO: 17417 - DNA, 60 bp, Artificial Sequence
  Description of Artificial Sequence: Synthetic probe
ccactattttggaacatcgcacaagggatatcccagataatacgttggcggtaagtgttc

SEQ ID NO: 17418 - DNA, 60 bp, Artificial Sequence
  Description of Artificial Sequence: Synthetic probe
gacggctttacagaaggaagtaggcgagaggacacgcgtagaaaccactatggtgaagga

SEQ ID NO: 17419 - DNA, 60 bp, Artificial Sequence
  Description of Artificial Sequence: Synthetic probe
tggagaggaattggaacaagtttacgattttatgagtggggctgcaaaagaggaagccgg

SEQ ID NO: 17420 - DNA, 60 bp, Artificial Sequence
  Description of Artificial Sequence: Synthetic probe
aattggatcagcggctatagacggattagtgcagggtagtgtacattcgataataacggg

SEQ ID NO: 17421 - DNA, 60 bp, Artificial Sequence
  Description of Artificial Sequence: Synthetic probe
gtcgatttggcaaaaaagtaggtaacgcattaacctcgaataccgcaaagaagatctata

SEQ ID NO: 17422 - DNA, 60 bp, Artificial Sequence
  Description of Artificial Sequence: Synthetic probe
aacgggaacgggatataatggttgggcgacgatcgatgttgagtatagagaacctgcacc

SEQ ID NO: 17423 - DNA, 60 bp, Artificial Sequence
  Description of Artificial Sequence: Synthetic probe
tcgagcagattttgcaacgggaacgggatataatggttgggcgacgatcgatgttgagta

SEQ ID NO: 17424 - DNA, 60 bp, Artificial Sequence
  Description of Artificial Sequence: Synthetic probe
agtcattggcacgcgttgggattagcgcaagaggtgagcgggcgtacgttaacggaggcg

SEQ ID NO: 17425 - DNA, 60 bp, Artificial Sequence
  Description of Artificial Sequence: Synthetic probe
caaccattgggaaggcggcagagcggtttgctgaaagtgagatcggtgcggcgacaatag

SEQ ID NO: 17426 - DNA, 50 bp, Artificial Sequence
  Description of Artificial Sequence: Synthetic probe
tcagttgtggggagtgtgacccattcatacgtcttgcgatttaaacttac

SEQ ID NO: 17427 - DNA, 60 bp, Artificial Sequence
  Description of Artificial Sequence: Synthetic probe
tgcgtatgtctagttgcgcttgcacggggcgcgctggccatacctgagtgtcagttgtgg

SEQ ID NO: 17428 - DNA, 60 bp, Artificial Sequence
  Description of Artificial Sequence: Synthetic probe
agtagctccaatcgtcgggcagatcactcgggcgatcgcgcgcgctgcgtatgtctagtt

SEQ ID NO: 17429 - DNA, 60 bp, Artificial Sequence
  Description of Artificial Sequence: Synthetic probe
catggagtagctccaatcgtcgggcagatcactcgggcgatcgcgcgcgctgcgtatgtc

SEQ ID NO: 17430 - DNA, 60 bp, Artificial Sequence
  Description of Artificial Sequence: Synthetic probe
atgtttatacggtattaaaacccgagtttgtgattcatggagtagctccaatcgtcgggc

SEQ ID NO: 17431 - DNA, 60 bp, Artificial Sequence
  Description of Artificial Sequence: Synthetic probe
tgtcaactttagctgatgtttatacggtattaaaacccgagtttgtgattcatggagtag

SEQ ID NO: 17432 - DNA, 55 bp, Artificial Sequence
  Description of Artificial Sequence: Synthetic probe
gttttagagatcccacttggcacgcgctgcgtacggctattctaaatcgaactac

SEQ ID NO: 17433 - DNA, 60 bp, Artificial Sequence
  Description of Artificial Sequence: Synthetic probe
cacttaacgttcataatccgactgctgctaatgcaatgattcagatacaggttgtttttt

SEQ ID NO: 17434 - DNA, 58 bp, Artificial Sequence
  Description of Artificial Sequence: Synthetic probe
cacttaacgttcataatccgactgctgctaatgcaatgattcagatacaggttgtttt

SEQ ID NO: 17435 - DNA, 60 bp, Artificial Sequence
  Description of Artificial Sequence: Synthetic probe
gtattgaaattttcgcgaatgcccagggtaattcggttcaaactcaagcgggagtggccg

SEQ ID NO: 17436 - DNA, 60 bp, Artificial Sequence
  Description of Artificial Sequence: Synthetic probe
tttggaggcgtattgaaattttcgcgaatgcccagggtaattcggttcaaactcaagcgg

SEQ ID NO: 17437 - DNA, 52 bp, Artificial Sequence
  Description of Artificial Sequence: Synthetic probe
atgccggcgcaagagcagatatacagcaaatcttccagggacgaaatgaccc

SEQ ID NO: 17438 - DNA, 60 bp, Artificial Sequence
  Description of Artificial Sequence: Synthetic probe
agcggttacgcctgtcatatgcggaccggatatgatccaggtatcgctgaatgccggcgc

SEQ ID NO: 17439 - DNA, 60 bp, Artificial Sequence
  Description of Artificial Sequence: Synthetic probe
gaggaggtgtttcagccgggaagatggtttatgagacctgcacaagcggttacgcctgtc

SEQ ID NO: 17440 - DNA, 60 bp, Artificial Sequence
  Description of Artificial Sequence: Synthetic probe
gagagtgaggaggtgtttcagccgggaagatggtttatgagacctgcacaagcggttacg

SEQ ID NO: 17441 - DNA, 60 bp, Artificial Sequence
  Description of Artificial Sequence: Synthetic probe
gagagacatcaacgtggggtccagctcgtcaggcgtacggtttcttcctagagagtgagg

SEQ ID NO: 17442 - DNA, 60 bp, Artificial Sequence
  Description of Artificial Sequence: Synthetic probe
aacggagtgcgctaatgaagtcgcacgagtcacgggagagacatcaacgtggggtccagc

SEQ ID NO: 17443 - DNA, 60 bp, Artificial Sequence
  Description of Artificial Sequence: Synthetic probe
tgaggtgccatttacaacggagtgcgctaatgaagtcgcacgagtcacgggagagacatc

SEQ ID NO: 17444 - DNA, 60 bp, Artificial Sequence
  Description of Artificial Sequence: Synthetic probe
cagcatatgggaacaattggcgtgttggcgacacctgaggtgccatttacaacggagtgc

SEQ ID NO: 17445 - DNA, 60 bp, Artificial Sequence
  Description of Artificial Sequence: Synthetic probe
tcacctgactatcagcagcatatgggaacaattggcgtgttggcgacacctgaggtgcca

SEQ ID NO: 17446 - DNA, 60 bp, Artificial Sequence
  Description of Artificial Sequence: Synthetic probe
tgctatccgcggctgggatcaatctaggcccaatttcacctgactatcagcagcatatgg

SEQ ID NO: 17447 - DNA, 60 bp, Artificial Sequence
  Description of Artificial Sequence: Synthetic probe
tgtgtttggacatgatgctatccgcggctgggatcaatctaggcccaatttcacctgact

SEQ ID NO: 17448 - DNA, 60 bp, Artificial Sequence
  Description of Artificial Sequence: Synthetic probe
aaatattgggtatagcaattaatagatacaatgggttaacactgaggggagtaacaatga

SEQ ID NO: 17449 - DNA, 60 bp, Artificial Sequence
  Description of Artificial Sequence: Synthetic probe
ctgcgttacactacaggaagcaaggattgtactggaagcaaatgttatggaaatattggg

SEQ ID NO: 17450 - DNA, 60 bp, Artificial Sequence
  Description of Artificial Sequence: Synthetic probe
ggcgaactccgaaagggaaagcctggaggagagttacgcagtaggacagcccaagtgggt

SEQ ID NO: 17451 - DNA, 60 bp, Artificial Sequence
  Description of Artificial Sequence: Synthetic probe
ggttgggcgacgattgatgttgagtatagagaacccgcaccctacgtacatgctcagcgt

SEQ ID NO: 17452 - DNA, 60 bp, Artificial Sequence
  Description of Artificial Sequence: Synthetic probe
cagtattaaggatgtggtgcgagctacagcgtacttcacagcgccaaccggagatccaca

SEQ ID NO: 17453 - DNA, 60 bp, Artificial Sequence
  Description of Artificial Sequence: Synthetic probe
tgttagtttcaaacagtattaaggatgtggtgcgagctacagcgtacttcacagcgccaa

SEQ ID NO: 17454 - DNA, 60 bp, Artificial Sequence
  Description of Artificial Sequence: Synthetic probe
gaagagaagacgtctgaagaaccagcgaatatcgggatcactatagagggggttatgagt

SEQ ID NO: 17455 - DNA, 60 bp, Artificial Sequence
  Description of Artificial Sequence: Synthetic probe
agcctcatggtgatgcgcagaaagaaggcaccgaggaagagaagacgtctgaagaaccag

SEQ ID NO: 17456 - DNA, 60 bp, Artificial Sequence
  Description of Artificial Sequence: Synthetic probe
ggtcccagcacagatcattgaagtagaacgcagtctccagaaagagttggggatttcgcg

SEQ ID NO: 17457 - DNA, 60 bp, Artificial Sequence
  Description of Artificial Sequence: Synthetic probe
cggtagcactaaagtgaaagtatgtcgacgaaattttttgaggtatgatcacaaagtcat

SEQ ID NO: 17458 - DNA, 60 bp, Artificial Sequence
  Description of Artificial Sequence: Synthetic probe
gtgcaaccgcaggttcaatgtgagacggcgcttcgtagatttccttatacgcgcgaatat

SEQ ID NO: 17459 - DNA, 60 bp, Artificial Sequence
  Description of Artificial Sequence: Synthetic probe
ctgggtgcaatggagtaagtgaaatgatgaccttcctattaccaattatacatccgcgga

SEQ ID NO: 17460 - DNA, 60 bp, Artificial Sequence
  Description of Artificial Sequence: Synthetic probe
gggacagcatatggaagaccaagaggtggaggaggacagcttggagattctaaagatttc

SEQ ID NO: 17461 - DNA, 60 bp, Artificial Sequence
  Description of Artificial Sequence: Synthetic probe
ggtgggaagggatttggcagatgggaatctaggcgattggcacgcatacattaagtacta

SEQ ID NO: 17462 - DNA, 60 bp, Artificial Sequence
  Description of Artificial Sequence: Synthetic probe
ggtttcgatggagaagggaccgcgtattattcctgcgatggtgggaagggatttggcaga

SEQ ID NO: 17463 - DNA, 60 bp, Artificial Sequence
  Description of Artificial Sequence: Synthetic probe
ctggcacgaatgtgcaatacgtacacagacagtggtcctatccggtattggtttcgatgg

SEQ ID NO: 17464 - DNA, 60 bp, Artificial Sequence
  Description of Artificial Sequence: Synthetic probe
gcgaagacgtggaaggacgcttacgcctttaatttcttaccattactattgtgtgctggc

SEQ ID NO: 17465 - DNA, 60 bp, Artificial Sequence
  Description of Artificial Sequence: Synthetic probe
gaagttttcccatttactatcgagaactgatgaagatcaagaatgcgaagacgtggaagg

SEQ ID NO: 17466 - DNA, 60 bp, Artificial Sequence
  Description of Artificial Sequence: Synthetic probe
tgcgacgcagattgtccgaggaataagcacggcgggaaaagagaaaagacttaagttgat

SEQ ID NO: 17467 - DNA, 60 bp, Artificial Sequence
  Description of Artificial Sequence: Synthetic probe
cgcttgctttgaaaggaagaatcaagttctaagggaagaggatgcgacgcagattgtccg

SEQ ID NO: 17468 - DNA, 60 bp, Artificial Sequence
  Description of Artificial Sequence: Synthetic probe
aggaccaagctgattatttctccgagtcgaggaaacgtgttagtgatatcattgattggg

SEQ ID NO: 17469 - DNA, 60 bp, Artificial Sequence
  Description of Artificial Sequence: Synthetic probe
attaggcgacgatgggtcagctaacagttgcacagggaccgcgtattcgtcgcgattacc

SEQ ID NO: 17470 - DNA, 59 bp, Artificial Sequence
  Description of Artificial Sequence: Synthetic probe
ctggactgaatcacattgtgaaccgacggaagcctctcatgggtcagacgttatcggtg

SEQ ID NO: 17471 - DNA, 60 bp, Artificial Sequence
  Description of Artificial Sequence: Synthetic probe
tgggttcaggggcgatcatgtcataacacattatactggactgaatcacattgtgaaccg

SEQ ID NO: 17472 - DNA, 60 bp, Artificial Sequence
  Description of Artificial Sequence: Synthetic probe
aagattacaccgacagaaatttctcatcgccaaagcgacgacccatggtgcgaacgaacg

SEQ ID NO: 17473 - DNA, 60 bp, Artificial Sequence
  Description of Artificial Sequence: Synthetic probe
ggaattcgaaaaagatgcgtaccttgacaatcgtaaccacttggttttgcctccgtatta

SEQ ID NO: 17474 - DNA, 60 bp, Artificial Sequence
  Description of Artificial Sequence: Synthetic probe
catacctgtgccggatgagatcgattatgaacatggatatttatgcccagaaagtggaga

SEQ ID NO: 17475 - DNA, 60 bp, Artificial Sequence
  Description of Artificial Sequence: Synthetic probe
caaaagtctaaaatcgatctataagtggaccttacgctcaagctattcttcccagcgtga

SEQ ID NO: 17476 - DNA, 60 bp, Artificial Sequence
  Description of Artificial Sequence: Synthetic probe
caacccatacccgtgtctacgtggttgcctgatagcatgtgagatggagctaggtgacgt

SEQ ID NO: 17477 - DNA, 60 bp, Artificial Sequence
  Description of Artificial Sequence: Synthetic probe
ggcagtggcagaacgcagaggcagaagttttatgcacctctaataatcgcagcgaccgat

SEQ ID NO: 17478 - DNA, 60 bp, Artificial Sequence
  Description of Artificial Sequence: Synthetic probe
cagcttgatgcgatctgtgtggcgtggtatggtggacaggtgcccatagtcgctgatgaa

SEQ ID NO: 17479 - DNA, 60 bp, Artificial Sequence
  Description of Artificial Sequence: Synthetic probe
gcccgtatataagcgtttcctcgaaggctacatacgctgtcaaatcgagccaaacgtccc

SEQ ID NO: 17480 - DNA, 60 bp, Artificial Sequence
  Description of Artificial Sequence: Synthetic probe
ttgcgagtggatgtcccatatacccctggcataggaagaaacgagaggatcagcgacatg

SEQ ID NO: 17481 - DNA, 60 bp, Artificial Sequence
  Description of Artificial Sequence: Synthetic probe
ctataggagaggctcgggagggacaaagacaggagttgcgagtggatgtcccatataccc

SEQ ID NO: 17482 - DNA, 60 bp, Artificial Sequence
  Description of Artificial Sequence: Synthetic probe
cgttggaggacgaagtctgcaaagtaaaattcacctcgctacttgggagcgtttcaaccg

SEQ ID NO: 17483 - DNA, 60 bp, Artificial Sequence
  Description of Artificial Sequence: Synthetic probe
taagagaccgactgaccatgacgtggactctatttcagacggcgacgttacggtgtgggt

SEQ ID NO: 17484 - DNA, 60 bp, Artificial Sequence
  Description of Artificial Sequence: Synthetic probe
agagcatacgatcataaacatcgattgacgagggataagagaccgactgaccatgacgtg

SEQ ID NO: 17485 - DNA, 60 bp, Artificial Sequence
  Description of Artificial Sequence: Synthetic probe
cataccacgagtgcgaaacataggtgtaagacaagaagggatacgtgttggactgaaata

SEQ ID NO: 17486 - DNA, 60 bp, Artificial Sequence
  Description of Artificial Sequence: Synthetic probe
gccgggatggaggatttccctgtgagcgtgatcgaacgtaattcaaccatcgcaccagcg

SEQ ID NO: 17487 - DNA, 60 bp, Artificial Sequence
  Description of Artificial Sequence: Synthetic probe
agagttacagatgcacatattaagaggaccactacatttccaaaggcgggcgatactagg

SEQ ID NO: 17488 - DNA, 60 bp, Artificial Sequence
  Description of Artificial Sequence: Synthetic probe
cacgtatagctcgcagatgcacgctcggagaatgatacggtcgaagactgtacaccccat

SEQ ID NO: 17489 - DNA, 60 bp, Artificial Sequence
  Description of Artificial Sequence: Synthetic probe
caggcggcggttgggaggagtctgaacgaagtgtataaagaatttttgaacctagcgatt

SEQ ID NO: 17490 - DNA, 60 bp, Artificial Sequence
  Description of Artificial Sequence: Synthetic probe
attacgaagatttgactgctcattggcacgctttaggcgcggcgcaggcggcggttggga

SEQ ID NO: 17491 - DNA, 57 bp, Artificial Sequence
  Description of Artificial Sequence: Synthetic probe
aaaagatacatccgaaagtcatgatgaagttcaaaattccgcgaactcaacagcctc

SEQ ID NO: 17492 - DNA, 60 bp, Artificial Sequence
  Description of Artificial Sequence: Synthetic probe
cgatagtatcgactgtgcttgatcataaattcaaggatattcccgatgagatgctcgcgg

SEQ ID NO: 17493 - DNA, 60 bp, Artificial Sequence
  Description of Artificial Sequence: Synthetic probe
cacgggtagggccatcgagggagcttacaaattaaagaaggtcataaacgccctcagtgg

SEQ ID NO: 17494 - DNA, 60 bp, Artificial Sequence
  Description of Artificial Sequence: Synthetic probe
caggagatagctggaatgacggcagacgtattggaggcagcctcggaggaggtgccacta

SEQ ID NO: 17495 - DNA, 60 bp, Artificial Sequence
  Description of Artificial Sequence: Synthetic probe
aatcgacgcattaaaagaggccatagaggtagaacgtgatggaatgcaggaagaggcgat

SEQ ID NO: 17496 - DNA, 60 bp, Artificial Sequence
  Description of Artificial Sequence: Synthetic probe
atgcaaacgaagatccgtgagttagaagatgaacagcgtagtgagttaattcggttgaag

SEQ ID NO: 17497 - DNA, 60 bp, Artificial Sequence
  Description of Artificial Sequence: Synthetic probe
cagtatcaaggatgtagcacgagctacggcatattttacggcgccgaccggagatccgca

SEQ ID NO: 17498 - DNA, 60 bp, Artificial Sequence
  Description of Artificial Sequence: Synthetic probe
agatctgcggcggaaagagaagagtggggcgcatgctaaggctgctgagaaaggaaggcg

SEQ ID NO: 17499 - DNA, 60 bp, Artificial Sequence
  Description of Artificial Sequence: Synthetic probe
gatgagatcccagctcagatcatcgaagtggaacgcagcctccagaaagaactggggatt

SEQ ID NO: 17500 - DNA, 54 bp, Artificial Sequence
  Description of Artificial Sequence: Synthetic probe
gaatggaggaagatgggtagttctaacggatgagatcgctcgcgcgatcgagtc

SEQ ID NO: 17501 - DNA, 58 bp, Artificial Sequence
  Description of Artificial Sequence: Synthetic probe
caaaaggatctggagaacgcgcgaacgagaatgttgacagaggagatggaaaggctgg

SEQ ID NO: 17502 - DNA, 60 bp, Artificial Sequence
  Description of Artificial Sequence: Synthetic probe
gaggaggataaagctgaggagtcaaaagatggtgaggggacgcaatcggagagcggccag

SEQ ID NO: 17503 - DNA, 60 bp, Artificial Sequence
  Description of Artificial Sequence: Synthetic probe
gatccaaagaggaggataaagctgaggagtcaaaagatggtgaggggacgcaatcggaga

SEQ ID NO: 17504 - DNA, 60 bp, Artificial Sequence
  Description of Artificial Sequence: Synthetic probe
gagcgaaagagggctaaatcagcagattgacatgattaagaaggaaattatgaagaaaca

SEQ ID NO: 17505 - DNA, 60 bp, Artificial Sequence
  Description of Artificial Sequence: Synthetic probe
gatttaaagaggtctgcagcggaggtaatcgaatggaaggagcagatggccgagcgtcca

SEQ ID NO: 17506 - DNA, 60 bp, Artificial Sequence
  Description of Artificial Sequence: Synthetic probe
tgtatatgcatacggagatgtatcaaagtggacgatacggcaattacgaggtcatgggtt

SEQ ID NO: 17507 - DNA, 60 bp, Artificial Sequence
  Description of Artificial Sequence: Synthetic probe
ggccgtaactgccggggtgtgtggcccagatatgatccaagtgtcattgaatgctggtgc

SEQ ID NO: 17508 - DNA, 60 bp, Artificial Sequence
  Description of Artificial Sequence: Synthetic probe
tcaaatcatacagggaatcattgtgatttgtatcctgacgatgtagagataacggctaaa

SEQ ID NO: 17509 - DNA, 60 bp, Artificial Sequence
  Description of Artificial Sequence: Synthetic probe
atcaaatcatacagggaatcattgtgatttgtatcctgacgatgtagagataacggctaa

SEQ ID NO: 17510 - DNA, 60 bp, Artificial Sequence
  Description of Artificial Sequence: Synthetic probe
tcggacacaaataatggtagagtatggtggtcaaatccttatccatgtttacgtggcgcg

SEQ ID NO: 17511 - DNA, 60 bp, Artificial Sequence
  Description of Artificial Sequence: Synthetic probe
gctaatgattgcggcatcagacacaaataatggtagagtatggtggtcaaatccttatcc

SEQ ID NO: 17512 - DNA, 60 bp, Artificial Sequence
  Description of Artificial Sequence: Synthetic probe
tgagttcgtaatccacggcgtaaacccaatgcctgggccgctcacacgtgccattgcacg

SEQ ID NO: 17513 - DNA, 60 bp, Artificial Sequence
  Description of Artificial Sequence: Synthetic probe
agacctgagttcgcgattcacggcgtaaacccaatgcctgggccgctcacacgtgctatt

SEQ ID NO: 17514 - DNA, 60 bp, Artificial Sequence
  Description of Artificial Sequence: Synthetic probe
agacctgagttcgtaatccacggcgtaaacccaatgcctgggccgctcacacgtgccatt

SEQ ID NO: 17515 - DNA, 60 bp, Artificial Sequence
  Description of Artificial Sequence: Synthetic probe
agaccggagttcgcgattcacggcgtaaacccaatgcctgggccgctcacacgtgctatt

SEQ ID NO: 17516 - DNA, 60 bp, Artificial Sequence
  Description of Artificial Sequence: Synthetic probe
ggctggtgttagctggaacttggatcatcaaagtgaggaggaggcggatggagatgaaga

SEQ ID NO: 17517 - DNA, 60 bp, Artificial Sequence
  Description of Artificial Sequence: Synthetic probe
cgcatcgtaatgaaatgttggaggttgctcctttggttgaatctgtttatgcgtcggagt

SEQ ID NO: 17518 - DNA, 60 bp, Artificial Sequence
  Description of Artificial Sequence: Synthetic probe
cccgatttaatagctggcgctcatcaaaatgcagatcctgtcgttctagatgtaagctgg

SEQ ID NO: 17519 - DNA, 60 bp, Artificial Sequence
  Description of Artificial Sequence: Synthetic probe
cgcgttacttcccgatttaatagctggcgctcatcaaaatgcagatcctgtcgttctaga

SEQ ID NO: 17520 - DNA, 60 bp, Artificial Sequence
  Description of Artificial Sequence: Synthetic probe
ataaatgaagatttacattcggtgttttcactgccagatgatatgtttaacgcgttactt

SEQ ID NO: 17521 - DNA, 60 bp, Artificial Sequence
  Description of Artificial Sequence: Synthetic probe
tgctgcaggcaaagattcggaagcagcgtatttccgcagtatgttacccttccacatggt

SEQ ID NO: 17522 - DNA, 60 bp, Artificial Sequence
  Description of Artificial Sequence: Synthetic probe
gggaaccgttggacttccagatcggcaggaaccaatatgattgtaatgtatttcgagcag

SEQ ID NO: 17523 - DNA, 60 bp, Artificial Sequence
  Description of Artificial Sequence: Synthetic probe
attatggccccacgggggaaccgttggacttccagatcggcaggaaccaatatgattgta

SEQ ID NO: 17524 - DNA, 60 bp, Artificial Sequence
  Description of Artificial Sequence: Synthetic probe
gaattacgacgactgggccttttgcaatattgaccggatcaacgccaaccgcacagcagc

SEQ ID NO: 17525 - DNA, 50 bp, Artificial Sequence
  Description of Artificial Sequence: Synthetic probe
cgcaagaggtacttacggactttagaagacaagatactatttgggtgctg

SEQ ID NO: 17526 - DNA, 60 bp, Artificial Sequence
  Description of Artificial Sequence: Synthetic probe
ggagatgtcacaggtaggcgatgttatcacagaagatgaaccggaaaagttctattcgac

SEQ ID NO: 17527 - DNA, 60 bp, Artificial Sequence
  Description of Artificial Sequence: Synthetic probe
ggaggattgtgcatgatattccaccatgttggaacgagactcagggagacaagcgcggac

SEQ ID NO: 17528 - DNA, 60 bp, Artificial Sequence
  Description of Artificial Sequence: Synthetic probe
gcggatgatatcgccatgatgctcagagacgcgtgaaggcggggagacaacgacttacac

SEQ ID NO: 17529 - DNA, 60 bp, Artificial Sequence
  Description of Artificial Sequence: Synthetic probe
gcggctttaaaatatggtgtgaaggtgatgtcgagggcggatgatatcgccatgatgctc

SEQ ID NO: 17530 - DNA, 60 bp, Artificial Sequence
  Description of Artificial Sequence: Synthetic probe
gagctttcatacatcgcgattaaaagtaatgcgatgcaattggtgacggatgaagacctt

SEQ ID NO: 17531 - DNA, 60 bp, Artificial Sequence
  Description of Artificial Sequence: Synthetic probe
cagcgctcccgcatgtcccatcctatttatctaggtgttcataattatgagctttcatac

SEQ ID NO: 17532 - DNA, 60 bp, Artificial Sequence
  Description of Artificial Sequence: Synthetic probe
ttcacaagaaacgtttacaacgctcccgcatgtcccatcctatttatctaggtgttcata

SEQ ID NO: 17533 - DNA, 60 bp, Artificial Sequence
  Description of Artificial Sequence: Synthetic probe
taacctggcgtcgagatcaactatggcgagtgacattcacaagaaacgtttacaacgctc

SEQ ID NO: 17534 - DNA, 60 bp, Artificial Sequence
  Description of Artificial Sequence: Synthetic probe
atcgagagttctttaacctggcgtcgagatcaactatggcgagtgacgttcacaagaaac

SEQ ID NO: 17535 - DNA, 60 bp, Artificial Sequence
  Description of Artificial Sequence: Synthetic probe
gcacaagaagttacgggcaggactttccgcgaggcgtatcgagagttctttaacctggcg

SEQ ID NO: 17536 - DNA, 60 bp, Artificial Sequence
  Description of Artificial Sequence: Synthetic probe
cgttgggagctgcacaggaagttacgggcaggactttccgcgaggcgtatcgagagttct

SEQ ID NO: 17537 - DNA, 60 bp, Artificial Sequence
  Description of Artificial Sequence: Synthetic probe
ttcgttgggggctgcacaagaagttacgggcaggactttccgcgaggcgtatcgagagtt

SEQ ID NO: 17538 - DNA, 60 bp, Artificial Sequence
  Description of Artificial Sequence: Synthetic probe
cattcgttgggagctgcacaggaagttacgggcaggactttccgcgaggcgtatcgagag

SEQ ID NO: 17539 - DNA, 52 bp, Artificial Sequence
  Description of Artificial Sequence: Synthetic probe
ttcacgtaatctcgccacatcatttgaacgaatcattcttcttgggctttga

SEQ ID NO: 17540 - DNA, 60 bp, Artificial Sequence
  Description of Artificial Sequence: Synthetic probe
tgcggctccatgggattcggacagcgtattcatctttcacgtaatctcgccacatcattt

SEQ ID NO: 17541 - DNA, 60 bp, Artificial Sequence
  Description of Artificial Sequence: Synthetic probe
atcgattcatatttatgcggctccatgggattcggacagcgtattcatctttcacgtaat

SEQ ID NO: 17542 - DNA, 60 bp, Artificial Sequence
  Description of Artificial Sequence: Synthetic probe
gatagagatgaaatcacgaattggtcaccgaagcggatacatccgaaaagcgtccaaagg

SEQ ID NO: 17543 - DNA, 60 bp, Artificial Sequence
  Description of Artificial Sequence: Synthetic probe
cgattgaagaggatagagatgaaattacgaattggtcaccgaagcggatacatccgaaaa

SEQ ID NO: 17544 - DNA, 60 bp, Artificial Sequence
  Description of Artificial Sequence: Synthetic probe
agttccgatttttggcgctggggtggcgacaagtattgcaacggcgcgagcgatagaagg

SEQ ID NO: 17545 - DNA, 60 bp, Artificial Sequence
  Description of Artificial Sequence: Synthetic probe
tagaacgtgaaggtttacaggatgaagcaatacaggagattgcggggatgagcgcggaag

SEQ ID NO: 17546 - DNA, 60 bp, Artificial Sequence
  Description of Artificial Sequence: Synthetic probe
ggagagtaccgtgataaaattgatgcgctatcaaaagccatagagatagaacgtgaaggt

SEQ ID NO: 17547 - DNA, 59 bp, Artificial Sequence
  Description of Artificial Sequence: Synthetic probe
aaaagcgttgcgagcgtacgggaacgtagtgaaggtcgaaggagaaagcgttcagaaat

SEQ ID NO: 17548 - DNA, 60 bp, Artificial Sequence
  Description of Artificial Sequence: Synthetic probe
cgcaggtaatcgctaaattcgggcgcgatcttgaagatgtctacaaatttgcgtcgcgag

SEQ ID NO: 17549 - DNA, 60 bp, Artificial Sequence
  Description of Artificial Sequence: Synthetic probe
gaagcacaatgcgcaggtaatcgctaaattcgggcgcgatcttgaagatgtctacaaatt

SEQ ID NO: 17550 - DNA, 60 bp, Artificial Sequence
  Description of Artificial Sequence: Synthetic probe
gttggaggatgagcagaagggagaaattatacgtacgaagcacaatgcgcaggtaatcgc

SEQ ID NO: 17551 - DNA, 60 bp, Artificial Sequence
  Description of Artificial Sequence: Synthetic probe
ctgaccccttaagtccgggtgagaacgacatggtgcatcgtctgaagaggttggaggatg

SEQ ID NO: 17552 - DNA, 60 bp, Artificial Sequence
  Description of Artificial Sequence: Synthetic probe
gaggcgattcaatagctgaccccttaagtccgggtgagaacgacatggtgcatcgtctga

SEQ ID NO: 17553 - DNA, 60 bp, Artificial Sequence
  Description of Artificial Sequence: Synthetic probe
ggcattatacagggcagtgtgcattcagcgttgacgggcgagtcgtatggggagagcgta

SEQ ID NO: 17554 - DNA, 60 bp, Artificial Sequence
  Description of Artificial Sequence: Synthetic probe
actatagatggcattatacagggcagtgtgcattcagcgttgacgggcgagtcgtatggg

SEQ ID NO: 17555 - DNA, 60 bp, Artificial Sequence
  Description of Artificial Sequence: Synthetic probe
gctgaaaggttcgtagaaagtgatctcggcagcgcaactatagatggcattatacagggc

SEQ ID NO: 17556 - DNA, 60 bp, Artificial Sequence
  Description of Artificial Sequence: Synthetic probe
gggaaagcagctgaaaggttcgtagagagtgatctcggcagcgcaactatagatggcatt

SEQ ID NO: 17557 - DNA, 54 bp, Artificial Sequence
  Description of Artificial Sequence: Synthetic probe
gttaaaaagtccttggtatcctgcatcatgggaaaaatcattaaatccctcgga

SEQ ID NO: 17558 - DNA, 60 bp, Artificial Sequence
  Description of Artificial Sequence: Synthetic probe
gcgtacgttaacggaggcgtatcgtgaatttctcaatctatcaatttcaagcacgtatag

SEQ ID NO: 17559 - DNA, 60 bp, Artificial Sequence
  Description of Artificial Sequence: Synthetic probe
ggaactactggaacgaatggaggaagatgggtagttctaacagaagagattgctcgcgcg

SEQ ID NO: 17560 - DNA, 60 bp, Artificial Sequence
  Description of Artificial Sequence: Synthetic probe
cttcctgatgatggtttgtgcaaaaagcgagagaagcttgaatcagcaaattgatatgat

SEQ ID NO: 17561 - DNA, 60 bp, Artificial Sequence
  Description of Artificial Sequence: Synthetic probe
tggagcaggtatggccaccgcagtagcgacgggaagggcgattgagggagcttataagct

SEQ ID NO: 17562 - DNA, 60 bp, Artificial Sequence
  Description of Artificial Sequence: Synthetic probe
tacacatgacgttgttagttgccgctgtcgtagcattgttgacgtcagtatgcacgcttt

SEQ ID NO: 17563 - DNA, 60 bp, Artificial Sequence
  Description of Artificial Sequence: Synthetic probe
tacacatgacgttgttagttgccgctgtcgtagcgctgttgacgtcggtgtgcacgcttt

SEQ ID NO: 17564 - DNA, 60 bp, Artificial Sequence
  Description of Artificial Sequence: Synthetic probe
ctatgtcgttgaacgttgctacccaggattttattgacacttacctcgcctatccctatc

SEQ ID NO: 17565 - DNA, 60 bp, Artificial Sequence
  Description of Artificial Sequence: Synthetic probe
gacggcgcaccctatatgtttccagaccaaaacttatctccgcagttctatatacagaag

SEQ ID NO: 17566 - DNA, 60 bp, Artificial Sequence
  Description of Artificial Sequence: Synthetic probe
atttcgagaaccatgatgcatagtgctcttctgaaggaatctagcgctaggacgttgtta

SEQ ID NO: 17567 - DNA, 60 bp, Artificial Sequence
  Description of Artificial Sequence: Synthetic probe
ccctataggttggaatgggtacggcgcgcatccggcagctctcaatatcgttatgacgga

SEQ ID NO: 17568 - DNA, 60 bp, Artificial Sequence
  Description of Artificial Sequence: Synthetic probe
agaagttgggagggtgcagcccgggattcttactttcttatcggagcagtatgtgggaga

SEQ ID NO: 17569 - DNA, 60 bp, Artificial Sequence
  Description of Artificial Sequence: Synthetic probe
ggagaggggagggtagcgaatacgttatggaatggaaagcgaagattgtttaaaaccaca

SEQ ID NO: 17570 - DNA, 60 bp, Artificial Sequence
  Description of Artificial Sequence: Synthetic probe
cggaggaaaagtaattgtcggagatttggaagccacggggtcacgcgtgatggatgctgc

SEQ ID NO: 17571 - DNA, 59 bp, Artificial Sequence
  Description of Artificial Sequence: Synthetic probe
ttttcaaccgagatttatgtaaagaagaggtttggtccaaggttaagggataaggattt

SEQ ID NO: 17572 - DNA, 60 bp, Artificial Sequence
  Description of Artificial Sequence: Synthetic probe
gttgcatacaccacgccgcttttatttgaaatgtgttgcatggaatcaattttagaattc

SEQ ID NO: 17573 - DNA, 60 bp, Artificial Sequence
  Description of Artificial Sequence: Synthetic probe
gtctgcgcgaaaagtgagaggagtttgaatcaacaaattgatatggttaagaaagaggtc

SEQ ID NO: 17574 - DNA, 60 bp, Artificial Sequence
  Description of Artificial Sequence: Synthetic probe
ttcaagagtctgaatccgatgctgggggtggtgaatctgggagcaacattcttgatgatg

SEQ ID NO: 17575 - DNA, 60 bp, Artificial Sequence
  Description of Artificial Sequence: Synthetic probe
aactgaataatgcgacaaccgagatacctccatggttcaagagtctgaatccgatgctgg

SEQ ID NO: 17576 - DNA, 60 bp, Artificial Sequence
  Description of Artificial Sequence: Synthetic probe
tgagtgtggccttcaaactgaataatgcgacaaccgagatacctccatggttcaagagtc

SEQ ID NO: 17577 - DNA, 60 bp, Artificial Sequence
  Description of Artificial Sequence: Synthetic probe
gatcttgggagtctaaagaagaaaagagcgataatacatatgacgttgctgatagcggca

SEQ ID NO: 17578 - DNA, 60 bp, Artificial Sequence
  Description of Artificial Sequence: Synthetic probe
gccaactgttgctcttgaaatcctggacaaagcgatgtcaaacacaacgggtgcaacgca

SEQ ID NO: 17579 - DNA, 60 bp, Artificial Sequence
  Description of Artificial Sequence: Synthetic probe
tatgccctcatcaatgccaactgttgctcttgaaatcctggacaaagcgatgtcaaacac

SEQ ID NO: 17580 - DNA, 60 bp, Artificial Sequence
  Description of Artificial Sequence: Synthetic probe
caatttcacaaccaccgaggtatgctccaagtgcgcctatgccctcatcaatgccaactg

SEQ ID NO: 17581 - DNA, 60 bp, Artificial Sequence
  Description of Artificial Sequence: Synthetic probe
ataatcaggaccgagttgaagagttaagcctggtccgtgtggatgatacaatttcacaac

SEQ ID NO: 17582 - DNA, 60 bp, Artificial Sequence
  Description of Artificial Sequence: Synthetic probe
aagaaaagatgaaacataatcaggaccgagttgaagagttaagcctggtccgtgtggatg

SEQ ID NO: 17583 - DNA, 60 bp, Artificial Sequence
  Description of Artificial Sequence: Synthetic probe
gtgctacgcttcaagaggcaagaattgtgttggaagccaatgtgatggaaattctgggga

SEQ ID NO: 17584 - DNA, 60 bp, Artificial Sequence
  Description of Artificial Sequence: Synthetic probe
gcgagcatgcgctacgcttcaagaggcgagaattgtgttggaagccaatgtgatggaaat

SEQ ID NO: 17585 - DNA, 60 bp, Artificial Sequence
  Description of Artificial Sequence: Synthetic probe
gcttacacgagcacgggaggggatgtgaaaacggagtttctgcatttgatcgatcacctc

SEQ ID NO: 17586 - DNA, 60 bp, Artificial Sequence
  Description of Artificial Sequence: Synthetic probe
agcttacacgagcacgggaggggatgtgaaaacggagtttctgcatttgatcgatcacct

SEQ ID NO: 17587 - DNA, 60 bp, Artificial Sequence
  Description of Artificial Sequence: Synthetic probe
gacgtctgaagaatcagcgagtatcgggatcactatagaaggggtcatgagtcaaaagaa

SEQ ID NO: 17588 - DNA, 60 bp, Artificial Sequence
  Description of Artificial Sequence: Synthetic probe
agaaaagcggggcgcatgcgaaggctgctgagaaaggaaggcgtaaacaggggaagaagc

SEQ ID NO: 17589 - DNA, 60 bp, Artificial Sequence
  Description of Artificial Sequence: Synthetic probe
ggagctactggaacgaatggaggaagatgggtagttctaacggaagagattgctcgcgcg

SEQ ID NO: 17590 - DNA, 60 bp, Artificial Sequence
  Description of Artificial Sequence: Synthetic probe
ttgatgcgggagttggaactactggaacgaatggaggaagatgggtagttctaacggaag

SEQ ID NO: 17591 - DNA, 60 bp, Artificial Sequence
  Description of Artificial Sequence: Synthetic probe
ctgatgcgggagttggagctactggaacgaatggaggaagatgggtagttctaacggaag

SEQ ID NO: 17592 - DNA, 60 bp, Artificial Sequence
  Description of Artificial Sequence: Synthetic probe
ggcttatacgagcgcaggaggggatgttaagattgaattcctgcatttaatcgatcacct

SEQ ID NO: 17593 - DNA, 60 bp, Artificial Sequence
  Description of Artificial Sequence: Synthetic probe
gactgcatattttacatcaccgacgggagatccgaactggaaagaggttgcacgcgaggc

SEQ ID NO: 17594 - DNA, 60 bp, Artificial Sequence
  Description of Artificial Sequence: Synthetic probe
tgttaagtatgatcggaggcgtggagaggaaagccagactagttggagcgcgtgagagcg

SEQ ID NO: 17595 - DNA, 60 bp, Artificial Sequence
  Description of Artificial Sequence: Synthetic probe
caacggcgcaaataattgaagtagaacggagtctgcagaaggaattgggactgacccggg

SEQ ID NO: 17596 - DNA, 60 bp, Artificial Sequence
  Description of Artificial Sequence: Synthetic probe
agcgatcgagtctaaatacggtacgaaagtggaggtgtacatggacgaaccaacggcgca

SEQ ID NO: 17597 - DNA, 60 bp, Artificial Sequence
  Description of Artificial Sequence: Synthetic probe
gcgcaaacgagaatgcagacggaggagatggagcgactacaagacgagatagagctgctg

SEQ ID NO: 17598 - DNA, 60 bp, Artificial Sequence
  Description of Artificial Sequence: Synthetic probe
tggatggacgcgtacatactgcagtgggatttggatcaggcgcagagggaattagaggaa

SEQ ID NO: 17599 - DNA, 60 bp, Artificial Sequence
  Description of Artificial Sequence: Synthetic probe
cagaggcaaattcagattaatctaatagattgggcggaagacggacgggagacgaaacag

SEQ ID NO: 17600 - DNA, 60 bp, Artificial Sequence
  Description of Artificial Sequence: Synthetic probe
aggtttgcgtcgtgcagggtggttgacctcgcggcgcagactcccactgctgtataacgg

SEQ ID NO: 17601 - DNA, 60 bp, Artificial Sequence
  Description of Artificial Sequence: Synthetic probe
cgccccgaggtttgcgtcgtgcagggtggttgacctcgcggcgcagactcccactgctgt

SEQ ID NO: 17602 - DNA, 60 bp, Artificial Sequence
  Description of Artificial Sequence: Synthetic probe
cgcctacggcacacaaatgcatacgagccgtttgatcagatcggagaccgtacacccaat

SEQ ID NO: 17603 - DNA, 60 bp, Artificial Sequence
  Description of Artificial Sequence: Synthetic probe
tggaatgcaggagggagcaatacaagagatagctgggatgaccgccgatgtgttggaggc

SEQ ID NO: 17604 - DNA, 60 bp, Artificial Sequence
  Description of Artificial Sequence: Synthetic probe
tgaggttgaaagggatggaatgcaggagggagcaatacaagagatagctgggatgaccgc

SEQ ID NO: 17605 - DNA, 60 bp, Artificial Sequence
  Description of Artificial Sequence: Synthetic probe
ctcctactcgcagaagatgggtaaggtcatacgatccctaagccgatttggcaaaaaagt

SEQ ID NO: 17606 - DNA, 56 bp, Artificial Sequence
  Description of Artificial Sequence: Synthetic probe
ctcctactcgcagaagatgggtaaggtcatacgatccctaagccgttttggcaaaa

SEQ ID NO: 17607 - DNA, 56 bp, Artificial Sequence
  Description of Artificial Sequence: Synthetic probe
ctcctactcgcagaagatgggtaaggtcatacgatccctaagccgatttggcaaaa

SEQ ID NO: 17608 - DNA, 60 bp, Artificial Sequence
  Description of Artificial Sequence: Synthetic probe
ctcctactcgcagaagatgggtaaggtcatacgatccctaagccgttttggcaaaaaagt

SEQ ID NO: 17609 - DNA, 60 bp, Artificial Sequence
  Description of Artificial Sequence: Synthetic probe
atcatcatgggatcattacgaccctgaaatatctgttgtacatctcctctcgctccagca

SEQ ID NO: 17610 - DNA, 60 bp, Artificial Sequence
  Description of Artificial Sequence: Synthetic probe
aatggcggagcgagaggagatgtacaacagatatttcagggtcgtaatgatcccatgatg

SEQ ID NO: 17611 - DNA, 60 bp, Artificial Sequence
  Description of Artificial Sequence: Synthetic probe
attcaagtgtcacttaatggcggagcgagaggagatgtacaacagatatttcagggtcgt

SEQ ID NO: 17612 - DNA, 60 bp, Artificial Sequence
  Description of Artificial Sequence: Synthetic probe
attcaagtgtcacttaatgctggagcgagaggagatgtacaacagatatttcagggtcgt

SEQ ID NO: 17613 - DNA, 50 bp, Artificial Sequence
  Description of Artificial Sequence: Synthetic probe
ttgtaaaaggtatttccggtgttgctagtacaccaatcgtagccatatgt

SEQ ID NO: 17614 - DNA, 60 bp, Artificial Sequence
  Description of Artificial Sequence: Synthetic probe
tcatttctttgtgctaacgaggtcgggcgcatcgtcactcctcgtaaagtgagtccattg

SEQ ID NO: 17615 - DNA, 60 bp, Artificial Sequence
  Description of Artificial Sequence: Synthetic probe
ggtacaatggactcactttacgaggagtgacgatgcgcccgacctcgttagcacatagaa

SEQ ID NO: 17616 - DNA, 60 bp, Artificial Sequence
  Description of Artificial Sequence: Synthetic probe
ggtacaatggactcactttacgaggagtgacgatgcgcccgacctcgttagcacaaagaa

SEQ ID NO: 17617 - DNA, 60 bp, Artificial Sequence
  Description of Artificial Sequence: Synthetic probe
gtgctaacgaggtcgggcgcatcgtcactcctcgtaaagtgagtccattgtacctattga

SEQ ID NO: 17618 - DNA, 60 bp, Artificial Sequence
  Description of Artificial Sequence: Synthetic probe
atcaataggtacaatggactcactttacgaggagtgacgatgcgcccgacctcgttagca

SEQ ID NO: 17619 - DNA, 58 bp, Artificial Sequence
  Description of Artificial Sequence: Synthetic probe
atgcgcaacgtagtgacaacgaagcgcttgctatatgaaacacacttagcatctttgt

SEQ ID NO: 17620 - DNA, 60 bp, Artificial Sequence
  Description of Artificial Sequence: Synthetic probe
ttataagggtcgtatatggtggagtaacccttatccatgtttacgtggatcattgatagc

SEQ ID NO: 17621 - DNA, 60 bp, Artificial Sequence
  Description of Artificial Sequence: Synthetic probe
gagaagtcgggaaagaagaacctggcgtcctgacctttctgtcggagcaatatgtcggtg

SEQ ID NO: 17622 - DNA, 60 bp, Artificial Sequence
  Description of Artificial Sequence: Synthetic probe
gcgccgggaagaaatagtgaaaccggaagatctgtacacatcaatgttgcgcttagcgcg

SEQ ID NO: 17623 - DNA, 52 bp, Artificial Sequence
  Description of Artificial Sequence: Synthetic probe
cccctcttcttacgaaatgcatgaacgcagcgggggaagcgcttccacttac

SEQ ID NO: 17624 - DNA, 60 bp, Artificial Sequence
  Description of Artificial Sequence: Synthetic probe
cgtacgaggttcttaagaacaacgctcagcgtatcgtttatgatgatgagctacagatgc

SEQ ID NO: 17625 - DNA, 60 bp, Artificial Sequence
  Description of Artificial Sequence: Synthetic probe
ctgcgacgagtatgttcagcagcgtaatacatacgagacgtatgataagatcgagagcag

SEQ ID NO: 17626 - DNA, 60 bp, Artificial Sequence
  Description of Artificial Sequence: Synthetic probe
tttgaggatcttaccagtcattggcatgcattaggaaatgcgcaagaggcaacaggacgt

SEQ ID NO: 17627 - DNA, 60 bp, Artificial Sequence
  Description of Artificial Sequence: Synthetic probe
atagacgtagtacattttgaggatcttaccagtcattggcatgcattaggaaatgcgcaa

SEQ ID NO: 17628 - DNA, 60 bp, Artificial Sequence
  Description of Artificial Sequence: Synthetic probe
aatccacatctatgctgctccctgggattccgacgaggttttcttcttccactgcgtgtc

SEQ ID NO: 17629 - DNA, 60 bp, Artificial Sequence
  Description of Artificial Sequence: Synthetic probe
atgaggtttaagatcccgagaacgcaacaaccacaaatccacatctatgctgctccctgg

SEQ ID NO: 17630 - DNA, 60 bp, Artificial Sequence
  Description of Artificial Sequence: Synthetic probe
cacccacgggtaatgatgaggtttaagatcccgagaacgcaacaaccacaaatccacatc

SEQ ID NO: 17631 - DNA, 58 bp, Artificial Sequence
  Description of Artificial Sequence: Synthetic probe
gctgcagttgccgataactgtaatgagatatctcatataaaacaggagattctaccaa

SEQ ID NO: 17632 - DNA, 54 bp, Artificial Sequence
  Description of Artificial Sequence: Synthetic probe
cccaaaaatcgagcctactatcatcgctacaacacttgagcatcgattcaaaga

SEQ ID NO: 17633 - DNA, 60 bp, Artificial Sequence
  Description of Artificial Sequence: Synthetic probe
cagaagaggtaccattggttggcgcgggcatggcgaccgccgttgctacgggaagagcta

SEQ ID NO: 17634 - DNA, 60 bp, Artificial Sequence
  Description of Artificial Sequence: Synthetic probe
agcgggaatgactgccgacgttttagaggcggcgtcagaagaggtaccattggttggcgc

SEQ ID NO: 17635 - DNA, 60 bp, Artificial Sequence
  Description of Artificial Sequence: Synthetic probe
gcgattgaggtcgaacgtgacggaatgcaagaggaggcgatccaagaaatagcgggaatg

SEQ ID NO: 17636 - DNA, 61 bp, Artificial Sequence
  Description of Artificial Sequence: Synthetic probe
gagctagaggatgagcagcgaaatgaattaattcgattaaaatataataaggagataacgg

SEQ ID NO: 17637 - DNA, 51 bp, Artificial Sequence
  Description of Artificial Sequence: Synthetic probe
attgaatgtattgagcgcaggtgaagaactaccagaccccttgagtccggg

SEQ ID NO: 17638 - DNA, 60 bp, Artificial Sequence
  Description of Artificial Sequence: Synthetic probe
gagaatcatatggtgaatccgtaaagcaggcggtactattgaatgtattgagcgcaggtg

SEQ ID NO: 17639 - DNA, 60 bp, Artificial Sequence
  Description of Artificial Sequence: Synthetic probe
tcaattatcacaggagaatcatatggtgaatccgtaaagcaggcggtactattgaatgta

SEQ ID NO: 17640 - DNA, 60 bp, Artificial Sequence
  Description of Artificial Sequence: Synthetic probe
ggtgcggcggctattgatggactagtacagggaagtgttcattcaattatcacaggagaa

SEQ ID NO: 17641 - DNA, 60 bp, Artificial Sequence
  Description of Artificial Sequence: Synthetic probe
gtgagataggtgcggcggctattgatggactagtacagggaagtgttcattcaattatca

SEQ ID NO: 17642 - DNA, 60 bp, Artificial Sequence
  Description of Artificial Sequence: Synthetic probe
caacgatcggaaaggcggcggaacgtttcgcggaaagtgagataggtgcggcggctattg

SEQ ID NO: 17643 - DNA, 60 bp, Artificial Sequence
  Description of Artificial Sequence: Synthetic probe
gaagaagatttactcaacgatcggaaaggcggcggaacgtttcgcggaaagtgagatagg

SEQ ID NO: 17644 - DNA, 60 bp, Artificial Sequence
  Description of Artificial Sequence: Synthetic probe
aagaaggtaggtaacgcgctgacatcaaataccgcgaagaagatttactcaacgatcgga

SEQ ID NO: 17645 - DNA, 60 bp, Artificial Sequence
  Description of Artificial Sequence: Synthetic probe
ctaagtaggtttggtaagaaggtaggtaacgcgctgacatcaaataccgcgaagaagatt

SEQ ID NO: 17646 - DNA, 60 bp, Artificial Sequence
  Description of Artificial Sequence: Synthetic probe
gtgctgtcctactcgcagaagatggggaagattataaaatcgctaagtaggtttggtaag

SEQ ID NO: 17647 - DNA, 60 bp, Artificial Sequence
  Description of Artificial Sequence: Synthetic probe
gttaaaaagtgctgtcctactcgcagaagatggggaagattataaaatcgctaagtaggt

SEQ ID NO: 17648 - DNA, 60 bp, Artificial Sequence
  Description of Artificial Sequence: Synthetic probe
ggacgagagagggagcctcgatcgattcgtggctagaattactgcgtcacttataatgcg

SEQ ID NO: 17649 - DNA, 60 bp, Artificial Sequence
  Description of Artificial Sequence: Synthetic probe
aatggggatgagagagggagcctcgatcgattcgtggctagaattactgcgtcacttata

SEQ ID NO: 17650 - DNA, 60 bp, Artificial Sequence
  Description of Artificial Sequence: Synthetic probe
gaagatggggatgagagagggagcctcgatcgattcgtggctagaattactgcgtcactt

SEQ ID NO: 17651 - DNA, 60 bp, Artificial Sequence
  Description of Artificial Sequence: Synthetic probe
aaacgaaaaatggggacgagagagggagcctcgatcgattcgtggctagaattactgcgt

SEQ ID NO: 17652 - DNA, 60 bp, Artificial Sequence
  Description of Artificial Sequence: Synthetic probe
ttggagccaagcatttatgaagtaatgaagaagtcggtgatcgctacagcctgggtaggc

SEQ ID NO: 17653 - DNA, 60 bp, Artificial Sequence
  Description of Artificial Sequence: Synthetic probe
cggttcgcgtcaaattctacgatgcacgacctccggatgatgttttgcagggcttaccct

SEQ ID NO: 17654 - DNA, 60 bp, Artificial Sequence
  Description of Artificial Sequence: Synthetic probe
gtaatcaactaccacgagcgctagatatcgcattaagtgcgcgtcttacgagaaagagcg

SEQ ID NO: 17655 - DNA, 60 bp, Artificial Sequence
  Description of Artificial Sequence: Synthetic probe
gggtaatcaactaccacgagcgctagatatcgcattgagtgcgcgccttacgaggaagag

SEQ ID NO: 17656 - DNA, 60 bp, Artificial Sequence
  Description of Artificial Sequence: Synthetic probe
aacagataatgaaggtaatcaactaccacgagcgctagatatcgcattaagtgcgcgtct

SEQ ID NO: 17657 - DNA, 60 bp, Artificial Sequence
  Description of Artificial Sequence: Synthetic probe
tcctacagataatgagggtaatcaactaccacgagcgctagatatcgcattgagtgcgcg

SEQ ID NO: 17658 - DNA, 54 bp, Artificial Sequence
  Description of Artificial Sequence: Synthetic probe
agagagatattccatattcactgctaaatcattacccactagctatacagatag

SEQ ID NO: 17659 - DNA, 60 bp, Artificial Sequence
  Description of Artificial Sequence: Synthetic probe
ggcatgcgttaggcgcagctcaagaagcaaagggacgcacactgaacgaggcgtacagag

SEQ ID NO: 17660 - DNA, 60 bp, Artificial Sequence
  Description of Artificial Sequence: Synthetic probe
gttcctcaagatcgcggaagatggggaagatcataaaatcacttagccgttttggcaaaa

SEQ ID NO: 17661 - DNA, 60 bp, Artificial Sequence
  Description of Artificial Sequence: Synthetic probe
gtccaatacacatacgaaattgcacgacttcaagcaaatatgggacagtttcgcgcggcg

SEQ ID NO: 17662 - DNA, 60 bp, Artificial Sequence
  Description of Artificial Sequence: Synthetic probe
gaccgcgttgtccaatacacatacgaaattgcacgacttcaagcaaatatgggacagttt

SEQ ID NO: 17663 - DNA, 60 bp, Artificial Sequence
  Description of Artificial Sequence: Synthetic probe
gacaggagggtttctattacaccaatatgctagaggctcccccagaaattgaccgcgttg

SEQ ID NO: 17664 - DNA, 60 bp, Artificial Sequence
  Description of Artificial Sequence: Synthetic probe
cgcgtcagagttatcagtaatgaaggtagacatgcgacatctctcgttgatgcagagaag

SEQ ID NO: 17665 - DNA, 60 bp, Artificial Sequence
  Description of Artificial Sequence: Synthetic probe
cacatggtaagattcgctcggattaaccagatcataaatgaggatttacactcggtgttt

SEQ ID NO: 17666 - DNA, 60 bp, Artificial Sequence
  Description of Artificial Sequence: Synthetic probe
cgcaacggatcacaacgactggaccctttgccatattgactggatcaacgccaaccgcac

SEQ ID NO: 17667 - DNA, 60 bp, Artificial Sequence
  Description of Artificial Sequence: Synthetic probe
agaattacttattcgcaagaggtacttaccgattttagaaggcaagatactatttgggtg

SEQ ID NO: 17668 - DNA, 60 bp, Artificial Sequence
  Description of Artificial Sequence: Synthetic probe
ggcacattgttatgcaatcaagagatcgggtactgcgggtagacacatattatgaggaga

SEQ ID NO: 17669 - DNA, 56 bp, Artificial Sequence
  Description of Artificial Sequence: Synthetic probe
attcaggaccgttgttatcggtgtttgcgctacaagagatcatgcagaaagtaaga

SEQ ID NO: 17670 - DNA, 60 bp, Artificial Sequence
  Description of Artificial Sequence: Synthetic probe
cgacgccctatttagagggagatgtactgtcaagtgattcaggaccgttgttatcggtgt

SEQ ID NO: 17671 - DNA, 60 bp, Artificial Sequence
  Description of Artificial Sequence: Synthetic probe
atacgagtacagggggtgatgtgaaaacggagtttctacatttgatcgatcacctctaaa

SEQ ID NO: 17672 - DNA, 60 bp, Artificial Sequence
  Description of Artificial Sequence: Synthetic probe
agcttatacgagtacagggggtgatgtgaaaacggagtttctacatttgatcgatcacct

SEQ ID NO: 17673 - DNA, 60 bp, Artificial Sequence
  Description of Artificial Sequence: Synthetic probe
agcttatacgagtgcagggggtgatgtgaaaacggagtttctacatttgatcgatcacct

SEQ ID NO: 17674 - DNA, 60 bp, Artificial Sequence
  Description of Artificial Sequence: Synthetic probe
ggcatttacgaggcgttgtccagatctctgtacggccagatcgcaccttcggcgtgacga

SEQ ID NO: 17675 - DNA, 60 bp, Artificial Sequence
  Description of Artificial Sequence: Synthetic probe
acacaggctagcatagtttcaactaaggcgttactttatgagacgtatctatcctcggtg

SEQ ID NO: 17676 - DNA, 60 bp, Artificial Sequence
  Description of Artificial Sequence: Synthetic probe
cgctcagtcgatgagtgcaggtggatattgcatttggtaaggtccacccgaagtcgggac

SEQ ID NO: 17677 - DNA, 60 bp, Artificial Sequence
  Description of Artificial Sequence: Synthetic probe
gggcttagtttagcggttaaacagacgccatccagtattcatcaagaattggcgaaggat

SEQ ID NO: 17678 - DNA, 60 bp, Artificial Sequence
  Description of Artificial Sequence: Synthetic probe
ggtaaccccttactatatgatctagagaaggacattaggttagatagtagatcacaagtt

SEQ ID NO: 17679 - DNA, 60 bp, Artificial Sequence
  Description of Artificial Sequence: Synthetic probe
attaataaagtgtatcagataacgaatcatacgggaaatcattgtgatttgtatcctgac

SEQ ID NO: 17680 - DNA, 60 bp, Artificial Sequence
  Description of Artificial Sequence: Synthetic probe
cgtctgaatgcaagcctggtgacgtgtaccataaattacgggcgtggtatgagtggagcg

SEQ ID NO: 17681 - DNA, 60 bp, Artificial Sequence
  Description of Artificial Sequence: Synthetic probe
acaactgatccggaaagaaacgtcatctttacacacaaaacacaccgtacgaatcaagat

SEQ ID NO: 17682 - DNA, 60 bp, Artificial Sequence
  Description of Artificial Sequence: Synthetic probe
acttggataggagggaacttcgagcgaacacacattaagtctcttgaaatatgtaagtta

SEQ ID NO: 17683 - DNA, 60 bp, Artificial Sequence
  Description of Artificial Sequence: Synthetic probe
gaaagcggataccacgtcatatcatacgattgctgtagaatcaaaaggggagcgtgggtg

SEQ ID NO: 17684 - DNA, 60 bp, Artificial Sequence
  Description of Artificial Sequence: Synthetic probe
gtctacgcttgctgacgtttatactgttttgagacctgagtttgcgattcatggcgtaaa

SEQ ID NO: 17685 - DNA, 60 bp, Artificial Sequence
  Description of Artificial Sequence: Synthetic probe
tgcaatggtccagatacaagttgtgttttacatttctatggataagaccttaaatcaata

SEQ ID NO: 17686 - DNA, 60 bp, Artificial Sequence
  Description of Artificial Sequence: Synthetic probe
cgtgggatggacaggccgctctacatgtgcacaatccaacacaacagaatgcaatggtcc

SEQ ID NO: 17687 - DNA, 60 bp, Artificial Sequence
  Description of Artificial Sequence: Synthetic probe
gcgtgggatggacaggccgctctacatgtgcacaatccaacacaacagaatgcaatggtc

SEQ ID NO: 17688 - DNA, 60 bp, Artificial Sequence
  Description of Artificial Sequence: Synthetic probe
ttagtgttggcggagtagatatgcgggcggggcgtattatagcgtgggatggacaggccg

SEQ ID NO: 17689 - DNA, 60 bp, Artificial Sequence
  Description of Artificial Sequence: Synthetic probe
gtgtgactgttagtgttggcggagtagatatgcgggcggggcgtattatagcgtgggatg

SEQ ID NO: 17690 - DNA, 60 bp, Artificial Sequence
  Description of Artificial Sequence: Synthetic probe
attgctcgcgtgacaggggagacttcaacatggggaccagcgcgccagccctatggtttt

SEQ ID NO: 17691 - DNA, 60 bp, Artificial Sequence
  Description of Artificial Sequence: Synthetic probe
atgagattgctcgcgtgacaggggagacttcaacatggggaccagcgcgccagccctatg

SEQ ID NO: 17692 - DNA, 60 bp, Artificial Sequence
  Description of Artificial Sequence: Synthetic probe
caatgacgcggtgaggatgagttttacagaattttcttcagtcccgctagatggtttcga

SEQ ID NO: 17693 - DNA, 60 bp, Artificial Sequence
  Description of Artificial Sequence: Synthetic probe
acctcaatggtttaagagtttaaatccaatgttaggtgtggtgaatttgggagctacctt

SEQ ID NO: 17694 - DNA, 60 bp, Artificial Sequence
  Description of Artificial Sequence: Synthetic probe
tcagtttgcacgttatcaagtgacatgagcgtggcatttaagctaaatggtacattagct

SEQ ID NO: 17695 - DNA, 60 bp, Artificial Sequence
  Description of Artificial Sequence: Synthetic probe
gcaatgtcaaatacaacgggtgcaacgcaaacacaaaaagcggagaaagctgcattcgca

SEQ ID NO: 17696 - DNA, 60 bp, Artificial Sequence
  Description of Artificial Sequence: Synthetic probe
aatgcgatggcattagttagtaacgaagatttacaaatgcatgtactgcgcggccctgtg

SEQ ID NO: 17697 - DNA, 60 bp, Artificial Sequence
  Description of Artificial Sequence: Synthetic probe
ggagtagtcatcctatctatttggggatgcacgactacgaagtttcatacgagcagatca

SEQ ID NO: 17698 - DNA, 60 bp, Artificial Sequence
  Description of Artificial Sequence: Synthetic probe
ctgagtgtgcctaaagttcagcccaaaacgttggaggcgattctagatactccaaagggg

SEQ ID NO: 17699 - DNA, 60 bp, Artificial Sequence
  Description of Artificial Sequence: Synthetic probe
tcgatttgactcatctgagtgtgcctaaagttcagcccaaaacgttggaggcgattctag

SEQ ID NO: 17700 - DNA, 60 bp, Artificial Sequence
  Description of Artificial Sequence: Synthetic probe
ggcgcgtacaaaattaaggctgtgataagtgctctgtctggaatcgatttgactcatctg

SEQ ID NO: 17701 - DNA, 60 bp, Artificial Sequence
  Description of Artificial Sequence: Synthetic probe
tagcgaatatcgcgacaaaattgatgccttacggggggcgattgaggtcgagaaagaggg

SEQ ID NO: 17702 - DNA, 60 bp, Artificial Sequence
  Description of Artificial Sequence: Synthetic probe
ctcgagaaagcgttgaagtcttatgtgggtgtctttaaggcggaaaatgagagtattaac

SEQ ID NO: 17703 - DNA, 60 bp, Artificial Sequence
  Description of Artificial Sequence: Synthetic probe
gacggattaatacagggaagcgtacactcaatcatgacgggagagtcgtatggcgagagt

SEQ ID NO: 17704 - DNA, 60 bp, Artificial Sequence
  Description of Artificial Sequence: Synthetic probe
cggaaatgcagctgaaagatttgccgaaagtgagattggaagcgcggcgattgacggatt

SEQ ID NO: 17705 - DNA, 60 bp, Artificial Sequence
  Description of Artificial Sequence: Synthetic probe
gcagccaccaagcattgcatgatggggaagatcatcaagtcgttgggcaaatttggcaaa

SEQ ID NO: 17706 - DNA, 60 bp, Artificial Sequence
  Description of Artificial Sequence: Synthetic probe
cgctcgcggatgtttattcggtgttgagaccagagtttgcaatacacggtgtaaatccaa

SEQ ID NO: 17707 - DNA, 60 bp, Artificial Sequence
  Description of Artificial Sequence: Synthetic probe
gatggttcatgagagcggctcaagtggtcacgcctgtggtttgcggcccggatatgatcc

SEQ ID NO: 17708 - DNA, 60 bp, Artificial Sequence
  Description of Artificial Sequence: Synthetic probe
gtatcaaccgggaagatggttcatgagagcggctcaagtggtcacgcctgtggtttgcgg

SEQ ID NO: 17709 - DNA, 60 bp, Artificial Sequence
  Description of Artificial Sequence: Synthetic probe
actactctattggttgctgctgtgattgcgttgttgacatcagtctgcaccctttcaagc

SEQ ID NO: 17710 - DNA, 60 bp, Artificial Sequence
  Description of Artificial Sequence: Synthetic probe
cgagcaatcatacacactactctattggttgctgctgtgattgcgttgttgacatcagtc

SEQ ID NO: 17711 - DNA, 60 bp, Artificial Sequence
  Description of Artificial Sequence: Synthetic probe
acgagcaatcatacacactactctattagtagcggctgtggttgcgctgttgacatcagt

SEQ ID NO: 17712 - DNA, 60 bp, Artificial Sequence
  Description of Artificial Sequence: Synthetic probe
tggattgaagaggaaacgagcaatcatacacactactctattagtagcggctgtggttgc

SEQ ID NO: 17713 - DNA, 60 bp, Artificial Sequence
  Description of Artificial Sequence: Synthetic probe
ctcaaccaccaaggtatgctccgagtgcaccaatgccatcatctatgccaacggttgccc

SEQ ID NO: 17714 - DNA, 60 bp, Artificial Sequence
  Description of Artificial Sequence: Synthetic probe
tcgcatcgtacgcggaagcgtttcgtgatgatgtaagattaagacaaattaaacgccacg

SEQ ID NO: 17715 - DNA, 60 bp, Artificial Sequence
  Description of Artificial Sequence: Synthetic probe
ggaactagcgggttggaaaaactacgtgaagcgagaagcaatgtttttaaagaggtggaa

SEQ ID NO: 17716 - DNA, 60 bp, Artificial Sequence
  Description of Artificial Sequence: Synthetic probe
gatgaggcgaaggtggatgatgaggctaaagagataattccgggaactagcgggttggaa

SEQ ID NO: 17717 - DNA, 60 bp, Artificial Sequence
  Description of Artificial Sequence: Synthetic probe
ggttctatgcattatgacatatctttctcagatttgcgtggaaatgcgcaacggattgtc

SEQ ID NO: 17718 - DNA, 60 bp, Artificial Sequence
  Description of Artificial Sequence: Synthetic probe
cgttaactgaagcgtataaagagtttttgaatatggcaatttcgaacgttttgggaacgc

SEQ ID NO: 17719 - DNA, 60 bp, Artificial Sequence
  Description of Artificial Sequence: Synthetic probe
atctcgcatcatcatgcaaacgagtcattctttttagggtttgatctaagtattgattta

SEQ ID NO: 17720 - DNA, 60 bp, Artificial Sequence
  Description of Artificial Sequence: Synthetic probe
ttccgagagcacagcagccacagattcatgtttatagcgcgccttgggattcagatgacg

SEQ ID NO: 17721 - DNA, 60 bp, Artificial Sequence
  Description of Artificial Sequence: Synthetic probe
gtggaattgatttaacgcacttacgtacgcctaagattgagccaagtgtggtatccacta

SEQ ID NO: 17722 - DNA, 60 bp, Artificial Sequence
  Description of Artificial Sequence: Synthetic probe
tatgcaggaagaagccatacaggagatcgcggggatgaccgccgatgtattggaggcggc

SEQ ID NO: 17723 - DNA, 60 bp, Artificial Sequence
  Description of Artificial Sequence: Synthetic probe
gcacttaaaagtgcgatagaaattgagagagatggtatgcaggaagaagccatacaggag

SEQ ID NO: 17724 - DNA, 60 bp, Artificial Sequence
  Description of Artificial Sequence: Synthetic probe
atgcaggttaaattgaaagagctggaggatgaacaacgtaatgagcttgtgcgactcaaa

SEQ ID NO: 17725 - DNA, 60 bp, Artificial Sequence
  Description of Artificial Sequence: Synthetic probe
taggaaacggtgaagagcttccagatccgttgagtccaggagagcgaggcatgcaggtta

SEQ ID NO: 17726 - DNA, 60 bp, Artificial Sequence
  Description of Artificial Sequence: Synthetic probe
cggcgaatcgtacggtcaatccgtcaagcaggcagttttattaaatgtgttaggaaacgg

SEQ ID NO: 17727 - DNA, 60 bp, Artificial Sequence
  Description of Artificial Sequence: Synthetic probe
cagtacgatcgggaaagcggcagagaggttcgcagagagcgagatcggttcagccgcgat

SEQ ID NO: 17728 - DNA, 60 bp, Artificial Sequence
  Description of Artificial Sequence: Synthetic probe
cgaagagcatgtgggtaatgattcagtgtttaagacaaagctggttcgtgatgagcagat

SEQ ID NO: 17729 - DNA, 60 bp, Artificial Sequence
  Description of Artificial Sequence: Synthetic probe
gaccgcagcattgtggaatcgcgcgtgaggagatcgggtgatgaaagctggcaaagctgg

SEQ ID NO: 17730 - DNA, 60 bp, Artificial Sequence
  Description of Artificial Sequence: Synthetic probe
gtgtcaaacaaaattttgaaagagcaatgattgcggcaactgatgctgaggaaccacgga

SEQ ID NO: 17731 - DNA, 60 bp, Artificial Sequence
  Description of Artificial Sequence: Synthetic probe
aatccaatgcctggcccgcttacacgtgcgattgctcgcgccgcttacgcatagtccact

SEQ ID NO: 17732 - DNA, 60 bp, Artificial Sequence
  Description of Artificial Sequence: Synthetic probe
gcgtaaatccaatgcctggcccgcttacacgtgcgattgctcgcgccgcttacgcatagt

SEQ ID NO: 17733 - DNA, 60 bp, Artificial Sequence
  Description of Artificial Sequence: Synthetic probe
gcgtgaatccaatgcctggcccgcttacacgtgcgattgctcgcgccgcttacgcatagt

SEQ ID NO: 17734 - DNA, 59 bp, Artificial Sequence
  Description of Artificial Sequence: Synthetic probe
gcgtaaatccaatgcctggcccgcttacacgtgcgattgctcgcgccgcttacgcatag

SEQ ID NO: 17735 - DNA, 60 bp, Artificial Sequence
  Description of Artificial Sequence: Synthetic probe
gcagaagataggttgggtgaagaaatagcttacgaaatgggcggtgcgttctccagtgcg

SEQ ID NO: 17736 - DNA, 60 bp, Artificial Sequence
  Description of Artificial Sequence: Synthetic probe
tcgaatgcgcagaggattgtgtatgatgacgagttgcaaatgcatatattaaggggtccg

SEQ ID NO: 17737 - DNA, 60 bp, Artificial Sequence
  Description of Artificial Sequence: Synthetic probe
aatcggtagtacctatacctctccaatgcacgcccgacgcatgatccgatcgaaaacggt

SEQ ID NO: 17738 - DNA, 60 bp, Artificial Sequence
  Description of Artificial Sequence: Synthetic probe
ctcatctacgtacaccaaagatagaacctacgatggttgcgactacactggaacatagat

SEQ ID NO: 17739 - DNA, 60 bp, Artificial Sequence
  Description of Artificial Sequence: Synthetic probe
cctttagtcggctcggggatggcaactgcaattgcaacaggaagagcaattgagggcgca

SEQ ID NO: 17740 - DNA, 60 bp, Artificial Sequence
  Description of Artificial Sequence: Synthetic probe
ggatgacggcagatgtgttagaggcggcttcggaagaggtacctttagtcggctcgggga

SEQ ID NO: 17741 - DNA, 60 bp, Artificial Sequence
  Description of Artificial Sequence: Synthetic probe
cagagggaggcggcagaaagaactgaagctgagtcaacaatggttaaggaatacagacag

SEQ ID NO: 17742 - DNA, 60 bp, Artificial Sequence
  Description of Artificial Sequence: Synthetic probe
agagcagagaaatgaattggtaagactaaaatatgggaaagagattacaaagaaatttgg

SEQ ID NO: 17743 - DNA, 60 bp, Artificial Sequence
  Description of Artificial Sequence: Synthetic probe
ccgctatattaaatagaactactctgccaaatatgttaccgcctatatttcctccaaacg

SEQ ID NO: 17744 - DNA, 60 bp, Artificial Sequence
  Description of Artificial Sequence: Synthetic probe
actaagaaccgctatattaaatagaactactctgccaaatatgttaccgcctatatttcc

SEQ ID NO: 17745 - DNA, 60 bp, Artificial Sequence
  Description of Artificial Sequence: Synthetic probe
tttaacgtctatagcttcagagatcatacttggcatggactaaggaccgctatattaaat

SEQ ID NO: 17746 - DNA, 60 bp, Artificial Sequence
  Description of Artificial Sequence: Synthetic probe
gcagagatattcaacgtctatagcttcagagatcatacttggcatggactaagaaccgct

SEQ ID NO: 17747 - DNA, 60 bp, Artificial Sequence
  Description of Artificial Sequence: Synthetic probe
actgcagagatattcaacgtctatagcttcagagatcatacttggcatggactaagaacc

SEQ ID NO: 17748 - DNA, 60 bp, Artificial Sequence
  Description of Artificial Sequence: Synthetic probe
cgatggcgcaggggaattcacaacaaacgctggctggtgtaacggttagtgtcggaggtg

SEQ ID NO: 17749 - DNA, 60 bp, Artificial Sequence
  Description of Artificial Sequence: Synthetic probe
cgcgatggctcaggggaattcacaacaaacgctggctggtgtaacagttagcgtcggagg

SEQ ID NO: 17750 - DNA, 60 bp, Artificial Sequence
  Description of Artificial Sequence: Synthetic probe
cgcgatggctcaggggaattcacaacaaacgctggctggtgtaacggttagcgtcggagg

SEQ ID NO: 17751 - DNA, 60 bp, Artificial Sequence
  Description of Artificial Sequence: Synthetic probe
gtcgttggtttatgcgagctgcgcaggctgtaaccgctgtggtgtgtggcccggatatga

SEQ ID NO: 17752 - DNA, 60 bp, Artificial Sequence
  Description of Artificial Sequence: Synthetic probe
ggtcgttggtttatgcgagctgcgcaggctgtaacagccgtggtgtgtggcccagatatg

SEQ ID NO: 17753 - DNA, 60 bp, Artificial Sequence
  Description of Artificial Sequence: Synthetic probe
ctggtcgttggtttatgcgagctgcgcaggctgtaaccgctgtggtgtgcggcccggata

SEQ ID NO: 17754 - DNA, 60 bp, Artificial Sequence
  Description of Artificial Sequence: Synthetic probe
gtattgcgattaacaggtataatggattaacgcttcgtggggttacaatgcgcccgacat

SEQ ID NO: 17755 - DNA, 58 bp, Artificial Sequence
  Description of Artificial Sequence: Synthetic probe
gatatctccctatgcagatttatcggactgcgcgttgagtcatctgtgttgagggtcc

SEQ ID NO: 17756 - DNA, 60 bp, Artificial Sequence
  Description of Artificial Sequence: Synthetic probe
cgaaagggaaagcacgagcgagacttatcaggttgggacgcagagatggatacagctgcg

SEQ ID NO: 17757 - DNA, 60 bp, Artificial Sequence
  Description of Artificial Sequence: Synthetic probe
gcgttgggtgttgcttccgtcgctgcagccatcgttaaaactcgtgttggaggaggaggc

SEQ ID NO: 17758 - DNA, 60 bp, Artificial Sequence
  Description of Artificial Sequence: Synthetic probe
gctggcgcgcatcagaacgccgatccagtcgtactagatgtaagctggatatcgctgtgg

SEQ ID NO: 17759 - DNA, 60 bp, Artificial Sequence
  Description of Artificial Sequence: Synthetic probe
ggatgggccacaatagacgttgaatatagagatccagctccttatgtgcatgcacaacgc

SEQ ID NO: 17760 - DNA, 60 bp, Artificial Sequence
  Description of Artificial Sequence: Synthetic probe
ccaagaatttcatcgattacgttgactcaaagaatcacaacaacggggccgttcgctatt

SEQ ID NO: 17761 - DNA, 60 bp, Artificial Sequence
  Description of Artificial Sequence: Synthetic probe
tgcatgacattccgaccagagatcatcgcggcatggaggtcgcagagccagaagtgctgg

SEQ ID NO: 17762 - DNA, 60 bp, Artificial Sequence
  Description of Artificial Sequence: Synthetic probe
gttgagtatagagaacctgcaccctacgtacatgttcagcgttacatacgatattgtggc

SEQ ID NO: 17763 - DNA, 60 bp, Artificial Sequence
  Description of Artificial Sequence: Synthetic probe
atgttgagtatagagaacctgcaccctacgtacatgttcagcgttacatacgatattgtg

SEQ ID NO: 17764 - DNA, 60 bp, Artificial Sequence
  Description of Artificial Sequence: Synthetic probe
gaaaatctatttagccctgatgtttccgggacagattatactcgatctaaagattgaccc

SEQ ID NO: 17765 - DNA, 60 bp, Artificial Sequence
  Description of Artificial Sequence: Synthetic probe
ggtattggttaggatgcccgggcatgtctttggaaatgacgagctaatgacgaagctact

SEQ ID NO: 17766 - DNA, 60 bp, Artificial Sequence
  Description of Artificial Sequence: Synthetic probe
ttattcgcggaggcatatctcaggggtcgtttcgatctgcgtggaccagaacggccaact

SEQ ID NO: 17767 - DNA, 60 bp, Artificial Sequence
  Description of Artificial Sequence: Synthetic probe
gcctctttatgtgcgggactagctgattctcttgtgtatacgctgcctgtagcgcatcct

SEQ ID NO: 17768 - DNA, 60 bp, Artificial Sequence
  Description of Artificial Sequence: Synthetic probe
gcgactcaaagaagaagcaggatgcggatgatacccataaagagtttggctcaatatgtt

SEQ ID NO: 17769 - DNA, 60 bp, Artificial Sequence
  Description of Artificial Sequence: Synthetic probe
cgtccggtgtgcaccgattggatattttacgcgaaactttccccaactttcttaggcacg

SEQ ID NO: 17770 - DNA, 60 bp, Artificial Sequence
  Description of Artificial Sequence: Synthetic probe
cgttgatcattttatcgagttatgaacgattggacccaagtttacatgaggggagggagc

SEQ ID NO: 17771 - DNA, 60 bp, Artificial Sequence
  Description of Artificial Sequence: Synthetic probe
acgtctgcaattattcggcgacgctctcagtctggaacaaaaacagtcagccgtattcga

SEQ ID NO: 17772 - DNA, 60 bp, Artificial Sequence
  Description of Artificial Sequence: Synthetic probe
tgccaagcttaagattgcgcgtggcgagatcgcaacccggaaggtggatgacccttggaa

SEQ ID NO: 17773 - DNA, 60 bp, Artificial Sequence
  Description of Artificial Sequence: Synthetic probe
caaacctgcttactatcgacttcgagaaggatgcctatcttggttcgcgctctgaattag

SEQ ID NO: 17774 - DNA, 60 bp, Artificial Sequence
  Description of Artificial Sequence: Synthetic probe
cggggataggtataaagagatgtttgatcgtatgattcaaggcggatgggatcaggagcg

SEQ ID NO: 17775 - DNA, 60 bp, Artificial Sequence
  Description of Artificial Sequence: Synthetic probe
tctcgtcttaatctgtttgacactaacctagctattggagatgaaatcattcactggcgg

SEQ ID NO: 17776 - DNA, 60 bp, Artificial Sequence
  Description of Artificial Sequence: Synthetic probe
tcaagagcacgtaaacatatttgaagtaggtggtcccgcaacagatgatgggagatttta

SEQ ID NO: 17777 - DNA, 60 bp, Artificial Sequence
  Description of Artificial Sequence: Synthetic probe
tgatagaactaaaatacgcgcattggagctctgcaaaatactctcggcgatcggacgtaa

SEQ ID NO: 17778 - DNA, 60 bp, Artificial Sequence
  Description of Artificial Sequence: Synthetic probe
gtacaaagattgggtatagagggcagccgtacgaacgattcatatccagcttagttcaag

SEQ ID NO: 17779 - DNA, 60 bp, Artificial Sequence
  Description of Artificial Sequence: Synthetic probe
cgcatgaactagtagctcattccgaaagggaaagcacgagcgagacttatcaggttggga

SEQ ID NO: 17780 - DNA, 60 bp, Artificial Sequence
  Description of Artificial Sequence: Synthetic probe
ccgtaaaccatcagcttttcaattgtatagttaaagcgaggtcagcaaatgcggacacca

SEQ ID NO: 17781 - DNA, 60 bp, Artificial Sequence
  Description of Artificial Sequence: Synthetic probe
ccgcagtggtttaagagtttaaatcccatgcttggagtggtaaatctaggtgcgactttc

SEQ ID NO: 17782 - DNA, 60 bp, Artificial Sequence
  Description of Artificial Sequence: Synthetic probe
ccgaggtatgctccgagtgcgccaatgccatcatctatgccgacggttgcccttgaaata

SEQ ID NO: 17783 - DNA, 60 bp, Artificial Sequence
  Description of Artificial Sequence: Synthetic probe
atcatcgaaaaggtatgagttgcaatgtgtgggtgcgtgtgagcgtgttgcttttgtctc

SEQ ID NO: 17784 - DNA, 60 bp, Artificial Sequence
  Description of Artificial Sequence: Synthetic probe
tcgaattgtatcatggtcgcgatcgtggcagattcctaaaaaagagattgtttgaacacc

SEQ ID NO: 17785 - DNA, 60 bp, Artificial Sequence
  Description of Artificial Sequence: Synthetic probe
gtcgaattgtatcatggtcgcgatcgtggcagatttctaaagaagaggctatttgaacac

SEQ ID NO: 17786 - DNA, 60 bp, Artificial Sequence
  Description of Artificial Sequence: Synthetic probe
atgatgttaggaagatctacttagcgctaatgtttcctggacagattatacttgatctaa

SEQ ID NO: 17787 - DNA, 60 bp, Artificial Sequence
  Description of Artificial Sequence: Synthetic probe
cctcaaagagatatgatttacaatgcgttggggcgtgtgaacgcgtcgcctttgtttcca

SEQ ID NO: 17788 - DNA, 60 bp, Artificial Sequence
  Description of Artificial Sequence: Synthetic probe
gcttaaatcgaaggatgagcgcttaatgagtttatctggcgcgatgccacaagcgagtgg

SEQ ID NO: 17789 - DNA, 60 bp, Artificial Sequence
  Description of Artificial Sequence: Synthetic probe
agtttctaagcagcttaaatcgaaggatgagcgcttaatgagtttatctggcgcgatgcc

SEQ ID NO: 17790 - DNA, 60 bp, Artificial Sequence
  Description of Artificial Sequence: Synthetic probe
cacaagtctgatgtgagtacggaaaatgatggaaaagataaatgtggagaagagcagaac

SEQ ID NO: 17791 - DNA, 60 bp, Artificial Sequence
  Description of Artificial Sequence: Synthetic probe
actggagtttacacaagtctgatgtgagtacggaaaatgatggaaaagataaatgtggag

SEQ ID NO: 17792 - DNA, 59 bp, Artificial Sequence
  Description of Artificial Sequence: Synthetic probe
ggggatgagtttaagaaagtggaattaggcgacaactggagtttacacaagtctgatgt

SEQ ID NO: 17793 - DNA, 60 bp, Artificial Sequence
  Description of Artificial Sequence: Synthetic probe
actgcaaacgcttgggggggatgagtttaagaaagtggaattaggcgacaactggagttt

SEQ ID NO: 17794 - DNA, 60 bp, Artificial Sequence
  Description of Artificial Sequence: Synthetic probe
atgaaagcgaagacgcgatatcgactgaaaccgagacagtgacactgcaaacgcttgggg

SEQ ID NO: 17795 - DNA, 60 bp, Artificial Sequence
  Description of Artificial Sequence: Synthetic probe
gcgaacgatgaaagcgaagacgcgatatcgactgaaaccgagacagtgacactgcaaacg

SEQ ID NO: 17796 - DNA, 53 bp, Artificial Sequence
  Description of Artificial Sequence: Synthetic probe
gatatacgagagctgcgccaaaaaattaggagtgaacgtgaacaggtgccgcg

SEQ ID NO: 17797 - DNA, 50 bp, Artificial Sequence
  Description of Artificial Sequence: Synthetic probe
cgtacatgcgaaatgatttcgaccgtacggaagtaccggagctaccaggc

SEQ ID NO: 17798 - DNA, 60 bp, Artificial Sequence
  Description of Artificial Sequence: Synthetic probe
gtgataagcatgatgttgacgtccacaggagttgaagcaacgacggagagatgggaggaa

SEQ ID NO: 17799 - DNA, 60 bp, Artificial Sequence
  Description of Artificial Sequence: Synthetic probe
ggtcctggggcttatagaattttggatgggcaagatgtgataagcatgatgttgacgtcc

SEQ ID NO: 17800 - DNA, 60 bp, Artificial Sequence
  Description of Artificial Sequence: Synthetic probe
tgctgagcgtatctggtcctggggcttatagaattttggatgggcaagatgtgataagca

SEQ ID NO: 17801 - DNA, 60 bp, Artificial Sequence
  Description of Artificial Sequence: Synthetic probe
caaaccagttaagaatccagaaccaaaaggttatgtgctgagcgtatctggtcctggggc

SEQ ID NO: 17802 - DNA, 60 bp, Artificial Sequence
  Description of Artificial Sequence: Synthetic probe
gagagttattgcgttcaaaccagttaagaatccagaaccaaaaggttatgtgctgagcgt

SEQ ID NO: 17803 - DNA, 58 bp, Artificial Sequence
  Description of Artificial Sequence: Synthetic probe
cgacgtgaatgcgaagacaatttgtggaataatcgcgaagcaaaatgctttgccatat

SEQ ID NO: 17804 - DNA, 60 bp, Artificial Sequence
  Description of Artificial Sequence: Synthetic probe
gcataatttcatcaatataagagatatgatgcgttgggtgttgctcccgtcgctgcagcc

SEQ ID NO: 17805 - DNA, 60 bp, Artificial Sequence
  Description of Artificial Sequence: Synthetic probe
ggggagtgatgtgaaaacggagtttctacatctgatcgatcacctctaaagggtccaggg

SEQ ID NO: 17806 - DNA, 60 bp, Artificial Sequence
  Description of Artificial Sequence: Synthetic probe
gcatgattggtggtgtggagagaaagatggctccgataggagcgcgggagagcgcggtta

SEQ ID NO: 17807 - DNA, 60 bp, Artificial Sequence
  Description of Artificial Sequence: Synthetic probe
gtcttcagaaagagttgggaatttcccgtgagggggtggccgagcagacggagagattga

SEQ ID NO: 17808 - DNA, 60 bp, Artificial Sequence
  Description of Artificial Sequence: Synthetic probe
ttgatgcgggagttggagctactggagcgaatggaggaaaatgggtagttctaacggaag

SEQ ID NO: 17809 - DNA, 60 bp, Artificial Sequence
  Description of Artificial Sequence: Synthetic probe
gcaaatatacggagatatacccattaaagtatggtgttgtttcatcaacgaactgagtgt

SEQ ID NO: 17810 - DNA, 60 bp, Artificial Sequence
  Description of Artificial Sequence: Synthetic probe
tgcaaatatacggagatatacccattaaagtatggtgttgtttcatcaacgaactgagtg

SEQ ID NO: 17811 - DNA, 60 bp, Artificial Sequence
  Description of Artificial Sequence: Synthetic probe
gatgcaaatatacggagatatacccattaaagtatggtgttgtttcatcaacgagctgag

SEQ ID NO: 17812 - DNA, 60 bp, Artificial Sequence
  Description of Artificial Sequence: Synthetic probe
aaaacgagatgcaaatatacggagatatacccattaaagtatggtgttgtttcatcaacg

SEQ ID NO: 17813 - DNA, 60 bp, Artificial Sequence
  Description of Artificial Sequence: Synthetic probe
ggcaggatcggagatcattattatactacaaattgttacactggggcggaggccttgatt

SEQ ID NO: 17814 - DNA, 60 bp, Artificial Sequence
  Description of Artificial Sequence: Synthetic probe
cacgggtgtgggttgcacagacggagtgtcggttgtgggaggtgtaacccattcatacgc

SEQ ID NO: 17815 - DNA, 60 bp, Artificial Sequence
  Description of Artificial Sequence: Synthetic probe
gcgggtggaagattcacgaatttaacaccaaatatggcgagacagctcgatatagcccta

SEQ ID NO: 17816 - DNA, 60 bp, Artificial Sequence
  Description of Artificial Sequence: Synthetic probe
gcttacccacaggggaatacatcgcgcaaaaccaaagaatttcatcgattacgctgaccc

SEQ ID NO: 17817 - DNA, 60 bp, Artificial Sequence
  Description of Artificial Sequence: Synthetic probe
gaggttctgactgattttaggaggcaagacacaattgatgtgccgcgcagctctatcgcc

SEQ ID NO: 17818 - DNA, 51 bp, Artificial Sequence
  Description of Artificial Sequence: Synthetic probe
ctatcgcatatacaatagagtgcaagggtatattgaggcagtgcaattaca

SEQ ID NO: 17819 - DNA, 60 bp, Artificial Sequence
  Description of Artificial Sequence: Synthetic probe
tggcgtaaacccaatgcctgggccgctcacacgtgctattgcacgcgccgcctatgtgta

SEQ ID NO: 17820 - DNA, 60 bp, Artificial Sequence
  Description of Artificial Sequence: Synthetic probe
atggcgtaaacccaatgcctgggccgctcacacgtgctattgcacgcgccgcctatgtgt

SEQ ID NO: 17821 - DNA, 60 bp, Artificial Sequence
  Description of Artificial Sequence: Synthetic probe
acggcgtaaacccaatgcctgggccgctcacacgtgctattgcacgcgccgcctatgtgt

SEQ ID NO: 17822 - DNA, 60 bp, Artificial Sequence
  Description of Artificial Sequence: Synthetic probe
ccaaggcgattcgattaagcaaactaaatgaagcgcacgccaagattgcgcgcgagatgc

SEQ ID NO: 17823 - DNA, 60 bp, Artificial Sequence
  Description of Artificial Sequence: Synthetic probe
gaatcgcggtacataattgcgcggattagggaaatgcgaggtaaagaaaaattgaacgtg

SEQ ID NO: 17824 - DNA, 60 bp, Artificial Sequence
  Description of Artificial Sequence: Synthetic probe
gggaatataggctgaatcattctacccgggagataacgtatgcgcaagggaacccatgtg

SEQ ID NO: 17825 - DNA, 60 bp, Artificial Sequence
  Description of Artificial Sequence: Synthetic probe
gtgacgtttattcgatgatgcgttcatggtatgattggagtgttcgaccgacctatacgc

SEQ ID NO: 17826 - DNA, 60 bp, Artificial Sequence
  Description of Artificial Sequence: Synthetic probe
ccgagcgcctgaagatatttgagcatgggaatcaacgtagagatgaggatcggttctata

SEQ ID NO: 17827 - DNA, 60 bp, Artificial Sequence
  Description of Artificial Sequence: Synthetic probe
gatatcgcgagcttggatgagatatgcaataggtggatacaaagcaggcacgaccccgga

SEQ ID NO: 17828 - DNA, 60 bp, Artificial Sequence
  Description of Artificial Sequence: Synthetic probe
gaggacgcgtcgaaaggatgtttgcatacgaggaccatgatgtggaatcacctggtacgt

SEQ ID NO: 17829 - DNA, 60 bp, Artificial Sequence
  Description of Artificial Sequence: Synthetic probe
gaacgcatatgacatcaagcaggagagcatccgaaccgcattatggtataatccgataag

SEQ ID NO: 17830 - DNA, 60 bp, Artificial Sequence
  Description of Artificial Sequence: Synthetic probe
tacgaaattgcgcgactccaggcaaatatggggcagtttcgtgcagcgttacggcgtatc

SEQ ID NO: 17831 - DNA, 60 bp, Artificial Sequence
  Description of Artificial Sequence: Synthetic probe
taccctcgttacagccgtcacttaaattagcgttggaagaagaagcttgggctgcggcga

SEQ ID NO: 17832 - DNA, 60 bp, Artificial Sequence
  Description of Artificial Sequence: Synthetic probe
gcagaggagattcccggatgttctaatccaagcgaggccgtctcatttctggaaggcggt

SEQ ID NO: 17833 - DNA, 60 bp, Artificial Sequence
  Description of Artificial Sequence: Synthetic probe
gcagcgtatttccgcagtatgttgccttttcacatggtaaggttcgctagaattaaccag

SEQ ID NO: 17834 - DNA, 60 bp, Artificial Sequence
  Description of Artificial Sequence: Synthetic probe
atggttgggcaacaattgatgttgaatatagagaacccgcgccttacgtacatgctcagc

SEQ ID NO: 17835 - DNA, 60 bp, Artificial Sequence
  Description of Artificial Sequence: Synthetic probe
cggcgggaggacgatttactaacctaactcagaatatggcgcgtcagctggatattgcgc

SEQ ID NO: 17836 - DNA, 60 bp, Artificial Sequence
  Description of Artificial Sequence: Synthetic probe
ctcagcgaatcacgacaactgggccttttgcgattttgactggatcaacgccaactgcgc

SEQ ID NO: 17837 - DNA, 60 bp, Artificial Sequence
  Description of Artificial Sequence: Synthetic probe
cactgcagttgcccgtaaatcctcaagtagtctgggacgttcctcggagttcaattgcta

SEQ ID NO: 17838 - DNA, 60 bp, Artificial Sequence
  Description of Artificial Sequence: Synthetic probe
gcgggtagacacatactatgaggagatgtcgcaggtgggtgatgttatcacggaagatga

SEQ ID NO: 17839 - DNA, 60 bp, Artificial Sequence
  Description of Artificial Sequence: Synthetic probe
cgaattcttaaatttagcaatcggtagtacctatacttctccaatgcacgcccgacgtat

SEQ ID NO: 17840 - DNA, 60 bp, Artificial Sequence
  Description of Artificial Sequence: Synthetic probe
gggcgtaccttgaacgaagcatatcgcgaattcttaaatttagcaatcggtagtacctat

SEQ ID NO: 17841 - DNA, 60 bp, Artificial Sequence
  Description of Artificial Sequence: Synthetic probe
gctaaagggcgtaccttgaacgaagcatatcgcgaattcttaaatttagcaatcggtagt

SEQ ID NO: 17842 - DNA, 60 bp, Artificial Sequence
  Description of Artificial Sequence: Synthetic probe
ggcgcggcgcaggaagctaaaggacgtaccttgaacgaagcatatcgcgaattcttaaat

SEQ ID NO: 17843 - DNA, 60 bp, Artificial Sequence
  Description of Artificial Sequence: Synthetic probe
ttaggcgcggcgcaggaagctaaaggacgtaccttgaacgaagcatatcgcgaattctta

SEQ ID NO: 17844 - DNA, 60 bp, Artificial Sequence
  Description of Artificial Sequence: Synthetic probe
agtaccatagggaaggcggcggaaaggttcgcggagagtgaaattggatctgcggcgatt

SEQ ID NO: 17845 - DNA, 60 bp, Artificial Sequence
  Description of Artificial Sequence: Synthetic probe
agcaccatagggaaggcggcggaaaggttcgcggagagtgagattgggtccgcggcaatt

SEQ ID NO: 17846 - DNA, 60 bp, Artificial Sequence
  Description of Artificial Sequence: Synthetic probe
gaaacaatcgtataatgatgcggtgaggatgagttttacagaattttcatcagtcccgct

SEQ ID NO: 17847 - DNA, 60 bp, Artificial Sequence
  Description of Artificial Sequence: Synthetic probe
tgctggtgctagaggtgatgtgcaacagacctttcagggtcgtaatgatcccatgatgat

SEQ ID NO: 17848 - DNA, 60 bp, Artificial Sequence
  Description of Artificial Sequence: Synthetic probe
aatgctggtgctagaggtgatgtgcaacagacctttcagggtcgtaatgatcccatgatg

SEQ ID NO: 17849 - DNA, 60 bp, Artificial Sequence
  Description of Artificial Sequence: Synthetic probe
ggtcgttagtaagtattatttctcgcgtagacacgttagcggaatagtgtctatatgtgt

SEQ ID NO: 17850 - DNA, 60 bp, Artificial Sequence
  Description of Artificial Sequence: Synthetic probe
cctgtagaggtcggagcgtatgcgaacagattcggaataaagagtttcttcaactttacg

SEQ ID NO: 17851 - DNA, 60 bp, Artificial Sequence
  Description of Artificial Sequence: Synthetic probe
cgtgataaacttcttaccgctgttgtttctagtgcaggataatatatcctattggcatag

SEQ ID NO: 17852 - DNA, 60 bp, Artificial Sequence
  Description of Artificial Sequence: Synthetic probe
cttggacgagccgcagcgactagagatgttaaatgttacgtttcctaacttctttcgtca

SEQ ID NO: 17853 - DNA, 60 bp, Artificial Sequence
  Description of Artificial Sequence: Synthetic probe
gagaggcatgatcaactgcgtgatgcaaaggaggcgaggaggattttgtatttaattcaa

SEQ ID NO: 17854 - DNA, 60 bp, Artificial Sequence
  Description of Artificial Sequence: Synthetic probe
gtggtgtgtcctcattcaggtggcgcgctgtatacttttcggagggtggcactgatgctg

SEQ ID NO: 17855 - DNA, 60 bp, Artificial Sequence
  Description of Artificial Sequence: Synthetic probe
gccaacaagaggactttcctacgctgacgagctatgccaaaggtgatgtggtgtgtcctc

SEQ ID NO: 17856 - DNA, 60 bp, Artificial Sequence
  Description of Artificial Sequence: Synthetic probe
gggatgcgctaagctcgaagcagaatcaatcagcggtctttcagtatctgagccaacaag

SEQ ID NO: 17857 - DNA, 60 bp, Artificial Sequence
  Description of Artificial Sequence: Synthetic probe
catcgacagagagtcctgaatacgcccttggacaatatttcgacatgcgtatacaatttt

SEQ ID NO: 17858 - DNA, 60 bp, Artificial Sequence
  Description of Artificial Sequence: Synthetic probe
ctgaatattagatcagaattcgtgctcccaagttatttcgatcaatggatctactcaccc

SEQ ID NO: 17859 - DNA, 60 bp, Artificial Sequence
  Description of Artificial Sequence: Synthetic probe
cgaagagaaatataagacaatgctcgatagaatgatccagggtggttgggatcaggaaag

SEQ ID NO: 17860 - DNA, 60 bp, Artificial Sequence
  Description of Artificial Sequence: Synthetic probe
ggttatatgtgtaagacggagcgggaggatgaagagttagtgtgcaaaattagcgaagag

SEQ ID NO: 17861 - DNA, 60 bp, Artificial Sequence
  Description of Artificial Sequence: Synthetic probe
atgaagttgacggcccagctgagacaacgtatgacaacggttatatgtgtaagacggagc

SEQ ID NO: 17862 - DNA, 60 bp, Artificial Sequence
  Description of Artificial Sequence: Synthetic probe
gccgaattaatctgtttgattcaaatctggatgtgggcgatcaagtagtacattggatgt

SEQ ID NO: 17863 - DNA, 60 bp, Artificial Sequence
  Description of Artificial Sequence: Synthetic probe
ggacaaacccgtatccgtgtctaagaggcgcgctgatagcagcggaatgtgagctcggag

SEQ ID NO: 17864 - DNA, 60 bp, Artificial Sequence
  Description of Artificial Sequence: Synthetic probe
gccttaatagcaattgcggcgaccgatacgcagcgtggtaggatttggaggacaaacccg

SEQ ID NO: 17865 - DNA, 60 bp, Artificial Sequence
  Description of Artificial Sequence: Synthetic probe
aacatatttaacgtcagagcaccggcgacacatgagggtaggttttacgccttaatagca

SEQ ID NO: 17866 - DNA, 60 bp, Artificial Sequence
  Description of Artificial Sequence: Synthetic probe
gcaccaagatacgagcgttggaactatgtaaaatactttcagcgattgggcgtaagatgt

SEQ ID NO: 17867 - DNA, 60 bp, Artificial Sequence
  Description of Artificial Sequence: Synthetic probe
cgcgcggctaaatgtgatcaggacggagtggatcaacgcgcaatttgatagcaccaagat

SEQ ID NO: 17868 - DNA, 60 bp, Artificial Sequence
  Description of Artificial Sequence: Synthetic probe
gaattatgaactgatcacaaattctgagaggaatagtaccgaagaaacttacgcgcctgg

SEQ ID NO: 17869 - DNA, 60 bp, Artificial Sequence
  Description of Artificial Sequence: Synthetic probe
agagtaaagtgaagaagtgtaatcatgccaacctggacctgttaagaagtctgacaaaca

SEQ ID NO: 17870 - DNA, 60 bp, Artificial Sequence
  Description of Artificial Sequence: Synthetic probe
attactcttcgagcttatgacgatagaaaagcaataaaaagcgcacgaggtgtagagttt

SEQ ID NO: 17871 - DNA, 60 bp, Artificial Sequence
  Description of Artificial Sequence: Synthetic probe
actcgttgttaagccactacccgttagccattcgtacagatgttaaaatagcagacaccg

SEQ ID NO: 17872 - DNA, 60 bp, Artificial Sequence
  Description of Artificial Sequence: Synthetic probe
gttaaaagagtgtcccatcatggaggagttcgtcatacccgtctattcggaaacagacat

SEQ ID NO: 17873 - DNA, 50 bp, Artificial Sequence
  Description of Artificial Sequence: Synthetic probe
cactggagcggaggcgttggttacaaccgcgattcatattcatcgctgga

SEQ ID NO: 17874 - DNA, 60 bp, Artificial Sequence
  Description of Artificial Sequence: Synthetic probe
cgcgatcgcagtattgtggaggcgcgggtgaggaaatcaggtgatgagaactggcaaagc

SEQ ID NO: 17875 - DNA, 60 bp, Artificial Sequence
  Description of Artificial Sequence: Synthetic probe
ctacggggtcgcgcgtgatggacgctgctgattgctttcgtaactctgcggatcgcgata

SEQ ID NO: 17876 - DNA, 60 bp, Artificial Sequence
  Description of Artificial Sequence: Synthetic probe
agcttatacgagtacagggggtgatgcgaaaacggagtttctacgtttgttcgatcacct

SEQ ID NO: 17877 - DNA, 60 bp, Artificial Sequence
  Description of Artificial Sequence: Synthetic probe
agcgcccatggcacgtgagaaatgatctaattgcggcgctgagggaatacaaacgaaaaa

SEQ ID NO: 17878 - DNA, 60 bp, Artificial Sequence
  Description of Artificial Sequence: Synthetic probe
cggttggtcagcgcaaagcaaggaacagaaactacgtgatctaaagaggtctgcggcgga

SEQ ID NO: 17879 - DNA, 60 bp, Artificial Sequence
  Description of Artificial Sequence: Synthetic probe
gagggttcgaaatccaaccttacatgagacggccgatgagttaaagcggatgggattgga

SEQ ID NO: 17880 - DNA, 60 bp, Artificial Sequence
  Description of Artificial Sequence: Synthetic probe
tttgccgtttcgttgagagagccgatacccgatcctcctgtacccgacatttctttgtgt

SEQ ID NO: 17881 - DNA, 60 bp, Artificial Sequence
  Description of Artificial Sequence: Synthetic probe
tttgagcaccttcatatcgtgcgtaagaatggattgctgcatgaaagcgatgaaccacga

SEQ ID NO: 17882 - DNA, 60 bp, Artificial Sequence
  Description of Artificial Sequence: Synthetic probe
ggttattcgcacgtagaccgtcacatgcatccagatgcttccgtgatgaaagttgtttca

SEQ ID NO: 17883 - DNA, 60 bp, Artificial Sequence
  Description of Artificial Sequence: Synthetic probe
ttggcagacgtagaatccgtatgcgtaagggatttggtgacgcactgaggaattacgcct

SEQ ID NO: 17884 - DNA, 60 bp, Artificial Sequence
  Description of Artificial Sequence: Synthetic probe
gcggaatggaagttgcggaaccagaagtgttaggcgtggagttcaagaacgtgctgcctg

SEQ ID NO: 17885 - DNA, 60 bp, Artificial Sequence
  Description of Artificial Sequence: Synthetic probe
gcgggatggaagttgcggaaccagaagtgttaggcgtggaattcaagaacgtgctgcccg

SEQ ID NO: 17886 - DNA, 60 bp, Artificial Sequence
  Description of Artificial Sequence: Synthetic probe
cgcatcgtacgcagaagcgtttcgtgatgatgtgaggttgagacagattaaacgacatgt

SEQ ID NO: 17887 - DNA, 60 bp, Artificial Sequence
  Description of Artificial Sequence: Synthetic probe
aggggcgcgggagagcgcggttatgttagtttcaaacagtataaaagatgtggtgcgagc

SEQ ID NO: 17888 - DNA, 60 bp, Artificial Sequence
  Description of Artificial Sequence: Synthetic probe
cgcagtctccagaaagagttgggaatttcccgtgagggagtggccgagcagacggagaga

SEQ ID NO: 17889 - DNA, 60 bp, Artificial Sequence
  Description of Artificial Sequence: Synthetic probe
tatcaagcgctatgcctcaagcgagaggtggattcgatcgcatgattgttacgaagaagc

SEQ ID NO: 17890 - DNA, 60 bp, Artificial Sequence
  Description of Artificial Sequence: Synthetic probe
attcgcatcgtacgcagaagcgtttcgtgatgatgtgaggttgagacaaattaaacggca

SEQ ID NO: 17891 - DNA, 60 bp, Artificial Sequence
  Description of Artificial Sequence: Synthetic probe
gcgtgtcgcatttccacgccaacgagtcgttctttctagggttcgatttgggtattgatg

SEQ ID NO: 17892 - DNA, 60 bp, Artificial Sequence
  Description of Artificial Sequence: Synthetic probe
ccggtaaatccgcaagtagtgtgggatgtgccacgtagctccattgccaacttaatcatg

SEQ ID NO: 17893 - DNA, 60 bp, Artificial Sequence
  Description of Artificial Sequence: Synthetic probe
gctaccggtaaatccgcaagtagtgtgggatgtgccacgtagctccattgccaacttaat

SEQ ID NO: 17894 - DNA, 60 bp, Artificial Sequence
  Description of Artificial Sequence: Synthetic probe
cctgggagcgttaaagtttggctgtaaggttttaggagatcgtctggacgtaccactctt

SEQ ID NO: 17895 - DNA, 60 bp, Artificial Sequence
  Description of Artificial Sequence: Synthetic probe
ctgcgtgggcccatacattttcaaagacgggcgatcctgggagcgttaaagtttggctgt

SEQ ID NO: 17896 - DNA, 60 bp, Artificial Sequence
  Description of Artificial Sequence: Synthetic probe
ttacagatgcatatactgcgtgggcccatacattttcaaagacgggcgatcctgggagcg

SEQ ID NO: 17897 - DNA, 60 bp, Artificial Sequence
  Description of Artificial Sequence: Synthetic probe
caatttacttgggctctttacattatgatatttcttttctagatttacgtgggaacgcgc

SEQ ID NO: 17898 - DNA, 60 bp, Artificial Sequence
  Description of Artificial Sequence: Synthetic probe
aagatggtgcacccaatttacttgggctctttacattatgatatttcttttctagattta

SEQ ID NO: 17899 - DNA, 60 bp, Artificial Sequence
  Description of Artificial Sequence: Synthetic probe
cgcttatgggacgcaaatgcatacgaggaggttggtgagatcaaagatggtgcacccaat

SEQ ID NO: 17900 - DNA, 60 bp, Artificial Sequence
  Description of Artificial Sequence: Synthetic probe
cacattggcacgcgttaggtgcggcacaaatggcgatgggacgtacgctatccgaggcat

SEQ ID NO: 17901 - DNA, 60 bp, Artificial Sequence
  Description of Artificial Sequence: Synthetic probe
acgaggacctcacagcacattggcacgcgttaggtgcggcacaaatggcgatgggacgta

SEQ ID NO: 17902 - DNA, 60 bp, Artificial Sequence
  Description of Artificial Sequence: Synthetic probe
ccttggttttgatttaagcatcgacctagttcattacgaggacctcacagcacattggca

SEQ ID NO: 17903 - DNA, 60 bp, Artificial Sequence
  Description of Artificial Sequence: Synthetic probe
caacgaatcatttttccttggttttgatttaagcatcgacctagttcattacgaggacct

SEQ ID NO: 17904 - DNA, 60 bp, Artificial Sequence
  Description of Artificial Sequence: Synthetic probe
tgggactcagatgacgtattcttctttcattgtatatcgcaccatcacgccaacgaatca

SEQ ID NO: 17905 - DNA, 60 bp, Artificial Sequence
  Description of Artificial Sequence: Synthetic probe
cccaagagctcaacagcctcaaatccacgtgtatagcgctccatgggactcagatgacgt

SEQ ID NO: 17906 - DNA, 60 bp, Artificial Sequence
  Description of Artificial Sequence: Synthetic probe
tcaagatcccaagagctcaacagcctcaaatccacgtgtatagcgctccatgggactcag

SEQ ID NO: 17907 - DNA, 60 bp, Artificial Sequence
  Description of Artificial Sequence: Synthetic probe
agataaaaccatacatccgaaggttatgatgagattcaagatcccaagagctcaacagcc

SEQ ID NO: 17908 - DNA, 60 bp, Artificial Sequence
  Description of Artificial Sequence: Synthetic probe
gggcttgtacaaggaagtgtacactcgatattaacaggtgaatcatatggcgaatccgtt

SEQ ID NO: 17909 - DNA, 60 bp, Artificial Sequence
  Description of Artificial Sequence: Synthetic probe
ggcagcaattgatgggcttgtacaaggaagtgtacactcgatattaacaggtgaatcata

SEQ ID NO: 17910 - DNA, 60 bp, Artificial Sequence
  Description of Artificial Sequence: Synthetic probe
agtacgatcgggaaggcggccgaaagatttgcggagagcgaaattggatcggcagcaatt

SEQ ID NO: 17911 - DNA, 60 bp, Artificial Sequence
  Description of Artificial Sequence: Synthetic probe
atccaagatcacagcaaccgcaaattcatatttatacggcgccatgggattctgatgatg

SEQ ID NO: 17912 - DNA, 60 bp, Artificial Sequence
  Description of Artificial Sequence: Synthetic probe
ttcccagatcacagcaaccgcaaattcatatttatacggcgccatgggattctgatgatg

SEQ ID NO: 17913 - DNA, 60 bp, Artificial Sequence
  Description of Artificial Sequence: Synthetic probe
tagtctctacaattttggagtatcgcgcgaaggatatcccggataatgcgcttgcagtta

SEQ ID NO: 17914 - DNA, 60 bp, Artificial Sequence
  Description of Artificial Sequence: Synthetic probe
cggagacaactatggtaaaagagtatcggaataagatcgacgctcttaagagcgctatag

SEQ ID NO: 17915 - DNA, 60 bp, Artificial Sequence
  Description of Artificial Sequence: Synthetic probe
cgatggtttagtacagggcagtgtacactcgatattgacaggtgagtcttacggtgagtc

SEQ ID NO: 17916 - DNA, 60 bp, Artificial Sequence
  Description of Artificial Sequence: Synthetic probe
cgatcgatggtttagtacagggcagtgtacactcgatattgacaggtgagtcttacggtg

SEQ ID NO: 17917 - DNA, 60 bp, Artificial Sequence
  Description of Artificial Sequence: Synthetic probe
gcggagagcgagatcggttcagcagcgatcgatggtttagtacagggcagtgtacactcg

SEQ ID NO: 17918 - DNA, 50 bp, Artificial Sequence
  Description of Artificial Sequence: Synthetic probe
ggggacgcaagcagaggaaggaaagccatggtgacgcgcagagagaaggt

SEQ ID NO: 17919 - DNA, 54 bp, Artificial Sequence
  Description of Artificial Sequence: Synthetic probe
gcgatatgagtgtggccttcaagataaatgggactaagacagaagtgccttcat

SEQ ID NO: 17920 - DNA, 50 bp, Artificial Sequence
  Description of Artificial Sequence: Synthetic probe
cgtgctattgcacgcgccgcctatgtgtaatccactttgcacgggtgtgg

SEQ ID NO: 17921 - DNA, 60 bp, Artificial Sequence
  Description of Artificial Sequence: Synthetic probe
taatggacttactctacgaggagtgacgatgcgcccaacctcgttagcacagagaaatga

SEQ ID NO: 17922 - DNA, 60 bp, Artificial Sequence
  Description of Artificial Sequence: Synthetic probe
ggctccctctctcatccccattttccgtttgtattcccttaacgcagcaatcagatcatt

SEQ ID NO: 17923 - DNA, 60 bp, Artificial Sequence
  Description of Artificial Sequence: Synthetic probe
ctgcggcggaggtaattgagtggaaggagcagatggccgagcgtccatggcatgtgagaa

SEQ ID NO: 17924 - DNA, 60 bp, Artificial Sequence
  Description of Artificial Sequence: Synthetic probe
ctcaattacttccgccgcagacctctttagatcgcgtagtttttgctccttgttttgcgc

SEQ ID NO: 17925 - DNA, 60 bp, Artificial Sequence
  Description of Artificial Sequence: Synthetic probe
caggtctgtgacataagcgccggacattaatgtgacatataaatgaccagacaaatccaa

SEQ ID NO: 17926 - DNA, 60 bp, Artificial Sequence
  Description of Artificial Sequence: Synthetic probe
cctgatcctcctgtgcctgatatttctttgtgtaggttcatcggactgcgcgtggaatca

SEQ ID NO: 17927 - DNA, 60 bp, Artificial Sequence
  Description of Artificial Sequence: Synthetic probe
cgtgggcgatgaattttgctgtttcgctaaaggaaccgatacctgatcctcctgtgcctg

SEQ ID NO: 17928 - DNA, 60 bp, Artificial Sequence
  Description of Artificial Sequence: Synthetic probe
gtggaggtacccagatatcgtaaagaaagatttgacgtatgaccctgcgtgggcgatgaa

SEQ ID NO: 17929 - DNA, 60 bp, Artificial Sequence
  Description of Artificial Sequence: Synthetic probe
ttcgcgttacccagatctaccgttatgctcaacggatcctaccgcgacatcagaattcta

SEQ ID NO: 17930 - DNA, 60 bp, Artificial Sequence
  Description of Artificial Sequence: Synthetic probe
aaggcgcacggcccacccaagcagtagctatcaccgacttcttcattacctcataaatac

SEQ ID NO: 17931 - DNA, 60 bp, Artificial Sequence
  Description of Artificial Sequence: Synthetic probe
gctccaatcccatattgcaccgattagtcaaataaaacagatccgctcgtggctcatcac

SEQ ID NO: 17932 - DNA, 60 bp, Artificial Sequence
  Description of Artificial Sequence: Synthetic probe
cagatccgctcgtggctcatcactttcgtgtaacaatccattcttacgtacgatatgaag

SEQ ID NO: 17933 - DNA, 60 bp, Artificial Sequence
  Description of Artificial Sequence: Synthetic probe
aatttcatgagattgagaggttactcacacgtggatcgccacatgcatccagacgcttcc

SEQ ID NO: 17934 - DNA, 60 bp, Artificial Sequence
  Description of Artificial Sequence: Synthetic probe
gcggaggatagattgggtgaggaaatagcttatgaaatgggtggtgcattttccagtgca

SEQ ID NO: 17935 - DNA, 60 bp, Artificial Sequence
  Description of Artificial Sequence: Synthetic probe
accacccatttcataagctatctcctcacccaatctatcctccgcaaacctggtcgtctc

SEQ ID NO: 17936 - DNA, 60 bp, Artificial Sequence
  Description of Artificial Sequence: Synthetic probe
tatcgtcagatcgatcgcagatgaatgatcatgagtgggagacaaccaggtttgcggagg

SEQ ID NO: 17937 - DNA, 60 bp, Artificial Sequence
  Description of Artificial Sequence: Synthetic probe
ttggatctggacactcaggtgctattgggtcatatacgtgccataacacccttctaaacc

SEQ ID NO: 17938 - DNA, 60 bp, Artificial Sequence
  Description of Artificial Sequence: Synthetic probe
cataaattttatgtagccgaggatttgcatcgttcaacgtttccgcctccgacccgtgaa

SEQ ID NO: 17939 - DNA, 60 bp, Artificial Sequence
  Description of Artificial Sequence: Synthetic probe
caatgcatcaccaaatcccttgcgcatacggatcctgcgtctgccgatctcattttcaaa

SEQ ID NO: 17940 - DNA, 60 bp, Artificial Sequence
  Description of Artificial Sequence: Synthetic probe
tagctgtacgttcttgtgcgtgcttataaaaatgaatccatgaccccgtaattgtcgtat

SEQ ID NO: 17941 - DNA, 60 bp, Artificial Sequence
  Description of Artificial Sequence: Synthetic probe
cgcgacagacgtatatgcatacggagacgtttcaaagtggacgatacgacaattacgggg

SEQ ID NO: 17942 - DNA, 54 bp, Artificial Sequence
  Description of Artificial Sequence: Synthetic probe
tgatgcgaaaacggagtttctacgtttgttcgatcacctctaaagggtccaggg

SEQ ID NO: 17943 - DNA, 60 bp, Artificial Sequence
  Description of Artificial Sequence: Synthetic probe
tctgggagcgttaaagttcggctgtaaggttttaggagatcgtttagacgtaccactctt

SEQ ID NO: 17944 - DNA, 60 bp, Artificial Sequence
  Description of Artificial Sequence: Synthetic probe
ctacgtggacctatacattttcagagacgagcgattctgggagcgttaaagttcggctgt

SEQ ID NO: 17945 - DNA, 60 bp, Artificial Sequence
  Description of Artificial Sequence: Synthetic probe
ttacagatgcatatactacgtggacctatacattttcagagacgagcgattctgggagcg

SEQ ID NO: 17946 - DNA, 60 bp, Artificial Sequence
  Description of Artificial Sequence: Synthetic probe
ggtgcatccgatttacttgggttctttacattatgatatttcttttccggatttacgggg

SEQ ID NO: 17947 - DNA, 60 bp, Artificial Sequence
  Description of Artificial Sequence: Synthetic probe
ggtgagatcgaagacggtgcatccgatttacttgggttctttacattatgatatttcttt

SEQ ID NO: 17948 - DNA, 60 bp, Artificial Sequence
  Description of Artificial Sequence: Synthetic probe
tgggacgtacgttatccgaggcatataaggagtttttgaatatggcgatatcgaactctt

SEQ ID NO: 17949 - DNA, 50 bp, Artificial Sequence
  Description of Artificial Sequence: Synthetic probe
attgacctagttcactacgaagacctcacagcacattggcacgcgttagg

SEQ ID NO: 17950 - DNA, 60 bp, Artificial Sequence
  Description of Artificial Sequence: Synthetic probe
cgcaccaccacgctaacgaatcattcttccttggttttgatttaagtattgacctagttc

SEQ ID NO: 17951 - DNA, 60 bp, Artificial Sequence
  Description of Artificial Sequence: Synthetic probe
ctccatgggactcggacgacgtgttcttctttcattgtatatcgcaccaccacgctaacg

SEQ ID NO: 17952 - DNA, 60 bp, Artificial Sequence
  Description of Artificial Sequence: Synthetic probe
cgtgtatagtgctccatgggactcggacgacgtgttcttctttcattgtatatcgcacca

SEQ ID NO: 17953 - DNA, 60 bp, Artificial Sequence
  Description of Artificial Sequence: Synthetic probe
tgcggaatagaagataaagtcatacatccgaaggttatgatgagattcaaaattccaaga

SEQ ID NO: 17954 - DNA, 60 bp, Artificial Sequence
  Description of Artificial Sequence: Synthetic probe
attcccgatagcgcattagcagtgagtgttttatcgaagaatcgtgcaattcaggaaaat

SEQ ID NO: 17955 - DNA, 60 bp, Artificial Sequence
  Description of Artificial Sequence: Synthetic probe
gagccgagtgtagtttctactattttagagtatcgcaccaaagatattcccgatagcgca

SEQ ID NO: 17956 - DNA, 60 bp, Artificial Sequence
  Description of Artificial Sequence: Synthetic probe
agtcatcaacgccttgagcggaattgatttgacgcacttgcgcacgccaaaaatagagcc

SEQ ID NO: 17957 - DNA, 60 bp, Artificial Sequence
  Description of Artificial Sequence: Synthetic probe
accgcagtagcgacgggaagggcgattgagggagcttataagctcaaaaaagtcatcaac

SEQ ID NO: 17958 - DNA, 60 bp, Artificial Sequence
  Description of Artificial Sequence: Synthetic probe
atcagaagaggtccctttgattggagcaggtatggccaccgcagtagcgacgggaagggc

SEQ ID NO: 17959 - DNA, 60 bp, Artificial Sequence
  Description of Artificial Sequence: Synthetic probe
tgttagaggcggcatcagaagaggtccctttgattggagcaggtatggccaccgcagtag

SEQ ID NO: 17960 - DNA, 60 bp, Artificial Sequence
  Description of Artificial Sequence: Synthetic probe
tggcatgcaggaagaagccatacaggaaatagccgggatgactgcggatgtgttagaggc

SEQ ID NO: 17961 - DNA, 60 bp, Artificial Sequence
  Description of Artificial Sequence: Synthetic probe
gatgcactaaagaatgcaatcgagattgagagggatggcatgcaggaagaagccatacag

SEQ ID NO: 17962 - DNA, 60 bp, Artificial Sequence
  Description of Artificial Sequence: Synthetic probe
tatcgtaataaaattgatgcactaaagaatgcaatcgagattgagagggatggcatgcag

SEQ ID NO: 17963 - DNA, 51 bp, Artificial Sequence
  Description of Artificial Sequence: Synthetic probe
ggttagctaatgctttacagaaggaaattggcgagagaacacatgcggaga

SEQ ID NO: 17964 - DNA, 60 bp, Artificial Sequence
  Description of Artificial Sequence: Synthetic probe
ggtgacctcatacaacaagatcttaacagaggaagatttgcaaatgaggcggttagctaa

SEQ ID NO: 17965 - DNA, 51 bp, Artificial Sequence
  Description of Artificial Sequence: Synthetic probe
gcattgacttagttcattatgaagatcttaccgcccattggcatgcattgg

SEQ ID NO: 17966 - DNA, 60 bp, Artificial Sequence
  Description of Artificial Sequence: Synthetic probe
catctcacaccatcatgcaaatgagtcgtttttcttaggtttcgacttgagcattgactt

SEQ ID NO: 17967 - DNA, 58 bp, Artificial Sequence
  Description of Artificial Sequence: Synthetic probe
aaaaggtgattaacgctttaagcgggattgatttaacgcatttacgcactccgaaaat

SEQ ID NO: 17968 - DNA, 60 bp, Artificial Sequence
  Description of Artificial Sequence: Synthetic probe
gggagcgtataaactcaaaaaggtgattaacgctttaagcgggattgatttaacgcattt

SEQ ID NO: 17969 - DNA, 60 bp, Artificial Sequence
  Description of Artificial Sequence: Synthetic probe
gcggggatggctacggctgtggcgacagggagggctatagagggagcgtataaactcaaa

SEQ ID NO: 17970 - DNA, 60 bp, Artificial Sequence
  Description of Artificial Sequence: Synthetic probe
ctgattggggcggggatggctacggctgtggcgacagggagggctatagagggagcgtat

SEQ ID NO: 17971 - DNA, 60 bp, Artificial Sequence
  Description of Artificial Sequence: Synthetic probe
aatgtgttggggagtggcgaggaaattcctgatccgctaagcccaggagagcgagggata

SEQ ID NO: 17972 - DNA, 60 bp, Artificial Sequence
  Description of Artificial Sequence: Synthetic probe
gcgaatcttacggcgaatctgtgaaacaagctgtattgttaaatgtgttggggagtggcg

SEQ ID NO: 17973 - DNA, 60 bp, Artificial Sequence
  Description of Artificial Sequence: Synthetic probe
tcataacgggcgaatcttacggcgaatctgtgaaacaagctgtattgttaaatgtgttgg

SEQ ID NO: 17974 - DNA, 60 bp, Artificial Sequence
  Description of Artificial Sequence: Synthetic probe
gtggttgcgctgttgacatcagtttgtaccctttcaagcgatatgagtgtggcctttaag

SEQ ID NO: 17975 - DNA, 60 bp, Artificial Sequence
  Description of Artificial Sequence: Synthetic probe
gcaaaagaaatgcttaagtactatatgaaaaccgacatttttagtggaggcgttcaaaag

SEQ ID NO: 17976 - DNA, 56 bp, Artificial Sequence
  Description of Artificial Sequence: Synthetic probe
tgatttggcctgcgcaggtaggcgctaattataatagatttggtttctgcggtttt

SEQ ID NO: 17977 - DNA, 60 bp, Artificial Sequence
  Description of Artificial Sequence: Synthetic probe
aagtgaggagacgagatatataattcatcagatccgagaattgagaggtgatggcagact

SEQ ID NO: 17978 - DNA, 60 bp, Artificial Sequence
  Description of Artificial Sequence: Synthetic probe
gattgatttattctttgaaaatagacgaacggtacgtccaagtgaggagacgagatatat

SEQ ID NO: 17979 - DNA, 60 bp, Artificial Sequence
  Description of Artificial Sequence: Synthetic probe
accgtcttattaattgacttattctttgaaaatagacgaacggtacgtccaagtgaggag

SEQ ID NO: 17980 - DNA, 60 bp, Artificial Sequence
  Description of Artificial Sequence: Synthetic probe
ggagccactgaagcaatacacacatccggaaatctcaacggagttcggcgaaatatcgtg

SEQ ID NO: 17981 - DNA, 60 bp, Artificial Sequence
  Description of Artificial Sequence: Synthetic probe
gcactacacaagacgttattagatgatcctgaaaatgatagatactatgaagcacgatcg

SEQ ID NO: 17982 - DNA, 60 bp, Artificial Sequence
  Description of Artificial Sequence: Synthetic probe
cgccctgctataatgggtcaaacactgtcaccacgccagaatcagactgcactacacaag

SEQ ID NO: 17983 - DNA, 60 bp, Artificial Sequence
  Description of Artificial Sequence: Synthetic probe
ctcgccctgctataatgggtcaaacactgtcaccacgccagaatcagactgcactacaca

SEQ ID NO: 17984 - DNA, 60 bp, Artificial Sequence
  Description of Artificial Sequence: Synthetic probe
taagcggacgctagccccattgtctgatgatcccgtagcgttacaactgagagctgtagg

SEQ ID NO: 17985 - DNA, 60 bp, Artificial Sequence
  Description of Artificial Sequence: Synthetic probe
aagataacggaaactgaaatcgccaacgcaaaaagctcggaccctgcgattaagcggacg

SEQ ID NO: 17986 - DNA, 60 bp, Artificial Sequence
  Description of Artificial Sequence: Synthetic probe
catggatctatgcgccgatctttagcacgaggtataagataacggaaactgaaatcgcca

SEQ ID NO: 17987 - DNA, 60 bp, Artificial Sequence
  Description of Artificial Sequence: Synthetic probe
catactattatgatacatggatctatgcgccgatctttagcacgaggtataagataacgg

SEQ ID NO: 17988 - DNA, 60 bp, Artificial Sequence
  Description of Artificial Sequence: Synthetic probe
gacgcaaagattactacacagtctgaggtggagtatccatactattatgatacatggatc

SEQ ID NO: 17989 - DNA, 60 bp, Artificial Sequence
  Description of Artificial Sequence: Synthetic probe
ggattttgaaaaggacgcaaagattactacacagtctgaggtggagtatccatactatta

SEQ ID NO: 17990 - DNA, 51 bp, Artificial Sequence
  Description of Artificial Sequence: Synthetic probe
acctgggctgagggatgttctttagctgatgaagcgccagatgatcattta

SEQ ID NO: 17991 - DNA, 60 bp, Artificial Sequence
  Description of Artificial Sequence: Synthetic probe
caaggataaacttattcgatacggataaggcgccaggttcacgtgtaatacactggatac

SEQ ID NO: 17992 - DNA, 60 bp, Artificial Sequence
  Description of Artificial Sequence: Synthetic probe
ctcgtatgtttttacaaggataaacttattcgatacggataaggcgccaggttcacgtgt

SEQ ID NO: 17993 - DNA, 54 bp, Artificial Sequence
  Description of Artificial Sequence: Synthetic probe
atccgtgtttgcgaggcactctaatcgcagcagagtgtgtattgggagatccat

SEQ ID NO: 17994 - DNA, 60 bp, Artificial Sequence
  Description of Artificial Sequence: Synthetic probe
cggacgcgttctcacgacgtatatggcgcactaacccgtatccgtgtttgcgaggcactc

SEQ ID NO: 17995 - DNA, 60 bp, Artificial Sequence
  Description of Artificial Sequence: Synthetic probe
gatctgcgctacggacgcgttctcacgacgtatatggcgcactaacccgtatccgtgttt

SEQ ID NO: 17996 - DNA, 60 bp, Artificial Sequence
  Description of Artificial Sequence: Synthetic probe
ggtagaactgatgatgagagattttacgccttattgctgatctgcgctacggacgcgttc

SEQ ID NO: 17997 - DNA, 60 bp, Artificial Sequence
  Description of Artificial Sequence: Synthetic probe
cgagatggtagtggtagaactgatgatgagagattttacgccttattgctgatctgcgct

SEQ ID NO: 17998 - DNA, 60 bp, Artificial Sequence
  Description of Artificial Sequence: Synthetic probe
gaagaagaacctaaggatgagggagccatgtcgttaaggtttcaggggaagattgacgcg

SEQ ID NO: 17999 - DNA, 60 bp, Artificial Sequence
  Description of Artificial Sequence: Synthetic probe
taagatgaatatggaagaagaacctaaggatgagggagccatgtcgttaaggtttcaggg

SEQ ID NO: 18000 - DNA, 60 bp, Artificial Sequence
  Description of Artificial Sequence: Synthetic probe
gaggtcagagcgctcgacttatgtgtactgctatcaaagattggtcgaattaagatgaat

SEQ ID NO: 18001 - DNA, 60 bp, Artificial Sequence
  Description of Artificial Sequence: Synthetic probe
caacggataatgaaggcaaccagctaccacgtgcgctagacattgcattatgtgcgcggc

SEQ ID NO: 18002 - DNA, 60 bp, Artificial Sequence
  Description of Artificial Sequence: Synthetic probe
agatgtaccaaatggtgaagccagatctgatctgaattacaacccaacggataatgaagg

SEQ ID NO: 18003 - DNA, 51 bp, Artificial Sequence
  Description of Artificial Sequence: Synthetic probe
actcgaaggatatgatattaaggtcgacttgagtgatagggtggtgcaaga

SEQ ID NO: 18004 - DNA, 53 bp, Artificial Sequence
  Description of Artificial Sequence: Synthetic probe
gttaaaagcttctcaggatggatgagttcggtgttccgatatttcggtcgagc

SEQ ID NO: 18005 - DNA, 60 bp, Artificial Sequence
  Description of Artificial Sequence: Synthetic probe
acatgagcttaatcatattgccggtcggtgtttaggcgcttgtgaccgcgtggttagggg

SEQ ID NO: 18006 - DNA, 60 bp, Artificial Sequence
  Description of Artificial Sequence: Synthetic probe
tcctaaaaaatgcatcgttctaataattgtgggagacgacaaattggaaccgcatacgcg

SEQ ID NO: 18007 - DNA, 60 bp, Artificial Sequence
  Description of Artificial Sequence: Synthetic probe
acattaagtcccctgcggagtcgttagattttgttctcgggccctactacgatctgcggc

SEQ ID NO: 18008 - DNA, 60 bp, Artificial Sequence
  Description of Artificial Sequence: Synthetic probe
gagctatgcagtatcctttccacgattgggcgtaagatgctaaatacgcatgaggagccg

SEQ ID NO: 18009 - DNA, 60 bp, Artificial Sequence
  Description of Artificial Sequence: Synthetic probe
ctggaggagacttatgtggtaggacagccaaaatggatacacttgactagaggaacgcga

SEQ ID NO: 18010 - DNA, 58 bp, Artificial Sequence
  Description of Artificial Sequence: Synthetic probe
aagatgagattccatatgcgttactaagcagataccctctggcgatacagacaaatgt

SEQ ID NO: 18011 - DNA, 60 bp, Artificial Sequence
  Description of Artificial Sequence: Synthetic probe
cgagaccgtctcatttctggaaggcggttttgaatgatagccccgaagcggtcaaggccg

SEQ ID NO: 18012 - DNA, 60 bp, Artificial Sequence
  Description of Artificial Sequence: Synthetic probe
gcgacatctttcgttgatgcagaggagatttccagatgtcctaatccaggcgagaccgtc

SEQ ID NO: 18013 - DNA, 60 bp, Artificial Sequence
  Description of Artificial Sequence: Synthetic probe
tgcccgtgaatcctcaggtggtttgggacgttcctcggagctcgattgctaatcttatta

SEQ ID NO: 18014 - DNA, 58 bp, Artificial Sequence
  Description of Artificial Sequence: Synthetic probe
tcgatcacctctaaagggtccagggtaccttcttgacgtagggcgatttcatacttac

SEQ ID NO: 18015 - DNA, 54 bp, Artificial Sequence
  Description of Artificial Sequence: Synthetic probe
tcgatcacctctaaagggtccagggtaccttcttgacgtagggcgatttctttt

SEQ ID NO: 18016 - DNA, 60 bp, Artificial Sequence
  Description of Artificial Sequence: Synthetic probe
gatcgatcacctctaaagggtccagggtaccttcttgacgtagggcgatttcatacttac

SEQ ID NO: 18017 - DNA, 60 bp, Artificial Sequence
  Description of Artificial Sequence: Synthetic probe
catttgatcgatcacctctaaagggtccagggtaccttcttgacgtagggcgatttcata

SEQ ID NO: 18018 - DNA, 60 bp, Artificial Sequence
  Description of Artificial Sequence: Synthetic probe
cgcatgctaaggctgctgagaagggaaggcgtaaacaggggaagaagcctcatggcgatg

SEQ ID NO: 18019 - DNA, 60 bp, Artificial Sequence
  Description of Artificial Sequence: Synthetic probe
gcgggtatggccacagccgtagcgaccggtagagcaatagagggcgcgtataagttgaag

SEQ ID NO: 18020 - DNA, 60 bp, Artificial Sequence
  Description of Artificial Sequence: Synthetic probe
acgcatgctaaagccgttgagagagggggacgcaagcagaggaaggaaagccatggtgac

SEQ ID NO: 18021 - DNA, 60 bp, Artificial Sequence
  Description of Artificial Sequence: Synthetic probe
gacgggaacaggatataatggttgggcgacgattgatgtcgagtatagagagcctgcgcc

SEQ ID NO: 18022 - DNA, 60 bp, Artificial Sequence
  Description of Artificial Sequence: Synthetic probe
cctctgttctttctggtgagcgataatattatatacacacacaaacaatggtctgtaccg

SEQ ID NO: 18023 - DNA, 60 bp, Artificial Sequence
  Description of Artificial Sequence: Synthetic probe
tatcttaattttctacctctgttctttctggtgagcgataatattatatacacacacaaa

SEQ ID NO: 18024 - DNA, 60 bp, Artificial Sequence
  Description of Artificial Sequence: Synthetic probe
tgtgcacgctgaaaggagagatcggagtcaacccttccgacctggtgatcaaacattaat

SEQ ID NO: 18025 - DNA, 60 bp, Artificial Sequence
  Description of Artificial Sequence: Synthetic probe
atagcttacgctctgaagcctacatatgatatcgttgtgcacgctgaaaggagagatcgg

SEQ ID NO: 18026 - DNA, 60 bp, Artificial Sequence
  Description of Artificial Sequence: Synthetic probe
catgcagctcaagagatagcttacgctctgaagcctacatatgatatcgttgtgcacgct

SEQ ID NO: 18027 - DNA, 60 bp, Artificial Sequence
  Description of Artificial Sequence: Synthetic probe
gagtttacgattgactccagtacgaagatacaaagtgttggtgggcgccatgacgttaca

SEQ ID NO: 18028 - DNA, 60 bp, Artificial Sequence
  Description of Artificial Sequence: Synthetic probe
gagttgaagagctgagtttagtgcgtgtggatgataccatttctcaaccaccaaggtatg

SEQ ID NO: 18029 - DNA, 60 bp, Artificial Sequence
  Description of Artificial Sequence: Synthetic probe
gacggttcctgtcctcatctatacggagggagtcatgatttggccggcgcaggttggtgc

SEQ ID NO: 18030 - DNA, 60 bp, Artificial Sequence
  Description of Artificial Sequence: Synthetic probe
cgtttggaagggctttagacgtagtaaacagggcaacggacgtcgcgcatatcaccgcgc

SEQ ID NO: 18031 - DNA, 60 bp, Artificial Sequence
  Description of Artificial Sequence: Synthetic probe
tcgccctgccatcatgggctctacgttatcagcgcggcaggcacagacatccctacataa

SEQ ID NO: 18032 - DNA, 60 bp, Artificial Sequence
  Description of Artificial Sequence: Synthetic probe
aaagcgatcgagttatgcacactgctctcgcggatagggaggttgaagatggatatggaa

SEQ ID NO: 18033 - DNA, 60 bp, Artificial Sequence
  Description of Artificial Sequence: Synthetic probe
gtggatggaatggatgcttttagacgcgatggacgttcaacccctgaaaatcgattttgc

SEQ ID NO: 18034 - DNA, 60 bp, Artificial Sequence
  Description of Artificial Sequence: Synthetic probe
cgttttagaagattatgaacttagaattgatttgagtgatcgggtcgtacatggagggga

SEQ ID NO: 18035 - DNA, 60 bp, Artificial Sequence
  Description of Artificial Sequence: Synthetic probe
taattgcagcgttgagggagtacaaacggaaaatggggataagagagggtgcctcgatcg

SEQ ID NO: 18036 - DNA, 60 bp, Artificial Sequence
  Description of Artificial Sequence: Synthetic probe
cccgatccccctgtgcccgatatctccctatgcagatttatcggactgcgcgttgagtca

SEQ ID NO: 18037 - DNA, 60 bp, Artificial Sequence
  Description of Artificial Sequence: Synthetic probe
gcgactgatgtatatgcatacggagatgtatcaaagtggacgatacggcaactacggggt

SEQ ID NO: 18038 - DNA, 60 bp, Artificial Sequence
  Description of Artificial Sequence: Synthetic probe
cccttatcccatagacatttacgaggcattgtccagatctctgtacggccagatcgcacc

SEQ ID NO: 18039 - DNA, 60 bp, Artificial Sequence
  Description of Artificial Sequence: Synthetic probe
ggtacctcccgattacccatccagttaagtgtttagttgcgcttgaggtgtcggactcgc

SEQ ID NO: 18040 - DNA, 60 bp, Artificial Sequence
  Description of Artificial Sequence: Synthetic probe
ggatgattcagcttacaagattgagggaacgttgtatgatgtctcgcaggtggtggttca

SEQ ID NO: 18041 - DNA, 60 bp, Artificial Sequence
  Description of Artificial Sequence: Synthetic probe
tgtttaatgcaaaagtgaaaccatgcgaagtcgagttagcgcaacgaaagaatgaagacc

SEQ ID NO: 18042 - DNA, 60 bp, Artificial Sequence
  Description of Artificial Sequence: Synthetic probe
cgtctgaatgcaagcttggtgacgtgtaccataaattacgggcgtggtatgagtggagcg

SEQ ID NO: 18043 - DNA, 60 bp, Artificial Sequence
  Description of Artificial Sequence: Synthetic probe
acaaccgatccagaaagaaacgttatttttacacacaaaacacaccgtacgaatcaagat

SEQ ID NO: 18044 - DNA, 60 bp, Artificial Sequence
  Description of Artificial Sequence: Synthetic probe
ggattggcgaacataatttttacaccataacacggaatcaccacatgcgtttaggcgata

SEQ ID NO: 18045 - DNA, 60 bp, Artificial Sequence
  Description of Artificial Sequence: Synthetic probe
cgggatgttctcaaacacgttacacatcgattcgaggaaagcggataccacgtcatatca

SEQ ID NO: 18046 - DNA, 60 bp, Artificial Sequence
  Description of Artificial Sequence: Synthetic probe
gaaaaagagcatgatgaagaaggatggagtcgattttgtatccaacacgagatggttaga

SEQ ID NO: 18047 - DNA, 60 bp, Artificial Sequence
  Description of Artificial Sequence: Synthetic probe
ggcgttacgattacgtcattgaactgacggaaccagaggacggcgagtggagtggccacg

SEQ ID NO: 18048 - DNA, 60 bp, Artificial Sequence
  Description of Artificial Sequence: Synthetic probe
gaggaccgttacacttccagcgccgagcaatattaggtgcgttaaaattcggagttaaga

SEQ ID NO: 18049 - DNA, 60 bp, Artificial Sequence
  Description of Artificial Sequence: Synthetic probe
agtttacgatgatgaattgcaaatgcatatacttagaggaccgttacacttccagcgccg

SEQ ID NO: 18050 - DNA, 60 bp, Artificial Sequence
  Description of Artificial Sequence: Synthetic probe
atctttttaggttcaatgcattacgatataacttatgaagctctgaagaataatgcgcag

SEQ ID NO: 18051 - DNA, 60 bp, Artificial Sequence
  Description of Artificial Sequence: Synthetic probe
gaagatttaaccagtcactggcacgcgttagggatggcacaagaggccagtggacggact

SEQ ID NO: 18052 - DNA, 60 bp, Artificial Sequence
  Description of Artificial Sequence: Synthetic probe
ttcttctttcactgtgtgtcttaccatcatcggaatgaatcattctttctaggctttgat

SEQ ID NO: 18053 - DNA, 61 bp, Artificial Sequence
  Description of Artificial Sequence: Synthetic probe
ggctgataattgcaacgagattgctcatattaaacaagagatactaccaaagtttaaacag

SEQ ID NO: 18054 - DNA, 60 bp, Artificial Sequence
  Description of Artificial Sequence: Synthetic probe
gcgaagccccaagatcgaacctactattatcgccacaactcttgagcataggtttaaaga

SEQ ID NO: 18055 - DNA, 60 bp, Artificial Sequence
  Description of Artificial Sequence: Synthetic probe
agaggcggcatcagaagaagtgcctttgataggtgccggtatggcaacggctgtcgcaac

SEQ ID NO: 18056 - DNA, 60 bp, Artificial Sequence
  Description of Artificial Sequence: Synthetic probe
atgcaggaagaggctatacaagagatcgctggaatgacagcagacgtgctagaggcggca

SEQ ID NO: 18057 - DNA, 60 bp, Artificial Sequence
  Description of Artificial Sequence: Synthetic probe
gcgcttaaaagtgcgatagagattgagcgtgatggaatgcaggaagaggctatacaagag

SEQ ID NO: 18058 - DNA, 60 bp, Artificial Sequence
  Description of Artificial Sequence: Synthetic probe
gacagaagattgatgcgcttaaaagtgcgatagagattgagcgtgatggaatgcaggaag

SEQ ID NO: 18059 - DNA, 60 bp, Artificial Sequence
  Description of Artificial Sequence: Synthetic probe
cgaagatggctattttagcgcgtgcgttacaacgagaggcagcggaaagaagtgaagatg

SEQ ID NO: 18060 - DNA, 58 bp, Artificial Sequence
  Description of Artificial Sequence: Synthetic probe
taaagagctcggagaagtttatgacttcatgaatggggaggcaaaagaagtggaggcg

SEQ ID NO: 18061 - DNA, 60 bp, Artificial Sequence
  Description of Artificial Sequence: Synthetic probe
gagaatcgtatggggaatcggtgaaacaggcggtcctattgaatgtgttgggtacaggcg

SEQ ID NO: 18062 - DNA, 60 bp, Artificial Sequence
  Description of Artificial Sequence: Synthetic probe
caacgattggaaaagcagcggaacgttttgcagaaagtgaaataggtgcggcaacgattg

SEQ ID NO: 18063 - DNA, 60 bp, Artificial Sequence
  Description of Artificial Sequence: Synthetic probe
tccccttagggatgcaagttatggctgacttcgtaaaccgttttgattcaccattccacc

SEQ ID NO: 18064 - DNA, 53 bp, Artificial Sequence
  Description of Artificial Sequence: Synthetic probe
gagtggcgccccgaggtctgtgtcgtgtagagtggtgatctcacgatgcgact

SEQ ID NO: 18065 - DNA, 60 bp, Artificial Sequence
  Description of Artificial Sequence: Synthetic probe
gtccacttagcacgggtgtgggttacacatacggtgtgtcggttgtgggaggtgtaaccc

SEQ ID NO: 18066 - DNA, 60 bp, Artificial Sequence
  Description of Artificial Sequence: Synthetic probe
ttatgtgtagtccacttagcacgggtgtgggttacacatacggtgtgtcggttgtgggag

SEQ ID NO: 18067 - DNA, 60 bp, Artificial Sequence
  Description of Artificial Sequence: Synthetic probe
cgatggctcaagggaattcacagcaaacgctggccggcgtgacagttaacgtcggaggtg

SEQ ID NO: 18068 - DNA, 60 bp, Artificial Sequence
  Description of Artificial Sequence: Synthetic probe
cgcgatggctcaagggaattcacagcaaacgctggccggcgtgacagttaacgtcggagg

SEQ ID NO: 18069 - DNA, 60 bp, Artificial Sequence
  Description of Artificial Sequence: Synthetic probe
ccggcgcgtcaaccatatggtttctttcttgaaacagaggaaacgtatcagcctggtcgt

SEQ ID NO: 18070 - DNA, 60 bp, Artificial Sequence
  Description of Artificial Sequence: Synthetic probe
gagatcgcacgtgtaactggagagacgtcaacgtggggaccggcgcgtcaaccatatggt

SEQ ID NO: 18071 - DNA, 60 bp, Artificial Sequence
  Description of Artificial Sequence: Synthetic probe
aagctgcgaatgagatcgcacgtgtaactggagagacgtcaacgtggggaccggcgcgtc

SEQ ID NO: 18072 - DNA, 60 bp, Artificial Sequence
  Description of Artificial Sequence: Synthetic probe
tcagcggctgggataaatgttggaccaatatcaccagattacacgcagcatatggcgaca

SEQ ID NO: 18073 - DNA, 60 bp, Artificial Sequence
  Description of Artificial Sequence: Synthetic probe
ggtattgcaattaacagatataatggattaacccttcgtggagttacaatgcgcccgaca

SEQ ID NO: 18074 - DNA, 60 bp, Artificial Sequence
  Description of Artificial Sequence: Synthetic probe
ttaggtattgcaattaacagatataatggattaacccttcgtggagttacaatgcgcccg

SEQ ID NO: 18075 - DNA, 60 bp, Artificial Sequence
  Description of Artificial Sequence: Synthetic probe
ggtcatgagtcaaaagaagctcttgagcatgataggtggcgtggagagaaagatggctcc

SEQ ID NO: 18076 - DNA, 60 bp, Artificial Sequence
  Description of Artificial Sequence: Synthetic probe
tagaaggggtcatgagtcaaaagaagctcttgagcatgataggtggcgtggagagaaaga

SEQ ID NO: 18077 - DNA, 60 bp, Artificial Sequence
  Description of Artificial Sequence: Synthetic probe
gggaagagagttcatggtgacgcgcagaaggagagtaccgaggatgagaaaacacccgag

SEQ ID NO: 18078 - DNA, 60 bp, Artificial Sequence
  Description of Artificial Sequence: Synthetic probe
ggaagacgcaaacaagggaagagagttcatggtgacgcgcagaaggagagtaccgaggat

SEQ ID NO: 18079 - DNA, 60 bp, Artificial Sequence
  Description of Artificial Sequence: Synthetic probe
cagagacagattcaaattaatatgattgattgggcggagagtgaaagtggaaaagggagt

SEQ ID NO: 18080 - DNA, 55 bp, Artificial Sequence
  Description of Artificial Sequence: Synthetic probe
gtgtgttggttgtggggagtgtgacccattcaaacgtctcttagattacacttac

SEQ ID NO: 18081 - DNA, 60 bp, Artificial Sequence
  Description of Artificial Sequence: Synthetic probe
gcacgggtgtgggttacacaggcggtgtgttggttgtggggagtgtgacccattcatacg

SEQ ID NO: 18082 - DNA, 60 bp, Artificial Sequence
  Description of Artificial Sequence: Synthetic probe
gctggtgtcactgtgagcgtgggtggtgtggacatgagagcggggcgcataatcgcatgg

SEQ ID NO: 18083 - DNA, 60 bp, Artificial Sequence
  Description of Artificial Sequence: Synthetic probe
gctggcgtcaccgtgagcgtgggtggtgtggacatgagagcgggacgtataatcgcgtgg

SEQ ID NO: 18084 - DNA, 60 bp, Artificial Sequence
  Description of Artificial Sequence: Synthetic probe
tgcaattgcacgcgccgcttacgcatagtccactttgcacgggtgtgggttatgtggagg

SEQ ID NO: 18085 - DNA, 60 bp, Artificial Sequence
  Description of Artificial Sequence: Synthetic probe
cacggtgtaaatccaatgcctggcccgctcacacgtgcaattgcacgcgccgcttacgca

SEQ ID NO: 18086 - DNA, 60 bp, Artificial Sequence
  Description of Artificial Sequence: Synthetic probe
ctgagtttgcaatacacggtgtaaatccaatgcctggcccgctcacacgtgcaattgcac

SEQ ID NO: 18087 - DNA, 60 bp, Artificial Sequence
  Description of Artificial Sequence: Synthetic probe
cctgagtttgcaatacacggtgtaaatccaatgcctggcccgctcacacgtgcaattgca

SEQ ID NO: 18088 - DNA, 60 bp, Artificial Sequence
  Description of Artificial Sequence: Synthetic probe
gcctgagtttgcaatacacggtgtaaatccaatgcctggcccgctcacacgtgcaattgc

SEQ ID NO: 18089 - DNA, 60 bp, Artificial Sequence
  Description of Artificial Sequence: Synthetic probe
aggcctgagtttgcaatacacggtgtaaatccaatgcctggcccgctcacacgtgcaatt

SEQ ID NO: 18090 - DNA, 60 bp, Artificial Sequence
  Description of Artificial Sequence: Synthetic probe
tgtcgacgctcgcggatgtttattcggtgttgaggcctgagtttgcaatacacggtgtaa

SEQ ID NO: 18091 - DNA, 60 bp, Artificial Sequence
  Description of Artificial Sequence: Synthetic probe
taacaattttactactgtcgacgctcgcggatgtttattcggtgttgagacctgagtttg

SEQ ID NO: 18092 - DNA, 60 bp, Artificial Sequence
  Description of Artificial Sequence: Synthetic probe
tttctatgcctcaaggtaactcacagcggacgttagcaggagtgacagtaagtgtagggg

SEQ ID NO: 18093 - DNA, 60 bp, Artificial Sequence
  Description of Artificial Sequence: Synthetic probe
tgaaaatttttctatgcctcaaggtaactcacagcggacgttagcaggagtgacagtgag

SEQ ID NO: 18094 - DNA, 60 bp, Artificial Sequence
  Description of Artificial Sequence: Synthetic probe
aaggattgaaaatttttctatgcctcaaggtaactcacagcggacgttagcaggagtgac

SEQ ID NO: 18095 - DNA, 60 bp, Artificial Sequence
  Description of Artificial Sequence: Synthetic probe
cgcctgtggtttgcggcccggatatgatccaggtttcattgaacgcaggagcaagaggtg

SEQ ID NO: 18096 - DNA, 61 bp, Artificial Sequence
  Description of Artificial Sequence: Synthetic probe
cgaatgtaatggaaattttgggaatagctatcaatagatataatggattgactttgcgtgg

SEQ ID NO: 18097 - DNA, 60 bp, Artificial Sequence
  Description of Artificial Sequence: Synthetic probe
gcgaatgtaatggaaattttgggaatagctatcaacaggtataatggattgactttgcgt

SEQ ID NO: 18098 - DNA, 60 bp, Artificial Sequence
  Description of Artificial Sequence: Synthetic probe
aattgtattagaagcgaatgtaatggaaattttgggaatagctatcaatagatataatgg

SEQ ID NO: 18099 - DNA, 60 bp, Artificial Sequence
  Description of Artificial Sequence: Synthetic probe
gaggcaagaatcgtattagaagcgaatgtaatggaaattttgggaatagctatcaatagg

SEQ ID NO: 18100 - DNA, 60 bp, Artificial Sequence
  Description of Artificial Sequence: Synthetic probe
gttacaagaggcaagaatcgtattagaagcgaatgtaatggaaattttgggaatagctat

SEQ ID NO: 18101 - DNA, 60 bp, Artificial Sequence
  Description of Artificial Sequence: Synthetic probe
cacattcaccgctggattagaggctgtggcatctggaacgatgagggatggcaggagggt

SEQ ID NO: 18102 - DNA, 60 bp, Artificial Sequence
  Description of Artificial Sequence: Synthetic probe
ccagatgatgttctgcaaggtttacccttcagttatgatactaacgaaagaggtgggtta

SEQ ID NO: 18103 - DNA, 60 bp, Artificial Sequence
  Description of Artificial Sequence: Synthetic probe
cctcgttacagccgtcacttaagttggcgctggaagaagaagcttgggctgcggcgaatg

SEQ ID NO: 18104 - DNA, 60 bp, Artificial Sequence
  Description of Artificial Sequence: Synthetic probe
gcagaggagattcccggatgttttgatccaagcgagaccctctcatttctggaaggcggt

SEQ ID NO: 18105 - DNA, 60 bp, Artificial Sequence
  Description of Artificial Sequence: Synthetic probe
ccaaggatttcttcaatcacgctcacccaacgaatcacgacgactgggccctttgcgata

SEQ ID NO: 18106 - DNA, 60 bp, Artificial Sequence
  Description of Artificial Sequence: Synthetic probe
cgacgtgtttgcctacgggagaatatatagcaccaaatccaaggatttcttcaatcacgc

SEQ ID NO: 18107 - DNA, 51 bp, Artificial Sequence
  Description of Artificial Sequence: Synthetic probe
tggttagaacggttaggtcacagaaagaggatcacctattcgcaagaggtg

SEQ ID NO: 18108 - DNA, 50 bp, Artificial Sequence
  Description of Artificial Sequence: Synthetic probe
cctcttcttacgaaatgcatgaacgcagcgagggagatgcttacacttac

SEQ ID NO: 18109 - DNA, 50 bp, Artificial Sequence
  Description of Artificial Sequence: Synthetic probe
cctcttcttacgaaatgcatgaacgcagcgagggagaaacttacacttac

SEQ ID NO: 18110 - DNA, 50 bp, Artificial Sequence
  Description of Artificial Sequence: Synthetic probe
cctcttcttacgaaatgcatgaacgcagcgagggagaagcttacactcac

SEQ ID NO: 18111 - DNA, 60 bp, Artificial Sequence
  Description of Artificial Sequence: Synthetic probe
gctatgctatctaaaacattcaaagcagatgcaaacgtgtggtgtgatcgatgtgcgtgc

SEQ ID NO: 18112 - DNA, 60 bp, Artificial Sequence
  Description of Artificial Sequence: Synthetic probe
ccacgcgcgaccgcagtattgtggaatcacgcgtgaagagatcgggtgatgaaaactggc

SEQ ID NO: 18113 - DNA, 60 bp, Artificial Sequence
  Description of Artificial Sequence: Synthetic probe
ccccacgcgcgaccgcagtattgtggaatcacgcgtgaagagatcgggtgatgaaaactg

SEQ ID NO: 18114 - DNA, 60 bp, Artificial Sequence
  Description of Artificial Sequence: Synthetic probe
atgataaattttttgagaatggatgatttcgcgaagcacttcaatagatatgcttcgatg

SEQ ID NO: 18115 - DNA, 60 bp, Artificial Sequence
  Description of Artificial Sequence: Synthetic probe
attcaggctacaatggtagggtttttcaagtgatgtacttaccaatccaaatgataaatt

SEQ ID NO: 18116 - DNA, 60 bp, Artificial Sequence
  Description of Artificial Sequence: Synthetic probe
acacaatcagattaaacgggaagtagagagacaaattaatacatgtccttattcaggcta

SEQ ID NO: 18117 - DNA, 60 bp, Artificial Sequence
  Description of Artificial Sequence: Synthetic probe
gacggtttggctccaatgtttcaaaagcttttcccaaccgtacgaagaggacatcgaagg

SEQ ID NO: 18118 - DNA, 60 bp, Artificial Sequence
  Description of Artificial Sequence: Synthetic probe
gacggagtttctgcatttgatcgatcacctctaaagggtccagggtaccttcttgacgta

SEQ ID NO: 18119 - DNA, 60 bp, Artificial Sequence
  Description of Artificial Sequence: Synthetic probe
gatcctaatacagactccgggctacgtcttcggtaacgacgaactacttacgaaactctt

SEQ ID NO: 18120 - DNA, 60 bp, Artificial Sequence
  Description of Artificial Sequence: Synthetic probe
ggcggtcccagttattttctatgcagataaaatcatgatcatcccggcggaagtaggcgc

SEQ ID NO: 18121 - DNA, 60 bp, Artificial Sequence
  Description of Artificial Sequence: Synthetic probe
cgctaggataaagccgtgtgaagtagaggtgggtgagcgtaagaatatcgatccctatgt

SEQ ID NO: 18122 - DNA, 60 bp, Artificial Sequence
  Description of Artificial Sequence: Synthetic probe
ccaatccatacccctgcttgcgaggcgcgttaattgcggctgagtgtaaattaggtgacg

SEQ ID NO: 18123 - DNA, 60 bp, Artificial Sequence
  Description of Artificial Sequence: Synthetic probe
cgaggaaagcggataccacatcatacaatatactcgctctcgagacgaaggaaggagcac

SEQ ID NO: 18124 - DNA, 60 bp, Artificial Sequence
  Description of Artificial Sequence: Synthetic probe
tggggcgttatgattatgtgattgagttggcgaggccagagggcgatgagtggagtggcc

SEQ ID NO: 18125 - DNA, 60 bp, Artificial Sequence
  Description of Artificial Sequence: Synthetic probe
gtgaaaccatgcgaagtcgagttagcgcaacgaaagaatgaagacccttacgtaaagcga

SEQ ID NO: 18126 - DNA, 60 bp, Artificial Sequence
  Description of Artificial Sequence: Synthetic probe
gtgaaaccatgcgaagtcgagttagcgcaacgaaagaatgaagacccttacgtgaagcga

SEQ ID NO: 18127 - DNA, 60 bp, Artificial Sequence
  Description of Artificial Sequence: Synthetic probe
tgtttaatgcgaaagtgaaaccatgcgaagtcgagttagcgcaacgaaagaatgaagacc

SEQ ID NO: 18128 - DNA, 60 bp, Artificial Sequence
  Description of Artificial Sequence: Synthetic probe
tccaccatatttcaacaaatggacgcacgctccaatgtttaatgcaaaagtgaaaccatg

SEQ ID NO: 18129 - DNA, 60 bp, Artificial Sequence
  Description of Artificial Sequence: Synthetic probe
gtcacaagttatatttccaccatatttcaacaaatggacgcacgctccaatgtttaatgc

SEQ ID NO: 18130 - DNA, 60 bp, Artificial Sequence
  Description of Artificial Sequence: Synthetic probe
atcacaagttatatttccaccatatttcaacaaatggacgcacgctccaatgtttaatgc

SEQ ID NO: 18131 - DNA, 60 bp, Artificial Sequence
  Description of Artificial Sequence: Synthetic probe
attaataaagtgtatcagataacaaatcatacgggaaatcattgtgatttgtatcctgat

SEQ ID NO: 18132 - DNA, 60 bp, Artificial Sequence
  Description of Artificial Sequence: Synthetic probe
catggtatgagtggagcgtaagacctgaatataaaccgcgagatttggaacgagaacaag

SEQ ID NO: 18133 - DNA, 60 bp, Artificial Sequence
  Description of Artificial Sequence: Synthetic probe
gtggtatgagtggagcgtaagacctgaatataaaccgcgagatttggagcgagaacaaga

SEQ ID NO: 18134 - DNA, 60 bp, Artificial Sequence
  Description of Artificial Sequence: Synthetic probe
ggtggtcaaacccttatccatgtttacgtggcgcgttgatcgcgtctgaatgcaagcctg

SEQ ID NO: 18135 - DNA, 60 bp, Artificial Sequence
  Description of Artificial Sequence: Synthetic probe
cggcttcgcgcgagatttcccttaagcgcagtgcatctgaaaggaatagtgattctttcg

SEQ ID NO: 18136 - DNA, 60 bp, Artificial Sequence
  Description of Artificial Sequence: Synthetic probe
cgaagcgtcgtttctaccaagcagatactttacgaaacttatctatcatcactatgcggt

SEQ ID NO: 18137 - DNA, 60 bp, Artificial Sequence
  Description of Artificial Sequence: Synthetic probe
gcggattcaatgtggtttctcccggtggaggtaggggcgttctataatcgatttggtgtc

SEQ ID NO: 18138 - DNA, 60 bp, Artificial Sequence
  Description of Artificial Sequence: Synthetic probe
tacagtgcgagatatcgatagcgctagatggacgatcgaattgatcagacgagtgagggg

SEQ ID NO: 18139 - DNA, 60 bp, Artificial Sequence
  Description of Artificial Sequence: Synthetic probe
tacgtattggagaaaacggctttattttggatcgacgttatggagaagcatgttggggac

SEQ ID NO: 18140 - DNA, 60 bp, Artificial Sequence
  Description of Artificial Sequence: Synthetic probe
agttgaaattgcgcaggccaaaagtgacgatccggacgtagtgagaaccttagcacctat

SEQ ID NO: 18141 - DNA, 60 bp, Artificial Sequence
  Description of Artificial Sequence: Synthetic probe
gatgcgagtcctggtacaaagataatacattggacatacgatctgattacgcgggagagt

SEQ ID NO: 18142 - DNA, 60 bp, Artificial Sequence
  Description of Artificial Sequence: Synthetic probe
acgaatggagtgtaagaccagcatattccccgaggttgagggagcgtgaggatgacaaat

SEQ ID NO: 18143 - DNA, 60 bp, Artificial Sequence
  Description of Artificial Sequence: Synthetic probe
ttacgttctaatcatgatagcagcatcggacacgtataacagccgtatctggtggacgaa

SEQ ID NO: 18144 - DNA, 60 bp, Artificial Sequence
  Description of Artificial Sequence: Synthetic probe
ctgtcgggtataggtaggaagatggtttgtatagaagaggaaccgaagaatgagagtgac

SEQ ID NO: 18145 - DNA, 60 bp, Artificial Sequence
  Description of Artificial Sequence: Synthetic probe
cgttgggcggattaactaggttgcgtgtgcaggggaaaataccatctctgatacaaaatg

SEQ ID NO: 18146 - DNA, 60 bp, Artificial Sequence
  Description of Artificial Sequence: Synthetic probe
gtgagaaagacaaagcatgcgatcatacgcgcgtttccatgtggaataatctaacgaggc

SEQ ID NO: 18147 - DNA, 60 bp, Artificial Sequence
  Description of Artificial Sequence: Synthetic probe
cacaagacgaatagtggaggggaattctattcaccgaacgagtggcttaactggatgatc

SEQ ID NO: 18148 - DNA, 60 bp, Artificial Sequence
  Description of Artificial Sequence: Synthetic probe
gccgatacgtgatgccttgaaacacctaccacagagaaatgatggtcacgtcttgacccg

SEQ ID NO: 18149 - DNA, 60 bp, Artificial Sequence
  Description of Artificial Sequence: Synthetic probe
gtttcgtgatggatgagctagcgatcccaattataaatggacacttcccaaaagagacgt

SEQ ID NO: 18150 - DNA, 60 bp, Artificial Sequence
  Description of Artificial Sequence: Synthetic probe
gagaggacccctacatttccagcgacgcgcgatattgggcgcactcaaattcggagtgaa

SEQ ID NO: 18151 - DNA, 60 bp, Artificial Sequence
  Description of Artificial Sequence: Synthetic probe
actctgaatgaagcgtataaggagtttttgaacttatctatcggtagcgcttatacgtca

SEQ ID NO: 18152 - DNA, 60 bp, Artificial Sequence
  Description of Artificial Sequence: Synthetic probe
taaacgcgttaagcggaatagacctttcgcacttgcgaaccccgaagatagaaccaacga

SEQ ID NO: 18153 - DNA, 60 bp, Artificial Sequence
  Description of Artificial Sequence: Synthetic probe
ataaacgcgttaagcggaatagacctttcgcacttgcgaaccccgaagatagaaccaacg

SEQ ID NO: 18154 - DNA, 60 bp, Artificial Sequence
  Description of Artificial Sequence: Synthetic probe
aaaagtttggcgatgagttggaggaaatatatcagtttatgaacggcgaggtgaaagagg

SEQ ID NO: 18155 - DNA, 60 bp, Artificial Sequence
  Description of Artificial Sequence: Synthetic probe
atgtactaggagcaggagatgagattccggacccgttgagtccgggagagcgcggcattc

SEQ ID NO: 18156 - DNA, 60 bp, Artificial Sequence
  Description of Artificial Sequence: Synthetic probe
tttgctgagagtgagatcggatcagccgcaatcgatgggctagttcaaggcagtgtgcac

SEQ ID NO: 18157 - DNA, 60 bp, Artificial Sequence
  Description of Artificial Sequence: Synthetic probe
taagccgttttggcaaaaaagtaggcaacgctttaacctcaaatacagcgaaaaagattt

SEQ ID NO: 18158 - DNA, 60 bp, Artificial Sequence
  Description of Artificial Sequence: Synthetic probe
tgcaagaggaggcgatacaggagatcgcggggatgaccgcagatgtgttagaggcggcat

SEQ ID NO: 18159 - DNA, 60 bp, Artificial Sequence
  Description of Artificial Sequence: Synthetic probe
attagaatgcctggacacgtttttgggaatgatgagcttatgacgaaattactcaatatt

SEQ ID NO: 18160 - DNA, 60 bp, Artificial Sequence
  Description of Artificial Sequence: Synthetic probe
gtgctcaagatacacctcgcttcactatgcgcgggattagctgattcgattgtctacact

SEQ ID NO: 18161 - DNA, 60 bp, Artificial Sequence
  Description of Artificial Sequence: Synthetic probe
agtaggtagagtggcgccccgaggtctgtatcgtgtagagtggttgatctcacgatgcag

SEQ ID NO: 18162 - DNA, 60 bp, Artificial Sequence
  Description of Artificial Sequence: Synthetic probe
agtaggtagagtggcgccccaaggtctgtatcgtgtagagtggttgatctcacgatgcag

SEQ ID NO: 18163 - DNA, 60 bp, Artificial Sequence
  Description of Artificial Sequence: Synthetic probe
agtaggtggagtggcgccccgaggtctgtatcgtgtagagtggttgatctcacgatgcag

SEQ ID NO: 18164 - DNA, 60 bp, Artificial Sequence
  Description of Artificial Sequence: Synthetic probe
tccgaggagttaaaacagaggcagattcaaattaatttagttgattggacagaaagtgag

SEQ ID NO: 18165 - DNA, 60 bp, Artificial Sequence
  Description of Artificial Sequence: Synthetic probe
tgttaaatttccgtagccatggctgctcaggcgcaaggggacattcaaaacgaccttgtg

SEQ ID NO: 18166 - DNA, 58 bp, Artificial Sequence
  Description of Artificial Sequence: Synthetic probe
aaaagaagaactattagatacacgagtacgggaggagatgtgaaaacggagttcctgc

SEQ ID NO: 18167 - DNA, 60 bp, Artificial Sequence
  Description of Artificial Sequence: Synthetic probe
tggctgcgaagcttcaaaaaagaagaactattagatacacgagtacgggaggagatgtga

SEQ ID NO: 18168 - DNA, 60 bp, Artificial Sequence
  Description of Artificial Sequence: Synthetic probe
gactaaagatgccagatgtgatagacgcatacacactgcagtgggatctggatcaagcgc

SEQ ID NO: 18169 - DNA, 54 bp, Artificial Sequence
  Description of Artificial Sequence: Synthetic probe
gaacgcaaagagggagacaaagcagaggaattaaaagatggtgagggacgcaat

SEQ ID NO: 18170 - DNA, 60 bp, Artificial Sequence
  Description of Artificial Sequence: Synthetic probe
gtggatagacgcgtacatactgcagtgggacctggatcaagcgcaaaaggacctggagaa

SEQ ID NO: 18171 - DNA, 60 bp, Artificial Sequence
  Description of Artificial Sequence: Synthetic probe
caccctttcaagtgatatgagtgtggctttcaagataaatgggaccaaaacggaagtgcc

SEQ ID NO: 18172 - DNA, 60 bp, Artificial Sequence
  Description of Artificial Sequence: Synthetic probe
gttaaaaagtagccaccaaacatcgcatgatggggaagatcattaaatcgctggggaagt

SEQ ID NO: 18173 - DNA, 60 bp, Artificial Sequence
  Description of Artificial Sequence: Synthetic probe
acgggacgataccggattggaacaaccttggaagctttttggatattattctaaaaggac

SEQ ID NO: 18174 - DNA, 60 bp, Artificial Sequence
  Description of Artificial Sequence: Synthetic probe
gttcgcgagggattggattacccggataggtgggaatggctcattgattacatggataga

SEQ ID NO: 18175 - DNA, 60 bp, Artificial Sequence
  Description of Artificial Sequence: Synthetic probe
ctgcctatgattattgttcgcgagggattggattacccggataggtgggaatggctcatt

SEQ ID NO: 18176 - DNA, 54 bp, Artificial Sequence
  Description of Artificial Sequence: Synthetic probe
ttttctcaaccatatgaagaggacgttgaagggaagatgaagcggtgcggggtg

SEQ ID NO: 18177 - DNA, 60 bp, Artificial Sequence
  Description of Artificial Sequence: Synthetic probe
tggctccaatgcttcaaaagtttttctcaaccatatgaagaggacgttgaagggaagatg

SEQ ID NO: 18178 - DNA, 60 bp, Artificial Sequence
  Description of Artificial Sequence: Synthetic probe
caatgggatgtgtgttaaacaaaactttgagagagcaatgatcgcggcaactgacgcgga

SEQ ID NO: 18179 - DNA, 60 bp, Artificial Sequence
  Description of Artificial Sequence: Synthetic probe
gctatttcaccacaatggacttgcagtcatttaaaaaggaattgcttattcaatgggatg

SEQ ID NO: 18180 - DNA, 50 bp, Artificial Sequence
  Description of Artificial Sequence: Synthetic probe
gctcttcctaaaaaacgcgtgacagcggtgatcccggggcttacacttac

SEQ ID NO: 18181 - DNA, 54 bp, Artificial Sequence
  Description of Artificial Sequence: Synthetic probe
tcccgctcttcctaaaaaacgcgtgacagcggtgatcccggggcttacacttac

SEQ ID NO: 18182 - DNA, 60 bp, Artificial Sequence
  Description of Artificial Sequence: Synthetic probe
tggcatgcgttaggcgcagctcaagaagcaaagggacgcacactgaacgaggcgtacaga

SEQ ID NO: 18183 - DNA, 60 bp, Artificial Sequence
  Description of Artificial Sequence: Synthetic probe
gcgcactggcatgcgttaggcgcagctcaagaagcaaagggacgtacactaaatgaggcg

SEQ ID NO: 18184 - DNA, 60 bp, Artificial Sequence
  Description of Artificial Sequence: Synthetic probe
gcgcactggcatgcgttaggcgcagctcaagaagcaaagggacgtacactgaatgaggcg

SEQ ID NO: 18185 - DNA, 60 bp, Artificial Sequence
  Description of Artificial Sequence: Synthetic probe
tgcgcactggcatgcgttaggcgcagctcaagaagcaaagggacgtacactgaatgaggc

SEQ ID NO: 18186 - DNA, 60 bp, Artificial Sequence
  Description of Artificial Sequence: Synthetic probe
ctcgctgcgcactggcatgcgttaggcgcagctcaagaagcaaagggacgtacactaaat

SEQ ID NO: 18187 - DNA, 60 bp, Artificial Sequence
  Description of Artificial Sequence: Synthetic probe
gttaaaaagttcctcaagatcgcggaagatggggaagatcataaaatcacttagccgttt

SEQ ID NO: 18188 - DNA, 60 bp, Artificial Sequence
  Description of Artificial Sequence: Synthetic probe
cgcgcaagcacgtgttgggcgttatctcaatcagcgttagccaagacggtaagttaaaag

SEQ ID NO: 18189 - DNA, 57 bp, Artificial Sequence
  Description of Artificial Sequence: Synthetic probe
tgttctgatagtggttggtgatgacaaacttgaaccacagatccgcgcggaacaggt

SEQ ID NO: 18190 - DNA, 60 bp, Artificial Sequence
  Description of Artificial Sequence: Synthetic probe
ggatgtcacaaggtggagtgaatatatcagtggtcactactaagttggatgtgctcaaga

SEQ ID NO: 18191 - DNA, 60 bp, Artificial Sequence
  Description of Artificial Sequence: Synthetic probe
gctgacgacgtacataaggagtttggtacaatatgctacgaatattacatgaatactagg

SEQ ID NO: 18192 - DNA, 60 bp, Artificial Sequence
  Description of Artificial Sequence: Synthetic probe
tcacgcggttccacccaggcgattccaggaagaagcagattgctgacgacgtacataagg

SEQ ID NO: 18193 - DNA, 60 bp, Artificial Sequence
  Description of Artificial Sequence: Synthetic probe
ggctatacctatggtactctttgacgaaaccatcaaactaattcctgttgaagttggcgc

SEQ ID NO: 18194 - DNA, 60 bp, Artificial Sequence
  Description of Artificial Sequence: Synthetic probe
cccctgttgtttcttgtccaagataatatttcatattggcatagacagtgggctatacct

SEQ ID NO: 18195 - DNA, 60 bp, Artificial Sequence
  Description of Artificial Sequence: Synthetic probe
gtagggtctcagcggttgggagtattgagtagtgcattcccaaatctcgctaatcggttg

SEQ ID NO: 18196 - DNA, 60 bp, Artificial Sequence
  Description of Artificial Sequence: Synthetic probe
cctaaggaggcgagacgaatcttgtatttggtccagaataatgtagggtctcagcggttg

SEQ ID NO: 18197 - DNA, 60 bp, Artificial Sequence
  Description of Artificial Sequence: Synthetic probe
atctctcgcagttaatatgtttcgtgtttgattatatttttgagaaacgcgcacagttac

SEQ ID NO: 18198 - DNA, 60 bp, Artificial Sequence
  Description of Artificial Sequence: Synthetic probe
ttcatgaaggattagaacatcaaacttatacgcatccttctgacggaatggattatagaa

SEQ ID NO: 18199 - DNA, 60 bp, Artificial Sequence
  Description of Artificial Sequence: Synthetic probe
taaaaccgctttgatgctgatggctaattacgaaaaattaagcccggagcttcatgaagg

SEQ ID NO: 18200 - DNA, 60 bp, Artificial Sequence
  Description of Artificial Sequence: Synthetic probe
tgtccgcatgctggagggtcgatttatactttccgtaaaaccgctttgatgctgatggct

SEQ ID NO: 18201 - DNA, 60 bp, Artificial Sequence
  Description of Artificial Sequence: Synthetic probe
gcggctgcaattttatggtgatacattgagtcaggggcaacgtcaatcttctgtctttgc

SEQ ID NO: 18202 - DNA, 60 bp, Artificial Sequence
  Description of Artificial Sequence: Synthetic probe
caaaactacgactgagtcgttggactacatgctagggagatactatgatgtgcggctgca

SEQ ID NO: 18203 - DNA, 60 bp, Artificial Sequence
  Description of Artificial Sequence: Synthetic probe
gcgtcgcgtaagactgacgacccgtggaacaaccgagtcgtgtttggatacatcaaaact

(The sequence listing continues in the following parts.)

What is claimed is:

1. A kit for determining the presence or absence of at least two porcine pathogens in a sample, said pathogens selected from the group consisting of Foot-and-Mouth Disease Virus (FMDV), Porcine Respiratory Reproductive Syndrome Virus (PRRS), Swine Vesicular Disease Virus (SVD), Vesicular Exaanthema of Swine Virus (VESV), and Vesicular Stomatitis Virus (VSV), said kit comprising nucleic acid reagents for detection of at least one nucleic acid signature sequence from each of the at least two pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

2. The kit of claim 1, wherein the kit is for determining the presence or absence of FMDV, PRRS, SVD, VESV, and VSV in a sample, said kit comprising nucleic acid reagents for detection of SEQ ID NO:129, SEQ ID NO:133, SEQ ID NO:137, SEQ ID NO:141, SEQ ID NO:145, SEQ ID NO:149, SEQ ID NO:153, SEQ ID NO:157, SEQ ID NO:161, SEQ ID NO:165, SEQ ID NO:169, SEQ ID NO:173, SEQ ID NO:177, SEQ ID NO:181, SEQ ID NO:185, SEQ ID NO:189, SEQ ID NO: 193, SEQ ID NO: 197, and SEQ ID NO: 201.

3. The kit of claim 1, wherein said reagents comprise a set of oligonucleotides for each signature sequence to be detected, said set comprising PCR primers and hybridization probes for each signature sequence.

4. The kit of claim 1, wherein said reagents comprise at least two sets of oligonucleotides selected from the group consisting of set 1, set 2, set 3, set 4, set 5, set 6, set 7, set 8, set 9, set 10, set 11, set 12, set 13, set 14, set 15, set 16, set 17, set 18, and set 19, wherein set 1 comprises SEQ ID NOs: 126, 127, and 128, wherein set 2 comprises SEQ ID NOs: 130, 131, and 132, wherein set 3 comprises SEQ ID NOs: 134, 135, and 136, wherein set 4 comprises SEQ ID NOs: 138, 139, and 140, wherein set 5 comprises SEQ ID NOs: 142, 143, and 144, wherein set 6 comprises SEQ ID NOs: 146, 147, and 148, wherein set 7 comprises SEQ ID NOs: 150, 151, and 152, wherein set 8 comprises SEQ ID NOs: 154, 155, and 156, wherein set 9 comprises SEQ ID NOs: 158, 159, and 160, wherein set 10 comprises SEQ ID NOs: 162, 163, and 164, wherein set 11 comprises SEQ ID NOs: 166, 167, and 168, wherein set 12 comprises SEQ ID NOs: 170, 171, and 172, wherein set 13 comprises SEQ ID NOs: 174, 175, and 176, wherein set 14 comprises SEQ ID NOs: 178, 179, and 180, wherein set 15 comprises SEQ ID NOs: 182, 183, and 184, wherein set 16 comprises SEQ ID NOs: 186, 187, and 188, wherein set 17 comprises SEQ ID NOs: 190, 191, and 192, wherein set 18 comprises SEQ ID NOs: 194, 195, and 196, and wherein set 19 comprises SEQ ID NOs: 198, 199, and 200.

5. The kit of claim 2, wherein said reagents comprise set 1, set 2, set 3, set 4, set 5, set 6, set 7, set 8, set 9, set 10, set 11, set 12, set 13, set 14, set 15, set 16, set 17, set 18, and set 19, wherein set 1 comprises SEQ ID NOs: 126, 127, and 128, wherein set 2 comprises SEQ ID NOs: 130, 131, and 132, wherein set 3 comprises SEQ ID NOs: 134, 135, and 136, wherein set 4 comprises SEQ ID NOs: 138, 139, and 140, wherein set 5 comprises SEQ ID NOs: 142, 143, and 144, wherein set 6 comprises SEQ ID NOs: 146, 147, and 148, wherein set 7 comprises SEQ ID NOs: 150, 151, and 152, wherein set 8 comprises SEQ ID NOs: 154, 155, and 156, wherein set 9 comprises SEQ ID NOs: 158, 159, and 160, wherein set 10 comprises SEQ ID NOs: 162, 163, and 164, wherein set 11 comprises SEQ ID NOs: 166, 167, and 168, wherein set 12 comprises SEQ ID NOs: 170, 171, and 172, wherein set 13 comprises SEQ ID NOs: 174, 175, and 176, wherein set 14 comprises SEQ ID NOs: 178, 179, and 180, wherein set 15 comprises SEQ ID NOs: 182, 183, and 184, wherein set 16 comprises SEQ ID NOs: 186, 187, and 188, wherein set 17 comprises SEQ ID NOs: 190, 191, and 192, wherein set 18 comprises SEQ ID NOs: 194, 195, and 196, and wherein set 19 comprises SEQ ID NOs: 198, 199, and 200.

6. The kit of claim 5, further comprising reagents for detection of one or more control sequences.

7. A method for determining the presence or absence of at least two pathogens selected from the group consisting of FMDV, PRRS, SVD, VESV, and VSV in a sample, said method comprising the steps of using the kit of claim 1.

8. A method for determining the presence or absence of FMDV, PRRS, SVD, VESV, and VSV in a sample, said method comprising the steps of using the kit of claim 2.

9. The kit of claim 1, wherein the kit comprises nucleic acid reagents for detection of at least one nucleic acid signature sequence from each of at least three pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

10. The kit of claim 1, wherein the kit comprises nucleic acid reagents for detection of at least one nucleic acid signature sequence from each of at least four pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

11. The kit of claim 1, wherein the kit comprises nucleic acid reagents for detection of at least one nucleic acid signature sequence from each of the pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

12. The kit of claim 1, wherein the kit comprises nucleic acid reagents for detection of at least two nucleic acid signature sequences from each of at least two pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

13. The kit of claim 1, wherein the kit comprises nucleic acid reagents for detection of at least two nucleic acid signature sequences from each of at least three pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

14. The kit of claim 1, wherein the kit comprises nucleic acid reagents for detection of at least two nucleic acid signature sequences from each of at least four pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

15. The kit of claim 1, wherein the kit comprises nucleic acid reagents for detection of at least two nucleic acid signature sequences from each of the pathogens, wherein the following nucleic acid signature sequences are detected: for pathogen FMDV, signature sequences consisting of SEQ ID NO:129 or SEQ ID NO:133; for pathogen PRRS, signature sequences consisting of SEQ ID NO:137 or SEQ ID NO:141 or SEQ ID NO:145 or SEQ ID NO:149 or SEQ ID NO:153; for pathogen SVD, signature sequences consisting of SEQ ID NO:157 or SEQ ID NO:161 or SEQ ID NO:165; for pathogen VESV, signature sequences consisting of SEQ ID NO:169 or SEQ ID NO:173 or SEQ ID NO:177; and for pathogen VSV, signature sequences consisting of SEQ ID NO:181 or SEQ ID NO:185 or SEQ ID NO:189 or SEQ ID NO: 193 or SEQ ID NO:197 or SEQ ID NO:201.

16. The kit of claim 1, wherein said oligonucleotide probes are affixed to a solid support.

17. The method of claim 7, wherein said method comprises hybridization of each oligonucleotide to the sample.

18. The method of claim 7, wherein said method comprises amplification of at least one nucleic acid signature sequence from each of the at least two pathogens.

* * * * *